United States Patent 9,487,797 (GENOMIC PLANT SEQUENCES AND USES THEREOF) - sequence listing, part 104

SEQ ID NO: 93800 - DNA, 931 bp, Oryza sativa
aacaggcccttaatatctacagccgatcgagtagatttagtcccttcttacttattaatgactgccgattgatgcatatatgacatcggctcaaagataaatgatatgtcatcagcatctagccgatcggctatcgtttatggatttaaccgcggtttctttgtctttgattcttgatgattgcaggatcaaatcaactggcacgctagcatacccaaaggcgagttttggacctgcactgcagttaagtagatctctcaggcctcgtgttttcacatcaacagttgccccatatggaggtcactatggagcattcaggcacacgcaaagatctggcagagtggattcttttggccatcaatgtatgatgacacaaaggaatttgttcggatatgtacaagttgccagaagcatggagggatccctgctcgcgatgcaatgccactgacaaacaatcttcaagtcgagctatttgatgtatggggaatcgacttcatgggacctttcccaaagtcctatgcctgcgagtatagcctagtggccgttgactatgtgtccaagtgggtagaggcaatgccatgcagggccgtaaacgccaagcacgcccgccggatgttccatgagattatcttccctcgttttggaactccgcggatggcgataaatgacggagggtctcatttcatcgataagaccttccgaaaatttttgcaagaacttggggcttaaaacaacattgccactccatatcattcccagacaagcggattggcttaaacgaccaacaaacaaatcaagaacattctacaaaagactgttaatgagatggggaaagcatggaagaacaagctacctgatgcactttgagcatataggactggttattaaacgcccatatggctgttaccattccaacttgtttacaggaaaa

SEQ ID NO: 93801 - DNA, 689 bp, Oryza sativa
tgtcattttagttcatggtaacatatgatcacatccatagtaatagaagtatgcaccaagtgtaacatcactggaattaattgcaaagaattggtatcaaagaagaagccattgaacatacccatctgatagttattctctcttcagcagcccgcttcagttctaccggtcggcgagcagagagaatttccacaagcagtatgccaaaggagaagacgtcgctcttaggagtcaactggtatgttctcagatactcaggatcaaggtagccagcggttccttttacttttgttgagatgtgtgtcttttctgtgtcactggggccacttcttgcaaatccaaagtcagacaccttggcccggtagctctctgtcagcaggatgtttgatgacttcacatcccgatgaattattgtcttctctgttcacatcggagaaattatcagatagcaatacagtattattaaaatcaaacttcatcaaaataaaaagtgtgaatttcataaaaccgcagcaatagcaaatgatttcatcaatatgaaattttctcccttatgtgtgtatggcatgtgggcccgatttgcataaagcatgtgtacgtcatgtgtatgataggtggggccaaaattgtagagatataaagttacagctttttgataaaatcgtatgctattgttgcagttctctgaa

SEQ ID NO: 93802 - DNA, 1540 bp, Oryza sativa
tttgcaacagaggcccgaagaccggtccttatatggccgaggtgctactatcaaaaccatgcaccccgagcccagcctaaaacccttttgaggattttgaatagagagggaggtgtgaatccaattccacaataatccaaccatttcacagtgtccaggtgatgagaatattcccaaagtctagagttgtaaaaccacctaatgttgcctaattaaccagcgaagcatctacctaaattcatactagtggtaccaggcatagggtacccactagttgggggttttgtttgttctagggtgaacaaggtaataataacaatagcaataataaggtcatataaagataaataggcatggctaaataaaacagtgataacgcgggaatttaaataaagcgataatgcattaatttaaatcaaaataattttataaactgggattcaatatgttcaaggatgatgtgacttgccttgctcgctttcccaaatgtcggcttcaacctccactaagagcggatcttccgaagctgcagcgtctacacgaccaacggaaaagaaaaaggcttttactctaataaactccatataacaagcaggaacaaagcataaaaatgggttcttgacttcttaaggaaaaattagagacttgaacggtccaattccgagttcaaatggccaagttatggccatttgaagtttatatgctctttaaatagatatttgcgaatttctttatttaaattttaatttaaaaagggttcagccgaggggagagggcgcgcagaccgggtccacgggagtggggcccacgcggcaacctcacggtccacggtggaccaggtgcacccgggctcacaccggccggcgccgtgggtcccacgcgtcagccgcacccgagggcatgggcggctgacggccggaccccacgcggcagccactcggcgggaggcggcgcgcccacgccccgatggtcgccgccggcgaccaccggtgcggcgaagcggcggccgagagaggggagggaagggggaaaggaggcgacggtccacggctcaccccggggcgatggcggcgacggaggaggcggccggagcggagggaggcggtggcgcggcttgggtcgacggggacagcggcgctccggcggtcggcgaccgaaacggagaagtggacgaggtcggcgaggatgcggcgaaaccgaaggaggcggcgccgaggtgggaggcggtcccgggcgacgacggtcggcggaccggagctcagcggcgacggccgagagagagagcgacgtcgcgagctcgaatccggcaaggagaaaggcgggcgagaggcggaaacggacggaggaagcgcggggagggtttaaatagggccggggcgagagagggcggccggaaaagaaaggaaaccggcgcggcgttctcgggctccatcaatggcgccggcgggattaggagaggggtttccaaacgaatccaagggagagagggagggaaattttgggggaaagggagagggaatcacggggagcaattcccccc

SEQ ID NO: 93803 - DNA, 698 bp, Oryza sativa
gttcttgctggtctagtggaagtatcattggtacatgtgtcccgtcaatagagccaacacaattctatacaaatacaaatatacccttgattaagtctttttatgtacaatgattggtttaactcaaagtaaaaaaaaaatcaaaacatgaatctgttcatacctcaaaaaaggggtgaaattttggtcttctcaagatatgatgggggtgtaggaaaggtggccgtatatatacacatgtaagttgtgtaactgcatcaagcacaaccccaaaatacttgcttattgtttgcccgctgtgttgaaactgatcttgcaaggtctcattacttgcattttttgctagtgcatacaagaatatagcaacttgttcttctactgagacatctcttgcatcagcaagtagttgtttctcacgcaacttatcgactaaagctcgaaaaacattaacttccatgcgaaaattccttttgcttaggctctgatgacctgttaagatttcattaacacgacaagcccctgaaagttttgatgtgtgcatcggtttcctactagatgatggttgtgacgaatctccttcgatggtagggagaacaaaaagcatgaactcatcttcattctgtgaccgtcgtcgataacttggatccatgacaatcacaggggaaatccacaacaaataataaatctgatggtttggt

SEQ ID NO: 93804 - DNA, 597 bp, Oryza sativa
atcgagcccaacgacgtacttgaggacctccccacttggtgaagtcagagtgactccggcccctgcacctttaaggttgagggagccgccaaaatgcataacccagtgcccagcacgaatgtcggcgtttgggtcctctccatctccggagagggagggaacgttggacggaacagggtcctccactggggtccactcccccatgaagtgagacaggacctggcttttgatcgcctgccatggttcgaaatgcaagtcgtactcaacaagctcgatggaccactttacgaccccgccagtaccctctcggttgtgcaagatttggccgctagggtaggacgtcactacggaaacccgatgtgcttggaagtagaggcgcaatttccttgtggccattaagactgcgtaaagcatcttctgggcctatgggtattggggattcacattccggagtgcctcggttacaaagtagacgggccgttgcacctttcagaggggacggtccttgttgtcaggggcaagagaccccgtgtgcccttgctcatatgccccacggggggctcgggtcatgtcaagactatatgcctctggaccacc

SEQ ID NO: 93805 - DNA, 508 bp, Oryza sativa
actatgctgtgcaacatgctttgaccaaccaataaggagtgcttgttaacactttagacaaatatgattaagtttgtggttggtggtaccataactgtgcattaaaacacggggccagacttcataccaaatggagtgtttccacagtacaagaatatggtgatagggaaccaacagcataacgtctatgcaccatcggtgcagacgatggcagcagtttcaggtctagtaacaagtgcaccgtggttgggacaaaggcaagtggataattcttatgttttgaccagagagcaaccacaacatgttggacacaacatcaattgtgtgactcaagagcagattgccgcaatgtttgcgccaactcaaccgactgtttagacattacattgtgtaccaatgaggacccacgttatccatgcgattaaggagtggacggtgcaacacatatctacacgacagaaaacacctatttgtcagaaaatgcatctgttggagaccagtttgtgcc

SEQ ID NO: 93806 - DNA, 5167 bp, Oryza sativa
ccacgtcaatgccacgtgggacgaaaaccaagtcaacactgccacatgtgcgccacgtcagcgaaaccgtcctccaaaaccaccaaggaagtcaaattgtaccggttttgatagttgaggggtcaagatttctggtattgctgttgagggatacgatttagattcggtggtcagttgagggagtcaaagtgatcttattccctatggaaaatcaggggaaggagcaaatgcctatgtcagcccacttgctctacatgtacacgttcaatagtcattagtatcggaaactctagggcttgtttggtttgataccaatttattaccctaccaaaattttgataatttcaatagtagcaagtgtatgtttggtttgctaccaaattttactcacaatagttcaaattgaatactacacaatttggtagtgccaaaatttgccaatgttttggcattaccaagattttggtagggcaaaaattggctccaaaccaaactagcccctaatgcacgatggatcgctaccgcgatcgggtagcgatcgcccaccctcccccctccctccctccacgtttccttttttggcaccgcattactttcctattttagtaaatttatacacctaaagtttatagacccaaagtttataaatcaaaagtttatatacccgattcaaatttgaatttgaaatatattcgattcaaatttgaatttgaattcaaatattttttatatatagtatttagtttcatctaaagtttatacacctaaagtttatagtcccaaagtttataagtcaaaagtttacatactcaattcaaatttgaatttgaatttgaattatatccgattcaaatttgaatttgaatttaaatatttttatatatagtatttctatacatctaaagtttatacacctaaagtttatagacccaaagtttataagtcaaaagtttacatacccgattcaaatttgaatttgaattcaaatattagtttatagacccaaagtttataagtcaaaaatttacataaccgtttcaaatatgaatttaaatttaaatatttatgatgtagtaggaagagaaaaaggaaagaaggaaggggggagaggagggagcgaccatacaagggaggagcgatcacccgcgcattaggcgtaccccattagtattctatagtacatttacaaaaaaaaatgttgaatgcatatacaactactcatattcatacatatctctatgagtattttttaaaatattaaactgcatatcttaaaataaaaaaaaatattttatttcttcaactaattcaatggacaccattaaaaaaaatctaatttttgactcggttcactttacttcgtaatagcatttctcattttttgttactctttatataagttgtattttaaactgaaccatacatgggattattatcaaagtttgttacggatgtttgcttgaactttaaattttgatgtttaaattagtcttaagtgctttcaacctacataaacaatgagaaaaaaaagaaatgttgaaatgtatgttgtaaatgcatgcaaaaatatgacttatatagagatttttttttaaaaaagggagagaaataacattaaaggagtaaaatgaaccgttttcaataattcgggatgtaaaatgagaaaaaaagtttagaaggtgaagtgctttggtgaaatagtataggggtaaaatagattttctcttaaaattaatgaaatcaccatatataactcattgtcaacatatatatcacctaccactaattagctgtcaatacaaattcctatactaagtatatgacttaaacccaacaaaacattatgactcctaacaaaacaaaattctagaacactttaattttttaaaaaagaaataccaacaccctattttattattagcaaacaatttaattataattttagacaaacaaaagaagaattaataatagcaatttaattataattttagacaaacaaaagaagaattaatagtacggacggaaaaaagagagaaagtttgacggatttctctacaatatgatcgattatgttaaactggaacacaaaaaattctattcaattatgatttttgcatgagtttcaaggaaaactaaattgatttctatattttttttatgaaaaatgcgctgattaataacacaaaaatattatatacaggtaataaatcgagcgcgccctaattttctagtctaatcttctaaagctggcaggcgttcctgcaagctgattggtcgattcgtcccccttactttggttgacacgtgtcctcgagcccgtcacgagttcgcgcgacgccctcctcgatgcttcatttttccgtgcgtacacactcgtgcaatcgtgcgcctcaggctccccgttgggccgtgcaactagcgtgggcctgatctgcctcgagatactacatgggagccaggtgctgtggcgtaagcaataataaaagcatataaaaagatttatactggaccatgttctaaaaagtacaaaacaatattctatagtgcagtcgtgtaatatatatttttatatggaaattgaactattttcaaggaaattttcaacatgatcatagataaaattagtttatggacgatgaccatctatcatacgcaacgctaagatcaggaaatagtgcaacggtatactagatcattaaatagagtgatggtatgttcaaaattatttggtggtgagcaaggcaacgtagttcagatggacagagccatctacatatatatatagagagagaatttcactaagacagacgaggaagcagacttgaaaaaagaaagaaaaaacaaaacaaaaataagatttaaaaatcattcatcggtattagacaactagcatcgacccagtattttctccccgtcaatcctccatgatccaaacaaatcacttttcgcccatgaaccgtttgtgccaatggattggtttgatcaaaaacttcaccaacattataaatttaaaacccattaaacaataagcacgggttataaaatgaatatactcgaaggtgagtgagagaccgtttccagcgaggtagatgaagtaggagacaaatcgaagtaacgcgagcagactattaatgcgaggaagatggtttctcatgaaattttgttccatgtgcgagtctcgaggagccgggaagcatgggaggcgcgcgggaggtggggagccggcgggtcggtcgccattctggcagcgccggcagatgagaacgctggggagtcaggagcgataacgacgcagtataatcggaatgggcctaggcagtggcttgggcttacccatgtatattgggctgtggttaacggtagggaagagagggactgcaatctgaaccattgctatttcgctgtggtaatttaaggtgacgtggctgcacgacaatacaggaaatttctattagtggggatgaattatataggtatataggataagagaagattcgaacgacggaaaaaaaacaaagagaaaaatgctgtgacttcagataaaatggttactgatcacgtgtatccaatatttcatcccaaggaacaagtacttgttcccttgttcccttgtatcaattctgattgaaaactagtttcacgcttatgcatccaacagaccaaagctacaaggtacttcgtgttggggaatacgcaagctttagctccatcagtacatcagaatttttcccttgaaaaaagtggagtacatcagaatctcaacactggaaatacctccggtagagataagagatcatatggagcatatcccgcagagacaatcctgctgccaaaaggccggccatggagtgaatgagcagccatgaatgaagcctccttgcacaagaactctacaagtatacagccagcttcgagtgcagtgttgttagaagccaaagcgttgtctctagcatctactgcaggtgccttggtgttgtcactgccagcaggatactctacgacatttatggatttcacagctccatacctgcaaaatcttgtccataatgtaagctgaaaccatcatgataagtaatacagcaagaatgcaagagaattatttctataccttgcacacttcacacgtacatcttccaatactgcatctacctcatattttgaaagcagcgagtattcctcctggtcaaactacatttattgcaagtttgtaaacaactcacatctttataaatgtaagaagtgtgaaaaaaattggttgttctgtttaccgactaaatgattttgatacgaagagagatatctattgggagagacttatgaacagagttaacactatgacataccacattttttagctgcaggacttgtgttggtactgcaagaagaggtttgggattggcaggaattccatgaaatgggcaagcttcattgccagcctgaacagagtggggtttaactcaataaaatgtataaggcagtaaatgaatgaatccaaaatgtcttaaagtttgaacctgcccaggatgatcagttaacacgccaacagcagttattacgcatccaccaagcttcatgccgttaaggccagcacatgcctttgatgtaatggagtgatcaatgtactgtgcatatcaaattgatcagaaattagtttgttggaggtatatccatatgctctagtttaggagtaagcagggctttccagacctcaagaaatgcgcatgctccaccaaggtcttcattaaaaagaaagcggtaagcagccaattgaccaaatgaactaactatatccctgagctgaaagaggaaaatgcagtaacttgtcagggataagagctttaataacaacatgcagagcgaagattactaggttatgcaaatatactggtggatgctgttatattaccatcttagatgaaatcactctaggaattccagcgatgaaaatctgcagagttaaaaagtgagatatccaatgaaagctactaaaattcttaaacaatcaaacccatatgtattccattagttcaaagacaaattttgctacatgacacttaaaatttgtgcaagttgttggtaggcatcgcaaacacatgtcgtagctgaaagacgctatagattattattggtaactagctagaggacactttcagcttaattggagaga

SEQ ID NO: 93807 - DNA, 2023 bp, Oryza sativa
cccatggccccatgtacattgccagcatatatacatcatattccatctttcactgcattcctaggttagaagcttttgtccctaggggtattctcgtctttttgaagaatttctctctccaattgagccaaaagtgtcctctagcaaattaccagctttttagagtgtctttcaaccgtgacacattttttgcgatgtctactaccaaattacacaagatttgagttcaaaataacagtaggcatatgatatgcatgtatcaaatatttaagccagaaaagcaagcatttctatctgtaaatattcttttaccaactctctctagaaatatagctatctttcatagagatgagaataaaacaactcagactgtggcaacttaccttgtgtggtgaatctctaacgacatcagatattaatttaatctcttcaactggcttcttagaatcagcatgctgcatgaaacaatatatataacacaagataaaataaaataagaaagattttacatgctatgatctgctgcaaagctgcaaaattcatgcaacagcaaaaataaaaaatgcaaaaggaattaagtatgctgaaaatatcagagtgatgttgaaaatcggacttaacccttaataatatttcttaccgacatgtctgaacttccaagaagatgccagatatcactgcatatggtaggatggttttgccgaacaatgtcgtcaacatttagctgcaaatatttatgttagaacttagtacagacaacctccatccatcccaaaacatagtgaactagtattcaattagacaccactacagattcatagtactaggtggtatctaatcgagtactaggtagcaatattttgggacggagggagtatttggctttcaacacatgcaaaatacatgtcaaaaaacattacctttattttattccagtgagcataagcaccacagacacagcgtacataatcttttaagcttctgaagtcatatgctggaattccttcatctttacgataggtttccatttcaaacaggagacctttaaagtcttgagttgttccttcattccaaggaagcttacggatttttgaagctctcactcttgacataaaagtgtcatcattcaacctaagtgatatatcctttgcaaagaagtttaccctcgtcatcaaatcccaaaaaagaggatgcccaagaacaatttctttaattgccggcaatgcagtcctgaaaattttgggaaaatgatgctctgcattagagcataaaatccaaatgctcaagtgatccgctacactatgttcaacggtataatgctacaatatcaaagtactgctacagtatagaacaattcaaaatccaaaggctcaagtgatctactacactatcaaagaagtactctgctacattataaaacaattcaaaacccaaaggctcaactgatctgctacagctacagtatcaaagtactagtgctacagtacaaaactgatctcagctaaagatgttgcattgtttttaacttacttatccagggttttcaatagagcagtcaaagattcaacatgtccgcagaaatatctatcacattgagcaagctttgagcttatttcagcagctctttctaaaatttcttcaagcattttaataaggcacaaccaatcggcccactgggcttcctccaagctcattgtctctgtaattcaaggagtaaatgtcacaaaatttaagaatgctacacagtgataaatagtacaaaacatgtaaaagtgagatcagtgatcagattgcaattacactatatatgttttaccttgttttctgaagttagcaagcttaacggtagacggttgaagatacaaaatcgaatcccaattgagattaccatgatacagtttgttcttcctcaagaagtcaagcccctcaatgacttgcctgagaaaagattcagcccaaaataaataactaaacaaataagatacatgcccagcagttatcattgcagacttgcggttataat

SEQ ID NO: 93808 - DNA, 902 bp, Oryza sativa
gctgagatgcccgatgtcagcgtcaaagaatcttggcacttcactttgtttctttggtggctgctgacattgcctatttcagcgccaactgatatggtgctgatgtttgttgtttcagcgccatttgtgttggcgctgaggatgcaaacactttgagccagcacagcaaactgctctctgcccaggaaaaatacatttaacaccgcatagcaacctatttcagcagcacaggaacacaacttttagaaaccatccatccattccagccattccatccatccagtctggggagccgttccaagcgccactcccgcgtcgttgacggtccgcaagagctcttgtgcctgtaaggttagaaagtgcaaaaagtcacaaaaattaaagcgagagcgtgcaaataacataacatggcaagtactcaccactctatcgcgaagaggtcctgtctcaaccgtggtaccttcacgggttcgagtgtcgtactcgttctgctcctccacatcttcagggtcgtccgctatgtcggctagcgtccaggccgggcgtaggacaagacgatagttcctatggagccacgccaagtatgcatcgaacttcgtcctgttgtgctgaccttggtccggtactccgttctcatcgaatttctcccattgcgtgatatgatcttgatggtagtaagtccaatcagtcaccttcttgttcttccgacgatcgaccctgcacatatgcaaaatagacaagtcaacaatttgaggatggcatcaaatcgatttggtctgttaactcaaagtacttacttgtggaggtcgatactagtggagaaacggtgcgggattgtttgaagcctcccgaactgccgcattatgcggttgcatagctggaactccactgcatagaagcaa

SEQ ID NO: 93809 - DNA, 10087 bp, Oryza sativa
atgaatatatgttaagtattataaagatgatggatacatatgcatacatacatacatgtatatgttaaaaatactatgaaaataatgtgaaggaagatgattggatgttgatttggagaattcaataaattatagatgatgttgcatgcttgcataagttttatatgtaattattgttagtggatgatgaagtggtatgtttgtatgttgaactttaggattagcgggttataactttatactaagatagaatatggagttataaaatttagaaaatgaattagaaatcaaacactagctatctaccagcagctacttaaaatcttattaagcttttcaaacagaccaagtatttttcttttttggcttcgtttctgaaccggagtctgggaatttttactagtaagatcatggtttaccacaatttatcttttttttttctgggaaggtcaaaaggaaatttaatgattgtattctgagctttcattttttttagcttacgtttttgagccgttaaccatacaaatataaaggtcatgtcccaaaaaaaatatttattgttttccctaaaaagagtatttcgtttggtttttctgtggcttatcaactgaagccacaatttagacatatgtatgcgcaacatatcatttagccatgcgcatacatgacaatgtatagagaattaatttgtgtctatgatgttgttcgaccgagctgaaatgtgtgagaatgtagggaaccttaagcataaaaaaaaagagagtagagaacctcgtacctgcgactttattcaatttttttcacggtctagcgtttggagccggaaattattctagcagttgcattagcaaaaacacttatcaaaatattactaacaggcagcgaagcaacacaaatacatcttagctagcaaagtagttgcattagcaaatttatttaccaaaataccgaacttatgtttaccaaacaaacaacatatgtttaccaaactttaaataacaccaaatctcctgtttaaaatttgcattagcaaaccatccgaacagatccgaaatgcacgttgacgaatgcgcgaaagcattaattgttcagaaacagcccctgaaggctgaagcttagtacggtgtgttgcgtccagttggaacttggaaccacctctttccaatcttgtccccgttcgtccggttatccggtgtagtgcgccagaagaagggaggaagggagagggagaattcgggggaccacattccaagttccaacggaggccggagaggatggtccatgtctgatgtctccatgatatccgtccgtccaacggagggacggccggatgggttcgccgtgtaacagagccgtacccgtccgtacacggtacatctactccaggccagtcgtgctgtaatagtagtatatactacctccgttcaattttagatgaatgtcctaggatacgttacgtccgtctaaaatctcttatattttagaacggagggagtaaataactagaaaaatatgcttgtgttatagtgaaaaaaaaattaaaattattgagcaatattaaaatctacttgtttagtgctaagcccttcgttcccttttctgtggggctcaaacagaagagaactcatttgaactacacatatatgaaccaccaatattactccaatgagaaaactcctgtgtaccccccgaaaattcacctaatcccttatatgcccttaagatttactcattctctttcatgcccctaaatttcagtttggatcctttctataccctttccgttagttgaccgttaaattcttatcataaagtccatttttccgcttgaaattgtgcatgaagggccgaagggtgaggtgggtggttcgacctcgaaggttggttcagcacgactgtcggccggaccagcgccatggttgcttgaggggctggacgcgtgaatatggtcagggtcggctgaaccaaatgaggtgaaacctaattgacttgggctgccgtggtcgaagcttgaatcacttgcgtcactgttgagggtcccgaagatggattgggcctcgccgaagccgaaggtgctgtcttggcttgcagggccgcctcataggcttgatgttgctcttgcatccggtgaagtgtgtcgtgcagccttatcatgttctggcgcatggcttccatctcggccctttgcgccgccggagcctcactctcggcaaccgcctgagttgtgcttgggatgatggaggccatcgcctgagtcgaagcttgagtatcaggacttggatggtcgaaggtgctgcttgagtccgagctagtttggccactgcttgctcctcgccaccttcaccttcttgtagctccgctcctgcttcggctcgtgcgggctcttcgcccgccatctccgcttcgccttcgctctccttcctcttaggtgcaactctctctctctctctctttgtgtgtgtgtgtgttttcttcggtgcatcagtggctccgccctgggttccctacggtcggcgctagctattgtcgaagcgacaatagcttcacattgaaggacgtgatttactcagtggagtgattgaacagtaaaacaatgtattaacttatgaaaatttgttgggatcccccattacatgcttctagtgggctatttataggctcagtacaaactcatgctctgtagggtttaatatgtttagagaaatttacatggatacctttataatatatataaactcatgcagtgtctattctaatgatgggcccctagatgggtcattggcctggcccataagaggggaatggtcttcatgggccatgctgcttggtgggctccctggtgaagcctgtcttccatggggcgaacccttcatgccttgcccagaggagagactaggtggtgagccttctcagcttggtagcgaaccctcttggcttcgtcttctggcttcacctcaaaacttcgcacgaggcaaatcttcttctgaacttggttggcgtcttgctgatttgatgatttcggtaggttcagctgaaaaccctcgtgacatgcctccggcacccatcttcctcgtgcaccacaatggtcaacgacctcctggatgctatgctgtctgtggcctctgtgttatgtcgggcacagtttcactgtcgcctgctgctgcagactagcagtgatcgatggaactactccactttttccttcgagctcaggcgttcggggccggggcaccctccgatggcatccagcatccctcaccaccacccgcgtcctccctcagccgcagccgtagccgcgctccggcggtctcgaccaccgccctggcgtcgtccttccgcgaggcaaaagacgagcttgatcaggaaacgaaaggcgtcgtcaggtggctgccaccaccatctgacccatcaggcccagtaacagtcggggcgcggtggcacagcagtggcaggcaagggaggcgatgctgtgctgcttgccggagctcctatcgcaagttcgtgttgccttgcagcaacttggtggccctcagtcttaaggtagagaagatcagagcaattataactaattaagttgcgtttttgctagtgatctgacgcgtgatttttttctcaggtatttcacgttttttttttgccgcacactatgtgcgccaagatttgtgcaagaattggtggccaaggctacatgcgttgtgcgttgtatgtttaggcccggttttttctaaataaaatttgttttctttaacggttgaaaaattaagatatttggaactaaaataaaaaaatataaaattatagtcctatataactaaaattatatttgtattagtgattttgttgagcaggatttgatggtccctttttttagagggaagttttatgcagtatgaaaggttccaatttcactcaaccattcatgatgtcaattaaccgcaaaactgtagtgcagagcacatcagaataatactgttttatcttcacccattgcaacgcatgaacattttgctaataacgatatttgttgcataataacgatataatagccaaacatttcgtaagtttgaatagaaaagaccttggagttcaagcctaattttcaaactaatgaaactttcatagggagacgagagaatacgacgctgttagagcaagtttaatagtatctcctgaagatgaagataaagattaagtgtttcacacaaaacgaggtggtaataacgtgtgattaattgagttttaattattacaaacttgaaaaatggattaatctgatattttagaacaactttcatatataaagttttcgcataaaacacaccgtttagcagtttgaaaagcgtgccactttaatccaaaattttatccgcgtttttaattggattcgaacgggaccacttgtcaactattagctccaatttatctatagtcaatctaatagtccattcatacaatagttacatactgcattattaatacatggtcacacatgtcatacacactgcgtcttggagtccagctgactacaaatctgtagccctttgttcttttctctcctcatatatctccttaaaatatatttatatgttcttttctctcctcatttactttcttaaaatatatttatagcaagcttatagcctgctattatacctactcacggctcacgggatcttttacggtgtattcgtcatgttgatgtcacattcctttttttaacaaaattaatgtcgtggtaaaatatagcaacttgaaatattccaatttcctcttagcttgccatgcatattttaggaccaaaaaagtatgtgatatctgagtatcacagcgctattacatgtagttaccaaacacctagttaccatatgcaagtatcatggcatttagctagtgtaccaaaattttagtttaaatcattatacaactggatggtctccaaagcagacagcgaacatttaaaatgatgaatgtattgtccgcatctgaataactgaggtatttggctaatgcataaatttcaattaagagccccatcgttttggtggcatatatttacaaacgaaaaataatttgtaaataaaaattttatatgcacacaaaggctgaaaaataaactataatgaaaaaccccccaaaatcaactccaattttaagcttcaaaattcaaagactaataagcattaagcataagcgaaaaaataagaccgtaacattacactgtaatagggttgcccagtgtaacacgggataaaagtatcatatctcaacagaagataataaataagaaatttgataataaaccgtagcgccaatatcctttcttattactaataatatactcaaaaagatttcagccgccatttgcttagttgtccatggcatgcattgcctcgctattgtctcccctgggctgtgttgtgcagtgaccttctaggttcttggctctggtcctctgcctatataagcaaatgatacaaaaagaactaaaatccacacattgttcccgttatagtgatgtataatcatatacaactgttgagaagtgtatgcatacttttggtaatcaaaccgatatcttctgcgatttttatcttgtttctggcgtaatccaaataagtctgtggttttggaatctgaagataaaattcgcctccatgttagcaaaataagaaaaatttggtgaaggcactcaacaccataatcaactaggaaagaaaaagagtctacttcaccccttaaagtaatggagttggtctacttaaccccgtaagtgtgaaatcggatattttagccccttaggtatgaaaaccagctcaaataaccccctagatggtttttaaggaggttttgccatgtaaatgatgacatgacagtattattatttgcatggcacaaatattagtccaaccctttacgaaatttcactcgctgattggtatgcctaaaaattatatattagcatcaatgtatattattctaaagccgttcaacttattaaaaaaaaaacttagtcgagtctagctatcatcatgtcattagaccctccatagtaaaaccaccgccatatcatcatgcatgttcacagtaaaatcgtctacaaaggagttatttgaaccgatttttatatttcagggggtagaatacccagtttcatgcttaggggatcaagtagaccatcctcaatactttaggggtgaagtattccactaggaaaatatcacctataccccaggatacatttgcttgatagggaaataaatcaactaaccatttctataatggcatctttgatcaattgacgagcttccttttctggcacctacacatagatgttccattagtgtgaagaacatatttcagttgagcatgaacctcatgcaaaaaagtatatgcttaccgtttcatcaatgcaagccacgtagagatcgtactgaacaacagaaagaaaaaagaattaaaaatggatggattgatgagttgtaatcatcctgatgtaacgaaactgagaagaggaacctacattttccttcatcgaacggaatctccctcgagtactgcgaagctcatccttaatatcaacattgcgcaagggaaacatatcttctctataaagttctgacagggcatcagtgaattccatctgacaaaagatgaaatagcataagtatacatcactaagaatataaagcaaagaacgaacagaaaaaaaaaagagcaccataagctgcgtagttctgcacattgaggtaatctaaccttctgcttagcaacccgcttccaaacctcaaaatacacaccatcaaaatccttgtagttacaacaatcaaaccgcatgctccatatatattcctaaattagaagatagtactattgttaaataccatcaccacttatgcttgccaattaaaattaacaggaggcattacctggaaagcagtcataacttgcattagagaaacaacacgaatgcgtagtgcgatcttcattgcttgaaggtaaactgtatttttaactttgtcccactaaacaatggaaacagttgccattaattgacgcattataacataaatatacattgcacaaatggcttttgggatggttacctgacccatggttatcttatcctcaacagcaatgagtaccaaataatcttgaaaccactgccatgtgaataaatgacatcagacaaggatgattagatggcatatggccagtattttcaccttgagtcagtcataccttagtcttatgtgctagctcttcacagaatttgacatatgctagatcactctcataggtactataatttgagtggtattgatcccagtccatgtacaaaccctgcacaaagaatacattgtccattacttgcacaagtggcatctactaggacacttgtactaacctaaacagtatctacaacaagaatataccaaatgcagaaatatggcacttgcacagaatgccagcttgcaaacaatagtatccaacatgcctgatgatatgaactaccaagttagtttgcggataacatggcaaaaagcaagtttcatatgcaaatcctactgaatatatcaatagagtgatctcaaatgagtcagtcaacaaacgaagtatatctctaatcaaatacttatgttccttttatctctaatcaaacatgtgcattcaacatttcaaaactttgatgccattagatttgctacttttgtcaacgaaagtaaccacaatggctaaacacacatatgcagacctatcattgtccaaaatggcagacaaacaatgttattttgattctatctctccaaattataaatgaatgggcatttgatggtttgcagttgcaagagaacattgattaggataaaaagttaaatactaaggcccaggggtgaaacggaccaaacaaaaaattaatagaggtcagatcagcatccataaaggtcagatagggataaaaccgagactgctctcatcgatgcagggcttgtcctgattgctaggtgactctgatcaagctagacctaactttcaataattatgtattgcttgattatacagaagtacatgtgccgcttaacttgtcccttaagaatacaattgatatctacattcataacaaactatatccataattcctaactaaaccaataccttcctagctactccctccgtttcatattataagtcgttttgacttttttatagtcaaacttttttaagtttgaccaaatttataaaaacaatatagtagcattttttaacacaaaacaaacatattattaaaatttattcaacgttacatttaatgaagttaatttcgtgttttagatgttgctaattttttctacaaagtcagatttaacaaagtttgactagaaaaaaaatcaaaacgatttataatatgaaatagagggattacagataccatactaaatatctatctctatcctaggaaagtaattgatcatttaggcactactccctccgttctatttcatatcatagtcgtctgacttttttcttagtcaaacttaataaagtttgacaaggaaaacaagtcaaacgtcttataatatgaaatggagggagtagatattattgttgtccaaggtaaactccctaatcctataaatgcagtacgcatttcttttcatataacagtataaacgctcttaacaataacaatgttacaaaagaatgtaacataactagcccaaattttaacctttacaatattttcgtttaattaagtaaattaaaattgtggtagcatgggtacagcaacgcaattgattataccaccaagtactgataaaaataagcatttaagctagttgtcatggaggagtcaagtgccgatacctacattatcacaaagcactagacgctggtagttatcaagggcagcaggctggaatcgttcaggatcaaagtaccattcaagactatcctcatagtactgaaagtaccccttctcataaagaatggagggagggtacttctctttcagttttgcaatatccagttcgtcaagctttctaccatttgataactgcaacagacaataggaaagtagtttataacaagcagagagatgcatcaaactaaaatatacataactttactcatcccaggtgatgataaaagatacctcataacctatgatgcggtagaaggccagctgctcatgcaactcagtgagctgctgtggcccatcgcattcaagccaatcatcatcatcatcatcatcaagatggtcctgaacatataactgatgaaagtagtaactgactttgtttgagatggtatcctcatccatgccaaggagatcttctaaatcctccattgattcttgttcttgtttgtgttctcgtgaaatcttggcaaggtccccagaagatggttttggctccccctctattgttgatgtgcttgttccatcatgagaagaggatgggctaccactgtggcatgatagattttctgtggattcgtccatcttgcgcctctgcctcttcttctgtttcttcttcttcttcggcttgctaatttcttgttgacttgaggatttaacatcttcaatgctgtttttcttctgctgtgcttcatatccaatatgcttgccctttcccttctcagcagtgggagaagagtccttagctgcttgcaagtcaaccttttccttaccaggaggagaaccataggcttcaactgcttgcaagtcacccctttccttatcgtctccctgtccatcagaagctgaagctgcagcagaggcttcttctctggattggctagcatcgtacgtgggtttggtttccagctccttcgtgtgtgacaaatccatcaccaactccggatgcaagtccaacctcgtccttttaaggagccacaacaaaaatttccacctgtactcattccactcgcatacatacctcaactccatacatattttgtccataagcttcaatcgggctataacaccgccatcctcaactcgaccaatcaactgacccctcagtagcctcaattggattagggaatattgcaacatcttcatagcattataattcttcttcttctt

SEQ ID NO: 93810 - DNA, 723 bp, Oryza sativa
cttaaatagggctgccttttggtgaagaaagctttgggtgaggatgctacactagtatctagctccggccttaaggatgctatacgagtttctgatgctttaaaaaatggaaatagcaataagggactgttttcatcatcccatttaagattgtcccaccatgttttctgccccatgacactctttaatttgacaattgcatgcccaaaaggcagccttctcagcttcggacaagcaaacacatcaaagtattccaaagaaggaaggtctaggctaaagttacagaagttttccaagcttggcaacgaattcaattgcaaaattctcagtcgtcgaaatccctggattggcatttcatcttgtacttcagtattgattttattctttatatggactagctgtttcattttattgcagaaagacacatccaattgctccaggtgcggtagtttcagaatgcaggacatgtccatcagttgatgggctttccctacataaaggacacgaaggttctgaatatgccccatactaatcttctcaattcttggaagatcccaaaaggtgagaaactctagcctcggaagatgatctccataacactgtggcttgtttgtgacagagaactcctttaattctgaacagtccgttatattaagaacaaggacactatctggtatagtgagcgcaagagatgtctcgccactcaatttatatagaccaagc

SEQ ID NO: 93811 - DNA, 6213 bp, Oryza sativa
cccgcgaacccgcttataggcaaaattagtaggtaacctacggatcacctactgatttgacttataaatgggtttatggatcggcccacttgtatctctaagtgcagcaagccgaatcacgatatgaaaacctacgggttatcacttatttgacatataagtaagttcgcgtgttggcccgctttcatccctacttcttctccctacattctatcaattatgatccagcggagtagaggggactcaagtcccccagcacccacgctgcactgacacatgggtcttatagctcgtgggccgacatgttagcaacctacgacagatgatagtatatcaaaggagcttctttaataggtatatatatctctctatcccgatggcttgtgtttcatttacttaggcaatgtgcatcaacatatgaatattaaattttgaactcgtttattgtggattattaacctacctctacattattccctccgtccaaatatatatgtggcgtattttattcgttaagaatataattcccatcacacaaaatcgatgtctttagatttgtattcgaaatatttatagttacacttttatatcacataaacggtatatatagggtaaaacaattgttagtcaaagtcttgccaatatttttggatgggggagttgtatatatcagctagcttagaatggaggaatttattttagcaaatggtgtggtgggaaagtcatggcaatgcacatgatttcatccaacagtgttcaaattctaatttctgtatataagaactttttactgtcacttgaaaggcggtgcattagctgcataccggcataacaatgatttgtaaaacgaaaccacacatgtcacgaagcagattaatgggttagtctgcattaaaaggaggggattaattactgtactttgatccgtacttactattgatgaatgtaggaacagttgtttaaacagtatttcgactagtcctaatgaatctgtaagtaataggaccggcaattcattcatagtgagagctgtagaaaaagattgcaattattatgcttaagattgattgacctatttgcctttcgccgtatggatattattaagtgttagcaagttgcaaggcaaggacccagtcattagggataatattgccaacacgtactacatctctatgcacaatccacataaaggattagtgctaattatttgcaatcagtacatatgtacacctatctgtgggaccataagtgcaaagtccatatatattttgtggttactgatgcgctagctcttaatttagtttataaagatctcagaaagttaaggcagaaatggtacagtattcatgtttaggtggccataatgtgtttagtttaggtgtaatgacaacccaaagtgatcatatctgtatctaaccatgaaaatgacaccagaatagatatcaacaaaaagctagagtagccaccaaataaccacacgaaagaaaaggaggggagaagaatgtgtgaatcatgtcacaaaaaaggtcaccattctattggctgagtgggagaccaatacatgaatcttccttgagatgacagctagccctattaacaataacttggctttcacctagctgtgaccatatatgtttagtgttttagtattgctctattatgatatactactagtaagacaaagtgcttttgcagttgaccattgtgaagtagtggaagaacacattctaagctacaagtagctagatatatttatgattctagctacttattaatacatacttacaaaataagaaaccatgttctaaaaaaatacaatcaagaattctggggttaatgagttttggaagtatatgtgctgctagcttttgggttgagtcctcagaaaggtcaaaactgttatgttggttttggtgtgtttcaccaacctttatattcatattgacttttgatgttgaacctaagctaatctgttactaactttgcatcagtactgaagaatgtgtatgcatgtatgacaaatagggtacttgttaataataagacatccatttggtggatatatgtactatatctgcaaaagcatacccatgggaatagaacaacatgctcattgctgtagacctttcaaccctgatctggccaacttgtcttcaaaaaaggcttttcatttttttttagtaaagaaaaggcttttctggtagaacagaatagtggaggttctccagttgcatttctaaaatgaaaccttgcgtcacaagtgatccaaagcaaacatttttcttcctctaaaaaaagtcaattgattcacatgtattatcttgatctcatctcaaactctcttaattagcagataacttagagcttagagaactttaatgatagtgacggcagcattatgcaagcgcattacatcttgagtagaaatttctctgacatgttcataaatcagatgctgcaaaatcattgttcttgagtagaaaacccaacagaaatgatgcaaccgcagccaaattcaagacaatattgtgatctatcaacgaggtgtgagtgtcgtgtgaactactcattatgatcacatcgaatcctgacctggacgtgaaacatcgttattcatcagagattatccaactgggttagacgttgatggcctaaaagtgaggtcaagctttcttcactagtacatccatcatatcgtatctttggtctgtcgctggtattgcatactttatccttttgacaactgtcttgcaggcaccaaactttgctttttgaccatgggggtgggccagtctgtaaggacctgcagaatatatcactgaatttggtgagagatgatgaatcgaagctgaatttgcagtgtattcacattcagtgtagatacacaaccacaagcaaagtgacagatttagctgataatagaaagacgaatctacatagtatcaatattgagtacatcagcaggccaccattagcatcatcctaaagaactgccagatatatatggaacgaagagaatggtccatgtcataaggtgatagcttactccaaagtgatgcagccatattcactgttatgaagaagtgtgctctgtttggcactcccaaccagttcctctatgataagtagataacagcgcaatttaattgtgtacttagtgcatgacatgctgttgtgatactcatgccgacagctctaatttctcaaaatgatactgctcgccagcaactacttttagaagctgagaatatctaccaaccgacgttgctttatggaccacaattagctaagaacataagatgtgtcttattggccacaaaatgcagatcaatcctgctgttggagttgagtactaacaacttggcatttgtttaaattcttccagctaaagacctttagtctccaagtgtttgcaacaacatgcctcataccatctgcaggatgtctggatcagatccaagtgccataaagcataaacatggaaactgctaatgcaggtgacaggtgatcatccacggagtttccattcaactgttcaagaaatccaaatgtatagaataggggtctagacagatgcaaaatacaattcgtagtcagcaaatgagttgatgccacacaaggtatcaccctgttaccttgaagcctccatgatcataaagaacagtgcctatattatctccagtctcatcatcattatcatcatattcactaggattagcttcttcgtcagactccgaagcatcagtgatatcagagaaaccatcgttatccatatgcgataggtccttcccttgactcggttcttccattttcagagaagcagctcttctatcatcacaataaacaggatcaacattctgggattgtgggtttccataaagtgcaatatgccgataataaagttcaagctctttttcagacacggcaataaaacgcctcactgtctccagtgattgttcatattttgatttttcaagtgcctgatgaaaaaaagggacagaggtaagtgcgcaaaatgatgcatagaaaacatcagttatctggcatttctacaagctaccaaccataggcaataatccatctgagacaactgaactgggtaaacagaatcaacaaacctacctttttctttgatagtgtatcgactggtgacatgacatctggctgaacatagttctttccccgatagaagactatggtgtcatttccaatagtattaatagggataccaccactcagtctggctatctcacttgcgtactcctggatttgccctggcttgcagggtttgcagatgacttttacagtctcatgtttcttccagtgcaaatgcatgtttagaataacaccaccaaagactcctctccttccaacagggacataatttgactttttttgagaaaccttcttcaaataaaatctttcctcgccatcaagatcatcttgtttagccatagggccttgtgctttagcaatctcatacttctttaacttctcaaccaacatagcttctttcaatttggcctggaagagaaacagatagtcttagtttgtactcccctagaaacaaaacaaagagaaatcaagcacattgtcttccaacatatttagcatatgtacttctgaaagttccttggaaaccaactacttctaaattctgattatatcatagaaatagaagaagacaaattatgaaggaaagtatattggcagtgaattgaagctagaatgcttattcaaatactgaatggcaaccagcaatgtcctactctgaatgaaagatgcttaatttgattcattgattgtaaagattgcttcaacaagaaactagtcgagcaaactaaattaagcaaatatgtaaaaagacataccttctcaatcttgtatttgagtcgagcttcaggtgtagaaaatttctgttttatcttctttcccttgggtctgatacgccgtggatcatttttattggcctctttcctcttcttcttttccctcttcctctgaagcttcaatcgcttctttgtcaaatacccccgcttcttggaaggttccacctcctcaatctcaaacttgggtttcccatcatcagatagaactagattgactgagctatggctagcccatctaaccatccatggaggactaaactgataaaagggatttaagcatttcccaaatgaagcaatagcaggcctgcaacaagtagcaggaaaaaaataccagggaaattaaacccgaattgtcattggttacatattactcacatcatgcttggtaagctacacggagtaattttagtgaacaagtaggcaactcttgccaaatgaacatcagtgctatattctttacagaaacaacaatcgtttgggaggaaactcctttatatgattattggaattaaagttgcacacatgcttcatgttgcatacatcatttttgccgcctgcagtttccagctcctcataaacaaacacctattcacaaattctagtagtaataatttggtatttctcccatctaaccaatgaggatgtactcgaggatcaggagagaggagaatcgagtaacagatagagttacctgagaggttcaggggaaggcgagattggtgccctctgggacagattgaggagtgagaacgaagccaactttctcaggttctgtgacaggacgcgggtcgccatagcccactagtcctatgccaacgcattgaaaagtggtgtagtcaggaatattttgttgagtgtgcctaacttcatataccgaaattttctaagaccgcaaatcctgtatgaaagtacaaattttagttaaaagtgtgatacaaatataggaataatatctcataatatcactaatcgacaaaaaaagagagaagatcatatataaaaggtcttacataaatatagcagattcacatagaacaaataagatgtgtgtgacagagggagagagaagcacttgtaggttgtggcatggccactgtcaatggtgatcgcacaaactcgtcatgatggaaataatgaatataatggttgtaaatacaagaacatatcactagaacggatgataatttaaagatctccgcaatttcaactctaaaaggtagtgaattaaaaaggcatagggtctggttattaccattgactcacatatacctaggttattactatggcatttgatcgaacacctttctgtcatgaaaaaaataat

SEQ ID NO: 93812 - DNA, 715 bp, Oryza sativa
atttttttttctgcgggcttgaaaccacaaccacagcaactatatgggctatatgagagtttatcaaaaatccacatgcagtggagaaagcgcaatcagatatacgaaaaatccttggaggcaaaagcattgtcgaagaagcagacatcgaagggcaacttcattactttcaaatggtgaacaagagactctaagattgcatcctcctgtgccattgcttcttccaaggttatggtctgaaccttgtaaaatcatgggttatgacatacctcaagaacacagcaatatttgtgaacacatgggcacttggtagaaaataaaaaacactggattgatgcaagtgagttcaggcctgaaatattcgaggatgggcatagtcgatttcaatggtttagacttcaggtttcttccttgtggtgccggtcgtaggatttgtcttggtttgatgtttgaactttctgatattgagctcacacttgcgagccttctttatcattccagctggaggttgccaaccagatcatactctaataaactggatatgaccgaagcaaacgggatcacaactcatcgtagaattgatatttggttagaagcaactccttttgttcctagaggctaaaaaaatatgtggttggtttgtgtttatacaattgtactatcttttaaaacttatgaaccatggcgttgcggttggatatcctaacttatatgt

SEQ ID NO: 93813 - DNA, 1361 bp, Oryza sativa
gctaatttcttgttgacttgaggatttaacatcttcaatgctgtttttcttctgctgggcttcatatccaatatgcttgccctttcccttctcagcaggggagaagagtccttagctgcttgcaagtcaaccttttccttaccaggaggagaaccataggcttcaactgcttgcaagtcacccctttccttatcgtctccctgtccatcagaagctgaagctgcagcagaggcttcttctctggattggctagcatcgtacgtgggtttggtttccagctccttcgtgtgtgacaaatccatcaccaactccggatgcaagtccaacctcgtccttttaaggagccacaacaaaaatttccacctgtactcattccactcgcatacatacctcaactccatacatattttgtccataagcttcaatcgggctataacaccgccatcctcaactcgaccaatcaactgacccctcagtagcctcaattggattagggaatattgcaacatcttcatagcattataattcttcttcttcttcttcttcctcctcttgagctgccgatcaggcctcgcttcgtcaccaggcgagcggtgttggccccgcttcccgtcgctttcctgttgatcagcgggtgcatcttgtccggatccgctagcaccgcacgcgggatcaggttcctggcaataaatctgccaccgcttctctggatcaagctgcggcggcgtcttgagcatcttctccctggagttgtaggagcaagcaggacgtcgaaaccctaatataacaagcgaaaatagtagtcaagattaggggttggcttcaggagcaattcgagggagtcggcggagattgatgatataatatttagggggggaacgagtgggatctggggattgtggaggcgatacctttccggtcttccgtgtgtggtcggcaccagggtttcaaaaaccgccgggggcccggttaccgccacccggcggtacggcggttaccggcggtacggcggttaccggcggtaaccgcggtaaccgcgcaaaaccgcgacaaatttacaaatcgaaatttgaattcaaaaattcgggcaaaccgcgcggtttggcgcggttaccgcgcggtttgacgcggtaaccacgcggtttggcgcggttaccgcgcgatgtgtaatgggttgcacagtaacgggccggcccattttttttctttttccaattttcaaatttattctccgttttgctctcaaatttgaataaatattactcttttttgagaaatttcttccccataaaacactataaatcaagcactaccttcactattttttttgatttttttcttttttttttaaatttttgaat

SEQ ID NO: 93814 - DNA, 2799 bp, Oryza sativa
  unsure (1)..(2799): unsure at all n locations
gctcggtacccttgcttggggctgtttctgtttgataccaaataaccaaaacttgccctaccaaatatttgccaatttaaaatagtatctgctagatgtttgaattggtgtcaaattttgccaaaactaacacaactgatgcaaccaaactctatatgaaaacttgttcagtaggttgggcattgaaccaaataacggccctttgctttcaacatggcacataatttgcttccggcccatatgaatgttggcagcccacatatatatgggtcgtcctacaacagtgcgaggcccatcaaatcatgccctccctacaacaccgcgcgccacgacgcccactgcaccgggtcagcccattgacgcgacgcggaatcggagcgaagaaattcagaatccacgggccgcggtcgtcacggcaacatccaacgggaagtgcgcgtcacgtnccaccggggcacgcacgcacttcgncgncgncaccaccaccaagggtctaggctccaacccaggcaggcgccgcccaccttgacgaggaatcacaagaatccctcggccgaatcccgtggattccaagtttccaaccattcggcgggcggccgcaccaccattccacccgtccacctcgttgccttcgccctctgtctcccggtcttcgcttcccctcgcatccgcgtctccaaaaacccccaactttgcactgcaccgaccgcgccgagaggagagacgagagcccccgagaccgcgcgccgccatggccttccactacgcagcaatgccctcctcctcctcctcgtccctttcgggcgtctccccccagcccccgcttcacctcccccgtctccgatcccctcaccaagcgtcccgccgcctctccgcgctccccttctcccgcgcgctcccgcttcccctccgcctccgcctccgcattccccgtccccaacttcctccgctgcccctcgcgttctcccacggtgggggcggagataacgatggcgacgataataataacaatggcggcggagatggcgagggggatggcggcgcgcccgacaaccggagggaggcgctgttcgtgctcgcgcaactggggaggaagctcgagagcctgccgtccgacctcgcggccgccgtggagggtggccgcgtcacgggggagatcgtgcggcgcttcgctgagatggagggctcggcgctgctccggtggctgctccagttccaggggttcagggagcgcctcctggcggacgatctcttcctcgctaagcttgccatggagtgcggcgtcggcgtcatcgcaaaggtcccatgacgaattctccctctacgtacttctattttggcatcattgcactgtgttatgttgccaatctgacgttttattcatgctgctctcgttgtttagactgctgcggagtatgagaagagaagggagaattttgtcaaagagattgatatcgtgattgccgatgtggtatgcttctgaaagtatttctaacaatttctgacaataaaacaaaagaatctagctcgatgtgatttcacttgtttggtttacattgggtgttactagaacaaccacttatttagcaaataattaccatgtggtataccgcttcatgttcagatgactagtactctaataacatatacatcatggaatttatttattgacctcgctttgtaaattagtcgctaagatcgttagctgatagacctttttttaaaaaaaaaaataatcatatgctgagtattatgttatcaggaactaataaagctggtgatctaaaccaaatagacttgaaaaaaaaatcttataatgtggtgatgtttggttttggaactatttctgaataatactaatagatactatgtggttgattaactgaattcagcattgaggtttgtactattaagtccatgtgagtaccacacctgattctagttgctattgaccatgagcgaacctatttttgctagcctaattttagtttaggaagagagtttatctcatgccatgggttcaattttactttctttctgaaggtaaatggataatgaaatttgaagttttttttttgttatgatttgtgaaatctaattttgtgttgcttctgatactacccatacaggtcatggcaatagttgctgatttcatgcttgtctatcttcctgctccaactgtatctctgcaaccaccacttgcaacaaatgctgggcatattgctaattttttccacaattgcccggataatgctttccaagtaacctaaactttctctcttttcatctgagtagaacattcttcctagaatcctccatgttttgctaaaaacacttcatgccaactgttctccagattgctttggctggaagatcatactcaattctgcagaggctaggggctattctggtatgcagttcttttgttgtggttattatgatacttagaccgtcggactcatagtggcctcagtctattcagtgtgctatattgatcaactaatgctagtggcttctttgcagagaaatggtgcaaagcttttcactgtgggaactagtgcttctctggtaagcttgccattttggtttgctgctacatcatatgattgtgatgatcatgtgttagcaacctcttttgatttgtgttagggtttgcatttgtttttattttctttgagcaggaatcctgtcatgaagttttaatcctgtcatgaagttttaaataaaacatttcagcaaggcaggaataaccaatgcgtcctggtgttttcattatgtctacctatctctgtcgttaag

SEQ ID NO: 93815 - DNA, 3446 bp, Oryza sativa
  unsure (1)..(3446): unsure at all n locations
cggtagttttcaagttttcactacatatgcggtttgcactgtatatttttccgccttatatagtggtgtagagagaaaaccttatagaaactagaaaaacaacaagtgtgatgatatagcatgacaacacataagaaaggtgtaatgaaagaggatgagagggtgacggcagctctttggcaatgcaagcagcaccatgtgcaggtatatataaaatggtgcggggcagatccaagaaaggataaaaggaggggctaaacaaactatacaaaactatagcacccctcttctaatggatatataataagaagtggaggctcctatggttacaacgccggcaatgggggtttaaggggtcaccctaatgggcgactagtcgcgtggaggcacagacgcgcgacgagcgctcagtctactagtactactgactactcttctactacagtactactagtcttactagtttactactacagtactactactagtagcactaatactacactactattactactactgttatactattaatagtattactactataaaatatatatatttttatatgtactatatatttttttatgtataaaaaaatatacacatatacaaaatttgtatacggcgtgtacaaactttgtatatgtacatattaaaaaatgaaaaaacaaaaaaaaacatcatgtatattcgtatacaagtatacaaactttgtatacgatatatataaagtttgtatacacatatacaaactttctatacacgtatacaaacattttatacgtatccgcatatgcttaaaaaaccgaaaagaaaaaaacagaaagaaaaaaccggaagaaaaaaaaacaaaagaaaaaccgcaaaataaggaaaagaaaaaaccaacggaaaaaaccagcgggccccaccgtacagacgcggctacgtgctgccacgcagccccctccgcgcgcgccacttgcctcgccgcgcgggggcgcgcgcgcggatgattgccttttagcccttttggggtttgagaccccgtatatctcatggtggatccgccactccgtaagcatgttgtgggtgctgaatggtgagattggagaaggggattaatagcagctagggtttaattcttcttcttttttttagaaaactagcgtttaatttggaggagcagtgagtgaaggttgatgggccagagatttttctgttttttttcctcaagataatatgggcctggcccatttactaaggttggtggctagggtttcgaggaaaagatggtgtagtgaaagaggacgtccgtctgatgttgatccaacggctgcaaattagagtgggtgatcactgaacatgccagttataaccaagacaaacctctttaaatttcagcgacgcgctcaaacactcacctgcgccgcaacagtttcagacacgatctcgatcgtgtctgccatggcggcggcggcggcgcctgactggtccatgctcccctccgaccccatcgtccgcatcggcgactgcctcctcgccgccgacgacttcgactgctacgacaacctgcgcctcgtctgccgcatgtggcgctccggcaccgacgacccgaggacggccgacttcgaggacgcccgcttcctccccaagaagctggccatgctcgagctcgacgtcaaccccggagaccaccgcgccgccgncgtcgccacgttcgtcaacctcgacaccggccgcttcctccgcaagcgcgtcccgggcctccgcggctgcttcctcgtcgccgtcacgtccgccgccctcgtcgtgctctccgacgcggcgccgccacacgggacccgcggggaagggtcgccgtttcagggcgcccatccatgcggangangaggtgagggangttgccctgaagacgttcgcgctcatggtgttcgtctcgtggtaccaagggaggtccgtgaggtgggttgatcaggacaccgagggcttccccgatgtaatggtctatttccccgacaatttcatgaacctgacgcccttcgccgccgaggtgtacgtcaccaaccgtggatccatcgtatccaccgtcctcctcaccgncgncgacgaggaagaagaagaagaagaaggtgagcagcaacaaggtgttcgtccgcaaccccgcgccgcggacaccatcgcgatgatccccatcattcgtatgccaccaccagcggtgaagctgtacgcctacttccaccacctcgtggagtctgccgccgagctgctgctcgtgagcgtgctgtggcgcgtgcacatgaccgcacaaggtggacaccgtgaacaaggtgttcgtcccggtccggagcctcggcaaccgctccctcttcgtcagccaggccaggagcttctccgtcgacgccgacaagttccccaccgtggaggccggatgcgtctacatcgtggagccgggcccggcgacgtacgagcgtttccatctcgccgacgggaggctggaggaggccataccaatggtgaacaggcgccgtgccgctgaaggagaaagctgcgtccttcctctcaccctggagcaagtcatggtgaactactgcgtcgacacggagaattattccgagctcgagatcgcgctcgacaccgatgatgacgaagagttcttcctgcctgaagctgaaggccacggaaccaactgatcgatccagatgctggtgatcaaaatatatgggtgaaaattaagagggcttacgatataattttcagctccaactatatatcctgatgatatatgatcctctctgtagctagtctctacatttcatgtaattttcttcaattgtattccttctctgttcgatgacatcgatactgtgcgatctcgccttgtttgcttttgcatccagaaaaacatgtcattcgcttaatccgtactatttaattatttttttagcttcgctgtgccttggtcaaattaatgttacaaaaaagaagttctggtatggtgtattggtgttaccatgactttgcacttcaattgcttatgtagtaatgtaaatctcgtgatctagcgaagctccatgagcatgcaagatgtactacatccgtccctagatataagggatttttgttgaatgtgacatatcctagtacaacgaatttagacaagctttctgtccaaatttgttgtactaggatgtatcatatccaaccaaaatcccttatatttagggacggagtgggagtagcttaattgggtgaagtaagcagcagtcaggccgaagcgcggctaagcctgccaatggggcaagatccaccccatatccaatccactagccatcccataaaatccaaaccagaccaatccattttcctcgtcagtccaaaccgaaccaacccattccaattttatggtctcaattcactttcaaaaccatttaaacccacttcaaatccactttgtcgatcct

SEQ ID NO: 93816 - DNA, 5273 bp, Oryza sativa
caatgctagaaagtcttataatatgaaacagagggagtatatacatattctctataatctatacatgaaacactagataccatttattctatctcatgtgaattccagcatgcaccatttcgtaaaatatgtatgttgattataaataatcacatcttgcaccacaaaaaactaaaaaaaaattgtttaccgctccctttgttccaaaatataagcactcgtagcatttgaaattttaccaaaatataagcactcctagaatattacttgtcccatcaaccactcattcaattttcttcccatattacccccaaacatacctcatttaataaggggcatggtctttcctactcaaaccttaatctttgctaaaacacctagaaatgcttatatcttgaaatggagggagtatttactagtgcaagtacctacaaagctaatttagacatgaaatattgacacactctcccagtaccttttgactttctatattgtcatacattggtcgacttttttgatgtatgatattgcctgctttttatgattcatttgcttaattaactcatctatattgtttggttcttctccaggggagagttcgtatgcctttatgaaaaatataatacttacattgtcacaaatcgctgcgaaaacagacaaagaatcagagcggaagaatgtaagtttatttcttgattgttctcacatcaaagatagagcatctatttgcttctttgtgtgtactgcgtacatataccatgtacatgagcattgaaactatttcatggcaatgcttatgtttcagttcctcccatgggagaatccagacctcagaaactttcactccaaataggaagctagagccataatgcctgtgaaagtttaagtacagaataaaaacgagaagtttataagattattgtagtcatatcataactgaaaaaggcttgagcattgaattattgaaatttcatttaacttgtcgtgttttcaggttgaagagtgcattggggcagctgtcattgctttggggccagataaaatcctttcactaattccaataggttttgatgaggaccggctaacatgctcaaatacttggcttctgcccattttagataagtatatctatggggcctcaccacaacaattcctagagcgcattgtacctctagcagaatctgtacaacaagcttctaacatgggtaggtaaagccaattcattaggtcttaaatacatacgcaacatgatttcctaaccttctgctttaacttcagccaagtcagcacggaaatgtgaagacttgaaatcatgttccaatcagctgtggaatttgcttcctgccttctgccgctacccagttgatatatgtcagaatttcggttctctatccaagttgctactagagatgttgaaatgtgacaagtatctgtacaaatccgctgttaaagccctgcaggtgcagttttcatttacagatatactgcatttttcttatcttatctatactcattttctttctggaatttcgaactacaaggctgctccatgtcttctctcagacaacatgttttatttttctcagcaacttgtagatggaactagaagattaagtagcagtgagcaaaacagagaaatatatgtggagctttctactttgttctcctcgaaaattattaacttaagctgcccaagctttgagaggtgctctaaaaaagatgctcgtaagaacatgaaagttctggcatcacattctgtgtatcttctttctactgtcacagattattttctagattcttcaccagagaagcgttctcatttgaaggtgtgtcacttaatatttctaattattatcagttgatgagcatgttagatgtcttcaaaccaattaagtctaaaaaacccctacttaaatcagtcacggacggactcacatattgaaacattactgtattttctattatttggcatttgaagtttgattgatctatgcacattagagtaccactgatttaaatgaggttttgtgtcacaaacttgagaaaggcttaacgccgcttgatgcagcccaatattgactgctgcaggctgtgccctacacaattaaagagagattatattagtagaacatggttattttgttgtgtttgtacttttttactatcatttaaccatgtttggttgatatagataaaaccaataaaggtgtatcagggatgagttatataagtaaattttataaatgcacttttgcatattattatcaatacataagaaaaggaaccacaaccttatttcttctcagcaaggcgcactcaaatgactaaatagcaaataccaagtgaaaaatgtctgagagattaatatcctggtccagttggttattccatatccatgtgcacggtgtgcccatgaatggctcagtccaatggcactgaatacttgttacagttggtttgatactttgatgcactgtattcttgtagtgtatattaacaaaatacagttttaccttgaatacatgatttctccaacttccttagctgtttgtacctgggagaggttgagctgtactagttgtgtcagtaaattaggttatgtaccctttgctctagcacaccttctatttatccctgaaaacaacattagtttttagactacatattgcacaatatttatcatatcatctttgtcttcttgcaggatgcattgagatgtttggctcaactttctggtagcacgaacatttgcaaccttttcctttcactggttaaaagatttggtttagaagatactcagtcagagcaagagaatattgaatgccaaactaatgaggtagacaagaaggatgaagagggtactgatgtagatgaggagaaaaataaaaagaggtctgctattattcctttatgcatctatgatgtttgttttcaatgtaggttactcattctgtagaaaaagaacataaaccatcaaacttgcctggctctcagcggtacctttttaattctttttggtttgaaccatataagcaattactcctattaatgttagggaaatgctcattaaatttgcattctaggatgatatttatcaacaaacctattcaaattgcatgccctacatttttcaatggtgggactatatgattatttccgtcatcatgtattgattcacacatggttactttctgctagcgtgtgtgtattatacatggtatgattgtaactctacttgtgtaggtctcttgtaatggaacttatttcgacattcgctgaagctgctgacgaggatctgcttgatttgctttttggatttgtcaaatcttctttactggtacagcttattaatttgttctcttgttaacccaactcttatcggagcattcatgctcataccagtttatctgttcttcacagaacaacaagcaaccttgtgagggcaaagctctatttgctctaagcataattttgaaggtcagtatgactgtgtgggaccctcttgcgtaatttttatgactatgctttttcttattagccaccatccctttcttctttttttcaggaacacaatgaatattctttggctcggttggatgaaataatgatgcttcttcatggaataaaggcagacttggataatgaagttttagaaggccaattattatgctaccagtatttgttggttcacatgattaaggtaggtttgacaggttttcccccctcttgcaataatctttgatgtagcacattatctagatctttcctttttgatgacttggattgtggaatttcaaggttgttctatgttgatctctgaaccattgtgcagaagccaaagcctcacaccttgtttgccctgaatagaaagcatctgttgtagcaaaagaacatgttgttctgcctgcatgtcatgtttagtacttggagagttttgttgtttagtcaatttgtactgttcgcgcataaacatgtaaattatatcctacttggtgctaatataatatccatacattgaaatttcagttaagtaattaaacaatttgttcacatctacttcaaagcagcaaaattttatatgtctaataatataaatgctcagaactattcaacttaaattgcacagaaagtagacctctagaatgtatgtaattgctataactgtaataaacacacgactagaaaatatcaaagcactacaatatctgtggtagctagaggtgcattgtacatctataaatatttctttgaactgattataataacataatggattagttcggatgtcttctggattggatgagtctactgcaaagagagtattgaaccatcaacactttgatggcatttatcccaccttgtctatgatgtgtacctatagtctagttctatgctattttggtttgatgttaccaatcctgcttgtatatttatgtaatgtatgtttgtctgacttcttttctgcgttgtaaggctaatgaagagaacacgagcaagaaggcgttcctgattctaaacgagttaatagtcgcgttgaaggtttattccctacctttttttatcagttaccaattatgtatcaggaggatatatcatgtcagtcacaagccttttgctattagatggatagttttcctctttcaaaaacttaaaagcaaggttcttaaaatatacacacgaccactgatgacaattgttcttgccctgctgtcatcatctgctttattttatcctgacccaccttttctccgtacgcagtccaagaaggaaagtagaagattggcatatgatgtactcctggctattagtaatagcttgagaagctctgagtcaaacagtgaagattcagatcttcaacgactattcacaatggtatgttaaagaaaagttctctctgctctgaaggtatcccttatgttttatgattttatctggcataattggtgaagttaccttgtcagagggatgcaaatacttcttttttaaaaaaaaaaaatcatatccttatcataacacctaaaagaatcattttgcttttcatgaaggaaatctgggaacatgttctccatttctattgtttgaacttaatgtctatgtaatctgaagagttgtaccactaggtcctctcatccttatgaattgcttagtgcattcagcttgtagaaaaactctctcagactccaatgtacaaaggattaacaattcgcagctgccaagcttttgagtgtatatctaattagttatatctgagagagcctcaagccctaggatca

SEQ ID NO: 93817 - DNA, 1176 bp, Oryza sativa
acatgccgttcccggcgcgcgcggcacgggctggtgtcgctgcgcgacacggcctacttcaacagccacgacaccagcatgcgaacgctgaagagggtgggcaagacggcgtgcaagccagcgtgtttgggcgactgcgcgtgcatggcggcgcagttcgtgtacggattcgaccccaccgacggcttttgctacctgcagtcggaggtgttgtcgctggagacgatgcagccggaggtgtttcactacaactcctccatgcatatcaagattgcccagggcaggttgccaagacgattctgatcgcctttttacagtctactatactatatcaaggaggagaaatccttgtaaatacatacatgaataaattcacgagaactagctaggattctcgattcatatgtttttgtattcaacatttgtttgtgggttttaacaaaatataaagaaaacatttttttttattttttcatttttattttttaatatttacagaaatattataccatccaaaatatttacagaaatggcccctgccgtccaagtggagggaggcaaggtgtgtgcaattttcaccctgctaaaaatgcatttttctagttttttttcatcttgtctgtcacctgccgccctcagtctacttctgtaaatattttcgccggtaaaatatttctgtaaatattaaaaaaataaaaatttaaaaatgaaaaatattctttttaaacaaggacacagcagcgtgccttactacgagttgggctggaacgggattcccacgaacgtgttgggccttttaactcttgggccgtgggccgtggccagtcatccagtcatcgcttggtggcactcgccgtcgccgccgggtctgcgtgaagccccgtgcgtctcccctccggctccgcttctcccctcgccggcgccgtcgccggcgttcctcggctgcagatccaatcccgcgccccgccgagtgactctcctgattccctgacggcctattgaagagctgcctagaccaccgccgctcgcgactcgcgagcgctggggcgcccgccggcggccgccacgcccttgttggctaggctgctagctctctgcccctctcgcctgtcggcctctactccggctaaccagagctcctcctcccttgctcccttggctacacgggtataccat

SEQ ID NO: 93818 - DNA, 2641 bp, Oryza sativa
tacaacatttgccacaaattaatagatgatattatagcagcataaacaataacatatatgcttatggcagcaatattgaggtattgtttaaagggaaattaaattaacaaagtcaactcacttgtatgagccgacggattggcatctccaaccagattgatttttttcatcacttgggtgtgaaagcatactttggacccaaacctacaggtaaaacagtaaaaattaagaaatagatacgcagagcatcatctcaataaccaatagatatgcacaccttaaagttgccaccaaatgaagagctcacagccatgttttttccagggcggaaagcaatagcagaaattccagcatcgctgtatgaaagaatggtaagagaacatatgcaaccatttataattgaccttatatagtcatgttggtacctgtgcggctcataaatgacagtggacaaaaaatattgtccagcacgagacccttggttccaaaatttcaatgtaacaagcccacctaattcttcttcaggaagcttgacatcaatggtgcacataaacttaccatcaattgacaatgaaactaaggaaatgtacatctgtggaaaggaaagcattctcatcagagcaaacttctggatactaaaataaatgtgaaaaacaaagaaaaattttaagccacaagaacctaacaaaagaaatctacggtacaagcaaaaggaagttgttatctcactgtgatatcatcaacagggtgaaagttcctctcacaaacttgcacctgtagaaagtaaaaatattgggatgggatattcttgcacaaaaccagaacaggaagacaagtaccgattcaatatactgagaaccacagaactggataaaatatgatgaaatgctctcatatgcttactgttttacctctgaaacttcagtattctcaaataaatcgtagaactgtatgcaataatcttctgttggcacagcaacaagtttgttactgtaatcaaatccatacacatctcgataacaaccacccaggtttggtgaagatataggtagctgaagagataaacaaataaaagacatccattagcacataatataatcaccaaaaagtgaaacagcagagatcatcaatacaatttatttggattagagtgggctcttaaagggcatatttatgctattacaaaccttaattccagcaatagatttcatgacctccatgttgggcatttttagaagatggacttggttattcatacatgacacctgaaatacaaagaacattaagctctacttcaaaaatgaattgcaaacaaatgaaacagaaacagacaaaaagaaacggtagtttgaaacaatcatagagccaaaaaaaagtctaatacaaaaatgctacctgctacactttatgagcccccatcatcagtacagcccattaggaagtaaatgtgttaccataaaaagatgctgaagtgctgaaccattctagttttctcatatggttctaataacatcatgtaacctaatgtggacatgtatgattatgatatataattatgctcactctggccacaaaaaaacaagtcaatttaaaatgcatgcagtcaacacgagttctttgaccataaatatcagttaaaatatagtattccggtatgcaaatgaaactgataaattcaattttgtcataacaagagctttcataatattacagttatataaacttttttaaaatttatgctaaagaactaggcagtaaaaagttgtataatgtggacttagataagtccaaaacaacttgtttttgtgactggaggctactatgtggcaacatcatattcaaataactcttaaatcaacaaaaatagtgtgtttttcactcttcagattactatatcaggtgcaacgaagttcaatgggagatgtaaaatatggggatacttacacaggcaatggaagaatccggagaatctacaaaggacaaaagaggagaccctagacgtggtttatatcttctcttcccagtatctagttgccatacaacaataactccctccataccacctataagataaggaacttgtcattgaaaagcataaaaccctagaatcacaactgaatgaacacaaatcagcaagcaaaacctgagaacaagtaagctccatcagtagaaaatttgagaaacctcactccgcttgaatgccaatgccatgtagtgcaagtatctgcatcaccattacccctcacatcacccctgtcttcatctagttcagattttgtgccatctgatccagaaaactttgcatttccaaaacctctccagatcagtattcgccccgttgcatcaccactagcaacaattctctcacttggatggaaggccagtgtgttcaagttttttgtgtggctaagctttatcttccttatcttgtcgggcttgaaattttttgttggtatcctccatacatggagctttctcttatttgtaatacccaaaaattcaccagagctacttgcaacaatcatttccggtttacgggtctgtttaaatcgaagcaaacaacacattgatgtaagttttaatagaaaaccttaccacagatactacagcacaatattattgttatatttctaattgcaat

SEQ ID NO: 93819 - DNA, 649 bp, Oryza sativa
aatgagaaattgcgcgggcagttgcgaatttatgacttaaccaaagggcgtcaagtgggtagtcttctggctgaggtacaaattttacctgtcccagttcgttttctaaccattttcctgcgacaatatgtttttagatattttattattgatcatgctatgaatagtgagcttccatttggaaatgtagtttgctgctaatgttgctattgcaattagaaatataacaataatattgtgctgtagtatctgtggtaaggttttctattaaaacttacatcaatgtgttgtttgcttcgatttaaacagacccgtaaaccggaaatgattgttgcaagtagctctggtgaatttttgggtattacaaataagagaaagctccatgtatggaggataccaacaaaaaatttcaagcccgacaagataaggaagataaagcttagccacacaaaaaacttgaacacactggccttccatccaagtgagagaattggtgctagtggtgatgcaacggggcgaatactgatcttgagagttttggaaatgcaaaagtttcttgatcagatggcacaaaatctgaactagattaggaacagggtgatgtgaagggtaatggtgatgcacatacttgcacttcatggcattggca

SEQ ID NO: 93820 - DNA, 1234 bp, Oryza sativa
gctcacgagtttatgcaaattttaacattttaaaaggaaaaaaaatatgttttctatttaaaagatccaaaagtttgcacccgcaacaaaagattgcacaagttaaagaataggacaatcgctaccgtagcctgttggagtcacctaccgtctagaaggatgcttttttatgaagagaaaaacatgccgctcctcctcaaacccaatcggatccagaattgcagattcatgtgacaagcatcaatcatcatgcctgacgtctgatcttcacaatggtaaaaaaaatgttgaacaattatttggtcagtgggaggaccgactggacagtaaccttgggtaatctgaccatccgaaggataggcagtaaaagaaactccattatgttcagacactataagcaatagaaatgttccatgagatgatcgcgatcttccgtgaaatgcaattctgaaagtctcagattttcaatgtgttccgtttccagcaggctggtagatcagagaaccctatgactgtcactgattcactgattttcaatgtgttcttaaaccggtagaatggatatgtagcctgaaaacaggacagttaacaaatcaatccaatttgggagcttcggaagcgtgtacgtgataatccatagtctacaagaaaaggaacagggcctaaacaggggtaaaaatcaatccaattttgcaattgatctgatacataaaatgcatgtcaaattatcaatactcaatatgtcatcttagcaaggacgatgtctcagtgtgaggagcgccagtgctgccgctgctgctccctgtcacagccaaagatgacgtgtagccaaaagcatcaatcggtggcaggaacgtcgccaccggcatcctcgccgggaggctcggcggcggcgcctcacccctcagcacgctgatggcctgcctgatcaccggcctcacgctccggtcagggtgcgcgcaccagagcccgacaaccatgacacgctccatctcgccaccgtcgaactcgccggtgagccgccggtcagcagcgtcaagaatcctcccattgccgtacaaatcccagacccattgagcaaggtggatccggtcttcgtctacctcggattggtggtccgccattatcggtcgccggccacaggcgatctcaaggaggaggacgccaaagctgtacgcgtcggactcggcgttggccctgccggtgatcatgcacttcgggtccatgtacccca

SEQ ID NO: 93821 - DNA, 825 bp, Oryza sativa
agagaggaagagagcataagtagatgacaggtgggtcccacaaatttttttataatatagtgctgattggactgccacgcgcacgtcacgtggaccaaaaccaccgcggattggatcgaggggggtaatttgtccggtttacatagttgggggtgaagaatacccagttttgtggttcgggggtaattcggacaaccgcgatagttcgggaggggggtaattcgtactttttccaataataaatatggtcaattatcaactgattgagtgtcgttttttaaagagatgctatcgattccaactgttttcatcccttgggccgtagcaacaccgggctgaaattgtcacagcgaggggaaaaaatggaaaaagaaaaaaaagaggaaaaggagaggtcgacgtcgatgtcaattgtcaagctcgatttgcggcggtggccggcggcgaggaaacaacgggccggagatgttggtcgtcggcgccgatgagtggcacggcagctggattgattgggccggagcccactggatcattaattacgcgtgcggtttggcccgaaccaactgcagggttgggtgcacgtactaaaattcttactaaacctttagctttagtaacagtcatattatggtggtttcatgttgctgaattcggtggttgtctaatacacattttgtcctgtaataaaacaatctaataggatgaaacataactgagtacaataaatcctgatagcatctaatttgttttataaaacggagagataatatatgaatttatagtggacatgtcacatgtgtatagggtaccgagctcgaattcgcc

SEQ ID NO: 93822 - DNA, 897 bp, Oryza sativa
ctcagcatagagcgaaacaatccttgaatagattggggtgcatttgatgttgccgctttcatccttcattacaatgccagggcggacttcaatgttctggttcaccctcaaaactccctataaaagaagcatcacaatttaagtcatacctaataacccaaaagtagtgataaaaaatctaattacatgacacacgagggaatacatactctgaggatgctgccaccagctacaccacccctaatttcatcaacctctgaaccaggcttgttgacatcaaaggagcgaatgacaatcatgtttggaggggaagtgaagttcctttcaggaatggggattttcttcacaatgtattcacatatcacatcaatgttatacttaagctgagcagatattggcaccaccggagcaccttcagctatggtaccctatagagaaataaaataacccataaacaaatagacagacagatgtacccatctacaagataataatggacagtagcaacctggatgaatttctggatcgcttcatgttgattcattgctgcactttcctggataagatcaatcttgttctgaagaataatgatatgttggagacgcatgatttcaaccgcagcaagatgctcagatgtttggggttgtgggcagctttcattggctgctatcaaaagcaatgctccatccatgatagcagctccattaagcattgtagccatgagaatgtcatgcccctgttaagaagaaataggtatgtattacatatgtaatattttctcattattgacttcgagagatcaaaaaataaaaaacaatatgcagtgacccataaaaatatttgagatgacatcagtttatacttcttatcgggtaccgagctcgaattcgccctata

SEQ ID NO: 93823 - DNA, 1314 bp, Oryza sativa
agtgcttcttatccatataccctgttctccaaaccctagcccaaactccatccactccatccactgtgtcgccgccaccagcatccactccgccgtcaccaccgtccccttcctcctcctcccacccgccgctgcgggcgccgctgctcatcaccatctccttcaccttctctttccccaccctcacgccgccgcccaccacgccgtcgtcctcctcctcctcggtcgcgcttcgatccccatcgccatggccttgggtggcgtgtccatggccatcatcgccatggccttgggcggcggcggcggcggcggaggcgggagcgtgaaggggagggacatggcggggagcggatgggcggccgacgcctgctgcacggcggcgacctcctcgacgcggcgctcgaggcggccaatgcgcgcatcggcctcgtcgcggaggcggcgcacgccgtcgagcacgtggtagggtcgtggcgggacagccaccgcgcgatggcggtgtcggcggcctccatacggcgggccagctgggcggtgcgttacatgttccaccgccggcgccaacagccgagcggctagcagatcaggtggcgatggaaggccagcgccgccgccgccaggaggaaggcgatggagggcgcggaggtggaaggggagggcaaggggaagcactggatggaggatgacaaagtgggccacgtaagctattccccgagttctctcactaaacgccactctgctctttgctcttcctccaggaccccaaggccatcaagatacggcggcacgccttccatctccaccagtgcgtcgccgcctgccctcccctcctccgaattccttggctttgcttgcgagaatttgaatcggattgacgaatcgtgtgcttggttggtttctcctccaggtcggggtcaaccacgctttccgcgtcggcgctacgtactcctgccgccgggatcactggcggagtcgccgccgcttctcgatcgcatctgcttggctcacggccactcagggggagttgcgcttacctccgcgtcgctcgtcgagccgttcttggtcgaggagcagcacaatagccccagccaggttggatttagcttccgcaccagtgtgatttgaggtgtttctactttctaatgataatttttttttggttgcttgcaggatatgcaaccgaggttggtaccagaggctcatcttgatgtgctcgttgaggtgaggatagtaaactgatgcatatcttcgggagcattaagactcgatatcaatgtttgttaaattaaggatacataggatcatgtgtgtagg

SEQ ID NO: 93824 - DNA, 831 bp, Oryza sativa
tgcaagcttggttatgctaatgcgaaaatctacaaatgtgaagacgagaaatgcccacgaccaatgtgctacaagtatgcaataaaccactaaatggcatgatttgttctatgcaatgaacttccatttgtattaccatgttaaaaacacttatctatataaaattagttttccagttaatatctggtagaagttatgattaaaatctcatgattgattctccagaaaagtaacttataattatctgccattcacctacttaggactgctgctttgatgtcaagctaatgcatgtgagctctgcactatatgttgactttttttcctgttatataaagggcttatggaagtggaaaagaagatagccctcactgtgatgtgcctgggtttgaaaacactaggatgaagctactgagacatgtttcttttgttgattgtccggtatgatataaacctcttaccctttgttgcatatatgaatgttctttttctcaagacatttctctgagcatttattgtcttcctgaatgtttcatgatattactttatgtggcttttcactagcctgtatatttgttttaaaacattttgttccgtcaattatgatcatggggtttcacttgcattggtttttatatgcaaatattttttccactagaaggcacatggccatacaggagtgaaggatgtagataagaagtataaactgatgtcatctcaaatatttttatgggtcactgcatattgttttttattttttgatctctcgaagtcaataatgagaaaatattacatatgtaatacatacctatttcttcttaacaggggcat

SEQ ID NO: 93825 - DNA, 1408 bp, Oryza sativa
ctgagattgttgtgtgaatgtatttgattggatctgagattgttgtgtgatgtatttgatttgtgtgtgatgtgaatatgtgatgaattttgtagaagttgtgatgtaattttttttttaagattttgtgatgtatttgaatatttgagatgatcgatttgtggatttcaaggcaatttgaggatgattgatttgggattttggggatggaatggggtgaaatcaatatatttaaaaataatgaagaaaaaaaaataataaagaggaaccggaaagagcaaccggattagcctctttagtcccggttggtatgctttatctttagtcccggttggtgttaccaaccgggactaaaaatagatttttactcccgatttttttacccgggactaaagatagcgatctttagtcccggattcgtagttccggtttgaaaaccaggactataggggggttacgaaccggtagtaataaccctttcttcaccagtgctactagctttggatcagagtgtagatattggatccaacacaaaaggtaataagaattattacatcttgtgtcctgcctaattggtaattagtgtggcactcaacctaagcttagttggtaattatgaaaaccaagggtacgtagttcaggaggtttatgttctaagcaaccaaaattagttacactacactactcataccaatttccactcgctcgatcaagaacataacattctttgaattggaagtgtacacatcaacgacctgtccaggctagaaactgtagcaaattttataagtaggcctaccaatctagctagcagcttaattagttcacgcgtcataaaataaagtgagcatatagatcaccaagttgtcccctaagggtctctttgagaagcctaaattcccactttatttttgtagggtctcgtttgaaaaataaaaagcgacagcaaaaaactctaaattgcgaagtgagtatagttcaattggttagatttctcatggtgaaaacaacccacccaggtggacgggtttaagttctaaacttaacacggatgcttctatttacggctaatttttctttcaatggtaggcgtcgggtacgtactcatgacagcaagacgcccgtggtgacttcgttaattttaagataagttggcccagttttttttggagatgctcatatggttattttagtggtaggcacgagtgtccatcgatagcaaggtgtccatgatgactttgtcaatctcaagacatgtcgacccaatcttttaaaggtgctcgtaggagtgagtgtgcgtatgttgtgggtgtctacatttgtactgtgtgttttttataaaaaaaagacctctaattatttctaaaatttaaatttagctatggctggtgagagcctgatcatggtt

SEQ ID NO: 93826 - DNA, 1616 bp, Oryza sativa
cgagctcggtacccctctttggatgcaaacagaaaagacaggatagatggagaggcatcatcgctggtttatgtcaacggttctcatgagtatgttatatttgatccccgaagcaatgaagaattgcatattggcaagagtgcacacaaaaatattcaaactgaggagcctggtgagttatggtttgctgcatttattctaatcagcttctgtatacttgtatttttcattgtgttaacctgctcttctctacggctatatttgctggtggcaagattatatagtactccctccgttttaaaatgtttgacaccgttgactttttagtatgtgtttgaccatttgtcttattcaaaaaatttaagtaattatttattcttttcatatcatttgattcattgttaaatatactttcatgtacacatatagttttacatatttcacaaatttttttgaataagacgaacggtcaaacatgtaataaaaagtcaacagtgtcaaacattttgaaacggagggagtatatgaacatcatatcccaacattttctcatgctaaatgttttacgctccagaaaccattctcttttttaatgctagccttccagaaaccctttctgaatattgttgcattgtgcctggcaaaaccatttatttgcccctttttcttttgtactctaaaacatgttgaaaaaggctctgaagctcctttttgttattccaggaccaattggttatgcttctatttttggagaacttccgaaactggagtcaaagaaagatgttccagaaattctatttataccgtcagagagaccttgggagactatattcagtggatcaactcatgttcttccgcctctcacaaagttatgtcctgcattcttggcatcattgcttgagaagagaccagttgcaaatgagtgagaaagtgccgaagttttgtcccgtcatacaatgcaacaaggaaccctgctagttacaaatggcattgcacatgaaatccttatgactagtgctgcccgaagctcgtccaatactgctgaagctggttgtgggcattgattatctgtcagctcagctcacaagagaacacatgcgatgatggctacagcaacgctgttgggtgaatgagccaccctacctctttttgtaggtgatatctagtgatctatcttcagatcctagcaaattttgtttccataggctaatctgtaattctgatagcaaaaactagctctttttggtgaaaatgtaacgcgctaagatatccagtaacacggtgagtgaatgatgctgttttactgactctgaatgaagtgtgtgttgatctggtaaactgaaaactcgatgcttctttcagagtttcagttgtctgttgcttgcatacatgatggaatacttttttcttctagaactctataacaaccaggcaaataatttgtcttcctggaaaaaaggcaatcttgtcgattatgtactgatatctggcaggctaaacttagcaattgcattagatgccaaatattgccatataagtcttccagattcagaaattgatggctaagctgcactgacaagtacgaaatgcatgcaggcttgtgaacagtttcagtc

SEQ ID NO: 93827 - DNA, 2208 bp, Oryza sativa
ctccttcctcccctgctttgagctcttggacacccttttaatggcgacgtcaaggttcaactctttcaagaatcctctgtacactgatccgaacccgccttccccgagcttgtgctcgtcggagaagtcgtcggtggcgatggcgagctcgccaaagcggaatctcttcggccctgtccccttctcgaagtcgtcttccatggccgtctcatcatcgaagatgcccccctcttccatctcctgctccttcgtcaacccagcatgcttccgccgccggcgcaagacaaaccggactgagaaaccaagaaccaccaagaacgagatagcgctgacagtcaggcctgccacaagccccgctgacactgagggaggaggtactggcgtcgccggaatcggcggcggcggcgacgacgacaatggtgacggcgccggcggcagagtgatgttgaatggccaaaggtcgaacctcaggtagcagctgtaccccttaatgttgccagcgctttggttggtgtagtactggccgaggtcgtcaacgtacctcttcaggcacttctggcactcgctcccgctaggtccctcgtgcactgcgccagcccgtacaaccgcgacgtgccgagcttcgagtcgacgtacggcatgctgtcgttgaacagtctcagcttgttgtcaccggccctgtccgcgagtttgttcatcagctcccgcctcgtgtcgttcatggccgtcatgttctcgacgtaaagcccgttgaacgtgtaggtggagcgattgacttcgaccttgccgtaggtgagctcggagaaaaaggacgcatcggagtagcggaggaggcaggcgtcgtagttggccttgaccgtccggcttccggggcacacctgcttgatcccggcgggcgctccggcgaggcatttcttgcactccgtcgcgttgtagtcggcgtggcacatgataaggccgaatacctggtaggcagtacccgtcccgaccgagctggtgttaaaccaaccatcgtcggtggcggccgtggcgagcgtggagaggagctggtcgaggttcttctcgaactggttgcccacggtgtagttgccggtggtcgagcagtctggccagagcggctcttcgtagttgctccgagcaactgccgccgaggcaaccacggcgaggaggaagaggatgatgacaaggcgaggagccatagctggcgacgccttgaatttgctaggaacatgaatgctttggtcccaatttatcttggatgacaattgaagggacggggttcatgtgcagttttttcaaagagaactagtgttcgattacgcgttggatcatatagtatacactactggttggccacttggccagatcactgtttggtgtttgcaccgtatatatgtaccgtgaccgagtctgtctcgcggttaactaaaaggggtcgttagctgattggaatgaatgggtctatctctctagtaaggggtaatttttttggacaccattggcgataatgcataggaaccagtcagctttgcaattgcatagtaaggattacgtacgaaaatgattcggtccaccgcaaaagaaaaaaagaagaagaagaagacgactcggtccgtgcgcccgatccaacgaaaagtaatcggctgtgtttccactgctggagtgctggtactgctccctgtcacagccgaagatgtgtagccgaaagcatcaatcggcgctaggaacgttccctactaccgaacacgcttttcgcatacagttgagcggactgcatgaaagaaacggaaaggctaaaaaactgtcgacacatttttctctagaaatatgtcgatttctgatccattagatcaactgtaggattcgggctattttggttgacgaaaataaaattgtactgtaaagaatcgaactaggatctccagtggcttgtccagcggccctgaccaactgatcgagcaaagattttggcttgaattaaaattacatactaattacacttaaattgcatattatttacatatgtaatttagagacttacattgtaaatacactaaaattacatatgtaatttatagacttacatatgtaattttagcacttacattgtaaatatactaagattacatatgtaatttatgaacttacaatgtatgtacataccgactattttttttgtgaaaaatatggcgctataaatatagctgc

SEQ ID NO: 93828 - DNA, 4432 bp, Oryza sativa
cagctcgattacttgccatagtaagtatttctcctggttataattctgtcatatgcaggacaaatgtgccaaaaaccaactgaaccgtgaaaaagttcagtttcagcagcgtaccggatctcggtcttacattgcacatgcctatgtcgtggtaaggaaaaaatgatgatgtcatctagttggatgtagtttttgtgtttcctgatggaggtgtttagatccagtggagatatatatcttcatattgatagtggctctacataatgctatatgatttaaagctttagtaggctccctcttcatgtgagattatctgcagccctccctacatgtttttctgcagcagcgtgggttggccctctattcagcttttgctgcccttgttttgcattgtataggtatagcaatatgccattctgtagtggcatacctctacagtgcaaaacaaggacaacaagaggtggcaaagctctaacccctgctacagcaaaacatggagggagaatagcaggttatctcacactttgaccatgtaaaaatatgctcatgttttatccataaatttctatcagtttggtttgattgctcttgtcatgcttatgcttatttggggtgacatcaattaagtttatacatggcaaccactgtcaatgtttaacaaaaagaatcaatgtcaaccagaatgcttgttctggaggacatgtttttgtgttatctgtgtactttaacataaccattactcatgccatcatgtttctctcaacattgcagaagcaagaaaaatacaaagacagtgagcccactgcaattgatctctttaaggagttgcattgcagcaaaactaaaggttgcattgctgcttggtggaattttttttgctggctgctggcaagatatacgccgaaacttagtagtggctgctaggtggaattttttggtgcaggaacttggcactacctgtaggaactttgtagtcggctgggacttgtgtagttggatggtggatgaatcattttgtattcatgttttgtgcttttgtatggaaactgtattctggaacttgcttttgtatggggctggaaaattaattatagctagaatgtgattgtaatataattatagaaatggttgtggtttatattctatgattgctttttaattgggctggcccataatataggctagaattgtactattgggctataatgaaaaaaacgtaaaagcaaatttgtagctgggtcaaaaaaaaaaatatttgggccaattgggctgattgtaattgaaaataaaaaagcccatgctatatggcccgaatgtgaattgccacgtcatttgccacatcgcctgcccttgtcatttgcaacatcacatgtcatcatatacgtggcgctattcggttcaatttgttatgacgaatttgtctcgtcattcatcaatgacaggagaattatcgtcactgtatcaatgacgatgtcctctggtggtcacagaagctgattagtgacccaccttctgtgatgacagccatttcgtcactgcaggcagacagtgacaggaaataagctgttatcgtcgtaatgtaatcgtcatagaagcccagaattcctgtagtgtatagtagtgtgatgaacagcgtgggcgcgagatgtttggtgctgcgatgaagcggcagcttttcgttttctcttcgattgcaatatatagaagtaacaagaacaagggtagctaggcacgatgccatcaacctccactaagcataccacggtcaacagaccaaactagaaaacatgaaagataaaaagtaactacacatacatctccacgcatgatatacggattatcgaacttatcaagcaactgtcccagtcgtcctggatgactgagttgtgtttgtgctggtgctggtgttggtgttccctgtcacatatgaagatgtgtagttgaaagcatctactggggacaggaacgttgccaccggcatcctcgtcgggaggctcggcggcggcacctcgcctcgcagcacactgacagcctgcctaatcgttggcctcaggcttcggtcagggtgcgcgcaccagagcccgacaaccatgacagcctccatctcctcgccgttgaactcgccgcccagccggtggtcggcggcgtcaataatcctcccattgccgtacaaatcccagacccattgagcaatgtggatcatgtcctcttcttcatcagcttgccgttgcggcgccattatcggtcaccgaccacaagcgatctcgaggaggacgacaccgaagctgtatacatctgactcggcattcgccctgccagtgatcatgcactctggatccatgtaccccatcgtgccagctagcaccgttcgtgtgggagccccggtcgtggtcgacaagcctagctagcccgaagtcaccgagcttggcattgaaggcggtgtcgagcataatgttgctcggcttgatatcacggtgcgccacacactgttccgactcctcatgttagcacagaagcgctgatccggtcccaagcacgatctcgtgcctacaaattaatggagcaccgcttgttaattagaatgtcaaatatatgtttgatagattataatatagttagacaattaaagctataattgtagtgtgagattgagtccgcgcgtgttgggctatctaaatgtttttacagcaccttctgctgctagaggtagtagtgtagtttgtttagatctgaccattgattcttaaggctattttagacattagattaaagtattaattggagctattttaaccgaactaattctcgctgttctcgccgtcaaattcaatctctctcacggctagtgccaccagctaaacaccgcttgctatcattcttgcagcctgcattgcttaggacgaacatacacgaaacctggatagtgaagaactaatagtgttgatccattgattcagaattcagatcatacatataggtgcatgcaaatcctgtggacatatatatgtagaagcaagaaagctgaaactatttcatggatatagtcaatcatatatgcatgcacgaagaactcggttgatcctaattcctctcctaaaaagtaggcaagtaaactacacggaagaaacaatctttcaagagcattaccaatagattacctataatcttccccaaaaaaatgtttttaggtttctaaactgaaaataggtagtgaaaaaactcctccctccaacagatatcctaaattcaatccccaaaacttaaaaatgggcccttctgttaaactaccaacagaaatgttccgttttttttttctttcacagaaagatcgctatctcccatgcgcgggagccggaggagagaggcgggagtgtgagattgggagcgacgcgtccacatataaacggagcaaggaatcaggagaagggaactccaaaactcgggtaggagagtaggggatttgttggagctatttttttactaaaattcctcaaaatcagttttgggaatcagataaggtagactgttgttgttgctcaaagggaaccaaaaaaataagagatggttgccaaaattcaatcgggacggtcaatgaaatttgcaaaattatttacctgccatatgcatcttcttccaaatatatccctacacgaattctaccgtccatactacagggtatagtataaatgaatatgatccattgatctagatgaatggatggctcatattcatccaagggtactctaaaaaataatacgcctttaaatcggttagtgtgctatgatgattgggaaggaatgttcgatcactactgttagcaactttttgtgacaagttgataactacgatcgcagcacctaacgccttgcggtgattctagagtcgccaaccacctcaatctagcaaaaactagaccaagatgggttttgataactaaagcggctagcagagccgatttctagataactacccgtctcgtaggcaaaacgaaaggttttcaagacaaacctacgaagaggtgttgcactctcgcagctgcggcggacgatttacagcgcaaatagacaaaaatggacaaactaagagaaaactaaaagcaatatgaaaaacaattcgattgaatgattgtagattggttagttacaattgaaccggccatgtcccttatataggggttggtcttgccctctataggccctcctccacgtacaactcgggatagaatccaaaggaaacccgaaacatgccttcccgagcaaggaaacttcgagaccctgcgaaacagacccggactcggactctgccggtcagaccggccacacaccgccggtctgaccggccaacagatggcagtcagactggcccaattagagaaaaccggcagacttccaaactttggcaatttttcctattttatccctaggtacaaaat

SEQ ID NO: 93829 - DNA, 1335 bp, Oryza sativa
cagccatgcaggtcagcaggtgctggttgagtggttgtgatactgatgatatgactagatgattaaactatttttgcccctggcttctcatctttttttttttttgcccctggtataagtcataacctttttttttcatctgttctcaggcacaacaccaaccaaaggcttgcctgaccaggcattcctattccatcaaaacctcagggaggtctcaggcactgctcaggccgtccacaaaacatgcccttaacaacatggactagtattactgggatgagacgtggattgaagctcaagttatgaagaaatgaggtatactctgcctttagcaaatatctgtattgcaatattttcaagatatccatattattactaagtgtgttggtcatgtttgttactttcggttgcaacacgtgaatgccatgcacaactgattctcagccatgcataactgattctcgctgagatgtgtaaagatgatcctgatccaaagggtagtaggtttctcgcctacttcaacatggcaaggaaaacgattttcccagcattcagaatgtaaacaaacttagtaatgtaggcaaacttcagtatcgaccgtaggtgaattcacgcaatgacatctcttccaaactcatttgttttctcctccatctcacgaaaatagtgcctaggagctctctgcccttccacatttccttctctcttacctcaaactgttggtagacttctgcctaaacaactgcacttcagagcggacacggtggaacttcgagcgtcgtgccagcctggatctggccccatccgatgagtcgccaatgcttctcaacacgacggctaagggcaaccttctcacctttgcttgtgcagacaggggcagtgagctgaagtttggcaagatcgttcttgacagcaaccacacgagcaccagtcgacatggatccgatgttaagcatgaggatttcacccttggtgagcttggagaccttcccagccttctcagtaccttttgtcctcacacccaacagcctccgaagaaggaagaagttgatctgcatgcatgaaagtccagatttaagcaatgaatgttttattctcactaaatcttgatgcaacgaagagttgacaaacctcaagctccacatagacatcaggaagtgatccaacttcacctagaacctgaccaaccagtctatcagcacgtgtcaaggttggatccatggttgttcccacaccaataagacctccaggcacagcaaattggagctcattctgctcagcatagagcgaaacaatccttgaatagattggggtgcatttgatgttgccgctttc

SEQ ID NO: 93830 - DNA, 648 bp, Oryza sativa
cggcgccgcgctgatgtacctgcaccacgaggcggagcagcgcgtcgtgcaccgcgacatcaagccgagcaacgtcatgctggacgcgtcgttcagcgccaggctcggcgacttcggcctcgcgaggctcatagacgacggccggcgctcgcgcacgacgggcatcgccggcacgatggggtacatcgacgcggagtgcttcctcctcgccgggagggcgagcgtcgagtccgacgtgtacagcttcggcgtcgtccttctcgaggtggcctgcggccggcggcccgcggtggtcatcaacggcggcgaggacgcgatccacctgacgcagtgggtctgggacacgcacggcggcgccgccgggggcggcatcctcgacgccgccgacacgcggctgaacggcgagttcgacgtcgcggagatggagcgcgtgctggccgtcgggctctggtgcgcgcaccccgaccgcggctgcggacgtccatcaggcaggccgtcagcgtgctgcggttcgaggcgccgctgccgagcctcccggtgaggatgccggtggcgacgtacggcccgccggtgtccacagcgtcggcgccccccatcaacgacacctccgcaggacggtaggaactatggtttccatggccgccggac

SEQ ID NO: 93831 - DNA, 3582 bp, Oryza sativa
gggccaaatttggcccaaaagaaaaggaggattatttttaggtttttctttttaataaactttgataattgtttttgttgcttaataattgtttccggtgctctgaaaattcaagtaaaatttgagggctccttttagaccaaggagaatttaacaaaaattctccgggccacattcgaatttttcttgtacgtattttagtgtttgccattttctttttgaattttaattaattctattattccttttagcgaatgatttttaatttcgggatgaatttatcaggacgtgacaggatggcatgaatccttttggagagatgagcagcggccatagcacttggcccgttacgatgtgtatccacaacctcccctctggctatgcatgaagaggaagtacataatgatgccgattattattcaaggccccaagcaacctggtaacgacagcgatgtgtacctaagaccactggtcgaagatcttaaactgttgtggaagaaggaaggtgtccccgtgtgggacgaggataaacaggaggagtttaacctacgagcgctgctgttcgtaaccatcaacgattggcctgcacttagcaatctatccggatagtccaacaaggggtacaaggcttgcactcactgtatggatgaaacagaaagtacgtatcttaagcactataggaaggttgtgtacatgggtcatcgtcgattccttgcagcaaaccacccgatacggaagaaaggcaagcactttgaacataaggtggaccaccgtatgaaacctaaatatcgcagcgggaaaacagtgtttgctatagttaaaaatcttaaagtagtgttcggaaaggggactagaaactagcctatagagagcgaagatggttacgcggcgatgtggaaaaagaactctatattttgggagttaccctattgggaattcttggacgtccgccacgcaatcgacgtgatgcacctcactaagaacctttgcgtaaaccttcttggcttcctaggtgtatatggaaagtcaaaagatacactggaagcacgtaatcatctgaagcatatggaacaacgcggcgaccttcacccggaaccaaaggagaaaggaagccattacttgagtccagccagctacactcttagtaaggcagagaaggaaagtatgtttgaatgcttggagagcataaaggtaccgtctggatactccatgaatatcaagcgaataataagcacgtaggagaagaagttcaaaaacctaaagtctcatgactgtcacgtgttcatgacacaactggtaccagttgtaataaggggtatccttccagacaatgtccgggcaacaataacaaagctatgtgcattcatgaacgcaattttgcagaaggtcatcgatccggatagattagaagcccttcagaatgatgtggtgcagtgtcttgtcagttttgagttgatatttccaccttcatttttcaatataatgacgcatctgctttgtcaacttgtcaaagagatcagtattctcgggcctgtgtacctccacaacatgtttcctttcgagagatacatgggcgttctgaagaagtatgttcgtaaccatgctcgtccagaggcaagcatcgccaaggggtatggaatagaggaggtcattgaattttgcgtagaatttattgaagaccttcgcccaatcggggtacctgaatcacgccatgaagggagactacggggaaagggaactctcggaaggaaagcaataatgacggtagacaacaatttattccgtaaagcccatttcacggttctgcaacaatcttcattggtagctccttacatcgaggagcacttggctctacttcgcaccagaaacatcggtaagtccgatgcatggattacacagcatcacattgatactttccccgtgtggctacgacaacatctcatgggtaacgagacgatcaacaaacaactggccttcctggtgaggggaccatctgggtcgatcgcgacattccagggatatgagatcaatgggtacacattctacatgagagcccaagacatgaacagcacgaaccaaaacagcgctgttcatatcgatgccatgggacgcgatggaacaactggcacgtattatggtgccatcgaggacatataggaacttgactatggtcctctcaaggttgactggtcgaggcgtaatgattgatgacagtgggatgacaacggttgaccttaacaaggttggatactcggacgaacattttgtccttgccaatgatgtaacgcaagtcttttacgtgaaggacatgtctagcaaaggaaagaagggcagagggcctaacgagtcgaagcgtcacgtggttctcccatgcaaaagaaaaatcatcggagtttaggacaagactgacgaggattacgatcagtttgatgggcaaccccctttcatggtgacgattgaccctagcatcctcctatcaaatgaagataccccttactcacgtagctatctcaaggagggaacaatagtgaggagaaagtacgtgcggtcaaccgtcaccgccgatgtattgccgtaattattgtgtatacgatgtaaactattttagatgtattgattatccatataaatcaatttttgtatggcatatgttaattacttatgattattagaggttttaacaattttaaatcatgtaattgctagttacatgcgataattagaatttttaaaagttttaagtcatgcatgtggcatttacatatgttacttagagtttttaacaattttaaatcatgtatatgctagttatgtgcgataattagaatttttaaaagttttaagtcatgcatgtggcatttacatatgttactcagagtttttaacaaattttaaatcatgcatatgctagttatatgcgataattaggatttttaaaagttttaaatcatgcttgtggcatttacatatgttaattagagtttttaacaattaatttaatatcattcatatgctaattatatatgattatttgaatttttattaattttaaatcatgcatgtcgtatgtatatacatatgttaattagagtttttaacaattaatttaatatcattcatatgctaagtatatatgattattagaatttttattaattttaaatcatatatttgcttattacgttttatccacttaatttactacaaacaacaataatttttcgaagtaattgtcattaatttttcgactttaaataattttaatgcattattttctattttagaaacacatatgtaatggatattaatattcagtgagcttatcagtagtcccggttcttaaccctaaccgggtttaaaaagaatttggaaataacgggaaaatatctttagtcccggttgatgagaacaaccgggagtaaagatatctttactaccgggactaaaaatctaggggtatatatattcccgatgcgcgccctcgtcttctccaccaacacttagaagttttttccccgatcgatctctctcggcttctccttcgccaccactgcctagggcatccccgcaccgatgctgccg

SEQ ID NO: 93832 - DNA, 1413 bp, Oryza sativa
agaacgggcagtccataagctgccacaagctttcctcttcactttgtatacccacttccaaccaatgatatttttgccttgctaaggaggcacaaggtgccatgttttgtttctcattaatgcagtatactcaacatccattgcatttctccatctttcatcagttaaagcctcatctaaagtttgaggctcacctgtagcagcaaacccagtatatttatatggaatggttccatcagtatataccttaggtttgcggattcctccttgcaaccgtgttttcggtgttgtaggttctccccctgtctcaggcatcagtatcgtctgctcgacagtactatcatcaggagtactacttgcatctgcagcaggagccatcccctattagattgattctttttgggacgcagggagtaggtgggcataattaaataggcttatgtgtgattagttgggaagataaagtaggtggaaaattaaatgaggaatgttgtaattggttgataagagaaaaataggtgaagttaatatatttggcacaaaattcaactgctagaagttgttatatttttggacgaaggaagtagtacgagtgcttactggtatttagaatgattgagaaatttgatgaatatcgttaggcattcattcttttatgggcatgagccggatcgaatcctgaatgtggtggatacttgtcacgccccgagctagtcccgacttgaattagcccgtgacgctccaaattaacctgttaatcgataccagtcccaagaaacagtgctggtatcacaggaagatagaatatcacagcaacagaggtctctttattatagagtaggagtacagtcatgttgggctgcggacagatcccgagctcacaactgcattacaaaagggaaacggaagccgggacttggaccaaacaacacaggcgcgacttgggaactaggccgaaaccctaaaactcatcgtaaccggcttgctcctggaagaactcctcatcagcaggatccgcttcatcttcatcagcaactgggggggaatatttatatagagcaagggtgagtacgggagtactcagcaagccaggggaaataagtgtttaatgcaggcttcaaggaaaggctgttgttttcgtaattgattttatttgaactcttttctaaaaacatctaggtgagtgcttctcaaacgacacggttgagacagtgcgtctcgtccggtcggagtatgtgcaatgtatcaatctttagaatttaaacaagggtggcaccccggcaacagctttttcaacggccaccccggccaacaactttttaaacgggcaccccgggctagctgatccattagctgcagatttttcaaacaccggaacccttttaacacagcaatttcacagccggagtcaat

SEQ ID NO: 93833 - DNA, 967 bp, Oryza sativa
  unsure (1)..(967): unsure at all n locations
cggcgtaggatggacctatgagatggnacagnacctcatcagggcggcggagcgcgtgggggaggaggctccgcggggttctgggcggcgcgcggcgccggtggttgctacccggcggagacggagacggtcgcggtcgcggtcgcggagcccccgcgccgcccgcccgcgcgcggagtcctcgcggcggcctacggcccgccgtgcccgtgcccgtgcacgtagcccctcgctagagatcatcgacgtcgacagcgggagcgacaggggcgtggtgcgcgtcaaggaggagccgcgttccggaagcgactcggactacaatggtgcgagaggtcgtgcgcgtgcgcgggcgcgggcgccggtcgccgccaccgccgcgaagaagaagaagaggaaacgaggaaaggaagctccaagcagagcccaggagagccgggaggttgtccgcgtcaaggaggagccgaattccgacggtaatggtgcgggaggtcgtgcgcgtgcgcgctcgccggtcgccgccgccgcgaagcagaggaagcgaggaggaagagaagccccaagcagagcccaggagagccgtgtgcccgttcaaatcaaggaggagccgtattccgggagcgattccgacggcaatgtggccggtggccgtgcggtcgtgccggccgccgacgcgaagcaggggaaacggggaaagaaaaccccaagcagaggcaaagggcggcgggtggttgttcgcgagacttccacacccgctgctccgtccaatggtgctccctccgtcggcaggggaaaaggtagagggcgtgggagaggtcgccagagaagcaagggcgctgttcgtggtcgcgctactccggtgaaaagagtgagcacgggtgttggttgagaactcggtcacgcttgcagancaggggaagttttttccaaaanntnngngnggnccatgggacgtatcaccaagcgcgcg

SEQ ID NO: 93834 - DNA, 663 bp, Oryza sativa
  unsure (1)..(663): unsure at all n locations
gtggggagtgagacctaactnnnnnnnnnnnnnnnnnnnncattcgcgccgcccgttgtttcccgcgcgcgcgtgccgagtggccgaccgcccggtcgccgccgccgtcaccctctgccgcgccagcccgcgcctgtcgcccgtgtcgtcgcgccgctccaaaccgccccgccgtcatcgccgtcgtcatcgcccggcccccgccactccgcgcgctagcctccaaggggcggaggcagagagcccctctccctctgccgagtcgccccgctccctcctccttttcccgaatcggcaaaggggcgagcccctttctctccctccttttcctctttttctcccctttttcccctctcgccagcgtcacctcctgtcgccgctttggacgctagccggagcgccagctcgccggcttgaccgcccatgtcggttcccctctctcaaaccgacattgccacccttttaaacccgtcttccccctcccttcctttcctctcccattcgcctcctcaccgttgtcgccgctcccgtgctctgccttgcctccgccgtccatcgccaagcgccgggagagccggtgcgttcgtggacgcggaaagggactccgggggcgcccccttcttcctctttctcggcccgaggccggagagatcactcccgcgc

SEQ ID NO: 93835 - DNA, 6059 bp, Oryza sativa
  unsure (1)..(6059): unsure at all n locations
aataacagcacttgtatacaaaggaagatatattgccgccagagtttctaagatgcattgtgggtatgcgaggtggggccatattctatgttgtatggnnnccacctattgaatgaattggttattagattggctatagatgaattgtagctagtagtgggctatactattaaacttgctctaaaaggtgcctttagttagaattccttgtaaatnctagtgacaaccaacactgtaccagattgtgccaatatattaccgaatgaagattttgaattacaaaattgaggtgattcctcaacagattctcatgcctcccatcccctcaacagagtagcctttgcaacccggttaacccccaaagtgaatgcccccatcctaaggttgcagttttgggatttgcacatgtccttgatgttctgaaaagcgttcttcatgtacttttggagctccctgttcaccttctcttcatcccacatgaagccctgaatgttctgcaccataggcgtagcacaaacatatgccattagattcatgggaaagatccaaagaaggcacaaaatcttctgttctattacctgaacccactcaaaatagctgacgaccacgccgcctgaatttgcatagatatctggcagcacaatgactcccttctttgcgagtatcttcaaggcagagagtaagctcaaaagattagaattataaataaattatcattcttgatgtcttgaggatattcatgttccttgaaggagagagagagagagagagagagagagagagagctcattgtggttttgagcttacctcatcagcttctgtatcagtgggatgattagccccctcaattatgaatctggccttcacttcagctgcattttctctgcagataactcatgtgaattagcaattctgcaacatgcagctagactaaggtagaaaactaaaacagaaaactccacaatacacagctaacaatttttggtatcatgacaccgcacacactaccaaataccaaggtgccaatatttatatgaatggaaacacaggaaaatataaagcaaatctcatttgcagtttacaaacctagaaactaccataggataaaaaaaaactgacgtctaagatttgtcctcatcaccccgagtaaaacttttactctcagatttaataataagtaaaaagttttattgggagtaaatgctttactcagaatatcttagacggtttatttttaattggatcctacgttagtttttaggtttgcgctacatatgaaatttgtactacatatttctttggaaacactacggcctaataatgagatattggaaaccaggtgaaaatgtagcaaaaacatcaatcaaattaccataatacgagattcttttatcaaatgcagcaatgcgccgttcttacatgttgagaacaccacccaaggcgcacgggacgagaacatcacattcatgcacaagcagctctgcagcgtccataacttctgcaccgtagaagtcctccaaagatccaccctcgctcctgtgcttcaagagagcaggtatgtctatcccggatttatttctgattgcacctgttacatctccaactgcaactatcttgccacctttctgatggatgagcttggctgcccaagaaccaacattccccaaaccctgcagaaaagattagtagttgatcaagtacaaagttatacaatttttggcatcctaatattaacatattgttaagtcaatcaataatgttgtcattgttacctggataacaaaggttgatcctgaaattgactcgctgtattcagtcaataaagcctcagtagcatacataacaccgcgaccagtcgcagcatctcttcctaaggatcctccaagatcctatatcaaataagacaataagttaagttaatgataaaatatgaagagtttgtctagatgaaataggtttttcatgactcatgtaaactcacaattggctttcccgtgacaacagctggggaggggccatggaactttgagtattcatctagtatccatgccatggtctgtgacagttgaaaataaaattttcagaaacatgtaaagaagaagcagagtatgaagacagcagatgataaattataaggcagatggaattggatgactcacctgtgcatttgttcccatgtcaggggctggaacatctgtattgatcccaatgaggtcatgaattttctgggtaaacacgcgcgttaaacgctcaagttcacttctactcagttcaccaggagtgcacccaatgcctccctttgctccaccataaggcacagcagcaacagcagtcttccatgtcatcagctgagcaagtgcattcacttcatctgggtcaacctgtccagggagaaaccttgatggttacaatactaatcgatccttctaaagacctactcttttggaacgcaagaaattttgtagtttctaaaggaattggcagaaaaacatcatctcctcacctcagggtgatacctgatgccgcctttcatcgggccacgggaattgtcatgctgcactctgaacccaacaaacgtcgccaaggtgccatcgtctttggggatggtgcattcaacctgaacacacaaatgccaatggttcagtgaagccgatgtgaaccactgaatcaagcatcaaattgcgagaaacagagaagcaggaaatcacacaaatcacacagagcatctatcaatcaatctatgcaatgcaagcagggaatcgggtaccttgatctcgcggagagggatcagaaggctcttctggagtttggagtcgaggccgagtagcctcgccgcctgccggaagttgcggctggtggcggctagcgcgttcatggcagcaccggagatcgccctctttttctcacagaattgcacgaggattcgacggaaaacaagcacaagaacgacgagaagctcacgagacggaaatttggcgaaccaaaggcgtgattttcatctctggaatccgaaggcattaatagctgagtgactttgaaagcgtgccgggaacaaacaggaactctttcgagaatacaaacaggaactctattaggctcggtgacacggcattgcaccgctggttagagcctaatagaattattcatcaagaaagttattctgcaagggaatcgttgaaagtagagagtttgtcgaagaagaaagggtgttttgatgctatctttctgcattattttcttcagttcagttggctggtggatcgaactgctcgagtcatatactagtacgagtcaagaattctcgacgttacacaagcaggacatctgtggaggcacaaagcacgtaacaagtcccggggatttccaattggatctgcagttctgcacgatatcgagaaggcactaaactgttttcggacacgtttttaatcaagtagccaaagtgttttttgctcagcgcagagcttagaggtcttggaccggcgtctcggttgaaaaaagaagcgttttgaaagcatggacctttgaacgtctgttctctcagttctcagttgtcacaaaatttccaggctttgcaccgtgcaaacacaagctaaaacgtgaagctcaccaacgtgtgattgcatggttgaacggtggtagctgcaaccagcgtttaccttaccgccggtaaccgcgcggttaccgggcttaccgcggggtacggtaatataaataccacggtaacctccttatattcaaataaattttaaaaataatttgattttttgataaattttgcacggtttttcgcggttaccgcggttaccgcgcggtaaccgtgcttaccgccggggcgcggtaaccccggcactggcggtttgggaaaccctggctgcaactagcctgagacgcgatctcccaaatacccaggacactgaaacgtcaatggatttcgcaaagcacagagctagttagtcaaatgaggactagtactgcaaccagaatgtagaagaagcagacaaaacaatcgccaactgggtatttgtaaaagcagtacaaccaaatgtcaaccatccattgtgccattgtgcagctcaagaacagatcatctcatggttcagtatacgagcttcagggtcatccattcgtgcatctggcctaggaactcaaggaagccctggaactctaagcaattaaaaaaaattcccctattctcaggccttgcaggtttttctacaatttctattcagtcctttgagcatctatagctgagcaaaattccaggcagcacagtatggcggtgcagacacattttcctctccacagataagaagcagcgctgcattccctaaattaagaaaacacataagtaacttgtatacgtaatttccagttaggatatagatgctgatcaactagtaacttatataccgatgtgcctttccatatacttaccaaggatatgcaacctccctacaaaaaccgtaaggctcagttacaagatcgtacatagtatgaagtatgaaccgagaatcttcggtcaggacatagggacataaaaaataaggcacatcttcatgcttccatcgctacagttctaacggtgcctagatcaccacaaaacatggtagcaattaatcccagtttcaacatttgagcaatcaacacttcaatatcagtcgcatagcctgacagtgaataatttattcacatcaacattcctgagcttaccatcctccaaaaattcaggtgattttcttcttgagaagccaaaaaaatcagatatggatgaaacttgagtccgcatgcctacttttccgcaaacaacataaaaaaggacaacaaagtttagtcttagatgaatcaaactgacattttaatctcaaaagaatcaaattgcattttagtctcataagaatcaaattaccagatttagctgtaagtttactgttagtgagaatggagaatcttcacaaacatgtctttgagctccctatgtgatgtcattgcttccaatatcttgtcattgaatatcacttcttgagacaagttgaatcctgcagcatggggttcttttgaaaatagcagtttggacatatgatccttcttagcttgcctatcatatttgtccttctcctttgtcccttctgtgattagattgtatgtatacacaatcttctcttgaccaattctataagctcggccaatcgcctgccttccaactgaagggttccatacaacatcaaggagaaccacacgtgatgccccgataagtgtaatgccttcacagcatgccttcgttgatgcaagcattaccttggcattgcttttcatgtcattgaaggcctccatcaaagcttctcgattttgaacaaggacatttccactcatcagtaggatctcctcaccttctgtccaattgaacattttactaagttggtccatgatcagagatagtggttcaagatattgactgaaaacaagtactcgctctttcatggcttcacacaaacggacaatttccaaaacaaattttgttttgactcctacgcacgggtttggccgtaagctcttcagcaaagagacatccacagaagatgtttctttttccgacagttttgcacatgtgacgaggaacgggtgtatagatgcaagggagatcttgtattctgcatcaagagtccccattgtcactgtgttctccattgctgtgatgatttccttttgatgaggaagaggattcagaatcacaactgattctctcaatcctggaagagacttttgaagaatgtcaccgttatggatgtgcacaattggatcgagtatttgccggatttcatctatctttttctctgttatgttattcagtgtcaaggatgtccagtaatcctcaaggcctattttcttgaaacttttagaagcgaagtgtcttgcaaactttggtctaatcaggtacaggacattagagagctcaagaaagcttttctgaaatggagtaccagatagaattattcgctttttggtgcgaacttcttcaagaaccttncatatgagactnttcttgntccttggtgtgg

SEQ ID NO: 93836 - DNA, 3534 bp, Oryza sativa
  unsure (1)..(3534): unsure at all n locations
gatgggcctttgaaatcagatctgcatgtagnncancatgaaaagcgtatagctcacaccaattatactgctccctttacgccatgatgccaacttcaactttcgcctaaatttgtgatccaatttgtttctagccaaactttgggccaaattttcatccatgatagccagctgtttgatggtcctgtcttctttccagttaatctccttggagttcaatacatgaaaagggaccttcaccttccattttctgaactcctgttcccatgtagcaagcatccctctgggagcaattatcactggacagcactcgggaaaaaacgcaaagtaggattgaacaaatgtgattgctagtctggtcttccctgtccctggtgcatgagaaatcacacagccaccttcaatagtgtttgcattgttcctcagctgttcaattgaagtcccccctgctagttttctccacatgaactcaaaaccttcttgctggtgcgggaacatgtcctcccggaccccaggaactagatcccaaaccaggccagtctttttaccaccaaaatcacgtggtccttcatatcccgctgatgttaggatatcatcaaaaaacaagtctaactcgtgatcttttctcatgtccctttcagtacaggactttacctattgaatgagaaaaaaaagaaaacatatataattttttgcaagataatagatgattaatcagaagaaaggcaaaagcatcagtcaggtgaagtataaggtctttgggaaacatgttggagtgtacggtagtagcttaccatggagggaagtacgaatctgatttcaagatcaacaaagttgcagtgcttgcatcgaagtcctatttgctcatcaataatgagctcatgcttcccttggatgcatgaagctgctttgtccgcagggatttcttgctcatcttccttttcaccctgaaaacaacgatatgagcatcacttttgtatttagatttttttactggagataaaaaaacacagaatttccaaaagaggtttacatttgaatgcatacaaaagttaatgtttgtcctaacatgctgagaggacaaacaaggcaactcagacctccctatagggaggctttacaaacttattctgacaaccacttcctgaggctgatggatatccacaaagaacattaagctaactcgtgtattagcaagggctattgatgatgcatttattttgcatacttatatgcatataaaattttactacaaattaaatgatactacagctatgaataatcttgtgaggcagcaagactaactttctttttaaatatatattctttcttttttctttttttttgaaaccgagcaagcaattgctggtgttatattaagaaaaggcagcaatatttacaatggtgcaagtaagcagttgcacttagaaagggaaacaaagcaagaaaaatgggactgcgactgcgccatacatatatattcttatgcaaacaaaccttttgtttcttaattactctttgttttgaatttttatgtacataaatatctattcatacacaaaagacaaaacagtttattgttctataaattaatgatcaatagtcaggtttggagcaggctgatttaatttcaataatagtttcagaatccaaaactagtcattagacacatttacttggcttatataagatatatatagaatccatcctagctattattcctgattaaataataaacctcacattaaagccattcaagaaacacaaaagtcagggctgatagcgcacttctattgacataattagaattatcattttagataataagtataattctaactatatttgcgtagcagagagcacgatgtacctcctcgcagttgtgagaacaaacatttatggattccaaagcaaaatcaaattctttccacagttcatcttcatcctgtaacttgtcatgtttggatttctcttccagcttatcgtcatccccaaatgcgaataccaggggcaatctcctgtcaatttgctcttcaggaacaggctcatattggttgctctctatttcattaaacatggggtcgagcaaatgaccatacttttcttggtctgccgttgcttgcctgcgcttcctcctctgagcaatctttacatttctcttgaaggatacaccaccctgtccattgagcccatttgtttgtctcccaacttttggtccattgtttctgacgcattgtggagtggagccatcctttttcttgttggaaccctccttcttaacctgcctacgaggtgctccttcttgtaccctcctagaacctgatccttccttgacatcacatacaaatgttgtatcctcctcgctatcactatgggcactttgcctcctgttcaatttcctcctcttcacagctctatgctcctcattgccatcgctgccgccatcgtcatccgcacaatccccaccgtacgccgactgctccggctgtggcacatcctcctccgaccccgagctagacacatcgatacaataaggcttcgcgaacgtcccacgcttgagcagtttcttgtccaggagtttcttgcgtttgaaatttgatcgtgtgcgagctctgatatccctgccagtcgaggtgtccacctgttgtagaaaactaaatccctcaaacatcctctttcccatcagcggcattgccatgattcttgatcggggaggagattcctcaccggcctcacccggttgatcaggtgcatcacccggttcctcctcctcctcgtcatcatcatcatcatcttcttcttcctcctcctcctcctcctcctccaattcctcttcatccccttcctcatcgctgaagttctcatcgctatcatcactggtttcatcttcatccgtacccaattcctcctcctctatctccgcaacatcgtccgtacctccaccttctcccctgattccaccattgccatgatcgttgtcatctgaacgaacctccacctccacctccatctccatctcctcctcaccttcttcttcgtcctcctcttgttcctccacttgttcttccttcacttgtgcaaaagctctcccctgctcttcttcttcctcctcctcctctcgttcctccacttgttcttcttcctcttgtgcaaaagctctcccctgctctgccaagcgtgaccgagttctcgaaccaacacccgtgctcacccggttcaccggagtagcgcgaccacgaacagcgcccttgcttctctggcgacctctcccaggccctctaccttttcccctgccgacggagggagcaccacttgaccgggcaccgggtgtggaaaatttccgaaaaacacccgccgccctttggctctggttgggggtttcttttcccgttccccctgtttcgtgttggggggcgggacgaacgcacgggcaccggccacattgcctgcggaatggtcccggaatacggctcctcttgatttgacgggcacaccgttcttctgggtctgttggggctttttttctcctccttg

SEQ ID NO: 93837 - DNA, 3015 bp, Oryza sativa
  unsure (1)..(3015): unsure at all n locations
cgcgatgtggttcgttcttttttttaacattctactatacttccctccctcccgccacctttacttatatttcttcntttattgnccgnctggccncccnccnnnncggtggtgatgactcggtcgcctttaccaancagcctatgcatacaggcagcccacgccttatgaagtcaattatcccacccatgatctcaagttggcagccgtggttcatgctcttaagatctggaggcactatttaatcgggaacagatgtgaagtatacactgatcaccaaagtcttaagtatatcttcacacagactgagttaaatatgagacagagaagatggttggaactaatcaaggattacgatcttggaatccactatcaccctggtaaagccaaggtggtcgctgatgcgctaagtcgcaaggcctatcacaatgtagctcaaatacggcctgaccaagatcacctgtgcagagaattggagaagttaaggctgaccgtggtacagtcaggtgtccctgccagcttgacagtatagcctaccctagagtcgcaaatccgggaggctcagaaagacgacgaagggataaaagaattaataaaaggaatacaggagaagaaagacaccaatttctccatagacaaccaaggcacagtttggtgcggtccacgcatctgtgtaccggccaagaaggagttaagagatctcatcctcaaggaagctcatgagtccgcctattccattcatccaggaagtacgaagatgtaccaagatatcaaggcatacttctggtgggctggaatgaagcgagatgtcacagaatacgtagccctgtgtgacatttgccaaagagtcaaggcggaacatcagaggccagttggtctgctgcaacccctaccgactcccgagtggaaatgggaagagatcggaatggatttcatcaccggtttgccaagaacccccaacggatacgactccatttgggtaatcgtggaccgactcacgaaatcagctcatttcgtgccagtgaaaatcacctatgatggaaagaaactagcagaactctacatgacctatgtcgtatgtagatttggctgtcccaagaaaattgtgtcagaccgaggcactcagttcacctcaaggttctggaagcagttgcatgaagccctcggaattgatctgaattttagtacagcctaccatccgcagaccgatggtcagaccgaaagggttaaccaaatcctagaagacatgctacgtgcgtgtgccttggatttcgaaggcacttgggatcgttgtttgccgtatgccgagttctcatacaacaacagttatcaggccagcattcagatgtcgccgaatgaggcaatgttcggaagaaagtgccgcacccccttgtgctggaatgaggtgggcgaagcactggtattcggtccagacatactcaagtcagctgaagaacaagttaagctgatacgagaacgtttgaagacagcacaccgtcagaagaattacgcagacaatcgaaggtgtgaccttgagttcgaaaaaggagatcatgtgtacctgcgggtatcaccactccgcgcgctagcctccaaggggcggagggagagagcccctctccctctgccgagtcgccccgctccctcctccttttcccgaatcggcaaaggggcgagcccctttctctccctccttttcctctttttctcccctttttcccctctcgccggcgtcacctcctgtcgccgctttggacgctagccggagcgccagctcgccggcttgaccgcccatgtcagttcccctctctcaaaccgacattgccacccttttaaacccgtcttccccctcccttcctttcctctcccattcgcctcctcaccgttgtcgccgctcccgtgctctgcctcgcctccgccgtccatcgccaagcgtcgggagagccggtgcgttcgtggacgcggaaggggactccgggcgcgcccccttcttcctcttcctcggcccgaggccggagagatcactcccgcgccgtcggcctctcgtcactgcgccccgtcccgcacggtagtgcctctctccgttcttcctcctcgctccatctcctccccctagctttcggtagtagcttgagtagactccccgtagttagccggcgccgccccgaccgttgccgtcgctcgccgtgtgctcgccgccgtcgccgcccgagctccgtagcacccgctcgtcgccggcctcgctcggcatagttccgtccaatccgacgctagcgtcgagttcccgacgccgcgtagatgctctcaccgccgggaatcgacccctcgtagcttcgtcgccgttttccccttctcccgccgccggttgccgcccgcaatgccgtcgagcaacctccggcgaatccgagccgttggttcgtctcccctcgtcacgaacaaccgcccggtgtgctcgctttgcccgtatcaccgtggttcgctccgccgctcgccgcgccgccgcccgccgtcctttcgcggacggatcgtcgtctacctcccgccagcccacgtggcagccacgtaggcgccacgtcggtgccagctcagccagaccgggtcgggccgaccccggtcggtccctccgcgtgcgcgcgatccaccgcgagccgtgaggctgcgcgtgggcccgccgcacctgcgttcaccgcggaccgcgcgcatgcaccgcgttcctttcccgcccgcgcgcgtgcaccgtgtgctccctccgcgcggtgagccgagccgctgacaagcgggtcccacccgggaccgcgcgcggtgagcccggtccaccgggtcccttttttcttccctcccgcgcgcgctctgggccgccttttgggcggccgggccattagcttggccgagccgcccaaatcccttgggccgacctaaccgcccgaggaaatctaaatttctccctccttctttttttttttttgcaaaaggggttaattaatccttttctttaggccaaaaatcaaaatctta

SEQ ID NO: 93838 - DNA, 5935 bp, Oryza sativa
gatttcacaggtgatctacatgtactactggatttgtggtccggtcagaccgggcatgtgctgccagtcagaccagcttgtattgcccggtcagaccggcgcagcccgcggtctgaccggccgacgctgtgtcggtttcggtttcgggttgtttatttggatatctgtgattgtttcatatttatggcttctagattgatactatgcatatgtaatactgttgtttgctactaatgagtcaagttggagatagcttggtctcgaaatatggtttctttgtttgtttcatgtgtaggtgactcgatgcctcgggagagtatatttgcggtgatggaccgggagtcgacttggtgggaaggagatgtccgtggtggtcagatatcatgcgtgatacttaggctagagttcaatgcacgtggttggtgaagattccatatggcggatacgatggaggtattgtgtgcgtatgggatacggagtcgaatttggaaggagtccaaatttggtatgattggttatgtaaagtttgtttcttatacgaaaaggtttcctagggggattaggacttctagtatgagtttggttcatgcctttaggctgcctacctcatgtataaatagagagggagcgtgaggcttcccggtatcgcttttgagagcaattgagttgatagtttacttagggtttcgagtttagtcgagatttttgtaaggagtgctgttgttgcactttgtaaacacagagagaatcaataaagtcatcatccactttaagagttcttcgatttgtgttttctcgggtgtggcggtccaaccgacgagacaccggcggtcagaccggcgggcacacggtggtcagaccggcggcggcgacaggtgctggcgattgacctcggcggttcgaccggtgttacaacctcggtcagaccgacgtgttctaggcggtcagaccggcacgtctacttcggtcagaccgcgatccatcgaatttgagggtaacttttaattccgataaaagttttggtttttgggtataccaaccattcacccctctctggttggcttagttcttgtgtttcgatcctacaaatctatgttgtttaacgctagttaataataaaagggagttgggggtttgtctcattacctatcgtccctttttatttgttgaacaaacttatggttgtgtgctttagggcagaagccggagaaaaaaatatcatcagctgccacagcatcatgatactcacatggatcgatcagcttcctgtcctagaagaggtgtacttatacaaccgcaaccaatggtgaatccagaacaaaaattaccatgggtcatatacatatcatagcgtatataaaacgctaatttttaactattagagcctgtttgaatcataggaaggaaaaaaacaaagaaataggaaaacacatgattctgacatgaatataagtgttaacaagaggattgcaaaacacaagaatgattgtttgattggaccgtaggaaaaatacaggaatcggatgagagagatagagtcaaaggaaattttccaagagattggagctcttgctaagtttcctccaaaatccacatgcaatgagtcattacataagatttggaaaccttcaatcgtttgaatcaaagagccaaataggaaaatttcctataggatttgaatcctataaaattcctacataaattctttgattcaaaggggcccttaatgtagttaatataggctaaaataactaaatattgaaattctacttaattaaggtcctaggttaacataggtcactgccactgactgcaattcacttttggaggtagtgagtgatgatgaagaataaaaggtgtattgttgcccctctctctatgatgagtttgttgtactcgtgccatcatttttaagaatagttaatattgcaagacgatgtcccttgctagatcatatgcctttgatgttttatgagaggcgaattttatagctgtaatcaagcaagcactcactggtggggttatatcatgcatgatctgtcagcatggagatcgtttgtcactcaaagaaaacatcagatgttgtgtcacggtcatgggacacctgcatcaagaacacgatgaaccgaacggcttcttcctcctctggctctcttccttctctctgctattcctcctagctcaagctttcatttctctgatctcccggtcccctgctttccaccaccccaatctagcttctaatcccactctaaacccctgtttctcccaaattgtatccctgacactttgatatatggtgttggagacttggagttggatcatctcagttgtgcttgtgttgtcgggtggaaatcaagatgggtacgtaacaatatggtatgagagcaatcgatcccgggttttccggtgttaagatggtgtgggagagcaacttggtggtggtgtctttggaggagacgctgaccacctgttcggtgaaatgccggaggcgactcaggtgccacccttcgcgtctccgtgagccacattgtctacccagtgacttctgagatgctgcatctagtgtacaatacccatggagcagtttgatgctagttgtacgttcctagtccatccaataattggaaagccctggccatatataaaattcactatcctaaagatttaagcagagtgtccatcttaatagtaggatctgacactagtctggtatttacactgtacttctaaaagagacaaaatgacctactcctaatggttcttacatgtacagagctcatgaaacacttctgagttctgacatttaaactcacctaaggtctcaggctaccagcaatatctaaagatgatgactcattggtgttgctggatgatgcttgtgctgcagtcatgctttggctctgatcacttagtgtttgccagaagttcctgcgctgaccgcttgagctcaggctgtttgcagcaaggctgaggtctgacagaaatggttgaagtggtatgtgcccctcaagcaggctcaaaactttggtcatctttggtctcagtgttggtgctgcattggtgcacaggagggcaacattcagcatgaggagcgcctcttccgttgagtaatcggagcctaactctggatctaccagctccaggagatttcctcgctcatgtagaacacaagcctgcaactcatttaggagagaatacttttgaggtatgtacaatgtgaatgtagcatgaattgggaaatttaagaatttcggtttgatgaaaatactgtttgctttaacaactttctaattaaaatgcttgttgtgttatctttgaaataaacaatatgttggacaaaattaaaccagtaatggatgctgtttgtttcaaattagaaaaaaaatgccatcacattgataactaaagatctattcctttggttagattgttacataagtcaggtataatattagcggagtttggatggaattcatcaatgtccagaagaagtttaagagacaaaatgccggctaagattgagctaaattttagtgttcataataaggttcctataaatgtgcttccatggtcatgcacagaacattattgcgttaattggaaattgaccaatgtgccagtaactggtaactggttattctaagcatggtttaggaattacccaatcgagaagataaacaaaatcttcctttggcctgtagcttgtgttactttttccactaacaatttccaaagcaacaaccccaaaactgtaaacatcagctttgtctgtcaaataaccacgcattgcatactcaggagccatgtatccgctgcaggaagaataacaacaaaatgattgagtcaaatatctgctctgtagttgaatggaattatttggaaggggcatggagagaagaagtaatctccatcaatagttgttcatatggaaattgatttcagtagtaagaacattaattcctttgaattgttagtctacatatggtggcatctatttgttactgtttttgtgcaactacgtgccttgtaggatcctacattttatttcggttttttactatattagctaccctcagagtttccataaaccatacataaaggtcgcaatgttcatttttatctaagttctaactgtcatgtcatttaaagacttcctattgtagatcaatgagacttgggacacgatcgaaattaaatttggggggaaagggggtatggaaatcaaaaagaaaacttacatagtcccagctattcttgtacttatgtgtgtgtgatcatcatcgttaagctttgctagcccaaaatcggagatcttggcactcaagtctttgtcaagcagtatattgctagccttgatatctctgtgcacaatccttattgcagactcctcatgtagatatgctaaaccccttgctattcccaggcaaatcttacgtctcgtcggccaatccaagctcagcctgtattgttcgactgtacctaatcacagaaattgcacatgagttctaacatgaaataagttaagaggggaaaccaggaaattagaaagtaagattaccgaaaagagcacgcgctaggcagttgtttcccatgtattcataaacaagcaagagctggtttccttctgtacaacagccataaagcttgacaaggtttgggtgctggagtgcagatatcatgcctatctcattcacaaattctcgattcccttgtttagaccttgatgatagctgtttgacagcaataatggtgccatcagacaacagaccatgccagcagctcaaggatccatcataagaattgtgtacatttttagataatggatattcattaatccggaagaattgtgtacattgccttatcagactgccgagtttaagcatggagtcagtgatgatggctgaccttgtaaactgaaccaaaaccaccttcgccgatcttgttggccgcatcaaaattccttgttgccactttgatttgtctcaaggtaaaggatccagtttggaggtcaaaggctctgagatctaaagagaaagagacagggatgatttatctgttcccacataaatatataaatggtttgcaatgctagcctaactactttaactggcaattgtttgagaaatcaaagcatcctaggatgggttcgtctggtatagtgtaatctcttttttttttagataatggattttcattaatccggcctctatatccaccaaggatatacacagccaaaaggatacacgagcacttagactcacacctcaacaaggagaagaacacacaaccaaaaaagaaaagaaaatcaaacgacctcgacacatgcaatttagattgttggatctattgctagtattgctgaactgttggaacaagaaagatactccaatatgtggaagatagatgccactatgtcattcatgcaaattgaaataaattgagcaatcaagctctcatgtcacctttatgcattgagttctttctcctccatttaatccaataaatgccgacaaaaagtgctgcgcacattgctaaaattggcatggcaaccaggaatgctttagatatccttgaaagctttttgctacctccaatttgcggtggttcaacagccaaaggaacttcaaagtctgaataagcataatccaaaaccacaaggtcagtaaagaatataacatttttctttgaaaatcattatacaatcagtcagagttttgaagggcactgaatgtgttgttcaacgctgtaccattgctcatagtgattaatgaaacatgtcattcaaattcaatagattcaaatgtcaaaatgccatacttggtactactgatattgcagatatcagaggaccataatatcctctttttggaatgcctgttgtcccccttcctgcccaataaaaatgaatttccagtgtatgatttgtgacgtt

SEQ ID NO: 93839 - DNA, 1238 bp, Oryza sativa
tgagtgtaggagttctctaccctgcttttcttgcttgcacaactagttattatgatatgaattttgcggtactcatgcctctcatgatcattttgcaatattcttacaggtcttgaattatctggatgataggtgcagagttcacaaggaaacaatcaatctctgcaaaagcgtactgcagcgtaaatccattgactggatttcagtgcagcgaaatgatatgtctaatccaatacatgatgtggatcttgtgatttctgttggtggtgatggcactcttctacgggctagccattttttgaatagctcaattcccgttttaggtgttaattcagaccctacttgtcctgatgaggttagttcttcagattattgtcaagaaccatatgatccatgtttgtcaagttgcttttggcatgcttccaagcagactgatgcttacctgtatgcttggttaggtttatatatagattattcctttgcaggttgatgaattaactgatgaatttgatgcaaggagaagcacaggacatctttgtgcagctacggctgcaaactttgagcaggtaactttccattgcaattttttttggagcaatccaattcttctattacaggaactcgtactaatctaaacattaattaatgatacattgaacatgacgattcccagatacttgatgcaacccttgatggtagtaggcaaccttcagagttgtcaaggatctcagtgaaactaaatggacttcagctaccaacttatgctctgaatgatatattggtctcacacccctgtccagcaagtgtatcacgattctcatttaggtattgccttcaattctttgcgttaattttttaatttttttaatcaattctgatgttattgccatctcaggaagagaagcaacactggagagagctcgcatttaattaattgcaggtcaagtggtctcagggttgcaacgcctgctggatcaactgctgctatgctatcggcaggaggattcgtgatgccaatatcaagccatgagcttcagtatatgataagggagcccatttctccaagggatgctgacaagccactgctgcatgggttagttaagcaaggtcaacacatacttgtcgtttggtacaatgaggaaggcgctgtttattttgatggttcacatgtaatgcattcaattcagcatggagatacactggagatctcctgggtaccgagctcgaattcgccctat

SEQ ID NO: 93840 - DNA, 1637 bp, Oryza sativa
cctgtggagtggagccgtctgcgccgtttattttattttccggtggttagatctttattgattgagaggaactatctacctctgtaatgacattttatttcgcttattaattagagtaataattggactatattatcaatttgttattgtgtgcctcggctgattcctggacgagggttcacacacatgtaagcgtttagaattttggatagaaattccgggcgtgacagacggcgcccttgctgaggtagctgacgcgcgggtcgaacacagggccagcctgccggtggcacgacaccgagcacaaggagcactgcagctaggtgagcgatgagcccatgtcgacgaccatcacggtagaaggtcgccggcatgccgaggcccaggtgggtgacgtagttgcctacggctaccgacgcacccagcgtcagcggcacggacgacaacgacgcctgtgagccgcgccgctggccttcttcttgtggtggccgtggaggagagacgaccacgccgtgcggcaggaggtatactcattggagcaggagaacaggaactgatgctcagattgacatggccagaattttatccagcaagaaagaaaatctggagaccgcgggatcaaagtgcaagaaggatagcaagatgctcttcagacattagtcatctatacaatagaaaaataggagacttgatcaaaagaagctctgcacttgaagatcagcttgcgactgccttggcgagcacagaacaggcggagaatatcatcgttgtttggcgaggcacgagacgaggtgggcgatgcgtgcgtcatcgtgtgtgatgacgacggagacggcgggagccatcaacccgatctacgctgatgtcgtcatcgacatggtcgctgcccattcgtccaggacggcggtggccgtcgtcagcgacgatgacgatggcgctcctccagcgttggtgtggcggcaaggggtggcgccgaggacgggctgtgggaggcgatctgggcgacgagcacgcgcaagtacccgctcagccttggccacttccgtcttctgcggtggctcggctacggcaacatatcggcagcgtgtaccctcctcgagctccgtggcggcggcggcggcgccctcttcaccctcgtcgagtttgtgcggaggcacggccgaccgacggggaggagaagaaacaaagagaaggaagaaggagaggagaagaagagaaggaacaagacggaagggatggaaaacgtgacggcgatggcacagtttcaattttgcaaaatttcaatagcacctaaggatatcatgaatagtaatggtatttttctaaactggcaaagttgcaatggcatggataaaattaagagacaatccattatacgccactgactttatcacacgtccacgatttgccgctgactttatcacattctacaatataccatcaacttttgcttaacttctacgatttactatcgccgtccggttagtctcctttaggactgtacaaatttgtcaaaatgaccaaaatacccatgggacaaaaaatttcaaattttggataaaaattctgaaatatcaaaatttaaatttttggccaaagtttggatgtttacaatcttatgtttataatatgatatt

SEQ ID NO: 93841 - DNA, 678 bp, Oryza sativa
aaaaagtaaatcttttattcaaaccaatcaattatcattagacgctttacttaaaccttttaaagaacaaattgatggttttcaaaagcgggtgaatgaagtgcatagtgagtctgtcaaaggtaacacaaaccttgaagcagaaattaaacgtgtgttacaaattggtatttcaatgtcaacagaaactcagaatctaaccacagccttaaaaggcaataataaagtcctgggtaattggggcgaaatgcaattagaaagtaccttacaagctgccggacttttagccaatgaacattatgtcgcacaagaaaacttccgtgatcaaacaggtaaacgctttgcaccggattttgtcattcatctacccgataataaacatttaattattgatagcaaagtatctttattagcttacgatcaagcggtcagatcagaagaaaaattagcgataaaccaagcattgactgagcactgtaaatcactacgaacacatattgatggcctttccaagaaaaattatagcagtttaccgaaagtctctagccctgattttgtcttaatgtttgtgccaatcgaaccggcttatattgaagcaatgaagcaagatccacaattattcattatggctatgaacgtaatgtcgttctcgtttcgcataccaccttaatgcccatt

SEQ ID NO: 93842 - DNA, 685 bp, Oryza sativa
agtgcttgtgtcgttgttgccttacaaactgttggtgcaattttggtcattacgatggtaattacgccgggtgcaaccgcttatttattaactgaccgctttcctagcttggtgattattgcagcattgattggcggtttaacaagtatgttaggcgcttaccttagctatttcctaaatggcgcaaccggaggcttaattgtttgcttgcaaccttagtctttttatttactttctgcttttctcctaaatatggcttgctctcacagtatcgaaaacgtttagaggtgacccacaatgactgatttaattaaatggtttagcgagccttttcagtttgaatttatgcaaatggcattattaactgccgtacttgttgcttcagtatgtgcggtattatcttgctatttaattctaagaggttggtccttaatgggagatgctatttcacacgccgtgctacccggtgttgtggttgcgaatcttgcaggattgccactggctattggcgcctttagttcaggtttattttgtgccatctctattggttatctaaaagaaaatagccgcataaaagaagatacgttgatgggtattatgtttgcaggcctttttgccttaggtattgtactttttaccgcattaccttcagaacagcatttaactcacctattatttggtaact

SEQ ID NO: 93843 - DNA, 526 bp, Oryza sativa
gtacacgactaatcaccagttcattttcggcgatattttttgtaatagttgcaccggcaccaattgttgcgccatctgcaatgttcacgggggcaatgagctgtacatccgatccaacaaatacattattgccaatagtcgttttgaatttatttgcgccatcataattacaggtaatgactccggcacctaaattgcaattttcgcccacttcagcatcgccgacataagctaaatgattgacttttgagcctttaccaatgtgagcatttttaatttcaacaaagttgcctacgtggctttctgcttcaagcttagctccgggacgtaaacgtgcgaaaggccctacttgtgctttattgccaataattgcattttcaaaaactgaataaggtttaatatctacatcatcacccaccacacagttttttaaaatacagcccgcgccgatacgtactctgttacctaatttaacttcaccttcaaggattacgtttacatcaatttgaatgtcttttccgtattg

SEQ ID NO: 93844 - DNA, 709 bp, Oryza sativa
cgtaaaagattcgctcgccctattgtggataaagatcggccggatattcgtattcacgtttatttagatcgtgagaagctaattgtatcgctagacttaagtggcgaagcattacatatgcgaggctatcgtgaagataccggtaaagcaccattacgtgaaacccttgctgcaatcattgtgttacgttcaggttggcaaaaaggaacgccattagttgatcctatgtgtggatcaggcacgctattgattgaagcagctcaaatgcaagcgggtatcgtaccacaattacagcgtaaatattggggattcaacgcttggaaagggcatcagcaagcgatatggcaacaagtattagaagaagcacattcgcagaaaaatactcaaattgacccgcttttttatggttttgactcggatcatcgcgtccttgctaaagcaaaacagaatgctcaaaatgccggtgtagcgcatttgattcattggccacaagcggatattgcagcgttaaaaaatccgtgcctagatcagaaaggtacattggtatctaatccaccatatggtgaacggttaggcacaacacccgccttgattgcgctttattctgtatttggtcaacgattaaaacagcaatttgctggttggaatgtttccatttttagcggtgaaccatcattattgaactgtttacgtttaagatctacacgac

SEQ ID NO: 93845 - DNA, 827 bp, Oryza sativa
gtgagtaagtggattgcttgctcacttttttagtgagcccaaccgttcttatttgtttttatccaaattaacaaagatgaaggaatttgtaaaatgaaacaaaaattagaccgattacttgtgcaggcagatattcagttaactgaacggcaaaaagaacaacttattggctttgttcatttattgcataaatggaataaggcttataatttgacctcagtgcgcgatccagaagaaatgctagttaagcatattatggatagtttagtcgtcagtgttcatcttcaagggcaatcttttattgatgttggtacggggccgggattgccgggtattccgttagcgattgctaatccagataaacagtttgtcttgttagatagcttaggtaaacgtattacttttatcaagcaagtattacgtgaattagccattacgaatgttacaccggtgcttagtcgggttgagcaatataccgcacgtcagtttgatggcgtattaagtcgtgcgtttgcttcattagatgatatgttgaattggtgttatgccttacctaacgatagcggaaagttttatgcgttaaaaggtgtgtatgacggcactgaattgcaagcggttcaaaagccgattaaattagttgacgcaataaaacttaatgttcctcagttagtgggggagcgccatttaattgtattagcaaaatagattaatttttgtaagattaaccatattttctaccgcattaagcaggcttataatactgagtaaaccattacttacttgtatgaaattgttgaataattgtattaaaatataccaatgtgttg

SEQ ID NO: 93846 - DNA, 564 bp, Oryza sativa
ttaaatgcgtttgatctttataataagcatcttcagaaataatatcgatatcattggaatttaattcttctttcagttctttataaatggtagaagcaataaggcttttacctgaagcagaagcacctgcaatagcaataacgatacaagcttgattttcaatggtttctggcatagaaggttcctagtgtcagcgtataaatgagtgaaaaagtagcctattataccgtatttttgtaagtttttagctataattgaccgctaatttagcatacagaaacctaaacaatggcaatgctagtaattttccattgaatttataaaataaaaaacgtccaaactatttgtctgaacgttttttatttagattcaattataaataaaatttttcaatgaaatttaatttgctgtctaattttaaaactaatggttgacctgttagaatctcaaaatccataatttcagcatcagaaatcccgataatatgtttggcaagtgcgcgtaatgaattaccgtgggccgttactaaaacgcgtttgccagataataatgccggggcaattt

SEQ ID NO: 93847 - DNA, 655 bp, Oryza sativa
ctatttaataagctaaataagccccttatccggcatatacgggggattttattgcaaatatatataccattaattgttactatcctgttttatttgtcgaatgtaaaggtaaacggtatgacgagagatatttaagcgcgtacaacttgattaatcgcgtctttaatatcaaaaatgcctttttcatagagtgaaatcacaatgtggcgatttttgttgttatttaatatttgccgatctaccactgtttcctcaatggttttgtcaatggtttgtgcaactaattcatctactgaactagcaaagtttacgctgttattttcgtcatcttgtgtgcgtggaataaaagaagttaagaattgtgctgttggtacatctaaattaatattgatgcaaatgaatccgatgacatgttgtttgctattgcaaatagcgatggtgattgatttcatcaaaatacccccttttaagcgggtaaaatagggttttgaaacgctatcggtttgcatttgatgtaatgattttagtgctttatcggttaatggtgaaccaatttttcggtcagtgttatggccattagcgatataaattgcagagttttcaaggaattctagtgaatgtagtacaatctcacaatgttcaccaatcagtgcag

SEQ ID NO: 93848 - DNA, 1423 bp, Oryza sativa
acttcctatccaaatataaaaataattaattcccacttagcgcgagcaacacacatcaggcttagttaacctagtccttgaaagtgtgaaaaagaacaatagcttagctactgcgttttttcttcgctacaggttttttagtgactgacttattagtttcagtggctttttttgcaacttttttagttttctttaatggcgcgactgttttttgttgttctcgccattcatttaacttggctaataatacacttcccataggactaggatcgccggtaaataaagtagctaaaccattattctcaataatatgtcgacgcaatgctaaacggttccgtatgtttttccgctaaacgtagcgcacattcaatatattcatctacagtatcagcaatttaaccactctggtaaacctaagcgtttaaacagtccttcatcaatatgttcatgtacttaatcaccggttttacaaatgccgaccagtcctaaagtcaccatatcaataatgccattagtattcccaaatgggaatggattaagcatcatatcgcaattatgtaacacggttaaatattgatgataaggtgcgtgaggatatgctgtcgctgaatcgcctaaataggatttaataaaacgagcaatatgaggatgagtaacgccggtcgattgccctaatgcaaagtggaagtgaattttaactttagctcgatcacgaatcacttttaatgcatctagaaaatatggattcaacttcattgtagtggcagcaataccaatattaaccacttcaagattttcgcgttgcagatattttacttttttaggggctaaccccgatggtacgtaaggtaaagcatcttttggaaagggtataatgtttcactaaaacaagcctctgaaccaatataatcttcttcagcaatcacataatcaatgaattctgaatatgttgtggctgggtggcataatgcaatcacttgtatcggtgctagacgcgtattactcacaaaaatagtgcttaaatccattccaacgctaggcatatacagtactgctgctccgttttgtttataaatagaacgaatatgatctaatttatctttcatattgtcatcttctaacaaatgaaattcatcaaatactgcttgtccattagcatcaactgctttgctccccaaaccaattaaataaaaatgttcacgagcagcaatcattgaagttgaatgagtgtgataaatagaatgggttgaatggaaatgctctagtaacaccaccatcacgggcttatcattccgataaccaatgcgagttgtatcacgatcttgccaaccatattcattaacaacatggcgacgaataacatgatttaaagcttttttaaccgcatgcttattttctgcaatatcataactacagtgcatat

SEQ ID NO: 93849 - DNA, 753 bp, Oryza sativa
ggtttcaaatctagccctaaaagaaagtaatgaagatatttcagatgcaattgaacctcaaactagatcaagaaaacttgatgagccagagccgatttacggtacaattaataaatcaccagaagcaattgcacgagcaaatgcaaaagcagatgaggccatacaagctttaggctatgatccacgaattaaaccggttgtgcctgaagaggcacctccagcattgccgccgagaaacttgcaaactaaagctattagtgattacgatgatgtttcatatgtacctgacttcaaagtaagaaaaacagatgaaccagagccaatttacggcacgattaataaatcaccagaagcaattgcacgagcaaatgcaaaagcagatgaggccatacaagcttcaggatatgatccacgaattaaacccgttgtgcctgaagacgcacctccagcattaccgccgcgtacgcaatccttgatagattcaactgaagtaccaagctatagaagtgctttagctaatgtaaaatttgatgatgcatccccatggccacaaccaagtgcgttacgtagtaaggcttttgctgatgaaccttcatcagaaacgcctaagtctcgtggtaagcgtggtatttctaagaagtctttatcaaggacagttcaaccacgtagtagaaagatttcagaggaatatagctcttttggagcgtttaccattgcgtataatagataatgggtcagactatgctgaaatat

SEQ ID NO: 93850 - DNA, 602 bp, Oryza sativa
agtcgtcagacaaacagagccagaagtgatttatgaaaaaatcagagggcaacaagtagaagtagatgacccatcatcgttgtatgcgaaagtgaatagaaacagacgtttagataacgtagaaggtttttatccaccggaacagttacggacaagaagtgacaagttagcaaagcaagtgagtcgtgtaccgacaacagagccagtgtatgcggacttacgcttcaaatcggcggaggatgattacgcaccggcgctaccggcgagacggagctgggtaatgcggctggttttagaaaagcgaaggtaaaaggtgaagagagtgaatctacatggagtcgcttgaaacacttatttagcagggagagtggcaagaaagcacaagtagaaggaccggagataaaacacttaggcggagtggtagataaagatgcgttctacttccccttggataagatagtgacacgtcgagatgcggaaggagaaatccgagtgaacatggataacatcaagaaagcgtttaatccacgagacaagcactataacagccaagaggcgagaagcttaaggtcgttatataatcaagacccaagtatgtcagg

SEQ ID NO: 93851 - DNA, 790 bp, Oryza sativa
  unsure (1)..(790): unsure at all n locations
ccattagaaaattaagacggattggaacaatatccggaccccgcatganaaattctcgagtctcccacgtaaagcgcaatctgatttaggtgagaatgcattatcttatggtttacaaagaggcagacnagcattaatcagtaaagcgaatgcggcagataaagaaggcaaaaatgcgatattagcagacagttacataggcaaactgaatcttggttttgaatttggagaattaccaaaatttgcaaaacaagtgaaagatggcaaagtanccgagcaagatatacaaaatatcgcttcatttaatgacgaaacagctaaattagcgcgaagaagcgaaccaaaaaatcgtattaacgatgctaatgtagatgataaccaacgaattattcgtgagttaataaataatgaagcggcagttgatgcattaaaacggatagctacgctaagtgaccaagaaaaagcgatgcacagtacattaagagcaaacgaaaaatttgatatggatgaactagaggagtcccctaactatactactgcggaaaataaatcgattcgtgattataaagatacccagaaagcattaaatgatgcacgtatggacttctttaccgagaagacgaaatttatcgcgaaagaaacgctagaacgaggaggacagctttactttgcattagatggtttagtgacaaatagcccaggttttagagctgatacgcagattaatatggataaattgaagggtaccgagctcgaattcgccntatagtggatcgtcactcactgccgc

SEQ ID NO: 93852 - DNA, 681 bp, Oryza sativa
aaattaccgcctgaacaatgtgtcatcacgcgtaattgcggtaatgcattacgaatttgctcagcaatttgaaatgcctttaacgttgtattatcgccagcataaacaagataaatatcaactgcttttggtaaactcatcgttttatttacttcttgaacgagtaatactaagcgttctaatcctattgcaaaaccaacgccttgggttgcatgtccgccaagctgttcaactaagccatcataacggccaccaccacaaacggtaccttgtgaacctaaagcagaggtaacccattcaaatactgttttattataataatctaaaccgcgtactaattttgggttgacttcataacgaattcccattgcatctagcaactgacataattgtgcaaaatgctgacgactttcttcgtctaaataatctaataacttaggcgcatcatttaacactgcttgcaaagcttgatttttagtatctaaaattcttaatggatttttaactaaacgttccttttcttcatcattcattaacgcggtatgatttgctaaaaaatctactaatgctgcacgataattagcacgagcagctaaagaaccaatggagtttaattgcaaagaaaggtgttgctcaatgcctaatgcttgccataagcgcgcagttaagagaattaattct

SEQ ID NO: 93853 - DNA, 570 bp, Oryza sativa
tgacattaagctacttaggtgctgaacgtgcaattcctaactacaatgtaatgtgtttagctaaagcctccttagaagcagcaacacgtgtaatggcagcagacttaggtaaagaaggcattcgtgttaatgctatttcagccggtccaatccgcactttggccgcttcaggaattaaaaacttcaaggaaatgctctctgcatttgaaaaaacagccgcattacgtcgtacagtaaccattgatgatgtgggtaattccgctgcatttttatgttctgatttagcttcaggcatcacgggtgaaatagtacatgtagatgcccgttttagtatcacagcaatgggtgaactaggcgaagaataaataactaaaatcacaataaaaacggatgcaatagcgtcggttttttatcatcactatagccaaaacacatactaatttactcgctatttagttcattttattcagacaatttacaaaaaaatcctttataatgagcaacaactactatcgcacttttgtgtgctttttatacataaataagagaaattatgttccaaaacaatcc

SEQ ID NO: 93854 - DNA, 1856 bp, Oryza sativa
  unsure (1)..(1856): unsure at all n locations
acccaatttctcagctagttgagcattattacctaattcaggatgaacatctaacggcaaatgatagctaaataaattaatatcattcaataataactgctttatccgcttgcttttcattccacgaatacaaggcgattcatttttccaaaaatagccatgatgcactaatattgcatccgctttcttagcaattgcttgttcaattaacggcaatgaagcagtcacaccggtaataatgcgttgaatgttggttttaccttctacttgtaaaccatttgggacaaagtctttaatagcataactatttaatttttgattaataatctgttctagttctatatgggtgagtgccataatctttccttgtattgagaaaaagcggtctattttttgcaaaatagttcacaaaaatagaccgctttacctaaaatgtattaaattattcaagccagagtggtagtctagtttcaactcttaaaccaccaagaatacttttcattgcttcaacacgacctttatgttgttgagcagcatttgctnnnnnnnnnnnnnnnnnnnnnnnnnnnnnnnnnnnnnnnnnnnnnnnnnnnnnnnnnnnnnnnnnnnnnnnnnnnnnnnnnntatattctgattctggtacaccttcaccatcatcattaactgacataaccaattctttatcatcaatgtaaatcagtacagtgatactttgtttagcataactttgcgcattacgaattaatttttctacagcactggcaagaataatttcatnaccgttaataaaatagccttctacattatcaattcgttgctcaataaataagtctatttgattctgttctgcctcaaactttgcatcttctaaaatatcatcccaaattttattaattgagaagacttctcgcattagatgctgattaatttgctgacgtgaaagagaaagcaaatcatgtaccatcgtatctagtttcataatttggttatcaatacgcgttagctctgcagaatctccgttacgttgacggattagcgctgttgctaattgtaagcgcgcgagtggtgtttttaactcatgcgaaatatcagaaagtagtcgttgttgatattccgtcaactcctgtaacgaagtaatcatttggttaaaactacgacctacctctctaaactcatgaataccttccgtttctaattttgggttaatcgccaaattacctgtggctaccgcattggcacagattcgtaattcttttactgggcgcgcaattttccacgaaagccaaagtagaataggcacacttacaattaatacgatcataagcattagccaaggcgagtcaaaaattctattaaaaaactcttcctgaggatccactatctgtgcaaaatattgcatatattcgcgcttattagacttaaccaaaaaaggaccggaaatttctaaactaccaaagcgacgttgtaatggttcaagtggtgtttgtgcacgataaaggaaaacttggaatgattgaattctattagagtcagctcccgctccaacgaaaatgcgagttttggggtcgaataaaataatattaaagccattttgagtggctacagaaaggcgacgttcaaaaatttcatctaaattatattgtaattctgtttgacggctttcttgaataaaaaattcatgttcacctttttctaaacgtgagaatgaacgcgcatcgaaattaggaatggctaaggtaatagctaacataatagcaaatgttaagccaaaataggcaaagagttggtaagctagataatttctaacagattttatcttttttaaaaatttaggcatatattaaatactttaaaaa

SEQ ID NO: 93855 - DNA, 595 bp, Oryza sativa
aattaaatttttagcaaggggttgtttgataatagaactacgtcctgaaattgtgccatctacgcctgcaatagggaatgtttcaaataattgtaagttagcttcattatttgcaatatattctaatgcttgtaatagcgtttttgcattcacttgattatgtcttgataagcctgaaccatcgactaccacactgttattaaattgtacgccagcttttgattttaataactgacgtatagtttggctagcaaatggaaaagaagcggggcgatttttttgttggttagcaataatgcgaaataaactatcggcaatttgatttatccgattttttcatcatttttctcagtaaggttggtaatggttcagaattatgttctgcaagtaaatgcccttgttgtttattgagtgattcttgaactttgccattaaacgcaatgcctaaacgagttaagtttgctttgattagatttgcaccatatgctacaggatcttgcacagaaaaacttaaaccgaaaggttgcgtttggcgagccatacagccttttacgtggtagcggttattatcatttaccaccacatctaattgaca

SEQ ID NO: 93856 - DNA, 682 bp, Oryza sativa
tggcgagtgagtggaaaactgccagcttgtatcacttctatttcacctaagcgcgtaggaaagttttgcataatggttaatgctaattgttcaggtgataactgtgttagttcggcaatccgctgtggtgcatcgtaccaaacgacacaaccattttgatctgcaagcggtaaaaaagcacgtggacctgttggaaagaattgttgccaagtaacagattgagtgggtaaagcagttttaaccgttgcgagtaaacagtgttgccgatattgccagctagttagtccgatacctgcccaatggcgaacttgagagttagcgccatctgcggcaatgattaatgaggtagagaaagtttgatcgtcaaccgtaatcgtccagccagctgaatgatattcagcagtaagttcggcaaaaccaactatttgttggcagttggaatagaggttaagtgcctgccataaactcatttgaatgagcttattttcgaccataaaacctaaggtatctagaccaatttcctccgcagtaaagcgggtgctaaagccttcaacttcccaagtttccaagctatcgtaacggcaaacacgcattgcttggatctgttgccatacacctaattctgctaataaatttacggaagcaatgctaattgcagaaatacgtaagtcataagcagaat

SEQ ID NO: 93857 - DNA, 771 bp, Oryza sativa
aagcaaatgcttgctcaatttgtgcggaatcaacaacatctaattgaatacattcaaacccttcagcttgcaagcgctcaatatctgccgtttttctgcaacttgcaatcactcgccaaccctgttgttttaatagtttagccgttgcataaccaatgccagatgaacaacctgtaattaaaattgtttgcatcacatgatcctattacaaataactgacaaaaccctctgtattttctgtttcacgtgctaatgaaataccatctcttgcttccttaggcgatccaactaacaataaccctattattttatctcctgtttgacaaccaaaagcctgtcgcaacattttgccttctacccactgattactaatccaaacagtatcaaaccctaacgcattcgcagctaattgcattgcataagttgcacagcctgcactgatcatttgctcccaagcaggcactttttcagattgatgatctatttttgccacaatgccaatcataagcggtgcttgctcagcaattttatccgctttaagcgcatttttttcgtccatctcaaactcaatggccgcatccaccaaacacgcttttaacattgacatactctgtttttcaatcaccacaaaatgataaggcttcaatttaccgtgatcaggcgcacgtaatgcggctttaaacatatgttgcaattgttctgcgttaggcgcaatttgccctaattttttatttgaaaaaaaaaaatgtaataactctaatgttttcatgg

SEQ ID NO: 93858 - DNA, 892 bp, Oryza sativa
cgcacttaatgatttaaatgccgattgcaaacgttttaattttgccggtacatctggacgatttgcgatagctgaaataagtacattcatatcaaccccttgcaattcaactgacaaaatcgctgggtactctattggcaaaggctcatttggctttaaattcaataagttacgtaaggtttggtcccccacttttagagtagtgcgatagccaatcaaaccattacgtgcattcaaagggccttgcttggcttgttcaaccgctaagtgatcaattgcccccacttccattttattttctagaatatgattaatctgttcataatttttaatggtttgttcactaacattaatcacatctttcaaataggcaatttgataatagctagccacaacggcattaataatagaaagtcgagttgcttttaagtcttctatcgttgctttatattcccattccgacgcactagcactatcagctaaacgacgccataaatcaagcgtataacttaaattgaatgaggcattgtgtacaacatttgacgccttggtaacgctattagatgattgtaatgagccatcagaaaccaacaattttgatgccgagcttgaaccactaccactaaaagttggtactaaactagcaccaactaaattcgcattatatagcgctttattaaccaaaatagcacttttggctaagttaacattattagctaaggcttggctaacaagacgatttaactgcggatcgttataccctttccaccattcttcatcaatattaaactgcttagtcaattcttcatattgctggtagctggtttttgcttgttcaagcgagccatcttttgtcatactcgatgtacaaaatgacaaaaagcttgctaac

SEQ ID NO: 93859 - DNA, 929 bp, Oryza sativa
aaaggcaggggctgatatcttaaatgatattcgcgccttaacagaaccacaggcattaacaaccgcagtcaaactagcgttacccgtttgtttaatgcatatgcaaggtaatccacaaactatgcaacagcgccccaaatatgatgatgtgctagcagaagtcagcgattttttaaatcaacgcatttttgaatgcattacatcaggcattgccaaacagcatattatacttgaccccggatttggctttggtaaaactgttcaacacaattatattctgctaaaacacctaaaagccttcgccgattcaggctttcctgtgcttgctggtttatcgcgtaaatcaatgatcggcgccgtaacaggcaaaagcgttgaacaacgcacagcaggatcaataaccgcagcattattagccgtacaacatggtgcacggattattcgtgtacacgatgtagcagaaacagcagacgcattaaaagtttggcaagcaatgcaagattgtgaataaggaaatatatgacaactctcgtttatggtatcaaaaattgtgatacagtaaaaaaagcgctcaaatggttacaagcaaataatcagcaaccacaattacatgattatcgccttgatggcttagatgccgaatggcttgcacaaatggaagccaaatttggatgggaaacattagttaacaaacgttcaacaacgtggcgaaacttagatgaacaactcaaaaatagtttgaatcgttcaaccgctttacaactgttacaacaacagcctaccttgattaaacgccctattgtaattaaagacgatattgcgttgattggctttaatgaacaagactatcaacgcttaataaaccatatttaaccgcatccaaaaataattgaacaacaaaggtaaacctctgcaacatttcaaccgct

SEQ ID NO: 93860 - DNA, 756 bp, Oryza sativa
attagccgccattgaaaaactagcaaaagcagctcacaggtagtattccagattcattaagtttgacagaccaagcgattgccctaagttataccaatattacattacccgatagttagcgaaatgttaggcttaatcgatgatgatcaaccgcttgaattagtgatggctctagcccaagcaaatggcgatcaagttatggctattatccaaaacattgcaacaaaaggcattgactggcaacaattgctaaatgatgtggcagaaaccttacaccaaattgcaatgttgcaattgcttaaacaagaaacaccatcagacacgccattacatttgctcgcaaaacagataccacctgaagatgtgcaatttttttatcagttaatgctcatcggcaaaaaagaattagcttatgcaccagaacaaagtattggtgtagaaatggtatttttacgtgccttagcatttcatcctaaacgtactgaagaaattaacaacgtgcgcaactaaatcaagcaaataacgaacagtcggcaatggttgacaatacccaacataagcttgaacagctcaaagccaattttacacaagtaaccacagataaaacaagtgcacaagcggtcgaattttcaagcaaacgatcaataaagccggcgcaacaaactgtgccggctaatattacagatagcacaaataatacgctaatctcacccgcacttgttgcaatgcaagcgcggaaacaattacaacaaaagg

SEQ ID NO: 93861 - DNA, 631 bp, Oryza sativa
cataaaagaaattagaatggcaaaaaaatccgttttattgacccgctttatcaaaaatattttaagctatggcctgatctttattgcactaagcgtcataattgattggtatcgtaaaccgactgaaccacatcagtttgcccaacaagtactatacgatcttgatcaacaaccacgcattattgcacaattaagccaccaacaacccatgctactttatttttgggggacttggtgtcgctactgtcaatttacttccgctgcagttcaacaattagcgaatgaaaagattcccatattaaccattgctcttaaatcaggcgatgagcaagatatctctaacaactacttaacccaacaaaaatatacttttcctaccatcaatgatcctgatggtaacatcgcaaaaaattggacaattcaagctacacctacgattatctttataaaagaccgcaaaatcgttgaatatacaacaggactaactagctattggggcttaaaaagtgcctttggctagcaaatttaaactaaaacaagcggtctactttagcttttttgagcaaattagaccggttaatatgatgagaaaaaaatgatcactgttcaattatcaacaagaacgcgaaaa

SEQ ID NO: 93862 - DNA, 595 bp, Oryza sativa
gtttctgagttacgtagtattttaaaatgggcaagcttattacatgaaattgggattgtaatcaatcataatggtatccataaacattcagcttatattattgcacatcgcgatttaccggggtttgatgttgaacaacaacatttattggcgattttaatgcgattccacttaaaagcatttaaatgcagtgatattcgtagcactaatcgttatcaacaccgcgatattttaaccttattacgtttatttcgtttagccgttttattaaatcgttctcgccaagcggctgtttttcctcaaatattaacgcttaagacagaaaaaaatcactggcaaataagttttgatttagattttttaactaaaaatcctttagtgttagctgatttagaagaagaacagcaatatttagctgcattaggtttatatttgcagatcacttcgttaagttaaaatttgatctagttcgtatttttcctttttattgcttgttattttattaataaccttttaacctacttcaattggagtaggttttcattaattgcaattttatggagcaaaatgatacaaccatattccattattaatt

SEQ ID NO: 93863 - DNA, 562 bp, Oryza sativa
ctaaatgttgtttggtttgctgataacgcggcgatgatgctaattgttgaaaatcaatggttcttcgtttttttaaagttaagtatttttgttggtctaatttatttggttgataagttaagccattcagtacttcaattacaccttcaggttgattacaaagtagtagtaaatcacaccctgcgttaattgcttgctcactccgttgtagaaaattgcccattaaattagcaccttgcataccaaggtcatctgaaaaaataatccctttaaattgaagttggtgtcgaagtacttgttgtaaccagtatgtagaaccgctagcggggtgtggatcacattgtgtatataccacgtgagcaggcataatagcagacagtttatttttagcgataaaatactcgaaaggttgaatatcataattaaaaatattcgctttggcgcgctcatcaaaaggggtttctaaatgcgaatctgcgataacctgaccatggccaggaaaatgcttacctgtagtcgccatttctatttcacgcataccatcaataaaaccttcagcaat

SEQ ID NO: 93864 - DNA, 682 bp, Oryza sativa
ggaaagttatttacaattattccaaaatgtgagttattcatcagatattattttacccactgaaagtgcggatgaaatgcttgaacacgtgttggcattacctcggtcaggggtgatgagtgagaaagataactttggtgaaatgattcgcttagatcgagaatcagccgtattaatgacctattatcggaataatattcagcatttattcgttttgccgtcattagtggcgagtatcgttttacataatgaagcagcgtctaaaacattgattcgtgaaacggtgagccacatttatccattcttaaaagcggagctatttttacattttgatgaaaaagaggtgttagagcaagttgagctgatcttaacggaatttattcgtcaacaaaggtgaaatatgatggtgacgtgttaaccattaaccgtcgtcgtttgccaaccttgcaattacacgcggcggggatacgtgaaattctacagcgttattatattagcttaagccttttattggagtgcccagccattagtcgtactctattagaaaaaagagagcagaatgattgctcaacgtctttctattttacatggcattaatgcgccagagttctttgataaagcaattttttcaacctttacagccagcctaaaagcacaaggttattttgatctagaaggtcat

SEQ ID NO: 93865 - DNA, 521 bp, Oryza sativa
taaacaaaatgccaaaaaatgtaagccaaattcacctaaatgaaatgttaatgctgtctgagtgagtttcacaccttttaatgtttcactgccataattatctgacattaaaataataattgcggtacaagtacacaccacaatcgtatccacaaacacccctaacatttgaataagcccttgacttaccggatgttttgcatttgaggttgctgcagaattaggtgctgatcccatacctgcttcattagaaaataatccgcgcttaattcccattaacattgtctttgaaacaatactaccaaagaatccacccgcggcggcagaaaaatcgaaagcactatcaataatattagctaacacggcaggaacagcgttaatattcatacctaaaatagctaaagcaataatcagataaaataatgccattactggtacaattctggctgaaataacaccaatgcgtttaactccacctaaaatgattatggcggttaatacgactaaaatcatgccaatat

SEQ ID NO: 93866 - DNA, 561 bp, Oryza sativa
aggtctgaattatggcattggttttgccattatttttatgttgcattttacggttgctacaaaacagcctgcaatgaccgcttctcgttttgctgaggcggtcgaacgaaattcacaaggtagagcagtgaatatgaaattagcacaattattagtggatgtattgcgttcgcaaagtgcggcggtatttgggaatgtattggtgtcagtttatgttgctgcaggtattgcttatctctatgcctctcacatggggcagccgttgttaacatcagagatggtgcaatatcagttacattctattgatcccacgcaaggcacactgtggtttgcggctattgccggcttatggttgttttgttcgggtattatttccggttattttgataatcgcagtaattatttaaacacgcgtatgcgattacgtcagcatccagtgttgaaattattattaccacaacgcttacgtgagtgtttagctgattatatccatgataattctggatctattatcggtaatatatgctttggtatgttattaggtttaacgggggtgatagg

SEQ ID NO: 93867 - DNA, 522 bp, Oryza sativa
ggcggctaatatcgctggtttagcttcagaggtgaaacgtgaagcctacaatgctgatattacttattcgactaatagtgaattagggttcgattatctgcgtgataatctagcacacacaaaagaagaacgctttcaacgtgaattatattatgcattagttgatgaagtagactcaattttaattgatgaagcacggacgcctttgattatttctggtcctgcagaagatactacacaaatttatcaagcaatagataccattattccacatttaatttcgcaagataaagaagattcagatgaatataccggtgagggcgatttcactttagatcttaagaataaacaagcccatttgactgaacgtggtatggtaaaagttgaaggcattttgactgaaatggggcttatgcaaaagggtgaaacattatatcatccagcacgtattgcattattacaccacgtttatgccgcattacgaagcgcataaattatttgaggtagatgttgattatattg

SEQ ID NO: 93868 - DNA, 833 bp, Oryza sativa
tatccggactcaccttatcaacagcgcttaaatcaattaatgtttgagcgtttatatcagcaacaaaaattttcagcattattagcttatgcgaaaaccattgcaccggaaaatgctgataatcaatgtcgtgttttttctgcgcaatatcagcaatttatggcacaacaacagaataaagaagctcagcaaaacagcaaaaaaacgatttggttagccactatgatgcaggatttattggcacaatttgagaaaatgtggttaaaaacagcagaattaccacagcactggcggatattgaacaatattggcgggatcaaggtagaaaaaccgatgaaaatatcagattaaaagcggttgaattagctaagcaaaatgctaaaaaaggctttgaaattttggatcaacatcatcaaaattcggagttaagcgattggttggtagaagtcagcaaattaacggcaaatgtcaaatatttgccaacttttgttgaaatgcaactgcttaccacacccaataaagcgcttatattagctttttttccaaaatttattaaaaccctttcagaaacattagcacaacctaactttgatacttatcaagcatgggcagataaatggcagttaagcacggatgaactgcgggagtggaaaattgcgtttattagtcgtttatttgacaatcaagatccaaactttaatatttggcgggataaacaactatcagaaatacaaacagatagcttgattgaacgccggattagaatggcactctggcaacaacagccattagcacaatggttagcgctcctttcgagtaaagcgcaagaaaaa

SEQ ID NO: 93869 - DNA, 537 bp, Oryza sativa
  unsure (1)..(537): unsure at all n locations
tgagcgtttaatgcctgcatggcaaacatctatcgccgcttgtaaaaaacgcgcggcagaatggtgataatcaccttgctgaataaatttttttaaatgttgtttggcttcacgcgggtgaatatctgaaatgaccttaccctgttcgtctagtaatccttggcggtcgcaaaaggctattaatttatccannnnnnnnnnnnnnnnnnnnnnnnnnnnnnnnnnnnnaaacgccaaattaaacatttttccggttactgatggcgctattggaccaatcacgacaattgcattttgcgctaattgctgttgaatggcctcaatattaatccgtctatttttaccactcaagccataatctacgccgtcaatcacaccaagcggttgggcaagaatagcattactgctgactacattcagcaccggtgaatggggtaacttaagcgataagcgcgagaaaatatcataatgtaagcaacaaaaagcttgtttaatgatttcaagcatattgctgtctgtaacacgaatattatgatg

SEQ ID NO: 93870 - DNA, 542 bp, Oryza sativa
gcgttgcgcgccgtcgaacgcttgccagttatgtaccttatccgtctgcatgtactcaataaagcgcacaaactccgatttagttgaggagaagaagatatacggcggtcgggtgatattgactaagcgcaggaagtcgattaagtcaaaataatgcgcctgcttgtagctctcttgtttagtgcataaatagggtgggtcaagcacaaataacgtctttttggctgcgataaactgcgggagcaacgcatgaaacgactcgcttgtcacctcaatcccgtccaaatagccttccgcgcgcggatagtcgctttgacggatacaacaccaaaagtcttttttaaagagatcatcaaatgttgcaacctgctgcccggaaaacaacaaccagcttgacaagctcgctaaatctttggagccgtcaaatgcgttaattgttgcaataatcttagttttgagggctttgtctgtaatacgtttttgcgacggcacgtcacgcaacaacgcatgaatttgcccacgcaagcgggtaaagtcatcaa

SEQ ID NO: 93871 - DNA, 617 bp, Oryza sativa
ctagcgccgtttctttagcaaaatcacgtttagaacgtaccggtttctatgaaactgttgaaatgtcaatgccgaccgttaaaaacacggatgaccaagttgatattatttataaaataaaagaacgtaatacaggatctatcaacttcggggttggctacggttcaggaagtggtcttagctataacgcgggtatcacacaagataactttttaggaatgggatcaagcttaggcttaaatggctcacgtaatactgactccactaacgtcaacttaagttatacagaaccatactttactaaagatggtgtaagcttaggcggtaatattttctatgaagattacgataactcagcacgtaaagcttctgccgcttataaacgtaaaacctatggtgctagcggtaccttaggctttcctgttgacgaaaataactcctactatctaggcttaggttatactcatgataaattaagaaatgtagagcgtgaatatacccgtgaaaaatatgtgaattcaatgaaattcccgattaatccaaaaaattcccactatgatcgtattcagtcagctgattttgatttatcatttggttggatttataccaatttaaat

SEQ ID NO: 93872 - DNA, 733 bp, Oryza sativa
agacgacaacatcggcgtatatagcccgcttgttgaagaattgggtcgctccgctggcgaaacagcctgacgaattagtatttggcgcgttaaaaggcggttttacaaccgaatgctacgacaaacaatacttttttgacaccgaccacccggtcggcgcaaaccctgacggcaccagccctacttcggtatctaacatcaccgatgacggtacaagcgtgaccgcagacggcgcatggtatttgctcgactgttcccgtgcgttaaaaccgcttatcttccaacagcgcaaacctgcaacgccggcgcaaatgaccgacgccaacgcgcagaaagtgtttgaggataacgtgtacacccgttgcaacgtgggctacggattctggcagatggcgcatgcggtgaaaggcaaactaaacgccgagaacttatggaaagccattaaagcgatgcgcgcggtgcatagtgacggcggtcataagcttggcattaagccgactcacattgtggtgccgacaagcttgcaagaagaagcggttaaattgttggagcgtgaattgcgcgtagaagacggtgcagccgtggacaacgaatttaaaaacatgaagttgacattaatcgttgccgattatctgtaaatttcaaaagtgcggtggattttaaccgcactttaaatccaatttaaagtagttttaaacggagaaaaaatgcgatgtctgacgttaaaaaatat

SEQ ID NO: 93873 - DNA, 730 bp, Oryza sativa
cctctgctattgcatcttttgaaaagatgggttcaagaaacgtacaagcgaatttatttggtgaacaaattcaattaagtttaatttttgctcattataaaaccggtgaatattataaagcactaagcctggctgaacgttttgtacgtgcttatccaaacagtaataatatggattatgtacattatttagtcgggttaagtaatgttcgcttaggagataactttattcaggatttcttccatgtaaatcgttcttcgcgcacaattgagagcattcgtaatgcttacggaaatttccaaatgattgtgagaatttatccacaaagccaatatgtaaatgatgctcaacagtggatggtttatttattgaatcgtatggcagagcatgaattatctattgtaaaattttatgataaacgtgatgcatctgttgcggtcgtaaatcgtgttgaagaaatgcttcgtttttatcctgcaagcaagtcaacctttgatgcattgccttatatgcaaaaagcatatcagagaatgggattaaaagattcagaggcaaaagtcgcagagttgattgaaatgaataaagcaaaagtattccctaaaattactaagccagaatatagtaaacaattctaagtagttttatcataatattaacttaataaggggcgttatttgagataatgcccctttccctatttgattaatcagacgaacataatgcgaatttt

SEQ ID NO: 93874 - DNA, 976 bp, Oryza sativa
  unsure (1)..(976): unsure at all n locations
caactcgactaaaatgctcttctttaccgccaatcacttcacgcaaatgccaagcaattgcttccccttctctatccaagtcggtcgcaagataaatatggtcagcttttttggctaaggatttcaattcggaaaccactttatctttatccggtagaatttgataatttgctttccaatcgtgatatggatcaatgcccatccgtttaactaatgccgctcgcgctttatccgcttttacttttgctttctgctctgctgttaaacctttagttgagattggtttgactttttccgctttttcactaccgcttttgggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatgattttcccattaatgactatccacaaataaaataatgattgaagaaatttataagataatttcttattagttgatatttaatactaattgactcaaaataccggcaacaatagcaagcatttcgctaaaatacaatatatagataaagaaaatggataaactaaatacgcactcatcgccaataatggttatgggttacaataaaatactaattatccaatgccaacattaatacttttgacatacgttgataattataatggcgttgtttttcaacgggtaaatccgttggttgtatttgcacaaaacctcgttcttgaaaccattgtattgtttgggtagttaatacaaataatttttcaatatttaatttataggcgcgtcgtttaatcgcttctagtaaaatatcgcctctcgcagaatcacgataatcaggatgtacggcaacacaagccatttctgccattttctcagcgggataatgtatcaaagctgcgcaagcaattacaataccatcacgttcaataatcgtatattggctaatttccatttctaa

SEQ ID NO: 93875 - DNA, 531 bp, Oryza sativa
taaattacgcgagcaaggcaataccattgtcgtgattgaacataatttagatgtgattaaaacggcggattggatcgttgatcttggcccggaagggggggcaggaggcgggcaaattattgcacaaggtacgcctgaagacgtggctcaacaaccaggctctcacaccgtgcgatttttaacacaaatattggcgaaaggttaaggctattagccctatcaagaatgatgaaaaacgataaaattatccatacttttagtgaacaaggtttgctaagtagcaaaattaaaggctttcgttctcgtgccgcccagcttgagatggcactagcggtgggaaaagcaatcaattttgcgacatcagtggtagtggaagcaggtacgggtacaggcaaaacgtttgcttatttagtcccggctttggtgtcgggtaaaaaaacaatcatttcgaccggttcaaaaaattaacaagatcaactgtttaaacgtgatttacccaccattcaacaggccttgaaatataaaggcagg

SEQ ID NO: 93876 - DNA, 1055 bp, Oryza sativa
ttttcgtttactgatgggtgttaaagccagtattcgtggcaatttacgtgaattactggctgatcaaaaagtcgtaaatggcttaaccaaaatagcagaaaatatagaatttctacaagaagtgattaaaaaatcacttggtcgctcagaaacgttagataaaatcttcgaaagattggcggaagtcaaagttcaattacaaaaattgagtaatactagcatagttggttattgctattggtatgaagccaacgggcgttattttggtttacatatcaccccgttaaccgtggcagataaatttggtgaacaactcaaaaagcaacaaattggttgggtttttgcttcagcaactttagaagttggtggtcagtttgatcatttttgtcaacgcttaggcattgaaaatgcagaacaaatagtattacccagtccatttgattatgctaatcaatcactgctttgcgtgccacgttatctgcctgataccaataaatctcacacgttaaccacgttaggaaatatgttaatgcccgttattgaagccaataatggccgttgctttttgttgtgcacttcttattcaatgatgcgcggtatggctgattttttacgagaacatagccagcttagcgtattgttgcaaggtgaaacaagcaaagcgcgcttattagcacaatttattaccgaaaaaaatagtgtgttagtcgcaacgcaaagtttttgggaagggattgatgttcgtggtgatgcattatctttagttattattgataaattaccatttacctcaccagatgaaccgctattaaaagcgagaatggaagattgccgtttgcaaggtggtgatccatttaatgatattcaaattcctgaagccgtgattacgctaaaacaaggtgttgggcgtttgattcgtgatgtaaccgataaaggtgtagtgattatttgtgatgctcgtttagtgatgcgtcagtatggcaagacttttttagaaagtttgccaccatcaagccgcactcgtgatcttgctaaagtgattcaatttttgaaaa

SEQ ID NO: 93877 - DNA, 653 bp, Oryza sativa
acttattacttgccctgtcactttttctttcaaaagttgccaattagctggtttttgaagcgccaaatgatctttttcagtttcaacataaatcagcgctttgctcacaagccaatcatttcgctcaagtatgcaataacctcaggcactaaattattatggaatggcggatcaataaacacgagttcaaaaggttgttgcgtatttttttgtgcaaggtattgtaatgtatctgtattaatgacacttgcattagcaccggttaaatgagcaacattattacgcaacacgctcgcagcattcgcaaatttctcaagaaaaaccaccgtttttgcttgtcgagaaagcgcctcaatgcctaatgaaccactgccggataaacaatctaaacaataacatccggcaacataatgcattagccaattaaataacatctcttttacacgatcggaagtagggcgcaacccttcataattgaacacggacaacttttgttcacgccataattctgcaatgatacgaacttgaccacttttgcttattctgtctaggaagattacgagtttttttcatattatataaaggaaaaaattaccgattatttggtaaactaacttagtttagtccattttaaaaggaaaagtgagaaaaat

SEQ ID NO: 93878 - DNA, 528 bp, Oryza sativa
cgctatgttgtaaccgtgatgggcgtactattagttttagcgggcgtatttccatggttaggtgctataattgtttctattcctagcccagtattaggtggcgcgggattgatgatgtttgctatgattattgcagcaggcattcaaatgttagacaaagtggaacgttcaaaacgtaatggtttaattattgctatttctatcggctgtggtttagctgtgacgactcgaccagaattattggataaactacctaatttctttaaagaagtatttggttcaggaattaccgttggatcagtcttagcattattattaaatttaattttgccagaggataaacattaaaataattaatgtaattgggcaaagtagcttgaaattagcgaatagaagatttattttaagtagtgtgtaaacattttattatttttaaggaaacatatatgacacatcaagtaactgatgcaacatttgaacaagaagttttaaaatcggatttacctgttttattggatttttgggcac

SEQ ID NO: 93879 - DNA, 737 bp, Oryza sativa
gctgattttgctattttatagccatgcctaatgagtttttcagcgtccggcattaaagtcggtggattacactaaatataaataattcgctctggtgttaatgccattaaatgatctaaacaaaacaaggcaccttgacgagcgggatcgagtaatactttattaaaaggttgtgtagcccaatgttgatcaacaaaagattctgctaaattagtttggtaaaatgctatattgtttaacccgctagtttgctgatttattttggcttgcttgaccatttcctctacaccttctaccccaactacgaaacccgcttgttgtgcaatcggtagactgaaattgcctatgccacagaataaatcaagaatgcgatcttctgctgtaattgctagccattctaacgctttattaaccattttttgatttaacggctgattaacttgaataaaatcacgaatgcaaaaatgtaatgttagcccgttaatttggtaataaggtgcttcaccgcaaagatgttcaatgtgattctcatcacacattaaataaagcgaaagctgttctgcttttgcaaaattgagcaacatgtgctgatcttgagcatttatttttcctatatggagaaccaacatcgctcgcgtattatcagcgttaactagttcaatatggcctaatgcttttttcattttccagccagcaaataagtgttgtagtttgggcagtaatgtagaaaggggtac

SEQ ID NO: 93880 - DNA, 993 bp, Oryza sativa
cgtccttttcccgtgattcctgacgagaagaatctaactgaatatccatatcatcaattttaacgtgaatgttatccaacgatagtttttttaattcaatctctaacggaatattcaattcagtaaatggcttactttctacttttttcgagggcggaagtttagtgctatcaattgtaacgtgagcatctttcagtgcaatattttccacacaggctctacgatagattaaacattcaaaacctatatgtaaggtcgcttgcccaacattaacatttactccctccataacaaattgagtatctgataaagttaacccttgttggatactgccttctactttgccaatagttaatggttctagccatctatctactaatcgaaaagccgtttgttgccctttagctgtaaataaaaatagtaaaagaagaagcaataaggctaataataagcaacaggtacggcgaagccatcgccatttattttttgaagtcgattttgctggcgcagaagagtcagcaaaatgctctgtctgatgtgtatttggttgtttatgcataataagattgagtaattataattctgaacctaagccaatataaaattgtacaccacgtttgttattaagtgatttaacaggtgttgcaatatcaaatttaatcgcaccaattggtgaaatccaacgcacgccaacgcaagcaccagaatgtaatgcccgatgatcaaattatctgatattaaaccggtatcataaaaaatgccagccccccattctgggtaaatcgaatattaatatcccccggtattggtcattaagtgtgaccgccttattactttcccccttttaggttctttaggtgaaatgttttaataaccaaaccttttaaggttcatatcccgccagcaaaatagggtaatgttggcgggatttaatgaaaatctttagtatgaacttgccctacctctccacccaaccataacctgtgacgatct

SEQ ID NO: 93881 - DNA, 926 bp, Oryza sativa
cttctgcttgtaatgaaaacgaaaaaagcggtatcaaaaaacataaaatttgctaaaataattggataatcgactgcttactttttaataaattctgcattttatttcacccaccccatcggattttttggattgcctttacggcgaatttcaaaataaagcgctgaccgattttgaccaccggtattgccaaccaaagcaattttttgtcctagtgcaacaacatcgcctttacgtaccattaaagactgattataaccatataacgacatatcatctttaccatgatcaatgaccacgacttgtccatacccttgtaaccaatctgctaacaccacacgccctcctgcaattgcgtgtactggcgagccttggttagcctcaatcactgtgcctcgccaagttaactctcccatttgagtggtaccaaatctattgatactttaccaacgacaggcatattaaattgtttatttggcatacctaaaccttgtaccgttttaatcaatttctcaggtattttaggttgctctactacttttgctgttgattgtttttctgtttcttgctgttgttctttttgttttcgtgcttgttgtaatttatcttctcgtttagcgtcttccatcgctttggctaactgagctcgtaacgcaatttcattatttttcaatgcatctaaacggttttgctcctgtgctaatgttttatccagcgaatgcaaggtagtttcccgttccatttgtactttttttagtgttttttcttgtgttttttgtatagttaattgcgcttgttgttctttttgttgctgttttaattcagttcgccgtgttttaagcgtttcttgtgtatgacgtaattgatgaataatatcaatccgcacttgattaagatacccataataagccatcattctctctact

SEQ ID NO: 93882 - DNA, 785 bp, Oryza sativa
aaaatgctttattgccacgtttattagacactctaattggcacagcattagcttggatcggagtacatatatttacccagattggaaatatttgaatttacaccggaatttaacgcatactttacaagcaagcagtcaatatcttcgccatattatagtgcaattgcaatttggctataacgatcggttggcctatagagtagtacggcgtgatgtgcataatcatttatcagaattaagcgcggtgatcaacaatatgcacagcgagccacaaaaatatcgttccgcattacaatttgctccacaattgttaaacactacaaacacactactcagctatatttctgcgttgggtaattatcgttctgaaagcgaggaacttagccataatatacatttttcagcggttttcttctctaaaggcaaacaagtgattgatattttagatgccattattcactcagatgatcggcaagttgatcaagcacaattaacacagcgtttaaccacaattaaacacgcccttaaacagtttgaaaatgaacagcaacatagccaagacaaactggcattattactcattcagcagttattaatgattgtgcaattattacctcatttactcacgttggttaaagaagaacaactttattcacagcaactcagctaatgcacccaaataagcggtgttttttgctaaaaattggcaaaaaataaccgcttgacgctttattaaacagaaatcatcattaaaaaatacagatataattctgcatttagtacgg

SEQ ID NO: 93883 - DNA, 885 bp, Oryza sativa
  unsure (1)..(885): unsure at all n locations
tgaaggggaattcttttttttggaaatctttattttcagattcattccagcttgaggtttttattttcttttaagggtaaccgtggagcttcttttttaatgcggctattttttttttaagtgaagttttacattagcttgttcacttttgtattttttaggctcgcttttcagtttattttttccagtcgttaaggctttgtttcttccggctagttttttatcttctcgggcatatttgttttgcccatttttgataattttgtcgaattttttgtacttcatccagtgcaaccgggtgattttgccttaaaaagtttggatcgccaaacgcaatattatcatttgcttgagctaagccaactgttgctaatgcactgcttattgttgcaattttaaacatttttttcatttatatatcctttaagttgataagttttagtatatataagcggttaattttttgtttatttagaaccataaacagaaattttaaccgcttggtaagtgaaattagaatgtgctgccaactgtaaattggaattgttctatttcatctcctgcatattttttaattggttttgcataagaaaatgataatgggccaataggtgattgccattgtaatgcaatacctgcagaggctcgcacgcgtttgtaatcaccaaagtcaggtaagattggataatctgctttactttgtttccatttagtattccacactgttgcagcgtcaacaaaagggtaccgagctcgngttcggccatatgattgtcaatcacnccccttnnggggggggnantcaggaatagcgcatattccgagtttaccgaggtagccgggagtagtgggtgtttgccccaatataccacgtacacccgttct

SEQ ID NO: 93884 - DNA, 690 bp, Oryza sativa
caatatgatcaaatgccccttacgattggcaaagcagtcacgcaattatctaacacatggcttgagttcattggtaatactgataaaacccttggtgcttctacccttgtttcggctgcgatttctacgctggcaaataatctcgaagggttagcaggcattgccattttagtcggtacggcatataccgcccgctatctttcggcaatgtacaccagtattggggtaaaaagtaaagcggcgattgctgaaagtgcgcacatgactgcaattaacgcgagcgcaacggcttcagtgcgccaagcacaagcgacagtggttttaatgcagccagttaatggcgagacggtatcagtcgggcgtgcaacgcaagcatatggtgcgcttgctgttgccaaagcacgtgccgctgcagtcaatgttggcgcaggcttgttctctcttatcggcggttcttttgggtttgcggttacggcactcgcaggtttagccgctgcctatttttatttaaaaaagtcagaagaagaagctgaacgccaatttgcccaatctctcactacgcttgatgccaatattgagaaaactaaagccttagttgaagcacgcactcaattaggtgaaatgggtggttttagtgaccgcatggaacagttaaaagtcaatacggcgtcattagacggagcgaaacaa

SEQ ID NO: 93885 - DNA, 605 bp, Oryza sativa
  unsure (1)..(605): unsure at all n locations
cgaaccacaagctctaccacaggccaactctatgtccgtaataaccttatccatttcaattacatcttgtgcggtttcagtttttggcatacgcaccacatctacgccggctctcaccactgcatttaaatctgctataccaaattcagaatgcaacgggtttacacgcacaacacactcaatattttgataaagcggatgttgtaatgcatgcgcaactaagatccgtgctgaatctttttctttcagtgccacggcatcttctaaatcaaacataattgcatcaggtttataaataaatgtattacttatcattgcggcattagaacctggcacaaaaagcatacttcttcttaattttatcggctggctcataatattttctcccaagcaagcgcttcatctgttgcacgcaacaaagcggcttttaaacgagcacgtaatacacaatctaatgcacctttatcttctataataatttgtgctgagctgacctcaaattgtgctaatacagcagttactgaatttaaaatatnnnnnnnnnnnnnnnnnnnnnntgagctattgatttcaatatcaatcgtagttgatggtgcaatacgtat

SEQ ID NO: 93886 - DNA, 1050 bp, Oryza sativa
gtgctctaaacgacgttgtaattctgctatttattgcatatcggcaaaggcaattgaagacaatgaagaaaagagcacggtcaagattgttttttggatacgttttttcatttatttcctctttatcaaagtatagtttttcatttgacagcatttttagtaaaagtttctatcatcactgcatacgactaatgcgcttcatcccaattagcacctacgcccacttcagcaatcagtggcaccttcatcgcaatagctttttccatttccgttttgattaagccagtgtagtactctatacattcttgtttaacttcaaatattaattcatcgtgcacttgcataatcatttttatattctggtcagcacgaatttgcttatcgatacttatcatcgcgattttaatgatatcagcggcggtgccttgcattggtgcgttgatcgctagccgttcagcagctttacggcgtatagcattatttgatttaatctccggcaaatacaatcgacggccaaacaatgtttcgacataaccttttacacttgcagattcacgaatatcgcgcataaattgctgaacatttggataacgttggaaataacgcgccatatattctttcgcttcatcgcgtgagatagctagctgatttgctagcccaaaatctgacataccataaattagtccaaaatttattgctttcgcactgcgccgctgttcactcgttacctcagctaagcttaaaccaaaaatttctgctgctgttgcttgatgaatatcttggccattagcaaaagcggtaatcattccttcatcatttgctaaatgtgccataatccgcaattcaatttgggaataatcagccgccacgattttataaccatcacgtgcgataaatgcttgacgaatacgccgtcccgcttctgtacgaatgggaatattttgtaaattaggatcacttgaagaaagtcgacctgtggtggtaactgcctgatgataagaagtgtgcactcgacatgtaggctgattaatcatcttcggtattttatca

SEQ ID NO: 93887 - DNA, 564 bp, Oryza sativa
ttttaatgattaaaccaatgctagtaccggtcgtttttcccgcaaatactcccgataaaatgtgtacttgatcggcttctcggcgagcagtggtataacgtgatgtgccgggtttacgccgatctaaatctggttgaatatccgcctcagataacgccatattgggcgggagtccgtcaattatacatcctaaagcaagtccatgtgattcgccaaaagtggtcactttaaataactgtccaatgctattgcctgccattatgcttcctatttattcattgttgcttcatcattaaattgaaatgttttactggctgcttttagctcttcttgtgtatctttatttttaataaatacgtccatttggttaaaggcaatttcaatattattttgattaaataattcataaatacgtcgatttaagaaatctagtgttggatttcgatcgcctaattgttcaacataaacccgtaattcatgatttaaggtgctttccccaaaagttaaaaaatatgcgcgtggtgtaggatcttttaacactttatcgtcttctaatgcggcttg

SEQ ID NO: 93888 - DNA, 671 bp, Oryza sativa
aataactttgccacgattattaatttcaacttcttcaaaaccagtttgaccatgcaattggtcttcataatatttctcaatacctaatttaccaatatcatgcgaaccggcgtaattgccaaatttcccctctttttcaagcctttccttatctttttcattaattttagctacataacctaaaatatgcgtcagcgtttcagcatatggataattacgtttatagtatgccagtacatttaaactcgggaaatggtattgattaaccgcaaagcgtgctatctgttcttcgcttaagttaccttttaataaaataggggaataacgtgaagtgcgttttttctctttatagaacacttctatatcttcatcggttagcccgacaacctcttttaactcaagtaaagtctgtttaagatcggtagttttctcaggaataatatacaaaccaaaataagtgatattttcagctaatactttgccattacgatcataaatcaagccacgcgtaggcggtacaggcaataatttaattcgattaccgtctgaacgtgtttgataatcttcataatgaataacctgcaagtggtaaaggttggtgattaatacaccggttaatcctaaaacaaagaaaaaagcaatcaatgctcgacgtgcaaacaaattacttt

SEQ ID NO: 93889 - DNA, 609 bp, Oryza sativa
ttagccagattttagcgcttattcaagcaataaaaccttgttcattatcaattatccatcattaaatgaataaaaataagcgttggtttgaatatcggttaagaaagaaatcgcttcttgttcagccacctcttggcggactgcatcgctattttctaattgatccataattgacccgtaaatcaagcctttttcaatttcgcgtaaggcgatcacggtaggtttatcattttcttcagggacaagcggctcacgaacgtgaagttgtaattgtcttgcacggcgtgcggctgttaaaattaggtcgaaacggttaccgattttatcggcagcttcttggacggttacacgagccattgagttactccaaagttttatgttttcatttataaaaaagatcggagattatataggtattctgtgttaatgacaattgaaaatcagcctatggtattgattagtgatccgttagcgattaagcattgcagtaatcggctttttgattcagccagcgtgcgatcaaggcttcagcaagcgctggatgttcactaataatttgtttggcagagtgttgcactaaaggaatcagtttacgatcgggtaccgagc

SEQ ID NO: 93890 - DNA, 636 bp, Oryza sativa
ccacctgaagcagctaagccccccattgaggttacaacaggtttgccggcttgttgaatagactgtaattcttgcaagattatttcagaagcaaccacgctacctcccgggctgttaactcgtaatatcacaccatcaacattattgtcttcgcgtgcttggcgtaataattcagaaatagtttcactacccgctgatctttctttgcttttgccagaaataatttcaccttctacattaatcacggcaattttgtgttctgcattgacagcaaaacgatccgttagattcaaagcataatcggcataattaatgtgttgatagatgcctttctcatttttaccgaattgttcgattaatgcttgttcaatttctgctttactgccgatatcggtcactaatttttggtttaaagcatattgagcgtcattagcgttaacggctttgtatttttcaatcaagcttttgggttcaggtaaaacttgatcgacagcaatcatacgattttcagcaatatctgtacggaattgatgccaaattgaatttaataatgtttgcgcattttggtttgcttcatcagacatatcattgcgcaagaatggttcaaccgctgatttataagtgcctactcggaaa

SEQ ID NO: 93891 - DNA, 612 bp, Oryza sativa
aatacatgaaaagcacggtataaataagaagaaccatccacgagaaccagtgggttttgtgcaatttgagccatttgaaatccttgctaatagatgccatagcatacagttaagatagaaacgggttgcgcatgcaaccctatacaaacatcattataaccaaaacaagcggtttaatcttgccttaatgtagcaaccttccacgtaaaagacagtatagacggatattattcacttttctcgctcacgactacaggctcaaattctgcccgcttcaaaaagtttttctctctaaaattaatcggaaaatggcaggcaaattcatgctgtttatatttacgtaatggtggtttttgtacacattttttctgtgcaaatgggcaacgtggtcctaaacggcaaccaatgggtatatgttgaaacattggaatactgccttttaacgtatttaagctacttttaaagactaacggctgcgaaaaatcaggaataccatttaataacactgccgtatatgcatgaaaaggctcttccataatcacctctttactacctgcttcagctgtttgtccacaataaagcacattgaaagaatccaccctttatgggtac

SEQ ID NO: 93892 - DNA, 785 bp, Oryza sativa
  unsure (1)..(785): unsure at all n locations
gatcatggaatcaagcagggtaatgtattgcgtaaatatgttccaacaaattttataaggcgaccaacaacgcgttcttgnccactttaatgtaatttggcttcataacatattctgcgcgttggcgtgtaaagcgaatgacctcaagcgtagcaggcaaagctaaaatcaaagtaggtaatgctaaatggtgtaatacactctgcatcattttcaatttatacggcgaatctgctaagaaaatatctaacagccgaaaacctgtcactaatgaaatttcatagattgggtgcaattctccaaccgcagcaatctgccaatcattactcgctgcataatataacgccataatcgctaaccaaaatacgggaatagctaaactgaacgcgctaacaatagcgagtaatttgcctacaacattataccgaaagctcgcagcaacaaatccgagcggaatcccgataatcacagatacaaataatgcggcaaagcatagggaaattgtagcaggaaatacattcaggatttgattagcaataggatcaccattactatagctaataccaaaatcaccgtgtaatagccccataacataactaaaataagcttgaataccatataaatccataaaatgatttaatggatcacgcaataaaatgttataaacaattaatgttaaaataatcaaggtaatcagcgaaagaaataaccgacgaataaaaggggtaccgagctcgaattgcgcctatttgaaatcggtnactcaagcaaatcaaatggccatg

SEQ ID NO: 93893 - DNA, 641 bp, Oryza sativa
atcgcctttagcaagagtctcagcgactttatctgctaatagaaaagcacctattggtaaaccaccggctaacccctttgctaaagtcactatatcaggttttaactcaaattgttgataagcaaacattgtgcccgtgcgacctataccggtttgcacttcatcaataattagtaaaatatcttgtacttggcataaaccttgcactgcttgtaaataggcttgatcaagtgaacaaaccccgccctctccttgcactacttctaagataattgcacaaatatcattttgtgctatccgtgttttaaatgcattaagatcgttcgcgattaagtgttcaaaacctgccgtaaatgggaaaaaatgttgatgaaataatttttgaccggttgcggctaacgttgaaatggtccgtccatggaaagaattaactaagctaataatagtagaacgtgtatcaccatatttgtcgtggctatatttacgcgcaactttaatcgcaccctcattcgcttctgcaccagaattagcaaaaaaaacccgttttagcccgcttacttgaactaaatgcttcgctagtcgggctgatggttcagtataaaataggtttgaggtatgtcataacttatgtaattgtgcaa

SEQ ID NO: 93894 - DNA, 714 bp, Oryza sativa
caattcaatttgcagcgcattaatttcgtttgcaagttgataaccgttcgaatcatctacataccaagccccctcacgcccatcttgcggttcgaaccaaccaaaagggaaaagctgaatgagcccgttcgcctcgcggttaagctgaaaactgcaagcaattggattaagtttgaatttttgtttaaacacaaaacacctcaacacaaatcattgaggttagaggatagcgaaaaggcaaatgccaaaaacgaggaggcatttccacattggcagattttttgagggatttttgtaaaatgcagttgaaagtgagaagaagaaatgaaatgcgttttaaaaccgttttaaatcattttaaaagcatttaaaaaaagactttcggtaaatcttatcataaaaaagataaaccgctcaatttgcgattttgagcggtttaagttaatttattgtaatagtcgctgccagtagtctgtgatctcttccagaatatccgatttatcttgctcggtcagggttaaaaatggacgagcctcaatcttcactttgcacccacgcccagccatccctccgaattgatgaatagccgcatattcctcatttgtccccacaaatgcggtatcattatcataggcgctggtaatgctatccattaaattttccgaatcaaccaacggcacccccttacggtgtttaatacctagccattttggg

SEQ ID NO: 93895 - DNA, 640 bp, Oryza sativa
gaattcgagctcggtacccatcttgttctttggcatcgtcaaacccttttttgataatttcacccaatatttttgcatcaccacttaatggcaataatagcgctacgttatttaatagcgtttgttgaaaattgaacactcgttgtaattctgttggcataacggctagtgcgctatgatttggatagagtcgtttccaatagttaatattttgtggcatctgagccggtgtcgaaacactttgattataaatttcaatcaatgctaaccaacccgccaattccatctcaccggcaccggcttgggcagaggataacatcccacgattagcattacgtaataatgaccaaattttgtcattattttcttggcgtaatttattatcgaccaattgagtcgcaattaatgatcgaattctgaccgcttcaatcgtatttttgctattttcagcaattttggcttgagtttgataaaaacgtaatagttgtgaatggcttaaattagcggccgaaatatgttgtaatgtgacctctgcttggtggttgttgccttttaaaagccgctaattgtgccgtgacaagttgatattcaagttgttgtaatggattttgttccattatattcaaccccgtggttaaat

SEQ ID NO: 93896 - DNA, 965 bp, Oryza sativa
  unsure (1)..(965): unsure at all n locations
cgtgcaaatgtggttaatggggataatggcccctgtgagattgattaggcacataaatgttgaatgaaaggggcttctgtacagtaattgacggcatcgcatttttcgcctagcagtttttcaacgatttgcaccacttgagatgatggtgggcattcgtagccgggaatcgcgtcgtgtagatggcggatttcaattaaatcgccatattgttctaacagtggttgtaggttttgattgaccattgcatagagatctgcaatcactaaattaggcagcggtcgtagatcaaattgtaattcgcaacaagcacagatgcgattaatggcatctccaccgtggatgttgccaaagttcatggttggataagggacttggaataaatcattatgatatcgatcgcgtaattgattacgcatatttattaaataacccgttgcttggtgcattaagtcaattgcattaatgcctttagcgggatcgctagaatgtccacttttgccggtaattctgaccgcttgtccaaggtgtnnnnnnnnnnnnnnnnnnnnnnnnnnnnnnnnnnnnnnnnnnnnnnnnnnnnnnnnnnnnnnaatatgtgtatgcttggcaaaagttcttgcacctaacatggttgtctcttcatcggcagtggctaaaattcgcagaggtttgtttaattttttgagatcgaggctagccaatacctctacannnnnnnnnnnnnnnnnnnnnnnnnnnnnnnnnnnnnnnnnnnnnnatttacccgctttttctgtcaaaacaaaaggatcagattgccactttccttggtcaaaagggaccgtatccgtgtgcccggctagtaataaaccgccttgcccttcaccaagtgtggcaagtaaattatatttattacggctacctgctacttcaataatatcaatattaaagccaaaatcagctaaccaactagccagcgtatc

SEQ ID NO: 93897 - DNA, 560 bp, Oryza sativa
ataaagcaccaatgtaattaaaatccccaacaatgttgctagccccacatcgcttttacgtttagcataagctgaaagtacggaagccccttcaacgccaacaaatacccaaggggtaattagcatcgtatttttgacttgggataatgtattagttgctagtttttgaccgctaaaatcagctaaaaattgtgtaggtgaaaagacccaaatagctaatgcaataaataataacagtggcaatgttttgacgatcgtagcaattaagtttacgtaacccgcttcacgaatacctcgtgcgattaaatgatgcactagccaaacaataattgacgcacctaatatgcaacaacagtattcccttgtgcaaaaataaccaactgttcgctgtcaacaaaggttcccaaaccttcaaaggcaaccactaggtaaccgacactgccgatagcggtacaaagccaatagccccaagcggataaaccaccgactaaatcgccaaagccttcacgagcataagtatatacacccccttctaattctggttttaatcgcgagagaaa

SEQ ID NO: 93898 - DNA, 620 bp, Oryza sativa
cattggctctgccgcagtttttgtaactatgctgttatttgcaataacttggttattgctaattttttaaaaagtaaaataggcaatggattacacaatccactgcctatttttttatatcatcaattaagaggttattatgaaattcaataaaacactccttaccatagcactttgtgcttctagttcaataatggcttatcagcaagataaagattattcatttactgtattgcatactaacgatattcacggccatttctggaataatgaaaaaggggaatttggccttgccgcacaaaaaacactaatcgatcagattaaaaaagaagttgaagcaaaaggtggctcgactatcattttaaacgctggtgatattaatacgggagtcccagaatcagatttacaaaatgctcgtccagattatgaaggattaaatgcgattggctatgaagcaatggtactaggcaaccacgaatttgatttccctttaccaatattaactatgcaagaaaaatgggctaaatttccgttgatttctgctatgtatttaacaaagcgacaaaaaaagaattagttgatccttatattatgttagataaacaaggcttaaaaatagc

SEQ ID NO: 93899 - DNA, 1640 bp, Oryza sativa
tcccctgcttcatttatttgataataaataaaacgatgaaaaatcaacatactaggatacttgcttaattgttgatataacttaaaatgcgctgcaatcaaaccatctttttgttcaattaactccgctaatgctatgtccacactgctattatgtttaacttgaattgatctaattagaaataattcgtaatttataaaatcatgtaatgccgcatgacacgttttaatgttatgcaacacttcactaatataatcaggatcttaactaaaatatgctcaaaatgtgttaatgcttgcgaaaattgtccttgcgccaaataataatcacccaataacatagaggctcgcgtacacaatggtgaatattctaatgctttacctaaaagcctcaaatataaatcctcatcttccgattttatagcttgtgcatactcacaataataatgcgataaaggaatacgatcagttttaggatcaatttttaaaagcttttccgcaacattaatcgctttcttccactcatttgttttctgataaagaaccattaattgtgtaagtgaatttaccgcaaattctggctcatctaacaacaaaatataatagttttctgcgcgatcataaaaacctgccgccataaaatccttggcaagttgctgtttagctaatagtttttgttcaatagaataatttagacttgaatctagcgcttgatgaatacgtaatgcgcgatcaacttcaccgcgagaacgaaaaagattacctaaagtaagttccgcttcaaattgtgattccgtggcaatctgattttcagattcctgtttttgaagcattgatagaaaaagatcaaccgctttttcttgctgattagacaaaagaaaatttaaacccgtaacataatcacgagaaaatttattattgatagattcttgctcctttttaacactaagacgtccaatataccagccataaagcgctgcaataggtaataaaaggaacaataattcgaacattagttagtcttccgcgtattcgttaattctgtaatttgttgagcttgacgctttacacgacgattcaatgcgatagtttttactttcaatttcaaataaaaaataccggtaagtaaccaacctaaaattaaaccaaaaccgaatagaatagcaacaaggctagataagcgtaattcactttgtgctacaacataattaaatgtaatcagttgatcattatttgctccaatagtaaccgcaacaataacaactgccagggtaattaaaacgcctaaaatatatttcattgtttatcctcttagtatactaatagaaaagacaaaattgcccttagaaaaccctatactaaatcaacgcgttcttttaaatccttacccgctttaaaatgtggcacatattttgcatctaacttaacacttgcccccgttttaggattgcgaccaatacgtggctgacgataatgtaaagaaaaactgccaaaacctcttatttccactctcttagcctgctccaaagtgagcataatattttccaaaatatctttaacgccgtcttcaactgccttttctggtaaactcggatttaacgctattaatttttcaataagctctgatttagtcataaaatt

SEQ ID NO: 93900 - DNA, 645 bp, Oryza sativa
  unsure (1)..(645): unsure at all n locations
tccgcttgtgaataatgtctttactgaagtcatcaattggcaacctatgctatctgaaatgcgattatttaaatcgccggcagaattagccttattccaccaagcgtgccatatttcctcattggcgcatattagagcaatgcgacaaacgcgcccgaatcgctatgaaatggaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatgaaaataatcaagtgttaaaagatggcgaactattgttgattgatgcgggagcagagtttgcttattatgctagtgatattacccgcacattcccaattaatggtaaattttcgctagcccaacgtgagatttatcagttagttttagatgcaatgaaagcagcaacgcaatatcttgtgccaaatggttcttttaaagcagctaatcaggccgctatgcaagttatgacagaaggcttagtacgcttaggcattttacaaggagatattacagaattattagcacaacaagcagtgcgccaatattatctgcatggtttagggcattggttaggactagatgtgcatgatgtaggtgactatgg

SEQ ID NO: 93901 - DNA, 798 bp, Oryza sativa
  unsure (1)..(798): unsure at all n locations
atggaatcaaaattattaacgaaagtgattgcttctgctcaagctaaagtggaagcgcataattttgaaggtcgtaaaaacttgcttcaatatgatgatgtagcaaatgaacaacgtaaagcgatttatgaacagcgtaattatttattagaaaccaatgatatttcagcaatgattgaaacgattcgtgatgatgtatttaatcatgtgattagtcgttatnnnnnnnnnnnnnnnnnnnnnnnnnnnnnnnnnnnngctggtttagaagaagtattacatcatcagtttggtatggaactgcctatccaacaatggctagaaaaagaaaaggacttacacgaagaaacgttacgtgagcgtattattaaccttgctaaacaagaataccagtcgaaagaagaaaaagtgggcgcagaagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagaatcttttgaaatgttcactaatatgcttgaactgctaaaatcaaatgtgattagtattttaagccgtattcaagtccgtagccagcaagaaattgaagaagctcagcgtcaacagcatgaacaagctgaagcagaatcagccaactatcaagcgaccacagaagaagcattagcaaaagaaaagcgtgatgcattaccagcagagctgactaatttacagattgggcgaaat

SEQ ID NO: 93902 - DNA, 516 bp, Oryza sativa
acccgcttgcattacagtgtcataacgcgttttccacgccgatttaatcgcttcaatctcagcttccgttggattgtctaatttggcgagttccgctttccagttgccccccaacacaatatccgtaccacgtcccgccatattcgtggcgatagtgactgccgatggagcaccgcttcagcaacaatttcagcttcttgagcgtggaattttgcattgagtacgttatgtttaatgcctgcttttgttagtgcattggataagagttctgacttttctacggatgctgttccaactaacaccggctgttggcgagacatacattcctcaatacctttgattattgccgcaaatttttcttgttcgcttttaaacattaaatctgtacgatcatcgcgaataaccggtttattggttggaataacaacggtatctaatccataaatttgttggaattcaaaagcttctgtatctgctgtgccagtcataccggctagcttttcatataaacggaaa

SEQ ID NO: 93903 - DNA, 559 bp, Oryza sativa
ccgtaaatatggtgatatagtcaaccaccgtttaatcaaacaagtattactaaatcagccaattaagcacatagagagtacaattttagcccgcttacaagaagcacgccgccaaaatcgtttagtcgaacgcgatatcgcagattggttatatgcacgctatttgctcccaatcgcaacacaaggggtagaatttgactgcgaaattaccgatatttcacgtggtggtattcgtgctaaagtactagaaaatggcgcacaaattttcattccttgttcaacattacacgaaaataaagatgaaattgattttatccctgaagaaattgcactttacactaaaggggaaaaaatttatcaaatagggcaagctacccgtgtaaaactaaccgatgtgcggttagaaacacgttcggtgttaggtaatattattaaatagcaaatcactcaattctccacctatttatcaaaaattaaccgcttattttaggagtaacaatggcgacttatattatgggtgacttgcatggttgttttactgagtttcagcaactgcttg

SEQ ID NO: 93904 - DNA, 729 bp, Oryza sativa
ctatcaattgccgactgaattgagcattccaaccacatctagcccgttaaaaaatttagtggtagatattgattataatgaagtgttgatcgtagtaaaaactagcccgggtgctgcgcaactaatggcgaggttattagattcgatgggcaagagtgaaggaattctaagcaccattgccggcgatgatgcaatttttatcacgccaacacactccacgccgatggaaacattaatcaaaaatatcactacccttttcgagtcttcattttaatgaatattgtactcaccggtggcacaggcttcataggaaaagcattaacaaaagcacttctccaaacgaggcatcaattgacaattctcactcaccaaacgcaattaacctcaaattcaccaacagagactttttgtcaaaaaatgacagattggcatcacttaaatcacgttgatgccgtcattaatctaacaagtgaacctaattttgataagggttggacgaacaaacaaaaacaacaattattaaccaggcgcgtcgatttgactcatcaaatagttatttgatcaatgcggaggaaaatccaccgcatacttttatttcaggatcagcctgtggctattacggcaatttagcgaattccaaccatttctatgatgaatcaacccctgcaggcacgcactttagtgcaaagatttgtcttgaatgggaaaaagctgcattaaatgcgcaaa

SEQ ID NO: 93905 - DNA, 1069 bp, Oryza sativa
ttcaacgcattggttctggttaagccaatcacagcagtggcaattattgatcggattcgctgggttacttgttatgctttatggcattttttacgctaaatcaaaatggttttggtggcaaagtgcggggttaatcttagtgagtgtattgtttcatttattcatttttagtagtaaaaaaattgaatggattactttcgatgttgggcaaggcctatcacaagcttttgtttattaacaaaatggacagaacaaggctattttttatgataccggggtaagctggggcgcaagtggtaattcaatggcaagtcttgagatcttgccttatttaaggcgacataatattgaggtagaagcaatttttttaagccacgatgatcgagatcatgcgggcggaatttctgatttgctagcagtgtatccaaatgtgcgcttgatttcaagcagtgctatgccttatgcaaataaaatgccagaagcttgtattgtgggaaagcagtggcaatttaatcaattgatttttcgaacaatttatccgcctaaattgacaccaagatctaaaaatgctgattcttgcattataattgtggaaatagaccgctttcgtatattgttgacaggcgatgcaactgcccaacaagaaagcatcatagccccatcattaccacggattgattttttacaagtgccacatcatggtagtaagacgagtagtagccaagcactattggctaaaattaaaccgtatttggcaattgcttcggtggggcgttggaatccttggcgaatgcctcatcctagagttgtagaacgttttgaacaatacaacattcctttagtcactaccgcaacagatggcatgataaaggttatttttgagcataatacctgggaggtaatcactaacagaaataagttttctgcgtggtatcgacagttatatgcaacatcggctaaacagtaaggatcaggcgtaattaatatttattacgccctatcattttgttggaggcaattacggcaaatcatttaatgcattaggatttttattgataagcattgcgtc

SEQ ID NO: 93906 - DNA, 572 bp, Oryza sativa
ttgtattaataaaaatagtggagtacacgatattatacaagcaaatggtaaggtttgtattaatgtgttaaaccatcagcaagaagaaatggcaaaacattttgccagtatgttgccgagtactatggaagagcgtttcagttgggatatttgggatgaaggaattgatggtttacccattttacgcgatgcgatttctgctctgcaaggtgatattattgatactcattctgttggcacgcatactatttttatggtgcaactgaagcatattgaggttaagccaagtaatagtttggtttattttggtcgtcaatttaaagtgattacgatctaatcgcacttgtcatttatagttttttaatgggaatgtagccttgcttttaaacaaggctacatttttattaggcaattcctttatggcgtaataaagcatctaaacgtggtttacggccacggaaacgttcaaataaaaccataggttcttcagagcctccgcgggttagaatatgatctaagtaagcttgacctgtttggcggttaaaaataccctcttcttcaaattttgcaaa

SEQ ID NO: 93907 - DNA, 752 bp, Oryza sativa
ctagcaatcaccgactagcataaaatagtacaaacaaataatgttagcttaccaataacgtaagcgaggtgattaagcatagaagtgcaaaggagtgacaatgaatcctaccaaatttgtattagcgaccagtaataaaggcaaagtaaaagaaatggcggatgtattgtccgctttcggatttgaagtaattgcacaaagtgaatttggcttagtttcaccgccagaaacaggcttaacttttgttgaaaatgccttattaaaagcacgttatgcctcaaaaatgaccggtttacccgccattgcagatgattctggattggcagttgatgcattagcaggggctccaggcctttattcagcacgttatgccggaattgaggacgatgatacagccaatcgacggaagttattagctgaaatgcaaaacgtaccagatggacaacgtgcggcaaaatttgtcagttgtattgttatgctcaagcatgaacggatccaacgcctaagattgcatttggcgaatgttttggtgaaattctacgtgaagaacgtggccaaaatggttttggctatgacgcattattcttttatccagctaaacagtgcacctttgcggaattagattcaacggagaaaaaacaaatttcacatcgtgcattagctttagtcgctttgcaaaagcaactttaaacggtattaacgctaaaagtaaatagcatgcaaaaatttaggaaggacaaatgattattacg

SEQ ID NO: 93908 - DNA, 630 bp, Oryza sativa
aatgcaagccgtaaatatcgcaatgttttagcattaatttttacgttaggatattcagtgagataataaaacagatctagaatagtactaggctgttgtgtaaaacaacgacgattttggcagttgagttgatggccttgtagataaaaataattatcaagcgcttgttttcagctaaatgatgcggattacgatccgataattgaaaattatctagtaataattggcttaattgagaaatcgattgtgtcgcttgaaaataatgacgcatcattgtttcaaccggctgattaccttctccttgataacctaattgtttgcttaaacagagctggcgatcaaaatataagcggttgtcataacgtttaagctgtaagtgtaaggcaaaacgcattttaaacagtaccgcttgtgccgcgcttaattcgcggtattcttcagcaaataaaatccctttattgagtagcgtatccagtgaaaaggtgccaaattgtcgcattgagatccaataaattaaatgtagatcacgtaaaccaccggggctatgttttatatccggttctaaattatagccagtattatgatagcggctataacgttcagcacgctcttccatttttgctttaaaaa

SEQ ID NO: 93909 - DNA, 680 bp, Oryza sativa
aaatattgctcagctaaactagccacaccgacatcgcgttttggtgcagtttgatagacttccataaacaataatccagtgtaagctaataatccccacaaactaatcaacaaaaacaaggtcgcgccaaagcccattcctgctgaagttaatggcattgcaagcattcccgcaccaatcgttgtgccggcaatcattaatgcactgcctaatattttatttttcatattatcctatttttactccactttattataaagcactttattctagcaaactaaaattaaaaagcggttagattctgcaaaatttttgcatatgctaaccgcttaaattgatttatatcatctaaacgcaattaaaaccacctaatatataaagaaaaagccgagataactctcggctattatcatgcgctttcagttaagcatctacccgattatccgcaacatctgcatctgtattcggcttagcctcttcaatcgtattgctcgctgatgtagcatctgaagaatcattcgaagaatttttttctttatcatcattccacccttccggttcgccaacaggacgacgatgcattaaatcatcaatttgttttcgatctaatgtttcatatttcaatagtgcatctttcattgcatgcaaaatatcaatgttttcttctagagtctgcttag

SEQ ID NO: 93910 - DNA, 839 bp, Oryza sativa
acatcattttagatatcggtagcccagaagaaatggacgaaaaacctttagttttagcacaggctcaagtgattgaattgcctttctataagttatccacgcaatttgcgcatttagatcaaagcaaaaattaccttttatattgtgagcggggcgtaatgagtaaattacaagcactttatttaaaagaaaagggctatcagaatgtgaaggtgtttaacttaccaaaatagcgagttaataagcgcttaaatttgtgaaaaaaagcgtgaaattgatcgctttcactgaataagaaagggattatgcataaaaaactttatcttgcttcaaatagtccacgtcgttgggcattattacaaaatctaggtttagctttattaccacttgcaagtgaaatagatgaaactgcacatgcaaatgaaatggctcaagattattgttcacgtattgctagggaaaagaatcaagcggctcaagcagttagaattcgccagaatcttgctgaatatccgattctaactgccgatatcatggtttcgattgacggagagattttaggcaagccaagtcatcagcagcaagcagttgagatgctcaaaaaattatctggccgaactcatcaagtctatacggcagtctgtgtaagtgctaatcaacaactatttgagtgtattcatagcagtgaagtcacctttaaaagattatctgaggctgaaatttatgcttatattgcaactggcgagcctatggataaagcgggcgcttatggtattcaagcactaggtggtatatttattcagcatttagcaggcagttttaccggtgtaatgggctta

SEQ ID NO: 93911 - DNA, 863 bp, Oryza sativa
tagtgcagtatcaaccaaaactgattttttgattgccggtgaaaaagcgggcactaagttgactaaagcagaacaacttggcattcgtatcttagacgaacacgcatttgcagatttaattaagcaacttgaatacgagtagataaaaacgcatagaatacaagcggttgatttcgctaacatctgcctaaaagaggaacacatatggctattttagtaacaggcggggcaggctatattggcacccataccgtagtagaattattaaatgcaaataaggagattgttatattagataatctgtctaattccaatcaaattgccgttgaacgcatacacaccatcactggcaaacacgccaaatttaacttaggcaatatcttcgatcgagttatttaacgcaagatttttgccgaaaatcaaattaatgcggtcattcattttgcgggttcgaaagccgttggcgaaagcgtgtttgagccattacgctattaccaaaataatgtaaccggttcgattgttttacttgaagaaatgttaactgcgggtattaataccattgtatttagttcttctgcaaccgtttatggcgatccaaaaacaatccctattgtcgaatcttgccccgtggggcaaaccactaatccttacggcacatcaaaatatatggtggaacgtattttagaagataccgtaaacgcaaatccacaattcagtgcggttgtgttacgctattttaacccgataggcgcacatccaagcggtttgattggtgaagatccaaatggcattccaaacaatttattgccttatattagtcaagttgccattggcaaactaccgcaattatccatatttggcaa

SEQ ID NO: 93912 - DNA, 762 bp, Oryza sativa
  unsure (1)..(762): unsure at all n locations
caggcatatgatgcatcgcacggtcganngagcttgtcccggatacctgcgtggaaactatggcattactagcataattttatctaactttgttttttttaattgactaatactaacacgtaacctgattgtgaaacactcccaaggtgatatatgcaattaatgattaaaaatggcacacttggtcaacaaagacaacttgcgtctccgcattttaatgcgcgtccgcaaatagatgatatttcattactcgttattcattatattagtttaccgcctgatcaatttggtcagccttttattgatcaattttttcaaggtaagttagattcatcgcttcacccttcttttgcacaaattaaagatttacgcgtatcggcacattgtttaatcaatcgtaaaggtgaaattacccaatatgtgaattttaacgatgtcccttggcatgcgggcgtttctagtttcgaggggcgcgaaaaatgtaatgattattcaatcggtattgagttagaaggtaataataatcacgcttttactgaagcacaataccaatcttttgcacaattaactcaagccattatagcttgatacccttaaataacgatcgatcggattgttgggcatagtcacattgcttcccggtgaaaaattgatcctggccatattttaaattggggtattccaatcgttactcaccacttaccatataaaaaaagctgggttctccctaaccaagattgatggataaattttaggcattgg

SEQ ID NO: 93913 - DNA, 659 bp, Oryza sativa
ttatttactttatttgtattgccggttatttacaccttcttaggtgaaaatcataaaccgctacaagagtttgaagaaaataagcattatccagtgattgctgagactgagcattcataacaaaaacataaaagcctcgcatcggcgaggcttttgttttcattattttgacgatgtcagataaccatttttctattacaatacaatccttatcttaaggttatatattattaaggaatgaaaatgaccccatttagcgtagtgattttaaccgccggtaaaggcacacgaatgtactcagatttacctaaagtactgcatcctattgcaggtaaatcaatggtcaaacacgtgattgataccgtcaaacaaatggacgccaaacaaattcatttagtgtatgggcacggcggttacttattaaaaacacatttaaaaacagagccactcaattgggttttacaggcaaagcaattaggtaccggttacgccaagcaacaaaggggtactttttttgcagattaataaaaaattttaattgtaaaaggcgaaacgccatttaatacaagcacaacctttaacccgctttatcgcagcaaacccggcaaatggcattgcattattaccagtagaattagcagatccgactggttatggca

SEQ ID NO: 93914 - DNA, 672 bp, Oryza sativa
atcccccatcattcgataaacattttgtccgtgattggctcgcaaatagtggttggaataaacaggcaccattctcctaaaattcctattgatgtaattcagaaagcggtggctaataatcaaaaagcgttggatctattgactaagtaatcaaatatgatcttataatgaataagcggatattaatttctattaatatccgccttattattgatgggacgttatgagtaatatttaccgtttattattcagcattattcagcgctactggcagattgtataaaacgttctattttagcgccaatgcgacgtacctttttttccatatgttaatatcggcgatctatatggtagatccgatccaccatggtttcactttatgcaatacagccggctaatactaaactgattgatgcacgtaagtcagttgccattacttcagccggctttaattgctcaacgccctgacaaatggcagtgttgccctctatttccgcttttgctcccatacgattcaattctggaatgtgcataaaacggttttcaaaaatggtttcagtgattcggcttgtgccttctgctaccgcattcaacaaagtaaattgtgcttgcatatcagtaggaaaaccggggtgtggcatagtgcggatattgaccgctttaggtcgttga

SEQ ID NO: 93915 - DNA, 790 bp, Oryza sativa
  unsure (1)..(790): unsure at all n locations
cgatggccatttgagtgcagtagcctctcgtcgaanncgagctcggtacccttgttgatgaaatgttagccgtcacagatttagtgatcttagatctcaaacaactcaatgatgaaattcatcaagacttaatcggtgtttcaaacaaacgaacgcttgatttcgcccgctatttacataaaatccataaacaaacatggattcgttatgtggtcgtaccaggttatactgacgacgactctgcccataagctcggacaatttattcagaatatggataacattgaaaaagttgaattattgccttatcaccgcttaggcgcacataaatggaaaacgttaggctataaatacgaattagaagacgtattacccccctctaaagaagatttagaacgtttgaaagcaattattgaaagttacggacatactgtcaaatactaacctagcggtctatttagcccaaaagattgccaaatagacccgcttattntactcaacaacttgatatttttcacaagactccccaaatataacgatactttttaacaaaaaggaattaaatacataatgtcaaacccacttttaccatacacaggtttaccttgcttctcaaaaattaaagctgaacatattccaccttgccgtgaaaccggtatccaacaatgtcgtgacgtgatcgaaacagtcgctcaaattcgacaacccacttgggaaaaatttatataccacaagcagaaagtcgcggataattttcacgggttgggcaccggtgggcactaaaatgcgtg

SEQ ID NO: 93916 - DNA, 799 bp, Oryza sativa
  unsure (1)..(799): unsure at all n locations
gatggcatttgatgacttcacttcgggcgaacncgagctcggtacccgttttagaagatattgttaaaaaaattccagcaccagaaggcgatccagaagcacctttactttctttgtttattgattcttggtttgataattatttaagtgttgtctctttagtccgcgttaaaaatggatcaattaaaaaaggcgacaaaatcaaagtaatgactactggccaatcgtataatgttgaccgtttaggtattttcacaccaaaacaagtagatacgacagaatttaaaacaggtgaagtgggttgggttgtttgtgcaattaaagatattttaagtgcaccggtaggccatactttaacacatcaacaccattctgctacagaagttttacccgtatttaagaaagttgtaccccaagtttatgcaggttattccggatcgtttacatgatattgaacttttctggattgcttagggcaaattagccctaatgacgcttttttattttatgcaccaagaaatttcaccccgttaggcttttggtttccgtggggattcttacgtttattacatatggagatcatttcaagaacggttagaacgtgaatattgatctgatttaaattacccctggcccctacacgtaggtattgaggtattaccaacacaattggcgaaccgattaacgtattatggcccggcaaaattaaccgcccattatgtcattttgatgaaatttcgcgaacccaattgctgaatgttatattcttgctcccacaaggattattatggtattatat

SEQ ID NO: 93917 - DNA, 610 bp, Oryza sativa
tataggccgaattcgagctcggtaccctatttgagcctgaaattccacaaaatagtgggaatattattcgattatgtgcaaattgttgttttcgattgcatatgattgaaccctttggttttacttgggatgataaaaaattaaaacgttctggtttggattatcatgaatttgtcgatattcaaaaatatactcattttgatgattttcttgctcgtgcaaagcctaaacgtttatttgcattaacgactaaaggtgaagcaaatcatagccaagtacaatacgaacaaggcaattttttgatgtttggaccagaaaggcgtggaattccaaccgctattttagagactttgccaatgtcacaaaaaatgcgagtacctatgtgtaaagatagtcgaagtatgaacttatcaaataccgtggcagtagtcgtgtatgaagcttggcgacaatttggttatcaaggtgctgtagcaagacaagccatttaaataaataagcggtctttttgtgattatttttgcaaaaaagaccgcttctgaaaacaaataaaaatcctaacgattaattatttgaaatatttataaaattacagttttgctgaaagcat

SEQ ID NO: 93918 - DNA, 554 bp, Oryza sativa
gaattctagctcggtacccactttaactgattatttttgattgtatagatcgcactgttgttttacggacaccatttcttttgctttggattgacaaactcagtgcctttatccttaaatttaaccccttctaacgtcagtaaataacgtttagtcgctagccctcctccaaagccggtcaaactattatttttacccaatacacgatgacaaggcaccaaaattgagatcggattacgtcccacggcaccgccaaccgcccgcattgcttttggttttcccaaacgtactgcaattttaccatagcttgttgtttttccatatggaatatggcgtaatgcttgccaaacggcctgttgaaaagccgtgccttgcggtgctaagaaatcaagttgcgaaaaagagaccgcttcaccggcaaaatagcggtctaaaagatcacatgttttactgaaaacgggatacataggatcattactactgataggttgccattctactgtttggcgagtgaattgctcttgttcaaattcaacaaccattaaaccttgttg

SEQ ID NO: 93919 - DNA, 1028 bp, Oryza sativa
  unsure (1)..(1028): unsure at all n locations
cgagttctgattcagtatcaagtgcagatgttgcttcatctaacactagaaccggtgcattacgtaataatgcacgagcaatggctaaacgttgacgctgaccaccggataaacttgcgccattttcaccaattacagtatctaaaccctgttctaatttttcgataaactccattgcgtgagccgcttgtgctgctgcaataatttgcgctcggctatatttatcttttgctgcataagcaatattatttgcaatggtatcattaaataagtgaacttgttgtgaaacaacagaacattgctcacgcaagttttctaaggtatattcttcaatattaacaccgtcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtggaatagtaaatgaaacttggttcaatgcctgctcttctttaccttcataactaaaaataacattatcaaatgtaatacaaccttgtgctcgttcaacctgcttagtgccattattcttttcggtttttaaatctaaaaactcaaataatgtttgacatgctgccatgccacgttgaaattgagagttgacactggttaacgattttaaaggacgtaacatagccatcattgatgaaaagacaaccgtaaaagagccggcagttaaattttcactcataacctcagggaaagtagcaacataaagcactgctgatagcgctaaagaagcaattaattgcactaaaccatcagatataccatcggcagagactatcttcatgcctttccgacgcatatcattactgactcgatcaaaacgtgctttttcaactttttgcccaccaaatgaaagaacaactttatgcccttttaacatttgctccgttgtgactgtcaattctcccatagaattttgaatattacggctcaaaatacgaaaacgctttgaaacaatactaattaaaaatgcgataatg

SEQ ID NO: 93920 - DNA, 787 bp, Oryza sativa
  unsure (1)..(787): unsure at all n locations
catggcattgagtgacttgcgattcactatgggcgaattcgagctcggtaccccaacgggcagagcatacagtgcttttcctagcgcattaatgccattgattaaccaacatggatttgagctttttgtgactattaatgggcaatataatttctatcaaactcagctaatcagtcagtatggattaagccaacaacaaattgaacgctgtatccattttttaaaacaacttaatattgcttatggtttcgttaccaccgatcaaatcgctgtatcagaaaataacctaatggtgcatgaggcactctcgcccatcaaagccgattatattgttgatgctgaacattaccgacaacataacgtcatgcaactattagcattttatccacaagaacgtgatcacgaaatctttaatacaggaatctttcaacaggatttaaaagtgcctcgttggcatcaaaatgcggtcgatattctctgtaaacaacattcaaaagcccaagggattaaagatgtgattaaacattttaatctcaacctagccaatacattagcctttggtgatggttttaatgatttagaaatgttagaaacggtcggggtaggcgttgcgatgggtaatgcagaagaaagctgtaaacaattagccgatttttgaacccaaccaatcaacgaagatggtatcttatatgcattagaacatctaaacaatatntaaataacccactcgtaaacaaagggttcttacgaagatgcattcatcagccttatttatcaagcggtcgat

SEQ ID NO: 93921 - DNA, 831 bp, Oryza sativa
ccattgttctttaaggaaaatacccaaatgttatttggtgatgctaaagaacgggtagatgatattttacgagcattaaattagcattattagtgagtcaagcggtctgattattgaaatatgatgtaaataaagtagataattagatcgcttatgaatgaaaaaagccttaatttaaggctttttatgttgattaacggaaagatttatttatcttcattgatacgacttgaaatcgcactttgttgatttttatattttgcatcttcacgggcgttataaggcttagccgctgctccactcaatacttcaaagcttaatgcaccaatcgccatattaagacgcaaggctaatggtagtttaccagcattaaagaattctaatacaattttgccgtgccaaccttggatcaatgcgatgagcggtaacatgtaccattaatcctaagcgagccaatgaagaacgttcatctagccaaccaacaatattatccggtaatttcactgactctagggtagtggccaaggctaattcgcctggatgaaggaaaaaagcttcaccttctgctaaaataatttcatcactcatgattttttcaagttgtgcgctgacttgttcaccaggcccacttaaatcaatataaggtgtggcgtgctcacgaaaaacacggaatgaatttcctagtcgcacatcaacggtcgcaccagaaattttatcattagttgggcgagggctaatgttaatgagatcttgatctaaataatgctcaatatcggtatcacatagacgcataacctatcctatttttttgataataattgtttgatttgg

SEQ ID NO: 93922 - DNA, 809 bp, Oryza sativa
  unsure (1)..(809): unsure at all n locations
caacacgtgaataaaacagaatccgccgtgcgaattactcatatgccatcaagtattgcggggcaatgccaaaatgggcgttctcaacatcaaaataaagatcaatgtctgatacagctgagagctaaattataccaaatggaaatgatgaaaaataacgctgaaaaacaagcaatggaagaaaataaatctgatattggttggggtagccaaattcgatcatatgtattagatgactctcgtattaaagatttacgtaccggtgttgaaaaccgtaatacacaagccgtactagatggtgatttagataggtttattgaagccagtctaaaagctggtttataaaacaagcggtaacttttacagttcatttttacacaaaaataaaaatagcccattaatttgggctatttttgtttctgttatgtacgctcaatcacttaaactttttttctcaatactaactgacttaatactactagtgacaatgagaaaataatcataatcgtcgctaaagcattcacctctggcgttacgcctgttttaactaatgagaaaattttcagtggtaatacttcatagcttgggctagtcacaaaagatgaaacaacaacatcatctaatgaaatggtaaagcttaataaccaacccgaaataattgaaggcaacgccaacggtaaaactattttgcgtaaagtcgtcacctcactagcgcccaaatctttggcagcttctaacattttaccatcaaaatcactcanccgtgatgaaatagtaataaaaacatatggcaaacagaacgtaatatg

SEQ ID NO: 93923 - DNA, 766 bp, Oryza sativa
acatcattacgacaaataacattccgccaacaaattgcttaccacggaatttataacgatataaagcaattgaagtcaatgaacctaaaatcgtagacaatgtagccgcaaaaaaagcaattgtaatcgaatttgtagtggcattaatcaacgtatcgttagcaaataaacgttcataccaattccaactaaagcctttccattttagaccgtaacgatcagcattaaatgaattaatcactaaaatgatgataggtatatacaagtaaacaaagactaaacaaacaaaaaggtttctaaatatctttttcattattcaagctccacctttttatttaaaaatttgttagcacgataatatacatacaacatcaatgccatgagcaaggttaatgcaatactgactgccgatcctaatggtaactggttagtattcaagaatagactcttgataatattaccaattaatggcgttttaccaccgcctaatagatctgcaacatagaacattcccatcgcaggcaataatactaataagcaaccggccacaatacccggcatcgttaatggaatagtgatacgaataaagcgttgcaatgcatttgcacctaaatcttttgccgcttctaataaacgattatcaattttctcaattgaagaatacagcggtaaaatcataaagggcaatagaatataaaccaaaccaataataatggccaattctgaattgagtaaccgtaaaggttgatcaatcaaacctactgcg

SEQ ID NO: 93924 - DNA, 785 bp, Oryza sativa
tgtgggcatttgagtgacatatctgatcactataggcgaattcgagctcggtacccttttggatttaccattaacttgctgaccttacttggactaattttagcgattggattgttagtagatgatgcgattgtagtattagaaaatgttgaacggcatatcaaacaaaacggagaaacaccattcagagcagccattattggtacgcgcgaaattgcaacaccagttattgcaatgaccatcaccttgatggcagtttattcgcctatggcgttaatgagcggtattaccggatctttatttaaagaattttccttaacacttgctggagcggtgtttatttcaggcgtagctgccctaacactttctcctatgatgacaagtaaaattctcaaacaatcagaaaaaccaagctggttagaacaacgtatagaaaaaaccttacataaagtaacggatatctataccaaaatattattggttgttatggcaagccggtatgccatattagtgtttgctggattaaattttgcatctttgccgatgttatttaattcactttctagtgaagtaccccctggcgagacccggggattggatgggaatgggaaagtggcctgcccacgttatatggactattttgcagacgtgatgtttcctgttgttaaccaaattatcaactgccagaagtaatgccacacacattatgcccgggttttccttttattattggtcaattatgtaacggcgcttaaagattgaagtgacctccttgtcacaaaaag

SEQ ID NO: 93925 - DNA, 767 bp, Oryza sativa
atggcctttgttgagtgagcacccatgcaaataggccgaattcgagctcggtacccgggcttgaattatcgcatttaatgcaagcattagatcaattttcaacacgtaagattgtttatgccgatctctattttcaattgagtgtggacgaaagttggtcattagaagattcaattattaaagagggtggcttttatatcgatcgtggttttggtgtccgtgcggtttcaggcgagaaaacgggttttgcttatgccgatcaaattagttttaatcaattattacagtgtgcgcaggcagcacgttcaattgataatacgcatagccacttagccatacagtcgtttaaacaaacggttgctcctcagcgttatgctgcgatcaatccgttggatagtattagtcgtgagcagaaagttgaattattacatttagtcgatcgtaccgcacgagctgaagatagccgagtgatgcaagtgaatgcgggtatttcggcggtttatgaagaaatattgggggctgctactgatggaacctttacccgcagattttcgaccgcttgtgccgttggcggtttccgattagtagaagaagatggcaaacctgagcgtggttaaccggtgccggcgggtcgtatggcttaccgtgtttttgagcctcaatactaatggcaaatggagggctttcccggccgaatttttactaagaagcggttctcaggctttttaattaggggattactgttcggcgggccaaggcaattggtt

SEQ ID NO: 93926 - DNA, 707 bp, Oryza sativa
  unsure (1)..(707): unsure at all n locations
cccagtacttttgggggcgggttgttgaaaaaagggctcatctaataacattgctaatagtgtggtatttactttaccggttgatgcccattccccattgtggtcgtaatgtttgctgattgggcattaatacggaaatattaacaatgccacctatgtttaacaccacggttaaacggcggcgatcggcaaaaatgcctnnnnnnnnnnnnnnnnnnnnnnnnnnnnnnnnnnnnnnnnnnnnnnnnnnnnnnnnnnnnnnnnnnnnnnnnnnnnnnnngcctgttttggcggcaagtaaatgcatatcaccgagttgtagcgtaaaaggaaatgcgccacttggctaatgccaaacggtttgtccgtgacaaccaatggcttgaatatcatgagcatgcagttgattttgtcttagaaaatcatgtacacaatcggcataaagttgcccaagctggtgatctatctctcctaaattttgcaaactggtttcacctgttttcagtaattgtgtgagcaatgttcgcaagttttcgggcattggtgtaaagctagaagcggtcagttttggtggattttgtgcaaaatccattaaggcgagatcaacaccgtctaggctagtgccggacataatgccaaggtataggttattttgcataaggcttcattgattggaaaatttgttgaattatatcgaatattgtgct

SEQ ID NO: 93927 - DNA, 627 bp, Oryza sativa
  unsure (1)..(627): unsure at all n locations
attttagtggcaaaattttgggtaagcggtcgtttttattactttttagcaaaaagccctcaagcttatttgctgagggcttttttatggcgagattaaagtgccatattggcgcttaataagccaaggttattaaataatcatatttaataaactcggtagcatattggcgattagcaaaccaaagcagatcctaaataccatacttaataaaccaggtagcatanagctatggttgaaaatatatttgccaattttagtggtgccggtagtatcaaagtcaattgaggcaatgattgggccatagttaggaatgaagaagtaaccatttacggcaacaaagaccccaatcagaacgggtacaggaataccgatagcaattgccaatggaaaagtgtagcaacggttgccccttggctgtttactaagatagataaaataaagagcgcaaaagcaaatgcccaaggcgcagtttcaacgaggcctgataccatacttttcacttcagttatatggctttgcattaatgtatcccctaaccaggcaataccaaaaatggcgataactgcacgcatacctgcatggaatacagaacctttggtaatttcgttaccatttggtttacag

SEQ ID NO: 93928 - DNA, 741 bp, Oryza sativa
ggcctattcgagctcggtaccctgttgtgcatggttatggtttagccgcgtcacaactacaacgattgcgcgatcaccatattccattaacagtagctgtcgataaagtcgcggcaagcggtggttatatgatggcatgtgttgcaaataaaattgtcgccgcgccttttgctattctaggttctgttggtgtagttgctcaagtgcccaatatccatcgcttcctcaaaaaacacgagattgatgtagatgtgatgaccgcaggcgaatataaacggacagtaaccttagccggtgaaaatactgaaaaaggtaaacaaaaattccaacaagagttagaagaaacacatcaattatttaaacaatttgtggcaaataaccgtcctcagcttgaaattgaaaaagtagccacaggcgaacattggtttggccaacaagcattaacgttaaatctgatcgatgaaattgcaaccagtgatgatttaatattaaatgccgtcaaagacaaagaagtcattaaactagcctttaaacaaaaaaaaaagttagcacaacgtttaggctcacaaatggaacaatcactcgaaaacctcattgctaagctattacataaaaaccgatcaaatatgctttaatatgcaaaaaacagaagcggtaattacaccgcctttttagggttaataccacccgtattttgcgcctatgttaccccaaatcaacttaattagctggctcttcttt

SEQ ID NO: 93929 - DNA, 1058 bp, Oryza sativa
caccttaaacggttttatgcacattccgttgaaataaaaattaaagcagataatacgcctgtaacggaagcggatctttttctcagtcaatttattatccagcaacttcaacaattaacgcccacgattcctgtgttatcggaagaaaattgtgccattccattaacagaacgggcaaattggcaagaatattggattattgacccacttgatggtacccaacaatttatcaatcgaaccgatcaattttccattgcgattagcttagtacaacacaatcagcctgtaatcggcattatttatgcgcccatattagccaaaacttattttgcaatgcgaacaagcggtgcttttttgcaagaaaatggcataattcgcccgcttactcctcacaaaattatggccaataatgagcgcttacgcatcgcaatgggagcaaccaataggacgacagtagcccaatgcctacaacaacctctacaagcagatatctttcaatatggctcgagtagcttaaaagccggtttagtcgcagaaggcaaagccgactgttacattagattaggcgatactggcgaatgggatactgccgccgctgaagtgctattaaatgaaatcggtggcaagatttttgatcttaattttcaaccgcttagctataatcagcgacaacattttattaacccgcattttgtaatggtggcagacaaacaggctgactggcaaaaaatctttcaattcaatgagtgacatctacatgcaaccgctattaaaatgttgcatattaggtaaaattttcattccaatcgagaatcaaaatgaatatagaaaatagttgtatcgtaatttttggtgcatcaggggacttaacattccgtaaacttatcccagcactatataatctttttaaagtaggtcggttaggcgaacatttttctgttttaggtgtttcacgatcagacctaactcacgattcttttagacaaaaaatgcgtgaagcattaatcaaatatgagcaagcaagcgggcagtttttagatgatttttgcaatcacttg

SEQ ID NO: 93930 - DNA, 654 bp, Oryza sativa
tactcgggtaactgaaatcgtaatccacttcaaaacgactccacatccagtctttagccaaaatgcgcctgaaaataaattaattatccgggtacaacctgatgaaggtatttctatgcggtttggtttgaaaaaacccggtgctggttttgaggcgaaagaagtctctatggattttcgctattctgatttaagctctgcttcaagtttattaaccgcttatgaacggttactattagatgcattaaaaggagatgcgaccctatttgcccgaaccgatgccgtacatgcctgttggcatttcgtacagccgattctagactataaggcagaacgtggccgagtgtatgaatatgaagcaagcagttgggggcctaaagaagctgataaactgattgcacgcaatggcaaagtatggcgtaaaccgtctggaatgatgaagaaaaaaatatagtcaacataagaaaatagctgcaataatcactattttctgtctaattaaggaatattatgcattaccttattttcccaacggcacaatgtgccgttgaaaaaatagcgcaagagtttattttatatagtcaattaaatcgccctgtacatatttcattatcgggcggtagcacaaaaaaattactcttcaaaaccttggct

SEQ ID NO: 93931 - DNA, 2235 bp, Oryza sativa
  unsure (1)..(2235): unsure at all n locations
actaatgaaagcaacagaacagctatcaagcctagaaatgatggcggtggatccattaagacgagtcatagcgcctcgcttttgggcaggggttatttcaatgccaattttagcagtcatttttaccgctattggtatttggggcggttcattagttggtgtggactggaaaggcgttgatagcggcagtttttggtcagtcatgcaacattctgtaaatggacaagacttgatcaatggttttattaaaagcatcatttttgctattgctgttgtttggatcgcattatttaatggctatgattcaactgctacctcagaaggtattagccaagccactacacgtacggtggtacatgcatcattaatcgtgttaggcttagattttattttaactgccatgatgtttggcggttaactcaagaaaggaaataaaaaatgcgtcaatcaatcaagtatgaattttgggtcggtttatttggtcttatttggcttagcttccttagtgtttttaggcttacgtgttgctaatgtacaaggctttaccactgaaaaaacatatacgctatatgcaacttttaataacattggcggactaaagaaccattcaccgattaaagttggtggagttgtaattggtcgagtttcaaacatcgatttagatcctcaaacctatactcctagagtcactttagcaataaaccaaacttttaataaaattcctgatacgagttcgctttcaattaaaacttcaggcttattaggtgagcaatatattgtattaaatgttggctttatgctagaaggcgaaacggaatatatgatagaaggaaatagctttgccgataccaattcagcgattgtcttagaagatttaattgggcaattcttatatggcgataaaaaatcagcaaccactgaataataagaagtagagtaaattaaaacacgacactatttaaacacaacgagatattcgttgatgattaaaagtgacagattcattttatcatttggagatttacatgttaaaacagcttaaaaaagttattattaccacggcgattgcattagctacactatgctcaacacaagcatttgctgaaactaacccatatctattaatgcaaaaaactgcggataaattattcactaatattaaaaacaatcaaactaaaatcaaagcgaatcctgaatatttacgtgatatcgtacgtgaagacttaatgtcatacgtacacatcagatatgctggccaattagtgttaggtaaatcactttcttctgtatcagagccacaacgcgaaaagttttttaatgcttttggtaaatttatcgaacaagcgtatgcgcaaatcttaacacagtatgaagatcaacaaatacaaattgaaaatgaaaaaccacttggcgataaatctattgtcagtatccgcgtaaatgttttatcttctggtagcacgccacccattaaattagattttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtaatatcttacgccaacaaggtattgatgcattaactaatcaagtagaaaaagcggctaaacaacctatcactttaaataaataatttatttatgatgccagaaaaaacattacaattcggtattcaagagcaaaatggaagcctttttgtaacattattaggtgaattaactcgagacacgttgctaccattatggaagcaacgtgcttcttttttatctaacccacataatgaaacaatttattgggatttaaaccatctgctacgaatcgattccgctggttttgcattactcatagaattgctaaaccactaccaaaaacaaagcacaaattatttaatcaatgtaccagatgttatcttaacattggcaggtttatttggcttacaagattggttagactcatttttaacaaaaagtaaaacagactaaggattaaaatggaacctacacaattagcagaaattttacgtaatgccctaccaaatgcggttgaaattcacgcacaaggtgaaaactcacattatggcgttattgttgtaagtgatgaacttgctcaattatcaaaagtaaaacagcaaccagcggtttatgctccactgagcgaatattttgctacaaatgcagtccacgcattaacgatcaaagtcttct

SEQ ID NO: 93932 - DNA, 1102 bp, Oryza sativa
taagcgggcaaatggatggcgttgatagtagtgtgttaatgatgaatggtattcagtatcttgcttggtcagcagttgagatgtggctgaaaattgaatacctttaattgcttgaatatctgttatttgtgctgagatggtgccaactattttggggttatgtacataatttgtgaatggcgtgtgtttttactggtcagtaaaatcaaacgcgccatgttgtgatcaaatgcataaaaacaactggctgtccagaaatcatcaatagtgtatgctgcaaaattgacgacgtggttatcttgaataaaacgactgatgaatgatggtattttttgcatatttgtgtagcgttatttctctccccaaccaggcattgcgatatcaatattaaatacatctaatgcgcgacttacgctatcagtcacaatatcatcaatggatgtggggttttctcaattacatcaataggagttttaaaatgaaagtgcctgtttattccaaccactatttgcgagccaatcacggacaaattgtttatcgaatgatggtggatttatcccttcttgataagtttcgaccgaccaaaaacggcttgaatctggcgttagcacttcatccatcaacgttaatacaccattctcatctaatccaaattcaaatttagtatcacaaataataattccttttgttaaggcatatttcacgttcacactcttcgtatgaaatattcacatcgtgatcacccacttcagctttactagacggcgtaaaaataggttgtggtaatttactcgcctcaactaacccggcaggtaatgctaaaccacaaatactaccggtttgttgataatcttttaagcctgaaccggtcaaataaccccgcacaatggattcaattttcacaggtgttaaacgtttacaaaccactgcgcgatgttgaatagcctcagcttcttctttagctaacacatcgaaaacagaatcacccgtaaaatgatttggcataatatgctcaagttttttaaaccaaaaattggagatttgcgtcaagatttcacctttagcaggaattggatccgctaaaataacatcaaaggctgac

SEQ ID NO: 93933 - DNA, 561 bp, Oryza sativa
atgtttatggtgcagatcatattaaaggcgctaagttttttcttgaaagacaccgattttttgtggtggaagatggaatgatgaattattccaaaaatatgtatgcgttctcactctttagaacaagaaatcccggtattttgccgggtggttttcatccaaacctaaagactatttttttgaccaaagataattcgatcccagatcaaattgctcataaaagagaaatcattaatatcaaaacattatggcaagctaagaccgctaccgaaaagactaaaatactttctttttttgaaatagatatgcaagaaatatccgtgattaaaaacagaagttttgttctctatacgcaaccactttcggaagataaacttctgacagaagcagaaaagattgatatatatcatactattttaactaaatataaccattcacaaacggtgattaaaccgcatccaagagataaaacagattataaacaactgtttcctgatgcttatgtgatgaagggcacttacccttcagaattattaactctattaggtgtcaattttaata

SEQ ID NO: 93934 - DNA, 629 bp, Oryza sativa
tttagcgattttatgtgtattgatcagcgcattggctaagttaccattgccacaatcaattgcagtaacgggctcgatcgaccaatttggtaatgtattaagtgttggtggagttaatcaaaaaattgagggcttttttaatctttgtaaagcgcgtcagttaacaggtaaacaaggcgttattattcctgccacttgcctttctcatttaagtttaacctcagacgtgatcaatgcaattaaagcaaaacaattccatatttggagcgtcaaaaatatctttgaggccgtatggattttattagaacatcatttttatgatgaagaccaaacaacagcaaacgataaaccaactattttcaatttgattcatcaacaacttgaacaagaacaagaaaattctgctagcgggtcattttttgcaaaaatttaccaattatttaccaaaaactgatcggatttgctcagctaacagttgttagctgatttaaaaggctgtactatttcaaatatcatcagcctagattctacgggctttttcgtaatatttaaaggattaaaaacatgaacaattgtacacctaatatcaagtcaagttatggttatgaagatttattagcttcaggacg

SEQ ID NO: 93935 - DNA, 567 bp, Oryza sativa
gagctcggtacccaatgcttttagttggctactttatttacggaaaagtggttgaacggatctttacgatcaatccccaaaaaatgacccctgctcatgcaatgagtgatggtgttgattatatgccaatgtcaaaaaccaaaatttggctgattcaattattaaatatcgcaggcaccggtcctattttcggaccaatcttaggtgcattatatggtcctgttgcaatgctttggattgttctaggttgtatcttcgcaggtgcagtacatgattatttctctggtatgttaagcgtccgtaacggcggtgcaacaatgcctgtattagccggcaaatacttaggccgtcctgtcaaagtcttcatcaatataatggcattacttttattattactcgttggtgttgtattcgttgctagccctgcgcaattaatggccactattacaatggatgtattaggtggtactagtggtgcattacagttaaatgatgctgaaacagttcaccaatcattacaaacaacaagtttaacggtttggggaatggataaagcgaccattattt

SEQ ID NO: 93936 - DNA, 559 bp, Oryza sativa
tttaggcttacatccactctatattgcacaacatcaatacaccgatttagatttactcgcgaaccactaagcaaagcaagacagacaatgctccgcgattgcagaaattggacttgataaaggcatagcaacaattgcgaccaccgcaatgtggtataaacaatgtgaattcttagaagcacagcttgcgctcgccaaacaagcaaacttagcggtaagtttacattcacgtaacacgcatgatcagctcgctgttttactcaaaaaaaatccattaactaaaacaggggtcattcatgcttttagcggtagctatcaacaagctaaacgctttattgaattaggctataaaataggggtcggtggcattatcacttatacgcgcgccaacaaaactcgcaacacgatcagtaaattaccattagacagtttagtcttagaaacagattcaccggatatgcccgtttttggctaccaagggcaagctaaccaacctgaacgaatcaaactgatttttgaggctctttgtcaaaaacgttaagaatccgctgaacaaatt

SEQ ID NO: 93937 - DNA, 707 bp, Oryza sativa
aataaatggtttataatataaacgcacgccccaagagttatcttccaatttttcacctaacgccgcatataaatctcgactaaagccccaatcaatcgcagcttcagtcattcccattttactgacattatagaaacgtttttccgcattcaaagttgcttcaaatttaccattatgatggacttcaatttcagcagtaccgccttgatagttagcaccgtcagtaatttttatccctttaaaggtaaaatcataatctttaatttgaacagtatcgccaaccttcatccgtacatttttttcaatactgaaattttgactaaacgtaatgccaaagactaacattgccacacctaaatgcgccaaaaccattccccaatgcgaacgagaaagcttaaatataccaacaagaaagctgtgtcgatgtgtagcacgttgatacaactcatacaggctcaacaacacgataataaccgccatcatgacaccaaggatcaaggtatcgttattcgatctataaaccaataaggcagtcaaacaccaagaatcaacatcagtacaaatgaaataatcaccggtagcctaatagctgaaacctgatctctacgccatttgactaaaggcccaatacctaaaaaaaatgcaaatggcaccattaaaatcaaaaacatctgatcaaaaaaacggcgcaccaattgaaatcgtgc

SEQ ID NO: 93938 - DNA, 852 bp, Oryza sativa
agcatatttgtagatcaagcggtcgatttaagcaattttttgcaaattcgaccgctttttattatgcgtttaaaaattatttttaagttatgcttgttttggttagaatggcaaatacgttacggaatagatgataagaggcgtacagatgaaacacgtttatatttttagtgccgggcctgcgatgatgcctaaagctgttttagcacaagcacaacaagaattattaaattggcaacagcaaggtacttccgtaatggaagtcagtcatcgaagtaatgcttttatggcgcttgccactcaaactgaacaagatcttcgacaattatatgctatacccgataattataaagttttgtttttacaaggtggtgctcacggacaatttgctgcaattccgatgaatttaattggcaagaaaggcaaagcgctttatttaattagtgggcattggtcaaaccgttctgcgcaagaagctcgtaatttttgtgaggtcgatcagcttaatatattaactcaagatgaagcgggtgttttttcggttaatcagacagattttagcgatattgctgagcaatatgattatgttcattattgtccaaatgaaacaatcagtggcgttgaaattccggatattccgattgtcggtaaagcggtattagtggctgatatgtcttctaatattctttcacgtaatattgatattagcaaatttggcttaatttatgcgggagctcaaaaaaatttaggtcctgcgggcatcactattgtgattattcggcaagatttaatcggtaatgcacagcgtgcaaccccgtctatttggaattatgccacgcaagtgaatgccga

SEQ ID NO: 93939 - DNA, 596 bp, Oryza sativa
cccgaatgccaacataatgcgcatttattttatttaaaattaacagattcagccgatcggaacgcgttattaacttggcttaaacaacacgatattttagcggtgtttcattatattccattgcattccagcccagcaggtaaacaatttgggcgctttgtcggtgaagatcaatttacaacacaagaaagtgagcgcttgctaaggttacccttgttttataatttgcatctaacagagcaacaacgtgtgattgaggttggacggattattttcagtaatgcagttgttaagtaaaatagcgatttggactacattagcgaccttattcaaattagtggttggcttgctcgtgctgaaacttttggggtggcagtttggtacagcaggcttaggacaagcagccaattttatgacgttgatcacagtcttgacggtctttgctggtggcggtatcgcgaatggtgtaactaaatatgtagcagagtttgaacatcatttaccaaaacagcaggctttgttggcaacggctaatttgattacggtattcttttcttgcctattagcggtctgttttattagtttttctcacaaaa

SEQ ID NO: 93940 - DNA, 599 bp, Oryza sativa
catcaacaattttcatttcattggttattcagtattatttatttcagtaccttttatctaggtttcccgtgctcaatgttattggcattgctgtttgatgtaacgctacctaactatgaaatgttattactcaccttattgactgcgttagtgagctacttactgtattacttcgtttataaacgagtaaatttgattcgacaagcggtacagaaaagacaggattttgctaaatcagaagctattttgaccgcttcactattgtgtatgattggactatttagcttaatcgcttttatctcaatgaatggcttgttaatttttaaattagaaaaatatagccaaatcttttctagtatcgtacaaggtatcccactaaaacgctttttttattttttcattgccggcttgttagtcttcttcttcctatatgaaaataaaaaaacttggttagcatttttattgattggcgcattttttggaggttttgcctatcttgcagtgggcggaacacgggctaaccttggtttagcgatcgtattattcttattattaggcctttataaaggctatttatcatataaatggttgctcttcat

SEQ ID NO: 93941 - DNA, 773 bp, Oryza sativa
gcgtcaaacattagtaccgccaattatcacgactcccctttatttcttgatttttggtcaattaattggcagtcgttttggcgaaatgaatggggtcagttatatacaattttttgcacctggcttagtgatgatgacagccattacagcgtcttatgtaaatacggcctcatccttttttctaagcaaatttacccataattttgaagaactattagtttcttctctttcaacccataacattatttggggttatgttgtcggcagtatcgtgcgtggtgggctttcaggtattttagtcacgctgatttcattgctattcgtttcttaccaaattcattcttggagcattattctgttaactttattaatgaccacaattgccttttcgttaggtggcttaattaatgcggtatatgctaaatcttttgatgatattggtagcattcctacatttgttttaacgccattaacgtatttaggcggtgtattttattcaattacattattaccagaattttggcaaacactctcaaaatttaatcctattgtttatatgattaatgcctttcgctatggttttttaggtattagtgatgtatccatcgcttatagtttctcggtattaatcatttttattctaatactatactattttgctttttcattaattgaaaagggcgtgggattacgcacctgattttcattgttataaattgtacgagagataatgctagaatcatatccatctctcgtataaaacattaaggaac

SEQ ID NO: 93942 - DNA, 664 bp, Oryza sativa
atccgcaacatccttatcatcaagtgtcaaaagcaacttatccctattttaatgcgatgaaaatgcccactttgttgaaagcggttgaaaaagtagatgactataccgtcaaatttaccttggctaaacaagacacgacttttatttcaattcttggtatggactttacctctatttattcagctgaatatgcagataaaatgttaaaagcaggcacgccggaaatgattgacacgacaccaatcggcacagggccctttgcgtttactagctatgtgttagatcaagcaagtcgctacgtggctcataaagattattggcaaggaaaagctgatttcgaccgcttgatctttgaagttgtaccggatgcgacaacacgctatgccaaattaaaagcaggacaatgtgatttaattgattatccgaacatcacagatattgaaaaaataaaaaccgatccagccgtgcaattactgtcgcaagcgggtttaaatattgcctatgttgcatttaatactgaaaaagcgccttttaaccatattaaagtacgccaagcgctcaatcttgctgtagataaaaaagcgatcattgatattgtttatcaagggggggggattgccgcgaaaaaacctttaccggctactatttggggctacaatgatag

SEQ ID NO: 93943 - DNA, 673 bp, Oryza sativa
cgaattattaagaatgttaatgtaaacgcaacgtcaccattatggttacaagaaaaattacgtcgttgtggtattctctccattgatccaattgtcgatattacaaatttaagtttacttgaattaggccagccaatgcatgcttttgatgccgagaaggtaaaggcccctattcaagtccgcctagcaaaagatcaagagcagttagttttattagatggtaccacggcgaagttacaaacgaatacattagtcattgctgatcaaaaaaatgtccttgcacttgctgggattatgggcggagaagcaagcaaagtaaatgctgaaacaaaagatatcattttagaagcggcattttttgcaccattagcgctcaccggccgtacacgtcaatatggcttacatacagacgcctcgcatcgttttgaacgtggtgtagacccaacgcttgctcgtcaagcaatggagcgcgcaactacattgatcatagagatttgtggcggtgaagtcgctgaagtatgtgaagcgataaatactgaatatttaccaaaacagccgatcattcgcttacgtcgtaccaaattagattcagtgataggccattatattgaagatcggctagtgacggatattttagttcgcttagggctaaatgtgacatgcgaaaatgatg

SEQ ID NO: 93944 - DNA, 917 bp, Oryza sativa
ctttagtttcacgtattaaatcaagtttcattcggatatttgtttttaagcttttgcgctctgcgagaataggcatattttctaccacttggtataagctatacattgcggaatagcgactaaatcctaaacccaatacttcacacaagggttttaaacgtaatactccttctgaaaaatcacattgtgccgataacatagctcgactaatcacgtcaatgctttccacaatgcttgctatccgtgcttgtttagcttgcatcgtttgttgcaataatcgttgcttagcggtttgttgttgacgtaatttaaccaataaatagaaagcgtaccctgccatagtaaatacgatcaggacagctaatatgataagcacaaactgaaacataaacgcttccgactaattatttaaatttattaatgtctatcgtttcaaattgacgtagtaaaagatcctcgttattttcttcatcatcttcaatacctaattcaattattagttcatgtacacgatctaaacattcatcaacaaactgttgatcttgggttgatagtactttacctgcttctaactgatccaataattgatttaaacattcattattttctaattgcgttaattcaacttccggtgaaaccgttgcttttgtggcgtgatttgatggttcaagcggtacgggtttaatcatttgtcctttttctggtttattgacaaattcgaccattaatggcacttttttgcggctgccaacacgtggatcctttttaacttttgctgacgctgtcttttgctctgttattacattacgagagccggttggtaatcctttatgcttacgctttttcttctcttcacgtgcttgtacatctaattcatagcgtgttggtttccgcttcttaccgttgcttattggcaa

SEQ ID NO: 93945 - DNA, 572 bp, Oryza sativa
cgactctagaggatccccatttgcaagcgggaatgtcgctcagcatttttttattcgataatttgatcgcacaagtggatttatcaagtaaagagggcaaatccaagttggcggcgcttgcagaaccgttaatcaatcgcattccaggcgaaatgttacgcgtttatttacgtaatatgttaggtcaaaaactaggcattttagatcctgcacaattagaagctattttgcctgctaaagtacccgcaaaccgtaaatcaatcgcacaagcgttgccgattaagcggacacccatgcgattattgatagcattattgttgcagaacccagaattagtccagtttgtacccgatatttcagcgctacagagcttacaagaacccggtttccaattgctagtggaattgatcgaagtgtgccgcgaaaaagtcggtatttcaatgggagtgttattagaacattggcgagataagccacattaccgtacattagaacggttggctaattgggatcacctagtgacgcctgaaaatgtggaaagtacttttattgaaacgcttgattttttgtac

SEQ ID NO: 93946 - DNA, 602 bp, Oryza sativa
attttttatttaattcagcttcaattgtttgaccatctgcagcaattttgtctaattgagcttgtaattcactaaatgccttttgtgcttcaggtgttggatttttagctaattcactattttgtttgatcattttagcaccaagtgtcattgcttgaagagatttatcttttaatgcttttacttgttcatctttaatctctaaagatttagcattttgttggattttctcaatttgatcaagaattgcattatttacagtgtcttgaacaatagtttcatctttagctttttcttcaccaagtttctcaagttcgttattaattgcttcaccaattaatttttcttggttttgttgccattcttggaattttttgtagtcttcagcgccggtatccattttagcttcaacttttttatccgcttcaggttgtgttgccgccgttgcagcaggttttgtttctacagggttgtttgcaggcttatcacaagcagttaaaaataatgcaaataatgcagctgcgctaattttagtaaatttagtcatttgaaagtcctatgtcagaaattgatagtatttactctaagtggttaactttatc

SEQ ID NO: 93947 - DNA, 534 bp, Oryza sativa
  unsure (1)..(534): unsure at all n locations
ttattttttgataatcagtataagcatcggttggtatatgctcaaacacgcctagttgttgtaacattttttcacctggcggtattaattgcactgacgcgattggcgtagtatttttgggtttttggtgcggatttttcaatgattttaatttggcaagggctatcttttaataagccagcaagcgccaaaccaaccattccaccaccaataataataagatcagcagatttcataagcgttatttttacatataaagcggtaagaaaatgtgtattagttaagtttttttatgatatttttcaaggctacggtggcggattttgacatttttgccacggctttgaaagtatttagctaattgttcagtgataaagacggagcaatgtttccacccgtacaccgatgcgatggttaagtagcttcggttatttttttctaacattggcagccaagtttctaaataattgcgtgttnnnnnnnnnnnnnnnnnnnnnnnnnnnnnnnnttcaagaaagtcaatgaccggttgtt

SEQ ID NO: 93948 - DNA, 659 bp, Oryza sativa
cccataactaaaatattaagcgggtaaggttcagctgtggcacgtgctttaaaacgttgggccggatctaataattcagataagtcttttctaacggggttaccaacggtttctgctttagcaaaagctgttgggaatgcttgtaagacacgttttgcaattttggctagccatacatttgttaagcccgcgattgcattctgttcgtgtaaaacgatgggcacattgcatagccttgctgcaattccacctggtccggaaacatagcctcccatacctaatacagcatcagggcggtatttttttataatgttaagtgcttgtaataccgcttttagaatagtaaaaggggctttgattaatgctagaacacctttgcccttgagccctgaaatttggataaattcaatggggatattgtattggggtacaagctctgcttccattcgatctttggtacctaaccaacagatttgccagccttgtttttgtagttcttgtgcaacggcgattgcagggaatacatggcctccagtaccgcctgccataattaaaagttttttgctcatttatgatctcatgttatggctaaggatcaaagagttctttttacaagatccatactttgattttcaatcgaaaatttgcttattctacag

SEQ ID NO: 93949 - DNA, 631 bp, Oryza sativa
caattcctttcttactgatgccttatctatcgcgtaaattaggcgtagaagggtatggtgagttatcctattaccaaacatatttagtgttattcttaattttggttagtcttagccaagatggtgcgttcgcgcgctatttttatttttacggtaagcggtcattaaatgtaattgtacatacaggctatttttatactttaatcgttggtggcattattttggctgtttgttggttgttacaagcggaaattattgcttatttggcggtttcagctatttttcaatcttttcttgcagtgcaattgagtgtccggcaatgtcagaaacaggcgttgcaatatatgattattcaatcattaactagctttacttctatttttttgaccgttgtgatgttggagttttatcaaacggatttggtcgaaaagcgtattttggctattttgtttggtaatttaatggttttctgtttggtttatttcttttatgtgggcaaagtaacgagtaataaacattattcattgcggcaatatcaattaagtttggtctatattttaacgtttggtttgccgttattattaaatcaagcaggcttttatttaaaaggacaattagaccgtatttttat

SEQ ID NO: 93950 - DNA, 634 bp, Oryza sativa
ggtatatggaaatatcattaatagaaggcaggaatatcctgccttttctatttgctaaattatcaatgtatttttaaatttatttaggccttatttatgcttacgataatttctccagctaaaacattagattttgctacaaccagtccctcttttgcttattctcaaccagtattgaccgcttacagcgaacaattgattaatttatgtaaacagcttactccggcagcgttaagttcattaatgtcgattagcgataaattagctagccttaatgttgcacgttttatagaatggcaattagtacacgatcaacaaaattcaaagcccgctttatttgcatttaaaggcgatgtttataccggtttagatgcacaaacattaacagaagcacaagttgaatatgctcaaaaccatttacgtattttatccggcctttatggattattgagaccattagacttaatgcaaccttatcggttagaaatgggcactaaattagctaatcataaaggtaaagatctttatgcattttgggataatatcattactacgaactacaaatggcaattgattgataggcaagcggataatattttgattaatcttgcatcggatgaatattttaaagcct

SEQ ID NO: 93951 - DNA, 687 bp, Oryza sativa
gcaattggcattgcactttatattagcattaatgccttcaaaatgttttgggaagccgtacaagtattactggataaagctttaccagaagaagatattaatcaaattttaaccattgttgctaaccagccacaaattatcggtattcatgatttattaacgcgtcaggctggtgctgtacgctttattcaactgcatcttgaattagaagatcacctttctttactagaggctcacacgattactgacaatttagaacaaaaaattcttgcagcttttccgctttctgaagtaattattcatcaagaaccgacatcaattgttcaacaggagcttgttttaggacaagtaaaaaactatgtaccaagttatcgctaatttttcatttcaaaattttgaacatgaccctgttatattgataaatcaaatcatcaatcaatggcgttataatgggcaaattattgggcgtgaattctcggtgacctaccatacacagcctagcgcacattttcaagttcgccttgccacaccagaacaaataagcttaatgccagaatggaataacgatcaagtgacggaagccttatcgcaagcggcagaaaaaggcgtagaatttgaatcttttgaaattattggtcgagattatcaagcagaacaaacatctgagaatagcaacgcacgttttta

SEQ ID NO: 93952 - DNA, 556 bp, Oryza sativa
tagccagcttagcattttttctttatttaagtagaatccgctatgcttgattttacaacctacctaccacgatccaagcggtttaatttacactttttttgttcattaaaccgcttgtcgtaaaacacgcccagtctgcgccttaaagcaattgatccgcaacaatccgtccctgttcaatatgaataacacgatcgaataatgcctcactttctgaaaattgatgggtcaccattaatagcgttaattgacgctgacggcaaatctctaacaccaactgttgcaattcattacgccgaataggatccaacgcagaaaaaggttcatctaataacagaattagcttatcttgtaacaaagtacgggccaacgcaacccgttgtttttgccctcccgataattgatccgctcgccgtaataacaattcagcaatccccatttgaccagcaatcttttttaccgcctgttgcttgtgtggcgttaaatgcaagcgaggcaccaacgctaaaccaatattttgctcaacagtcaaatgaggaaaaacattattttcttg

SEQ ID NO: 93953 - DNA, 562 bp, Oryza sativa
tacaattagctaaagcattggctattttaattaataatggctttgtaaatacaccgcatttaatgctagaaattattgatagcgataaaacagaagcctataaagatcctgtgctttatgatgatattagaggcgtaccaaaacacttttggcaagttgcaaaactaggtatgtataatgtgattaattcaccaaatggtacaggtaaaaaagcgggcggttctttttatcaagccgcgggtaaaagtggtacagctcaagtatttaaccttaatggtgcaaaatataataaagatacattgaaaaaagagttacatgaccatgcttggtttattagttatgctccttatgaagatcctaaagtagcggtcgcgattatcttagaaaatgcaggtggcggtggtgctaatgcggcaccggttgctcgaaaaataatggattttgccttaacgcatacttttaaacaacattcagacaatgtagaacaacccgttcaaaccatagaaaaaaacacaaccgcttgagcgaaaaaaggataaagtgagtaatgaatagagctgta

SEQ ID NO: 93954 - DNA, 555 bp, Oryza sativa
aaattaatccagaagttgcggcagcagacgcgattaaaccatcattgcctgatactcaagaggttgcaacgagcaatgacgaattgcgtattgaaattacaggcaaagaaagttggatcgccgttaaggttccgaacagtaaaaaaagcctagtagagaaactgtatgcaaatggtgaagtattaacgttcaatggcaacgaacaatatcgcctcactatcggcgcgccagcaaatgtaaaaatttattataaaggcgagcccgtactccttaaaattgatgggcgagtcgcgcgaattaaattacctctagtacaacagtaacgagaaaatgttaaaagaagttcctattaaacgtcgtcaatcgacaaaaatttatgttggtaatgtgcctgtgggaggcgatgcaccaattgcagtccaatctatgacgaatactcgtactacagatattgaagcgaccattgctcaaattaaagcgcttgagcgagtgggcgccgatattgtacgggtatctgtaccaacaatggatgcagcagaagcgtttaaagtgatc

SEQ ID NO: 93955 - DNA, 541 bp, Oryza sativa
caccacaattaaatgcgcaaacttatgtgttaatggactataactctggtgcggtattagcaagtttaaatcctcaacaacgtcaacatcctgcatcattaactaaaatgatgacgagttatgttgtcggtgatgcgattaaacaaggtaaagtaaaaaacagtgatatggtcacagtaagtgaaaatgcttgggctcgaaaatttccgggttcatcattaatgtttttagacttaaatacccaagtgtctgtagccgatttaatgcgaggcttaattattgtttcaggtaatgacgctgcggttgcattagcggaacatacttcaggttcgcaacaagcgtttattgatcaaatgaataaatttggtcaacagtttggtttgaaaaatacgcattttacaacggtacatggtctagatgaagagagtcaatattcatccgctttagatatggctattattggtgctcatgttattcgtgatcagccagaagaatataaaatctactctgaaaaagaatttaaatataatattaaaaaacc

SEQ ID NO: 93956 - DNA, 684 bp, Oryza sativa
cgttattattagcagtaataataatcccccaaacccgaatacaaggtaatagagaagtatcattgagcatgctccctaaaaatattttgtaattcaccggtgaggttaaatacttgcgcattttgatacaccgctgaacgcgttaataaaccgtgattaacaaatttaccgataattttattattttcatcacgatgttggcttgcttcaaatgagaagatgtcttgtaaaacaatctgtccattttccatacccattacttcagtaatattcattactttacgtgaaccgtcatttaaacgagatgcttggataatgatatttaccgcagaagcaatattacgacgaatcgcttctaatggtagagaagcgtttgacatcatcaccatactttctaaacgtgcggttgcatcgcgtggtgtattggcgtgcagggtagacattgaaccatcgtgaccggtgttcattgcttgtaacatttggaatgcttatgcaccacgacactcaccgacgatgatacgttcgggacgcatacgcaaggcattgattactaagtcttgcatggtgatttcacctgtacgttctacaccggctaaacgcgtttctaagcgtacaacaagcggttgttctaagcgtaactcagcggtatcttctaaagttaacacacgctcagttggtgagata

SEQ ID NO: 93957 - DNA, 949 bp, Oryza sativa
  unsure (1)..(949): unsure at all n locations
tggctaaggtgatctttcgttaactttttattattttaaacaggaaatcattatgaataatcttgatccattagcattgccattaaatggtaccttannnnnnnnnnnnnnnnnnnnnnnnnnnnnnnngttcacaatggcaaatttatatttacgtttattggtgggccttggttgtcagccgttaacggtagaaaaaaatttagtgggtacttttaccaaagcggcaaccgaagaattgcgtgatcgtattcgtcgtaatattaaagcctgtcgaagaattttttgggattatgaacctaaccaaattgatcaaaataaatataatttctatagtcaactttatgaaagggttgataatttagatgaagcaaaattacggttacgtattgcagaacgagaaattgatttagccagtattttcactattcatagtttctgccaaaaaatattatcgcagtttgcgtttgattctggcattcgatttgataatgattggcagacagatgaaagccatttattacagcagttaagtgaagagatatggcgagagcaattttacccgctgagtttgcaagaatgcgagatcatttataacgaattagaagaaccattaaaagcacttaaaatggttcaatcatttattgggattgaattgccggcgttatctgccgaacaaaaaagaatatttacgccagagctatctactcgttatctaattgaatataagaattttttacagcaaatcaaacagtattggcaaataaatggtaacgaaattgttactattattaatgcggaattaaaaaaaatatataaaacaggggagaaaaaagccttaaatcgtacctcttatcaaccccgttatcttgcaacatatcaatcagagcttgataattgggctaattcaatggatcttactttaccaaaaaatttcgagcgcttttgt

SEQ ID NO: 93958 - DNA, 576 bp, Oryza sativa
aaagcctagtggatctcgatctaaatcataaacaaaattaagcgatctactttgttgcacagtgccttaacaaaaagtttgctggccaataataattgcacgattataatcttgcattgccgccgcaaaaatttcagatgctgaggcgctatggcggtttatcattaccatcaattttccgtcatataatggcttatttgttgttactactgacttatctacttgtatttgaggctcatcttcgtacactttgatacgattaaaagcatctcttacctgtacaacaggactgcttttaataaataacctagttaattcaaccacttcagttaaagaaccaccaccgttatcacgtaaatcgacaattaatccttctattttcttagtcttaatttttgctaataatttgtgcatatcattagctaaaccgatataaaaagcaggaattttaatcactgcaatatttttacccgctactttatcaattgttaatttagcggcactgtcttctaaccgaacggtatcgcgtgttaacgtaatgattttagttttatgcgcttttgctggctcaatctc

SEQ ID NO: 93959 - DNA, 618 bp, Oryza sativa
tattgattttaattttatcaccagcaatgagtatggtcttattgtgaaattaggtgagcaattaaatgatttattagctgattcagcttatgttgtgcgaggtgagcgtcgtcaagcggtatcaacttttgcagaagcattagattggttagtgaaagaatctcggaaaggtttaaccattcaacgttataaaggattaggtgaaatgaatccagaacagttatgggaaacaactatggatcccgttgcccgtaaaatgttgcaagtaaatattagtgatgcgattgcagcggataaattgtttagtacgctaatgggcgatgaagttgaaccacgccgtgatttcattgaaagcaatgcattatatgctaatttagatatttagtttttgctactaacaaaaagccctaaataaagggctttttttgttggtaagaatggttaatttttcaataaattaaaccgcttattgtgcttgtttcgccttacgggctttataccatttaatgcacacataaatggcaagtaatcctaaaccagcaaaaataatgtgttgtccatttttaacttgttcatgtaaccaattgatattttgtgcaccataatcgcctaaatata

SEQ ID NO: 93960 - DNA, 534 bp, Oryza sativa
cttttaagcccgctaattgttcagccgatttaaactcaacctgcccttgcccgtgtgatacggctattggcatatgtgagcctgccatgccattaaaccaagccgagtgagtgtcattgattttgactaatcctacacgggcttcaaagcgttcagatttattacggacgaaacgtggccaattttctgtgcccgggataatttcagctagattagacaccatctggcatccattacatacccctaaggcaagagtatttggattagcgaagaattggctaaattgttctcgtaacattggattgaataaaatagattttgcctaaccaccaccagcgcctagtacatcaccatatgagaatccaccgcatgccactaaagcattgaaattggctagatgatggcgtcctggcattaaatctgacatatgtacgtcaatcgcattaaagccggctcgatcaaacgcagcgggcattttataatgactatttacgccctgttcgcgtaaaatcgcgaatgttggtttgaccccgg

SEQ ID NO: 93961 - DNA, 553 bp, Oryza sativa
  unsure (1)..(553): unsure at all n locations
ttcaaccatgggtcgagaattatcgactccaataatgcgaaaattttttgttggcgcatttcgcctaatagctaaaatgctagcgcctcttgaacagcctaaatcatagacattcgatccttcagtcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtaaaatcacctaacttttcgatgggggttgaaaaaatcgtatctctattcattatagtctttgatccttgtttaaaaatttagtaatagctcgtactacagcatcaggtttttctacatgcacccaatgatttgcatttgctacaataaatgatatagcctgaggaaattgggctaggattgttgctgtatctttagcttgaatataatgtgaatcagcacctttaataaataaggttggtttatcaaagaaaaccgcttgccaatccattaaatatggatattgtgcttttaacgcgcttaaattaaaacgaaaacgtt

SEQ ID NO: 93962 - DNA, 750 bp, Oryza sativa
aattcacggccgaactcccacgtgaggtggtattaaatacgttcgctaatttactgactaatattgacttaccgctactttccccgccgacaatagcaattgttttaacaaagaatggccgaacttccttggggataaagcgccaatatttaaatggattattgcgaatttgcgttgctgagatattaaaagatgtacgctcaggatccatcaaacagacttctagattcaaatattgctcataagatgttttatcttgtttttcactggtaaacactattttgggctgaatatttttctcagcaaataattctttaacgcgctcactccaatcaatccaaccatttggatagctaggaataccgtcttcttttaaatgatgaataacaatttgcttttgttgatatttaaaaatttgttgtaaccaacggaggcgatcttcgttagtcggcatacgtttcattttactatttttaaagagttcaagatcacgttcagtatccgtgcacacgaccacatgtaatatatccactttactaaacgcttcataaatcatattaatatgaccggtatgtaccgggtaaaacttgccaaagataaccccaacccgctggttcatatcttcaacgagatttaatacctgatgtaatgcatttaatttattagcgcttggatttttaatttttccactaaccaattgattaaaataggctctagtcaagcccgcttgtccacaaatatcattaactt

SEQ ID NO: 93963 - DNA, 669 bp, Oryza sativa
ttctttgatttgttatcaaaatgccgaacaagtgttaggtaaaaaagcggcaattttaggggcgatggctacggctgattattatgctaagcatcaacagttatccgataaagcaaaacaatggatcgatcaagcgttagctttagatgctaaagaaaataatagtttactgttattagctacaaatgctaatgctaataaacaatatcagcaagcaataaattattggcgacaagttttagacagccaaaacccggcagttgatcggcgagcagttattcaaaatattcaaatggcattacaacaattgtgatcaacaaaaagtaagttgatctttacaatttacattttaaagattgctaaaaataaggattgaaatataataaaatgataccattttgctaaatttgatcgagttttacatagaatgttaagtaaggagaacttatgagcgtaacgaatcgccaagaagtgttacaaaaccgtttagggccagaaattcaagagttaaagcaagatattcaaacacttgtgctttcgactgtcgatagcgaaggtaatcctaatgttagctatgcgcctttcgtaattaatagtggcgaataccaagtattaatttcaacgattgcacgtcatgcacgtaatttaattgaagtgccaaaagtatcg

SEQ ID NO: 93964 - DNA, 981 bp, Oryza sativa
acccgccagatattgttcgtacaggtaaggtttaaaatcgcctcgatgtgcacgttggatcatactcatcaaataaccctgcggttttttcacttctcccttgccaatacgctgttccacttcaaatagcaaggctttgcatatccccaagtccagacctttcatcgtttgagccacagcttgttgttccaagacggagagatttaatgtggttggccattcaatttccatacggttacccgtacagtacttatttatacaaatactcgtacttgtactgtactgagtcgctgagttccgtatgggaacgctgtgattttttactgagttccatttgggaactctgtatatttttactaagttcccgctctttttgactgagttccgtatgggaacttagtatgttttgaggaagttgacgcagttgatgttgttgttctaaaggtatctcatcttcttgttgtatgcgttgttgatacgcattaaagcgtgcttgtatccaatcaatatgggaaacataatgccattgggtcgggtcggcatgtaaattatcaataatatgattggcaacattgcgtacggtgatgtcacggtgattcgccgcattttcaagcagcttgaggtaattgttatttaattggatcgtatcaacaataggcatcggttcgtcatgtaataaataaacattccccatcacttgtccttgttcgttgcgtacggtttcacaaagcgtcagccagcgggttaactgtaataataagagtgtttggctcacaagcttacgagagagtttaccctcggcatacgttttatccgaaagtaactgtcccagtatgtcataagacgggaaaagtacggttttaaattctcgggctttatacttgataagctgccaagctaatttggcccgtgatgttaaatacggatcgaacaacaatcgagtcggtaccgtctcgtgctgattgcaaagaaaagcaaacc

SEQ ID NO: 93965 - DNA, 2090 bp, Oryza sativa
  unsure (1)..(2090): unsure at all n locations
ttctctatctcttgcaattcctgtttggaaaaaccgatactaccgcaaaaattgatgtttccttcttggagattggatgaggatttcattaaggacaacttgatttaagctactaaacattgtatgaatggcttcttggcaatataacgaactaaaccaaataaggggaacagcttgactagggtcacatcgtcaatcttctccgcatctaataagaaactaaaggttatcgaaaccgacggatagcttgtctatctaccgtttgtaacagcatgagcaagtcatagcacattttcaccatttcgttttccactgcattttctaaaggcagcatacgataggcataatccacccggtgtgtttaccacatgctcaacataacgttccaatccgacggattccgcaatatctaatgccaaagaataagcttccagtttatgtttgcgggcggggtaaatttgccagatatcatctaccggttgacgaccgacccaagcaaaagtcaacccgtagcctctgcacgctgttggcgttgctgttggatattgacgcccggtgcgataccctactgggtttccacactctgtgaaaagtcatgtaaggcgtctgtgggcatattgtaagattctgtcgactcgtcctcagtcggggtgctcgccggtgccacgggcgggtagcatattaatcaatgtcgaatagtcttcctcatcggaggggtaaatccggcgtatatgttgtcggactcaccgtagaggaaacggcacctttagcatggttatctgtaggcgtctttatactctcggtgtgcatgattggtttatgttgggggttatcatgctcactacactatgtaacggatggtgaaagtcggcaatatcttgcaaactttgatctaccgaggcgttaatctcttgttgtttttgcgctagctttttgaagcgttgttcgtctaaatcgatttcatgataaagtaactcataggaggtgttgtcacccaatacatcaaccatctcattaatgaggttgtcctgaaaatctttaatattaaacggattatcttcgttacaacgtgaaagactatgttgccagatgtcgtcaaactgaatttcagtgtcaaatcgatagttgtgccaaacggtcagcgcattgatacaaatggctagtagcttatcaataggggcatgccctaatccgttaataaaacgttttgaatatagggataaagaaatgaaatacatttctccattttatcaactaatgtatgagatataatatagcccatctttttcaagctcggaagacagttctccacaggaaagcgctttgtttaactttttctcgtaatatgctttcgcttgctgaatccccaatgctttctcgataaaggagaggtcggcgcgggtatcgttctcaataagatgaccgatcaataaatccaactcggcttgtacgctgtccgccgattctcctttccaaggtttgaattgacattcaatcgaccaaaaacgttgatcttgggtttcgggttttccgtgggttgtgctcataagggcgtaatttatctaatgtcaccgtaatatattgagattctgtcggatagtgagtcatacctgcggcaatatatgacggtgtcgtattggtgattggttgcacatttaagcctttggcgattgcctccaatctggcttgattctttttatctttggctgaaaaagtagcattactcataacggctatccttattatccatgttctcaaataatgagtattgacctaaaaactttgcggtaaccgtcgctaacggannnnnnnnnnnnnnnnnnnnnnnnnnnnnaacacaaccgcgttgttcggactgtgggttataaacttcatcgcggtagaggtgataaatcacatcggcgtcttgttctaacgaaccggaatctcgtaaatcggaattgaccggacgtttattggcacgttgctcgaggctacgattaagttgtgataaggcataaaccggacaaccggtttctttcgccaactttttcaactcagaggagatttctgccagttctaaattacggttttcaaacttgccggtgctg

SEQ ID NO: 93966 - DNA, 560 bp, Oryza sativa
atggttaaaatggctgaacaacgtatgaatacagaatctctgccagcaataccatttcctaacgcattaattattgaaaaagtattagcgcacacactgcaacaagcgcaagatatattaattgtcgttccaagccacgctttcgccgatatcctacaccaaataaaaccgctcttaacgacacaacatcggattatgtgggcaacgaaaggactagaacataatacaggccgactattacaaactgttgcaacagaaataataggagagcaacatccatttgcagtcttatctggccctacatttgccaaagaattagccttaggcttaccgactgccattacattagcctcacacgatgcaaaattcgcagatgaaatgcaacaacgaatccattgctcaaaagcatttagagtttacctaaatactgatatgattggcgtccaactaggtggcgcgatcaaaaatgttatcgcgattggtgcaggcatttcagatggaatggggtttggcgccaatgcacgaacagcacttattactagagggctcgccgaaatcag

SEQ ID NO: 93967 - DNA, 652 bp, Oryza sativa
ttacaacgttaggtgctcactttgttaaacagcttcacgacagaaaatttgatgtttttcttgatttaaaatatcacgatattccaaatactgtggcaagggctgtgcgttcagccgctgatttaggggtatggatggttgatttacatgcgtcaggtggattaacaatgatggaggaagcaaaaaaaattcttgagccttatggtaaggatgcgcctttattaattgcggtgacggtattaacaagtatggaagatttagatttgttacaaattggtattaatgcttctccgatggaacaggtgattcggttatcccaccttgcaaaacgtgcgggactagatggtgtagtctgttctccacaagaggtagaagtgttaagaacgcattgtggtgatgattttaaacttgtgacaccgggtattcgtccagccggttcagattttggtgatcaacgtcgtgtaatgacacccaaacaggctattcaaacgggggctgattttttagttattggtcgtcctattactcaagcacaagaacctttatccattttaaaagccattaatgcttcaattgcataattatgtatcataatgagggtgagctttgctcaccttttttattgtaagcggtcaatttttgagatttttat

SEQ ID NO: 93968 - DNA, 548 bp, Oryza sativa
tgttgctaaaagcattacctgaattacatttacgcttagatgctaatcgtagttggagcctagaaaaggcattaaaatttgcggaaaaaattgcagatcaacataaagcacagattcagtttattgaagaaccttgccagactccagaattatcacggcaatttgcacaacagagtggtattgcaattgcttgggacgaaaccgttcgtgaggcagattttgtggtaaagaaagagccaaatttagccgctattgtaattaaaccaactttagttggttcgttacaaaaatgtattgggttaattgaacaagcgcatcaacaaggtttgatcgcggttataagttcaagtctagaatcaagcttgggtttaacgcaattagctcgttttgcgcagcaatatacaccttgcactatgccaggtttggataccttgaatttaatgaagacgcaaatattgcgtcaatggcccaattcaaatttacctattgcggatttaaatagcccgtttattattgagcttgtgtcataatttggtgatgttaagcgg

SEQ ID NO: 93969 - DNA, 764 bp, Oryza sativa
tttgcattccaattgccacctcttcttgtaaatacggcatttctggagaatcggaattaaagactaatacatttggcactagtttttgtaaacgttgataagcctgcttaatttctgcttcttctgtattcggtgatttaccatcaagcaataaagcaatatgaaacacttctcgtgcatcattcattaataataatttgcctttatattcatcacgccataaatcttcccagcttgaaactgtgtgaggatctatttctttggcattgacgccaatcccagtcaattcatagacataaggcaatgaataagtattgtcaggatcaaatggtttacccattaattcaggggtaatattttttaaattgcttaattttgttttatcaatggcggttagcataccttcttttgccattttattaacataatagctggaagggaaaacaatatcgtaaccggttgaatttgataatttcaatttagagtacatttcttcattgctttcaaaagtagaataaatgacctcaatacctgtttctttggtaaattgctctagcaaagaagaggggacatattccgtccaattatagacatatagtttttcagcagcttgtgccgcaatactaaagtaagcgagagcgattgccgttaattttgcaaaaaatgtatagcctaatttgatcaattttatgaaatccttattgaatgcgtgatggttaatgattcaactgaatcaggtaacaaaagtccggcattatatagat

SEQ ID NO: 93970 - DNA, 704 bp, Oryza sativa
cgtgataatcgtaaaattcaccatcaggaatgatttgcaccgcaggtaaaacttcgccatctaaaacagggactgaatattcagcaccggtcaaaaattcctctactaatacgatagtatcaaattccagtgctgcggtaatcgcgggcagtaattcttcttttgttttgactttgaaaacgccgacacttgaaccttcacttgatggtttgacaaaaacaggtaaacttaattttgcaataatttgattaatatcgattgcttgtcctcgttgcactactaccatatctgctgtgggtaaaccgacagcattccataataatttggtacggaatttatctaatgtgatagctgaagccattacaccacaaccagtgtatggaatccccatttgttctaaagcaccttgcaatacaccattttcacctattccgccatgtagaatgttgaagactcgctgaatgcctttttcttttaatttctcaatagcgatatcttttgtatcaataccttctacattgtaacctaggctttttaatgcttctgtgactgctgcacctgagtgtagagacacttcacgttcttgtgaagtaccgccatataacaccgcaattttttcggtcttaatattcatgtatgatgagttcctttgattatgcttgccaatcttcagccaatttgcgggtaagtttactgatgttacc

SEQ ID NO: 93971 - DNA, 561 bp, Oryza sativa
tggctattttttcatcttctagtggataagtattataaataaccgcttccatttcaattttatgttgctgacaaactattaaacttaataaagtatgattaatcgagcccaacttagcggaagtcactaaaatcaacggtaattgttgttcaacgatataatctaatgttgtttgctgtgaattataaggaaccgccaaaccacctgccccttctaataatacatagtcatatttttgcgctaataacgcactggcttgtgcaatttttgatggaagtattggattattttccatttcagccgccaaatgtggcgaacaagggtaacggaataaatatggacaagttatgccatttaaatcttctgccgttagttcaatcccttgtagctgacggtgtttaataatatctgccgagatgtgttgacaaccggtttgaatcattttttgcgtaataacggaaaagccttgttgcatcaatcttttggcataaaaacctgtcgcaatagtcttaccaatatcagtatcaatacctgaaacaaaaattattttacccatttttc

SEQ ID NO: 93972 - DNA, 625 bp, Oryza sativa
cgattttttgttcactgagcatagtcaattttttaatttgtgtttgtgccattttagcaattttatttgccatctgtttattcactggcttcaactgtttttctaaactggtaaaagccacttgtgacgccatatcattgcctttgctatcaagcaataccctaaccggggtgggcggtaaaaaacgagtcagatttaaactttttggtgcttgtgcttctactacataaattgcttcaagcaatacggtgccggctggtaaatttttattaattaataatgaaatagcgcacttgccaatatcacctgaagtaattaaatcaataccatggcgaatcattggatgatcccaggttaacagttctatctcttctcgcattaatgctagttggcgatcaaatgtaatcgttgttccttcttcagataagcctggaaaatcagacactagcatatgccctgttggattcaatgcgatcaatttttcgcctaaatttcttgttctaaaccgatgatatcaaacaaatttaaagcaaaatttaccaagtgtggattattatcctcttgagcaatagcttcagccaatgcttgtgctgttcaccaccatttgaattcaattctaataagc

SEQ ID NO: 93973 - DNA, 870 bp, Oryza sativa
gatcatattcaaattccaccaaccaatattcatagtattcgaggtgagcaacctcctgaaactgaactggcaagatttactcaagaattaaatgaatgcctgcctaatttaacttttgattggatcatcttaggtatgggaaatgatggccataccgcttcgctattcccctatcaaacagattttgctgatcagcatcttgcaattatcgcaaaacaccccgtaaccggacaattacgtatttcaaaaacagccaagctaattgaacaagcagcgcgtattacttatttagttactggtcaatccaaagccactatattgaaagagatccacgacttaccggcaacacaattagcttatcctgcggcgcatatccgcgcaaaaaacgggataaccgagtggtacttagatcaacaagcggctgaattattccgttaatttgcatttaaataaacctagtatgaaagatgaaaaattgcgcaaaaacttaaggcataccattgatattagcccaatgagcaaatatcaatgggcaattgtactaatggccactattatgaatttcttagatggttttgatgtattggcaattgctttcactgccagtgcgatttcacaagattttgcattaaccaaaactgagtttggggtgcttgtcagtgttgggctgatgggaatgacaatgggttcattagtgttaacccctttggcagacaaaataggttgtcgcttgatgctattaattgctgtaacattttcagcgatcggaatggcgatttctgccatttcacagagttatgaaatgcttggtttttcacgagttattactggcttaggtgtgggggggattttagtcggcactaatgtgat

SEQ ID NO: 93974 - DNA, 607 bp, Oryza sativa
atttagtgtactatctgctattgctattattcttttcacatattatgcaaatcatttatcaatcgcaatgatcatcggtatcattgttggcgtattcgtcaatggctgtgttagtggtttatatgctatcacgcccatgacttatgctgctaatattcgtagcacaggagtaggctgcgcaataagcgctggacgtattggctccattttagcaccaactattgccggtattttattagatggcggtttagcaaaacaagatttatatctttgcgttgcggcgattatgttagttgccacttttattctagtatttaaaaaaccacatatcgatgcagtggcttaattgatcggaaccaccgcattctgcataatatgcgaatgccaaataagcgatgaaatttgcgcaaaataatacaaattaaaccgcttaaagctattaaccaacaggagaaaacaatgtcaatcaaaggtgatatcggcgttattggcttagccgtaatgggacaaaacttaattttaaatatgaatgacaacggcttcaaagttgtcgcatataatcgtacctgcatcaaaagtagatgaatttttagcgggcgaagcaaaa

SEQ ID NO: 93975 - DNA, 1237 bp, Oryza sativa
aagccccgaaagacgaatgaagtggaaaatatcgctactcaacttgcaatgttccaagatattgttgaacccactgccacagtggaaaatatggcgtatgaactcgctttgcgtttaggttttcaattaacgaatagcattgagtttgccgatcaagtggtttggctgaatgataaaacaggcaaaagaaaaactgcacttttattagcacagtatcacaatgaaatgcttaattgcattattggcgcacaaccacaaaaagtgtttgctttagataaagtatttaatggcaatgatgacttaaaagctaatctcgccctgcaattaaaagacgcaggtattgcctttgaaacattttagggggcgttatgcaattaaaatttgaagaactcacccaccaacagcaagccattgaagcggtgattgccttatttaaaggcgaattaaataaaaccacggaattttcccttaataacctaggcagtcagccgattatggcaaatcagctggcgttaccccttgaagaagtcgagaaaaatttaaatgcggtgcaggagaaatttcatcaaaaaacgaccgctctttccgatcacggtttgcatttttccgttgaaatggaaacgggtacgggcaaaacttatgtctatttacacaccatttttgagttaaataaacaatacggctggcagaaatttgtgattgtcgtgccaagtgtcgccattcgtgaaggcgtacaacaaaccgtacgaaccaccgccgaacattttactaatttgtttgataaaccgaccgttaataccacggtatatcgtagcgacaggctaaatgcgctacgcagttttgccactaataaccagattgaaatcttgattatgaacattgacagctttaaaaaagatgacaatgtgattaaccgtataaacgagagtggcgaagccccgattttgcaaattagccaaactcagccaattgttatcattgatgaaccgcaaaatatggaaacagatttagccaaacaggcgatagaagccctgaatccgctatttgtattgcgttattctgccacgcataaaaatccataccataaaatttatagcttaaatccgttagacgcttataaccaaaaattggtaaaacaaatcgaagtcgaacctgtgctggcagaaaacgatgtgaacggggcttatgtggtgctaaaagagcctgtggttggcaaaggtaaactcaaagccaaaat

SEQ ID NO: 93976 - DNA, 674 bp, Oryza sativa
gaattacaaactgcgggcaggttattaaccgcggggcctaatcctagtgaagaaggggataatataaccggttcgacagtgattgcggaatttgattcattagcggccgcacaagcttgggctgaacaagatccttatgtcagcgcgggtgtttatcaaaatattatcatcaaaccatttaataacgtgttttaatcttcaatataaaagtacaaatgaaaatttggcttttctcttcaataatcatcctattttatgttttctcaacttgattttaccggcttaccacttgctaatacgggagaaaatagaccgcttgcaatcgcagtggctatgtcaaatttcgtgaaaaaaacgctacaaaagcaagctgatttacgtgatgattggcaacgaaaattgccgacattggcggattgtggcaattatgctgaacggttaacaatatatttgtcaacgattaacgatgaagtgcaactaagccattgtttgcgtaactttaggcaccgtgaaatggcacgtttaagttttattcagtcaaataaattagcaacggttgagtttgtttttgagcaattatctgatttagcagaggccataattcttgccgcgcgagattggttatttacccgttgatgtgcagaatatggcacgcctgtgaatggtttaggtga

SEQ ID NO: 93977 - DNA, 601 bp, Oryza sativa
actaatttgacatagtaagcggttggattttttaccaaaaatgtatttccttgtttttgtaaaatcagtttttcttcccagggggaccccattttttcgggaagaattgctttcgggcgataaaataattttacatgcgtttgcaaggcaatttgtaatgtattggctttattacttttaggtgggatttcacgtaaattagaataaaaaatgattccctatcttgcggtaaactgttaattgctggtaatgcttctattttcacttggcttgatttctcaggctctactcgttgaataggcggcaacacaacaaacggagaggtaatttttttgccattaacatcttcaatccacgtttgggcaaggtatggtaactgtttgttgttattagaaatacctaatgacatcgcttttttgtcaccttcaaaaacaacccgagtcctatctaatccattcacagcttgagttgcattgtaacaaatactccaactatgattcctgtaatgctgacatatatttatttattttcataccgctatttcctttattaaatgtttaatcaaaattatatattgttgttttttaatgcttcaccatag

SEQ ID NO: 93978 - DNA, 1333 bp, Oryza sativa
gaaatcttccgtagaaagttcgccggttgggaagttggaaaaaaaatattctcctagccgtattgttacattacaacgcattgcaatttgaatgctattcatcaacgcttgtggtaagtcggcaaataaggcgcacatttcttcttctgaacgaaaatattgttgcggagagtatttttgagggcgtttgggatcgtcgagtgtataactatcgtgaatggcaacccgaatttcgtgtgcatcaaaatcatcttctttcaagaagactacgtcattgactgcgactaaaggtaattgatattttttggcaaattgaaccgcttgctgaaggtaacgttcctcatctgagcgccctgttcgacaaagagaaagataatagtgatccgcgaaatattgttgataaaaagccactaatgtggcggcttcttgttcattttctttaagtaaagctttgcccacatcacctgaacgtccgcctgaaagtacaatgattccctcatttaattcagctagccacgctttttcgacaataggaaactcaacatacccttgctgataagcacgagaaagtagaacagtgatattgtgaaagccttgattattttttgctaatagtgtcagttcaaaaatatcttcactagttggatcagaacgaacataaatatcagcaccaataattggctttaagccggcagttaatgattcaccataaaatttcactaagccacaaaagttactaaaatcagtcaacgccattgcagccatctgtttggcagcggcagttttgactaaggcttttactttagcaagcccattaatcatagaaaaatcactgtgtactttaagatgaacaaagcgtggttgagtcatatgcgaattgtttagatgaggaaaatagaaagcaatgttaacataaataagcggttaagtttttgcaaatttttgcagaaatttaaccgcttttagccgggggaaggtatattaatcgcgttttttagtaagtaaccaccaaacgatcgctaaacagataaggcttggaattaaagctccaatggcgatgggtagccagctaaagactaaagtcatattgccaaagacgatatttgatacgtagaaaatgaagccagcgataatgccgataaataattttatacccattacactcctacgcaatggtccaaaaataaaagaaatggctaatagcatcataactgccattgagataggctggtaaactttacgccaaaaagcaatttggaagcgttttgaatcttgccctgtttcagttaaaaaactgacgtaatcagttaagcctgcaatagacaaggattca

SEQ ID NO: 93979 - DNA, 615 bp, Oryza sativa
aaccattcttcatctaaagttaaatcttcattcaaattgacactaatacctttagccaatacatcacgtgcaatttgatgagcatcttctagagaatgttctgagaatgtaccacattgataaatattcagctcaggaatttgtgtaacatcagatactttggttaatatatcatgcatagcatttttccatgcatttgcgaccgcttgtgcgcttggctcaccaataagcgacatataaaaccctgttcggcaacccatcggtgaaatatcaataatttccaccttatcgctatttaaatgatcacgcataaaccccgcataaaggtgttctaacgtatgaatacctttagacgacataatctccatattagggcgacaaaaacgtaaatcaaacacagtaattaaatcacctttcggcgtagtgatggttttagcaactcttactgttggtgcattcatacgagtgtgatcaactttaaaactatctaataaaggcatattttactccaaattatatgcataatcaagactattctgcgattgcttgatcccaacttaacgctttggctgggatcttacgttgtaaataaaaaccgcgggttggtttagcttg

SEQ ID NO: 93980 - DNA, 1448 bp, Oryza sativa
ggaaatcataatggttgggagccttttgcaccaaaaacgtgatcttttaccggggccaactgaagcagaaattactaaatatggcttagacttggcgtggaaacgtaaacttgtcgcacgagaacagcaagatagaagctattcattacaataccaattcttacctgaaaataacccttggattaatactgtcgcgcagctcagccactcgagcacttatcaacatgatacacgttcagaacaagcatcaaaaacatatttggcttcattaggtaatgaaagctggacgcgttataccgatttaacattcgatgtcaacaatactagtttgtttaatgtggcaaaaacatctcatacacttttagtcggtttacaatgggtaaaacataaacgacaaacgcttatttttgatccgagtaaactccaaaaagcagaatataaccatggatatttccaaccatcttacatgccatcagggcatcaatacacacacgcattttacgcacaggataagataaaaattcacaacctaacggttagcataggtgctcgttatgattatgtgaaaaatataggcaaacctaatatagctactatttataatgaccccactgcagggcatgattacagcagtaaacattatcctggctggtcttcttacttaggtttgaattataaactgaccccttacttaaatttattcagcaatataagtaacacctggcgtgcacccgttatcgatgaacaatatgaaacacagtacgcaaaagcaactttaagcccaacagcgagctcgttagacctcaaaaaagaacgtatcacacagctacgcgtaggaaagcagatacatttcgatcacattttatcaaataacgatcaattaagttttaactcaacttttttttactataaaggaaaagatgagatttttaaaactcgaggggtccgttgctttgaaagtgcacaaaacaacaataatgaagtttgtagcaaaaaaatcggcaattaccgcaatttacccggctatcaaattaaaggatttgagttagaggcgaattatgattcaacttattggttcaccaatcttagctattcacacacaataggaaaacgattagcatcaccaagaaacccttggctagccagtacaagctggattgcagaaattccacctcgcaaagccgttgttactttaggtagccatattcctgatacaaatttaacgttaggatggaaaagtgagtttgttcgacgtcaagatcgttctcctacagatcaagataaagatgcaggccattgggcattacctaaatcaagcggttatgctttacacggcatcttcgcgacttggcaaccgaaacaaatcaaacatttacgcattcaattcactgtcgataacctattaaatcgatcatatcgtccttatcttagtgagttagcggcgggta

SEQ ID NO: 93981 - DNA, 1091 bp, Oryza sativa
ggtccaaaaccccataagttcaccaaaggccctacagtcacattaaatgcgccctctgtaattttattcaagcggatagcttctgccaccaccgtagcaaagtctggtgaaatctcaaacggcgtattaacttcacgtaatttattaaagcgactgatttgtgaatcaagttggtaagtagacatctcatcattaacgactttaagcacatcatctaactgtttttttacttgttcagcggtaggtaaattagcgatcttaccatcatcaatatatttgactgtataagtggtgcccattgttttaccttgtaaagtaatttgttctgcagatttattacaagcggtcagaataaacgataaactcgcgacacataccaacattagagatttaagtttcacctggtttcctcatataaaattaattgataatcaattagcaaaaataacgagattaaatcaattatctattagccattaaatgcgttaagcggtacgatatgcaaaaaagtttacaaatcgtaccgctttatcatagtgtattaaagcaaattaaccaccgaaatcatctaataagatatttttgtcttcaacacctaaactcttcagcatacctatcactgcggcattcatcactggtggaccacacatatagtattcacaatcttccggtgcttcgtgatttttcaagtagttctcattaagcacattatgaataaagcccgtgtaaccatcccaattatcctcagggagtggatctgaaagtgctacatgccatttgaaattgtcattttcagcttgtagttgatcaaaatcctctacatagaacatttcacgtttagaacgtgcgccataccagaatgacattttacgtttagattttaaacgttttaactggtcaaaaatatgcgatcgcattggtgccatacctgcaccgccaccaataaataccatttcattgtcggtttctttagcaaagaactcaccaaatgggcctgaaatagttactttatcacccgcttttaatgaccaaatatatgaagacatttgacctggaggtgcatctggttggcgtggtggcggagttgcaat

SEQ ID NO: 93982 - DNA, 692 bp, Oryza sativa
caaaaataacggcgtggcgccatacccgctgtgcgttttccgtcacgatcttcaaaatgagagtcagggatacgtgttgcaccagtcgttgaagccacttcaggtgaatgacagcctaaacattgattagtatttttagttacttgtaaaccacgaatactatgcggtactaaaggtggctgaaatgggaaggtcgtcgggatattacccgtgtctttttctggattagtatacgcaggcactacattttctggcaactgctcaatggaatcactaatattgctaacatggcctgtagcagctgccaaaccggcaaataatgttaaaactaaagtgagatattttctcatttcgggttcactccgttaatttatcaaattaaattgaccgcatcatcaacttctcaagttgatcaacactcggcttaaatattttttactggtaattgcttttcaaaacgtaagccaaaagcaaatacattttcagcacatacatcaatacaacgcccacaacttatacaatctttggataataccattgggcttgcttctggtttaacaatggaaaggtaaccccaatactggtgattcaggacaaacgttatagcaatccatacagcgatcacaacgggtacgatcaacgacctttacgcggactagtgattgagcaccaattaagccgtaaatagcacc

SEQ ID NO: 93983 - DNA, 1617 bp, Oryza sativa
  unsure (1)..(1617): unsure at all n locations
ctgcattaaccattcacggtcgcactcgagaatgcctttttaatggacaggcagagtatgaaagtattaaagcggtgaaacaagccatttttatgccgattattgctaatggggatattacttccccacaaaaagcaaaagatgtcttgaatatacaggggcagatgcagtgatgattggtagagggagtttcggacgcccttggttgtttcaagaactgaaacagtttttagagacgggtgacataatgatttatcaatcgatgaaaaatgtcaattgatgttgaagcatatcgaaaatctttatcatttttatggtgaacannnnnnnnnnnnnnnnnnnnnnnnnnnnnnnggttggtatttagatcaattaacgcccaggctcaaattttaaacgtactttcaatgcattaagttcaacaacagaacaattgatagcattgaaagaattggtcaaatccattcgttagaatcctttgttaagttggatagaggacaatgttagaacaacaacctgcacaaaacccattaacggtatcaatgctgaatgcacaagcacagcaagtaaatagccacttcgtgataatgtgaaagcggcattaaaaaactatttatctcaattaaacggtgaagatccaacagaattatacgaattagtattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctaaatgcttaacaagggtaatcaataaaaaaacttatcggcaagaatcaagattttttgtgtgtgatatttataaataagcgcacttatttgctatttttttgcaaataagtgcgctttattatttaggattattgaatttttaattttttgccgacaacaatatgattgttttggattttatttaatttactcaatttatctggtgtggtgttatataaacgggcacacgaataaagcgtttcatttttttgcacaatgtgatagccattgttcaatttaccattttctttgttggccgttgctgttgattgggttgttgaagttgatttttgggcgctatcttttttaggcgacggtttaacttcttttttgttattttctttcaccttgtttatattagggtgatatgcccaataagtatttaagcctttataaatagcttgtgcgattttgcgtcgataaatagagctggcgagttgtttttcttcaattgcattagataaaaaccccgtttcgactaaaattgaggtgatatctggcgaacgtaagacgcttaaacttgcgtgttgaggcgtttttttagcaagtggagtaactttttaaaggtagataatacggttgaacctaattcataacccgaacgttgtgaatgagaaaactgtaaatccaatacggtttgattaagataatgttcatttttattagataataatgagcctgcactggcgagtaattctgattgcttttggtgatcttataaccatttacccatttcattgctagcgcgtctatttgataatatccatattgaagcaccttttg

SEQ ID NO: 93984 - DNA, 682 bp, Oryza sativa
ccagtagtaatacactgttttttgccacaccagctttaacgatatctgctaagcaagtggcataaaaatttacgttcataacagaactcccacatttaaataaaaataagaaataattgcatttagtatgttataaatgacaaaaggaagtaaaattacttccttttgtatgcttgaataaaatgataaaaatattcaaatttaaattttattgtaccgctttatgttataacgtatagaaaaatggaataatcgccatagagactaccgcagcaatcacaccataaataaacattggtacaaccggtttcttgaagattgggccttcttgtttttaatattcaagaaagagctgaagggtacaatggtattgatacaaaccatattacccattgcgccatctactgattggaatgctaatactaaaggagtggaaatgccagtaatttctggagttgataatcgtacactaacaaaagttaagttagatactgtattccaaccggaagaagtatgcgccaacagccctctaaatatggtgcaaataatgtcgaatattcgcctgttgtatcattcatcatagctttaaatggcagctgttggaaacgtgtagtaattaaaaataagattaatgcactatacccaaaccaagtaggagtatccccagcacccaaaataacgg

SEQ ID NO: 93985 - DNA, 724 bp, Oryza sativa
gagctcggtaccctaccgaatctcagcgaaatattaagttggaagatggcgctagcaattagcattggcatatttgttgcttggttaggcggacgaggcatcaatttaatggccactcaaccattaatcattacaggcttattgatcggcacaattatcggcattgccttttttgggggaataccagttgggccattgatcgccgcaggcattatgtcgttactagttggcaaattgtaaccgccaacgtcaaatgaacattttatattataaactcacttaattctttgaatagctatgtattacccacatcgaatgaaacgtcacctgcaaaaaaatcgcgtaaatcaaccgcttgatgctatgcaaaaagcattgtggcacaattaaccgatatctctaatttagattattaccgtttacgtagccgtattcatagcctgtctaatataaaaaaactgagctcaaacaagccgctacacacgaaatagcacaacaactacaaacggcaaaaaaccatttttcagtacgacaagcacaacatcaacaatagattaccccgatttaccggtttctgcccggcgtgcagaaattttaaaagtgattgccgaacatcaagtggttatcatcgccggtgaaacaggttcaggtaaaacgacccaattacccaaaatgtgtttagcgcttggacgtggtgtaaaagggatgataggccatacacaac

SEQ ID NO: 93986 - DNA, 579 bp, Oryza sativa
cccattaccctgaataaaaaaaacgtgcgtaatcattttatttttctcaattctttaccttatacgcctgaaaccaacaaaagcttggccttattaattttcggggcgatattgtggttaactgaacccgtacacatcgccatcaccgcgtattaagccctattttagctattttcctagatttggttaaatcaaaagcagctctcgtgacctttgctgatccccccttttttctcttttttggcgggtttgctttagcaactgccttacatattcagcaaacgggtataatcaaagcgggctttttactcaatattttgtgtgtgttgctaattgcaactgtaggtcattgccttttgcaataaatgtaccccaaataactgaatagcaattgcataaatgctcaaaaatctaataatttatgcgctttacgcactcttatttatatttaataatactttgttagttcattgtaatatatgtaataaatagctatttttgggttatttagatcatattactttgcataaaaattatcttttaaagtaaattaccaacactttttaaaaataatgcatg

SEQ ID NO: 93987 - DNA, 575 bp, Oryza sativa
tatataaaaggatatttaaatatttccgtggccgttatctaaatgggcacggataaaccattgtaatttttctaaactacgggtttgtgcgactaataaatcttcactaattggatctagatgaccattatgttctaacaccacacgatgtgcttcgatattgtgagagtaatataaatcaatcaattttaaatgatcttgtgcggttgcacgaccgagtggatattcagggctctggcgagtttcaactaaatttccggataaaccatttggagctacccctagcgttgccatacgttcagcaatttcatcaataaaatcgcgaacttcatcaacttgactgtctagcatttcatgtactgcaataaattgtgggccaaccacattccagtgggcgtgttttaaaatcaaagctaattcatttaagccttgtaaacgcatttgtaatgcctcagcaattaaatggccagtcgcaacggttaaacctggcactgtgtggtcagcatttttgtgcatatcattagtcagcgcttgcgattgtccagttaattttaaaacaggaaaagtaattgttt

SEQ ID NO: 93988 - DNA, 681 bp, Oryza sativa
gtacccgtaataagcgctgcccgttactgcgattaaacccagctgagcctctagattgggtgataaatattggaataaaaatcccccaaatacacctaatactgtcccgattacccgttcaactacccgcttttgggttgcggaataattgggttggcaaacaaaaatagcggtcaataaaatccaataccctttactgtctaactctgctaactgcacaattaaactaccgataaatactacaattgatagccgaacggcgtggcggaagagttgtgatgacagcgttaattgctcacgtactgcggctaacatattcttgaagcctgatacattcttatcggttaagcgggcagatttttctttttctttgctgatatccgctacattagccagttgccaaattcgactaaattgatactcaatatggagtaaattttcagcaattaataaccaacggtgtgcatttgctagtcctcgttcttgatggtagtgcaatgaatttaataaaccttgtaaggctttttcgctccgtccacaatgttgatagccggagttttgccgtaaggcaatcgccacccgttgacaagcaatcgcctgtaattccattacgcgttgaaagcggaacattagatcactatttcgtaactgttgaaaaagttcgtgatattgataatagct

SEQ ID NO: 93989 - DNA, 651 bp, Oryza sativa
agcgtatcagcgcatcaagattacctcactaaagcgctctttttagccgatttattaggggtaagcaatgccgaaagaacttgttttgctattgggcttgagcctactcaagcgattgagtatctcaagcagaaaaaaatgctggcagaaaaagtcttaaaaaaagagttgcacgaatcggctttagcccgtgccacaacgattgcccgcttgacctcgcttgagatgactaaagatatttatgcgtccatggaacagctcgtcgagaaggcaagagttttaatacgtggaaaaaagggctggttgacgaaatggagcgtaaaggttgggtggcaggacgtgataaaaaactcggtcgtggattagacggtacactacttgccgaccctaaaacaggcgaatattttggcacgcctcgcagattgaatacgatttatcgggtcaatatgcaagcagcatactcaggagcacgttatcaacgaatgatggataatgtcgataatcgcccctactggaaatactctgcggtaagcgatagtcgcacccgccttgcgcatttggcattaaacggtcgagtgtatcgttatgacgccccattttgggcgacgttttatccaccaaatgggtttaactgtcgctgcacggtgattg

SEQ ID NO: 93990 - DNA, 1121 bp, Oryza sativa
ttctgcgtgttgtataaagctacatcacttttactttgcattaatttaatggcacgttttaatatatcaatattggtatcaagtaaagcaagatgatgtaatacttgtttacgctcaaattctaattctttgagtttcttatctaaggtataagccattacttcccctactgccaaatcacttcttgatgaacgattttccgttgccaataaccgcaccattcgttattttcattagttgttgttaagcatttaccgagaatatcctgagattgccaaccattggcttttctacgattatcttcacggtaagcgatttcatttgcatagttgagtaaataaagattactcattttgtgaacgtgtccgtagtacattcgtttaaagcgagagaaaaaggattcggcttgattgttggttatgcctaaatcgctacgatattcttctttatgattcactgtgcgtaaatcatagtcgagtaataaactttcgtaagctgtactttcgtctgtattaatgcgactttcacgaacaataaagcgatttgagaagtcttttacaacaggttgtgattcagaataagtcacaaaaacgtgtgaacgttttgccccgcgattaaattggttttctgctttttcttctgcggaaaaatgttcacgagctaccataacacagcgtttattaggacttttattttctttcaagcgatagtccaagcggtcgattttcttgttttctttacggaggtgcagggtgaacataagtgccgtccatatcaacttcgcctgaaagggggtgcatatctcgattttctaacaaggctttacgcaatttatgacaaagcacaaaagctgtacgataattaattttagcgtcacgagagatttctagtgcagatacgcccttaaccgcattcacaaaacgagctaatacatacaagtaggtttgaatggaagccttacggttggcaaagattgtgcctgatgtcactgaaaaggtatgatgacaatgtttgcaacgccattgtttatgactagcaataaaataggcttgatgttgtacaccgcatttaagacacgttacgtgctgtttacttccccaacgcatatcacaaagcaagtc

SEQ ID NO: 93991 - DNA, 541 bp, Oryza sativa
aaaggggttgatttaccgtatttccgtaaattattacgtggtacagcattatatgttgaagcaatagatcatgatattaggcttatttagatcgaatggaaaatgatgttgatccaattgagcggacgattttacgtttagcgacctatgaattaaaatatgaattagatgtgccttataaagtcgttattaatgaaggtattgaagttgcaaaagtatttggatcggatgatagtcataaatatattaatggtattttagataaattagcacccgcattaggtcgtaaatagtgatataaggtaagcgaaagcttgcctttttgttttgaagtttacaaaggaaaattatgggtgaatttgatctaattaaacgttattttaaccgtcaactaccgaaattcggtgttgaactttcaataggtgatgattgtgctattgttgctcatcaagcagatacaagaattgcgattagtactgatacacttgtggcaggtagccattttttagcgaatatatcggcggcagatcttgcgtataaa

SEQ ID NO: 93992 - DNA, 1727 bp, Oryza sativa
ttacattggtctatatctgttacttgaagatgattatgatagtgctctagatgcatttaatgctgttttagaacttgatcctcattacaattatacgtttttaaaccgtggcttagcattttattatagcgggcgttattctgaagctgaacgtgatttattacgcttttaccaagaagataaagcagatccctatcgtgtcttatggttatacttcaatgagctagaatttaaacctaatgaagcaaaagcaaatctaattacacgatcaaaagcattatctgctcactattggggcacaaatattattcattattttttaggggagttaactctcgcgcaacttcgtgatataatggataaagaagctcaaccaaatacagcttcatatgcagaaattttaactgaaacatatttctatttagcaaaacaacaactcaaattaaataaaacggatgaggcaattagtgctttccggctctctcttgcaaatcaagtgtttaactttgttgagtatcgttttgccctgtttgaattatcacagctaagagctatggaaaatcaaacttatcctgttgttgggataaattaggacgcaaacaagcggttaaaaatggcaaaattactgtttttttaccgcttgtactcatttagacaaattgtaaaagcattgaattcgcttcgttatttcattttttctttcctaaaaactcaacaatttttatcaattagtaataagataatcttgaatataaatcagcatatttaagctaggtttaatgttttcatttgcttattactcattatttatggttttttatgacaaataatactttaactttctctgacttaggtcttcctcaatcaattctcgatgctgtcaatgatatgagttttgtaactccatctcctattcaacaagaatgtattccccatttattagctggtagcgatgtactcggtatggcgcaaactggtagcggtaaaacagcggcattttcattgcctttactcgcacaaatcgatccgaatcaacgccatccacaaatgttggtgatggcaccgactcgtgaatagcgattcaagttgcggatgcttgtgagcaatttaccaaaaatatgaaaggtattcgtgtagttaccgtttatggtggtcaacgttacgatattcagttacgtgcattaaaacaaggttctcaagtggttgtgggtacacccggtcgtattcttgatcatattcgccgtggtacgttaaatttatctaccctcaaatcaatcgtgttagatgaagccgatgaaatgttacgtatgggctttattgatgatgttgaaacagtaatggcagaattaccagaaaaacaccaaacagccttgttttcagccaccatgccagagcctatacgccgtattacacgccgatttatgtctgatcctaaagaagttaaaattcaagcaacacaacgttctgcaccagatattacacaaagctactggttggtaaatggtttccgcaaaaatgaagccttactgcgctttttagaagttgaagaatttgatgcggctattattttcactcggactaaaacaggcacgattgatatcaccgaattatgtgagcgtaatggctatcgcaccgcagcgctcaacggtgatatgactcaacaagctcgtgagcaaactttagataaattaaaatcaggtcgtttagatattcttgtggcaacagat

SEQ ID NO: 93993 - DNA, 548 bp, Oryza sativa
tgccgcgcctaatgcggcggctttatcgtgataaaaaacgcctaattcgcgcaatggctgataaaattcaggcgccaacattaaacaaaaaaaaccaataaataagctaatttctagctgataaccgccaaaatgaagttctcctaaataactaaagccaaaataaaccgccatcagcgcgattgaaatcgccgtaaaaaactctaacaccgcagaagacaaaaaagccatttttagcacatccatcgtactaagtctgaatgcttccgtactttgatgaatctgttccacttgctgttctgtttggccaaataagcgaatagtttccagacctttcaatttatctaaaaattgaccgctcaagcgagaaagaatgccaatattacgttgattcgcttctaccgctttcaaaccgactaacgccataaataaaggcaataaaggcaaggtgatcaataaaatacaacctgccgcccaattaatgggaaaaaccaccgctaaaatcactagcggtacaataagcgataaaaattgttgtggcaaatatc

SEQ ID NO: 93994 - DNA, 547 bp, Oryza sativa
gttaatgatgagaaataaaaactatacaataagttcgcttttcaaatattgaagaatctcatgataatttttagccggtttatttatctgtttttctttttgcgccatacgaatgaggttacgtaaatgttggcgatcaagttgaggatattcactaagtagctgattaagtgatgcatcacccatatttattaattgatcacgaattaattctagcttgtgtaataatgcttgttgttgattgcgtctattttttactttatctaatgcatcttgaataggtgcagaatctcggttacgcaatagtttgccaataaattgaatttggcgacgacgagcttctagtttgaagctttgagcttggcgaatagcatatttaagatcttcatctaaggggattttttctagattttgtggtgttaattcaatcagttcggcgcctaacttttttaggtgttcagaatcacgtttgatttcgcttttacttacccaaatgatttctttatcatcatctgtccagtcaatttctggtttgccgcgtttttta

SEQ ID NO: 93995 - DNA, 668 bp, Oryza sativa
attcgagctcttggcccattaataccttaaccgatgacggtaattccaggctaaacaaagtttatgctgattatgtccgtgtagtgggtaaagatattgagcttgctaagaatgggcaaattcatgcggatcaacaacttatcttaaacgccacagggcatgtaaaactaaacgatggttcaagtgttatatctaataataatttggggattagtgcgttaaatctaacattagaaaacgcgactgtatcagcaaataacttaagttttagggaacgaatgataccaagctaaataacttatctaaagtttcagcaagagcggcagatcttcaaagcggtaaccttaacttagataaagcttcagtattagcgcataaactcactttaaatattagcaatgatgtttctttaaataaccagtctaaactttcagccaataatctaaaaatcaagaaagtacgcgatcttaacttaaacaattccgagcttagcgcaaataacttaacattaaacacttctaacaatatcaccttaaagaacaaatccaaatttacagcgggcaacatgaccttaaacgtgactaataatgttacgttaaataatgattcagagcttgcagccaataatttaaccttaaacgtgactaagaatgtaactttaaatgatg

SEQ ID NO: 93996 - DNA, 1188 bp, Oryza sativa
caccctgagctacttcttccacaactaaatacgtatctgagatcactgtttcatctgctgctttagcactatgcgcggcttctttaatcgttaattgatgatgatgtttctgattgaccgcttttacacctaaattacagaaaaagccaataaataataagcccgccataatatacatcgttacactataagcctgtgccgcaggcacaccactatcaatttgcatatgacgaatataattaactaataccggtcaattacggctgcagttgaccaagctaataatactcgcccatgaatcgcaccaacttgatatgagccaaacaaatcacgtaaataagctggaattgcggcaaaaccgccaccgtacattgaaataattacacagaagcctataacaaataggactttattaccactttcaccgatcgatggaatgataaaataaagcacggcacctaacaaaaagaaaatggaatacagatttttacggccaattttatctgaaatacttgaccagaaaaaacgccctgccatattaaataaactaagtaagccaacgaaacccgctgcggctaaagtaccaatcgcagcttgttttccaaccgaaacttcagagaaaagctctggaatcattactgatgcttgccccaatactccaattcctgccgttacattcaaacaaagaatcgaaaacagtagccaaaattgtggcgttttcatagcttgattcacaccaacattgtatgcactgactagcttatctgcttttttatgttcaacaaatccttttggtttccaagttggatgaggcaaacgaatagtgaaaacaccaaacatcataaaaatgaaatagaaaacacttaatactaaaaaggtttctgctataccaaccgatgtctcactgctaaagaaattcatcaaaccaacggaaataggcgaagctaacattgccccaccaccgaagcccataatggctaaacctgtggccattcccggcttatctgggaaccatttcatcaaagtagataccggcccaatataacctaaccctaaaccaataccacctaaaacccccgttacccaaatagagtaaccataaattgtgttgatacacaccgattgctgcaacaacaaacccaaggctaaaacaaatcgtcgccacaaacattgctttacgtgggccaa

SEQ ID NO: 93997 - DNA, 713 bp, Oryza sativa
ccattggagtcactccataaattgctttgaaagcttgcttaatgtaattctgattggctttggcattaactaagaaagtgtactttcttggttctgacatcatgatgccataagttttttcagtaagtattggtttaataagtacgtcagtaatttgcatgattagttcaacctttcaactcagttattaattgcacttttttgcgctaagacacagttagcatcaattaagtcttttactgatacttggtttcatagtttgtatgaaacgttaggtaagttagcactagatttttctaggttttcgtttttttcaaaagctacgattaatacttttttattaaccttaagttcttttagtaatttagcaattgcttttgtacttggtttatcttgtttaatcgaatcaactaatcctaagaattcgttgttattaactttagaagtaattgctgatttgaaagctaatgaacttacttttttatttaccttaattttgtaattacgatttggtttaggaccaaaagcgataccaccacctacgtaatgagggttacgaatcgaaccttgtcttgcacgacctgtgtgtttttgttggtaaggtttcttaccaccaccgctcacttcaccttttttaagggttgagtgagtcccttgaatttgtgataggttttcagcaagaattgcatcgaagattgcttgtttatgtactt

SEQ ID NO: 93998 - DNA, 739 bp, Oryza sativa
agctacgtgtaactgtgccaacgatgtacggcgtaaagtttccgccatcacatcggctgtaaattgtgttcagttaaaagaagtgacggttaaacagacaccattcacggctatgctatcgcctaaatgtacatctttgagtaccttgcaagcattaatgggcagtaccgcaaaatcacctggatgcttgatattcgcaactttacccacttcttcaataatacctgtaaacataaattctcctgctgtcagttgctaatttttgcgatgatgaaacgtcataatctaacaagatatcgtcgcctatgtattgtgtggatttaagcgttaaattaaccgcttccgctagttgcaaaatacctgcaccaccgataggacttttggcagtgcttccgcctaataatttaggtgcaatataacaatgaattctgttaacaacgccagctttcaatgcactaaaattcagtgttgatcccccttcaagcaagacactgtcaatttgcattgcacctaatttggctaataaatcaactaaatcaacttgtttgttggctaccttacattggataatttgcacgccaaaggctttcaattgcgctatttttgtactatcagttgaagcggttgcaataatggttggatattggcgcgctgtttgaactaattgacacgctagaggcgttcgtaagtggctatcgcacacaacgcgtattggttgtttagcattcggcattcgact

SEQ ID NO: 93999 - DNA, 631 bp, Oryza sativa
ctgctcggtcgccattcaatagcaatcctcctaatttttcaaactgatcacgtaatgttcgatactggcgaataccaattaatgaagggggtaaagtgggtaattcaaataaagccaacgccgttgcttgttttaaactatcaaaaaacctttgatcatctaaaccaaaacaagccagtaaaaataccgcttgtgcattccccgccgcctgttttatttcttgtactaaatcttcaaacgctagtttatgctcaagtaattgagcaatattaacactccgaaattctcgcgcattttgacgtaaatagtctaattctggaatattcaaatatcctattgagaaatcacaatgcgaaaatgctgcgttctgctttaaattatcgactaatatttgtggctggaaatcgtgataaccttcgatacctaaaatagcaatctgacgataagggaaatgttcattttctgctataacaggcacacttttaggcgataaccaagtatggcgtaaaccacctaagggcgtaacacgtaaatggttttgtttatggctgccaaccaaacctaattcttgcataaattgctcaaattgttgcactttagctacaacttgatgttgacctaataaacaata

SEQ ID NO: 94000 - DNA, 1062 bp, Oryza sativa
  unsure (1)..(1062): unsure at all n locations
agcgtgttgtatgaagtattacaaatcattttggataatgaacatttacgtgcgattgaaattcaggtctatggtgcagattattggaatgtcacgattgataatgcacccgcacaaacatgggattttactgaaatagcggttgaaaatgaaaaagtcgcgcgattaggttggaagccgtcattattatgcccagatgaacgataattaaaaatgtttctgaaatgatcggccgtagtctatacgttttacaagtcaaaaacaacaannnnnnnnnnnnnnnnnnnnnnnnnnnnnnnnnnnnnnnnnnnnnnnnnnnnnnnnnnnnnnnnnntcgctcactttttttaaaattcaaattagcttattgaaatataatagcgaaacggtgaaaaattggcataaacagaaaacgattttagcggattttgaaaaagcgttaaacgaggcatatagtcagttaagagagctattatcgacttttcgcttaactattgaagaacctaattttaacctgtgcattagaacgtgttttggattcgttacgctcacgaacttcagcaaaaataagtttaaattgtaaattgccttcgcaaacgtttagtgctcagcaacaagtccatgcattacagattgtgcgagaagcggtcattaatgctataaaacattcaaatgcaacccaaattgaagtgattgctgaaactaatcaagatggcgaacaatgtttaattgtacgcgataatggtaatggaatcgtgaatggcattgaaccagatgatcattatgggctgacgattatgaaagaaagagcggcacaattaaaaggcgaatttactattatcaatcgtggtgaggcggtgtacaagtaatggtaacattacccaataccttactttaagcatcattcactttttattattcagtaaagcaattagcaacgtatttgaaattatgttggttatttataatcaaccccatccaagctagcaatcaccgactagcataaaatagtacaaacaaataatgttagcttaccaataacgtaagcgagttgattaagca

SEQ ID NO: 94001 - DNA, 685 bp, Oryza sativa
ttcagcagagtttgccgctaaaggttatcgggtaagcatttttaatgatttcattgactatgcgaatcatacggattatccgcttgactcttttccaaattttaaatacagcgtttcgccacaatggctgaacgcagtaatacaaggtgaacagccagaaacttatcagaataatcaatttatggtgtttgaagtttcatggggcagtttggaaaacgcaaagaattatacacaacacattgtcggcgcttatcactttaatacggattggatcgaaaatgcacccgtttggaatttgtctgatgctaacgtgattgaacagcatctattgcaaaatggcattactaaagataaaacgataattctttattctgataatcaattggcagcctatcgagtgttttgggcattgaaatgggctggtgtagaagatgtacgcgtattgaatggcaatttagcgagttggattgatgcaaattttgctaccgaaacaaaagttaatttaccacaacctgccacaagttttggcgcaacgattccggtgaatccgcagattgatattattacgcctcaacaagtgatggagcgacagcaacaaggtttgaaattaattagcaatcgtgcttggaatgaatatataggcaaagtgagtggttatgattatattcacggcaagggagagcct

SEQ ID NO: 94002 - DNA, 905 bp, Oryza sativa
ccagcgattgttttaatggaaccgaggcattcaataacatagctaactgattaattaattgagtgatttgttcgctttttggtttcctaactaaaataaaattaccttggaatatggatttttgaatagcctttacctaatagcccgtggttctaattcatcgtgacttttggccagagatttacctttttgccgttgattaaaacgattaaaagcccgccaatgaaattcatatattttcagcatcgcctaatactctgttaatttctgctaaggacgtaatatcagcctctaacttatgcttcgcactatgatgtaaactagcaaaatcaaggtaagcggtctctttttcaaagatttttcccgtacggcttaataattgataaatgccaatgcgtcctctatagccctgatagcaagcctgacagcctttaccaaaacattgcgtgcatagcttgcggacaagccgttgtgcaatgactaataataaggcgtttttaagctcatattctttaatacctaattgtaatagccgttcaattgcagagggcgcatcattagtatgtaatgtagaaagcacaagatgccctgtttgtgcagcgcgtaatgcaatttcggcactctccggatcacgaatctcacctaacataataatatcaggatcttggcgcaaaaatgttcgtaatagatggctaaaatctagctgaatcgctcgattaacttgtgtttgaatgattccttcgatctcaatttctattggatcttctgccgttaaaatatgcttatccggttgattcagatgacttaatgcactatacaatgtgatacttttgcaaaagtcggtggggccagtaactaaaattagactttgtggttgatgcaataagtgtaataacgtagttttt

SEQ ID NO: 94003 - DNA, 798 bp, Oryza sativa
aacgctaagtgatacgttacgggaacgcgctattcgaagcacttatcttgaaggtgatatggcgcaaacacaacgtaatcaggcaattacacgcctaaaagagggcggagtgaatgtattagttgcgacggatgtagccgcacgtggcattgatattgatgaagtggattatgtcattaattttgatttgccatatagtgaggatacttatttgcaccgaattgggcggactgctcgtgcgggcaaaaaaggttcagcgatttcattagtggaagcgcacgattataagttactgggtaaaattaagcgttatacacaagaggcattaaaacctagaatagtagaaggtttagaaccacgtacaaaagcgcctaaagatggcgaattaaatagcacttcgaaaaaagcaaaagcacgacttaaaaagcgtaaagaagccaaaaagattgaggctaaaaccaaactaaaagttcggcataaagagagcaaaaacataggtaaacggcgtaaagtggcaacaacaaatgcataaacgcgtttttagcaaaatgttgcgattatttgatcgcttatcttagccaatcgaataggaaaccgtatggatttacacaatattcgcgcagactacactaagcaacaactttcaaaaaaagagtgtgatgcaaatccaatgaagcaatttgagcggtggttaaatgaagcgataatggcaaaggtgaatgaaccgacagctatgaatatggcaaccgttatagatggcaaaccaaccagtcgtatcgtattgctaaaagaagtcga

SEQ ID NO: 94004 - DNA, 1171 bp, Oryza sativa
  unsure (1)..(1171): unsure at all n locations
aatactcattatatccgcgccggtcgttttttaacggatcaaacgattcctttattattcatttcttgttgttggtggctaatcgcatttggcttagtgatcagttatccaaaatcagctagcctttggtctaaatctattacagcaaaatttatttttggcttctgcacgttaatcccattttttattgcaatacttgcattacgattcaacaactacgccttcaatcaatttcaaggcgcgtatttattactttatgtatgcctattagtatggtgtgctgattctggtgcttatttcttcggcagagcatttggaaagcgaaaattagccgctaaagtatcacccagtaagtcttgggagggcgcattgggaggcttaatcacttcttgcgtgatggctttattattcataaaactaacgccaaataatatttttggtcgcgaatttgaaacactcccctttattatagtctcggttgctacagtcgccgtttcaagtttaggtgatttagcagaaagtatgttcaaacggcaagctaacataaaagacantaataatttaattcccagcccatgccgtattttagatcacatttatagtttaactgccaccattccattttttgctaccttattcttttttgtattataggatattatgaccgctattcttgcattcttaattttaatttgtgtacctgtttttgtacacgaatatggtcatttttgggcagcacgtcgttgtggtgtaaaagtccttcgcttctcgattggctttggtaaagttctatttcaaaaggtagataaacaagggactgagtttgttttttccttaattccacttggtggctatgtacaaatgtgggaaggtaatgaatccattaacacggataaaacacaatccctaatgcaaaaatcccgtttacaaagagcatttattatcatagccgggcctatggctaacctattatttgctgttttggcttattttgtagtgtttagttatggtatgccgacactcaaacccgtcatagctgaagtcacgccaaatagtattgccgccgccgctaaattaccgacagaatttgaaataaaacaagttgatgataaacaagttcaagattgggatgaagtcacgcttaccttagttagcttaattggctccaaag

SEQ ID NO: 94005 - DNA, 1005 bp, Oryza sativa
tttatggcgctgatcagtgtcaatttaggtataatgaatttatttccaattctaccgctagatggtggccaattagtcttgattgctacagaagccataaaaggtaaacctatatcaacaaattttcaattacgttttcaacaattaggtgctgtatttgtattggctttaatgatctttaccttacttaatgacgttattcatttttaattatagcggttaatttcgctcattatttacaatcataggatagtttaaatgaaaaaattattactctcttctcttttagttgccaatggcgttattgcggcaccatttgtagtaaaagatattcgcattgatggtgttcaaacagaaactggcaatgcaattattgcatctctaccggttaaagttggtcaaactgcaacagatggagatgttactaatattgtaaaacaactttttagtcaaaaccgttttgagaatgtaagtgctgcacgtgaaggccaaacattagtcattaaagttgctgaacgtcctttgattaacaatttaactattaaaggaaacaatgcaatccctaaaaatgcattagaacaaaacttaaaggcaaatctaattgtggcaggtgaagtatatgataaagcaaaattagaagcgtttaagcaagctttagtagatcattatcacactatgggccgttatcaagcagatattcaaaccattaccactcccaacaataacggcagtataaatgtagaattaaatatcactgaaggcgagattgcctatgtcaaaaaaattaattttgaaggcaataatgcattcagttatgatgaattaattaaagaactagagattaaacctaatgcgccttggtggaatatttttgaaagtagcaaattccaacaacaagaatataacaaagatatagaaatcttacgcgatttctatatggatcacggttatgctaaatttaccttaaaagacaccgatgtgaaatttaatgagaataaaactgaa

SEQ ID NO: 94006 - DNA, 630 bp, Oryza sativa
taattatggaaggaatcatattatttttttattgctatttatgattaggcttggttagaacggtagttaaattttttaagatagtcgaaagcatttttatgaaaaaagcggtctaatttacataattatttgcaaattagaccgcttatattatctaaatactgagcgatattgtggcttagcgcgtttaaattgactcataaagacaattaagaaaaatagcataaataaactaaaggcgacaattaaccattctggcatcccccagcctaacatttgccattgcttttcactacaattgaccgtaccagcagcaaaaatattgggaaaccattcatcaagcggtattgtttgtgggaattgtggtttaaactcacattgattccaaggcgatggattggcttgataatcataatgtttaatagaaagtgataaacctttaaatgcactgaaaccccataatactagcgctagccagcggaatagaaagaaattaggtgcaattaaggcaattaagccagcaattaaaaaaccagtaagtgcaacgcgttcatatatacacataacacgcggaattaggcctaatttatgttggaaataaagaccagttacttcaagggtacaggctaa

SEQ ID NO: 94007 - DNA, 584 bp, Oryza sativa
ctgttattgaacagaaaggattgtcatttattagccaagcattaggcacaaaagcaactgcagcagacggcgtaatattgcaagactatcagaaaatagaaagtattgaagcattacaaaaagaattctcagttaaattttactaatgtatagcaaccagcggtcgtaaatgaaatcaattttacgaccgcaagtaacgatcactaaataaaaaagcctcattctatgaatgaggcttttttattatttaccgagatgagtgaaaaagtttttaacactgtctaaaaaaccggcttgttgcgggcgatgatttgctttaccgtccaaacttatttcaagttggcgtagtaactctttttgttcttcattcaattgaactggagtttccactacaactttacaaattaaatcgccagcatatccaccacgcgggctcacgacgccttttcctcgtacacggaataatttacccgtttgtgtttctgtaggaactctgagtttgagcttaccatctaaagttggcacttcaatttcaccacctaatgcggccatgctaaaactaatcggtacttcacagtagaggt

SEQ ID NO: 94008 - DNA, 767 bp, Oryza sativa
  unsure (1)..(767): unsure at all n locations
attacccaggtgaatggttattagatttaccgttgttatcacaatcattcaaagaatggtcgcaagctcaacaagctgtagatcaaggggagcgcgttaccttagccaaaacgtggttagaagcggtcaataaaattgatttattcgctaaagcggacgaaaatcagttagctgatttaagcgaaatatacaccgcctatttaattaagtgcaaagcagcaggaatgcaatatactcagccggggcgttttgtgctaccggcagaaaatgctaaaggtgcgcctgtttttcaattttttccattattacatttatcagaagcagaatggcaacggctagaaactgctagcgacaatagcacttacaaaatattaaaaaaacgttatcgctattatcaacaaaagattattcaaccattttatgctgactatttttcacaatttgatcggcaagtgattttggcggattgcctaacaccactgaatcacggttatcctgcatttatcgaaatgaaaattaggttacaacagctatttaagcattttcattacggcaatcgttcactttttcaccgcttattctncgccaaaattgataagttattnatttttagccacctaagagcgatcatatttagtagccgatcaagatcgcccaatttagaaaagtttaaatgcgacaatttagtccaagaagggcggtcgttatgctgaatttgacgggattgaaattggctatcaagctatttcggctatccgtgccactga

SEQ ID NO: 94009 - DNA, 558 bp, Oryza sativa
tagtaatcaaggaataatcaatatgtcagtaattttaggatcagatttagtaaaacgtggtatggcacagatgcaaaaaggcggtgttattatggacgttgttaacgcagagcaagcacgcattgcagaggctgcgggggcagtggcagtaatggcattggaacgcgttccttctgatattcgcgcagcgggtggcgtggcacgtatggcaaacccgcgtattgtgaaagaagtcatggaggctgtttcaattccggtaatgcaaaagcaagaattggccatatcactgaagcacgtgtactcgaagcaatgggcgtagattatattgatgaaagtgaagtattgacgcctgcggatgaggaattccatttattgaaaagcgaatatacggtgccttttgtttgtggctgccgtgatttaggcgaagccttacgccgtattggagaaggtgcatcaatgttacgtaccaaaggagacccaggtactggaaatattgttgaagcagttcgccatatgcgcaaagtaaactcacaagtgcgtaaagtggtcaatatgagt

SEQ ID NO: 94010 - DNA, 642 bp, Oryza sativa
tctatagtattaaccaacccgccgctgcgcgtggttatcaaagcgtcttttggaatatttccttatatgataaatattattttgaagctatgtttagccagtttgttttccctgattttgaacgaccaaactggcaaacaaccgcgaaattacaacttttctttatgaaatggtttaaccaagaacggactaaagccattttgacttttcctgttatcacggcagctatgctcacagagcacggccaatgcaaagataatcaatttgctgatcaaatggcagaagaactttcgcaaggtaattcattctttatctaccaatcagataatcctgactctttagcgtcttgctgtcgtttacgcaatgaaatcgcggatcatacattttcctattcgcttggtgcgggcggtgttgctaccggttcaattaacgtaattaccatcaatatgaaccgcttggtgcaagataaacgcgatctggcaaaagaagtggaaaaaattcataaatatcaatacgcttaccgtaaaataatggaagactatttagccgcaggtatgttgccggcgtatgatgcgggttttattacgttagataaacaattcttaacgatcggcataaatggtatggcggaagcggcagaat

SEQ ID NO: 94011 - DNA, 628 bp, Oryza sativa
tgatactctgtacgaagcgctaattctggtgtaattgcatattcaacacctgtgcctaattataaagaaggtttaagtgtgtgtaacttagtttcgtctttaacgtgctgatctttactttgaagatctaaaataaatttataatcattacgcactaatcccataccaactttaccatatacgtctaagttaggcagaatttcatagctcggttttaagcttaaatttgcgccatgtgcagtatgtttaaattgacgatttaagtcgcctttaggcttaggtttatgaatagggggtcttggtcctctaggagtaggaacatctaacgctactttattttggctactgcctttcatttgaccatagtagtcataacctaattcaagcgctaaacccattttattttgattaaaaatttggtaaccaccaaaacaccataggtcaccgaattacggtgaatgccccaggtagtgaactccggattataacgtttatcattttgatatttactatcaaattgattaatatctttatgtgtgcttgcccaacctgcttttgcccctaaataaaaggtattggcatctggtgcagccaatgctgcgcttgtagcagataatacggataatgt

SEQ ID NO: 94012 - DNA, 569 bp, Oryza sativa
cggggagccgttacgtgaatttggctgggtagtacatacgcataaatcacgctcaacacaagcagcgcgaaataactattccgaacgcttgcttggctgtatatgtttaagcattactctgtgcatgattttgcggagtttttagagcttaacggtatgccaattcgcattggtaaatatggtgcaggtgcgacaaaagatgaaaaaaatacattaaaacgtgcactcgcgaaattgggcataacgctgcagggattatgcccgaatctatgagtattgagttgcataatgcagcaaatggggtggccgcgggaaataacccatttttacagatgatagattggtgtgagaagtcaattgctcgcttgattctagggcaaactttaacctcgggtgcagatggcaaaacctcaaccaatgcgttaggcaatgtgcataatgaagtccgccgtgatttgttagtctcagatgttaaacaacttgggcaaacatttacgcaacagattattttgccgtatttgttgattaatttcccaagcatcgatccgacacgtattccaacctttgag

SEQ ID NO: 94013 - DNA, 20822 bp, Oryza sativa
atttcatgcgagttttgctccgtttttgatggatttcatgcgagtttgctcccttttttgatgggattcgatcggttcggcgacggagccggaggtggtggggtggggagttttggggtacgagtgtttttcaaactcgctgaatttcgtcgaattcggatctagtgcatacatgttaattaaggtgttgttcagattggtatcatttcaaaacatactattttttaagcaagattgtcaaagatatatacatttagttatttaccaaacttttataaatacataaggaatcttaccaaaacttcgcaatattaatgtcaacttatcaaaatttagatattactaatatttggtaataaggtttattatttcggctataatctaaacactacttagtaacagtgatatggataagattatggcgtactgtagcagaatactgtagaagaaaatcagtcattagatcacaaaaacgcatggctgtggttgtgcagaagttgttgtatattgtgaacataatagcagcgacgaagttcgttctcaatagcatctggccgactggatctcaattcggttttggggtggttgtttggtatcttactgtagcatgatgtttcgtatatggtgtttggaaaatgatacacgtacacaattttgttatccatcgacatcttcaaaaactgatgtgccacactgtgcattgaattttgattttgttttcataactgtccactagttatgtccaacagttgagatctttgttactaagctcacggtttagtaaagatttttctaatactataaaagcggagtagttctttctttccacccctctctcaccagtgcacgcgggttggctaatcaccagatctaatgtttgtcgattactcttctagcccatatatgatacaccctagttatatgggcatgtcatgttacaacatatgtgcatgcttctacttaacctttgatggcattttcaaccatatcattttcagcaaagttgccaaaaaaaatgtctacgtttaatttgttgccaaatttggtaaatgcataagaaattctgctaattttttggtaatattaccaaatttggtaaggtttattttgactacaatctgaataggccataagtaatccagttatcacacggttaccagctatttctttgccaatattgtaagtagcaattttgaggtatccatgatatataataacacaaatgttcgttcaatagttttgaaacaaccggtttacaaagtcggctatcaaatttaaaccttaggcaagaatattttgctttcatcggaatgagttgtgctccctagcttgtttgtaaaacactagagagcctactactactactacctgttggtgataataagcactgtagttgatgtgctccctcttgcttgggtcacgttagatttccatatgtttccggtttcttttttggctaggaattgattttggggaaaaaaatcctgaaagctacttgttatatttgtaggttttatagatacatgaaagaaaatgttttggcttatctagaaattggaaatactactgtcggggctcctttttaaatgtagaaatttcgcaagaaattgtccattttcaacttctgtgctaaaagaactcttggtagtagtcatgagtgtaacctataattatccccttcatatgtttttaactgaaaaatcatcatatagatcaaattttatgtatttcaaacaggtttgttcacaggtcaaacttttcactggcaccatgaactaagcggaggtagaagcacacaattattgtgaaaactactgtcaattattaacatgtcgctgtcctactatatatgtcaagtaacaactgtttgttccctaccttaaatatttctacatatagtatactccttctaaattaatactccaacataaacatacccaaaagtagtgcctaattgtggcgcagatatgtgcatgcatacgatggtcttgttttatccatctgatgattggtcacctagatttctctcccgtgaacatgtacacactgtggctgtgtgcgtgccggtagttttggggtcacatttagttctttgggttccttgggagtaaagttttttaagtatacgaacacacatttaaagtattaaacgtagactaataataaaataaattacagatttcacctgtaaactgcgagatgaatttattaagtctaattaatctgttattagcaaatatttattgtaatatcatattgtcaaattatgatgtaattaggctcaaaagattagtctggcgatttaaatgcaaactgtgcaattggttttttttcattcatatttaatacaccatgcatatctccaaacatttgatgtgacagaaaagttgaaagcttgaagaaaaaaattttgaatcaaaaacacggccagttgattttggacgacaaacacacaagcgctagctttcatctatcgatcgtcagggggcgcagcaaaaccccacagccagagtgtttcttcgcttgtgcactccgggagttgggttcagtgtgagcgacactgttgctgctttgactgcaggacgacgagagctaagctagctagggccggggagcacgggtgagatgaatgaaatgaagaggaggagagcgagcttggattgggcgggccaatggcgctcggggcaagttgcgcttacggcggccaggcgtacaggagatttgctgtgctgctacagggcacttctgcggggattgttctccatcggtagctggcaacgtacactgcccaattaacaatagccaactgcccaattaaaatactttggtaataaagtaagtgaaaataataataattctaaatttttttaataaaacgagtgatcaaacagtgcaaccaaaatgttaaaatcccttatattatgggacggagggagtagtatcttaattcactaagataatacacattccgttacacaatttaaactgcattcatgggttttttatccaatattattgttcgtcttatttaaatatttttttatgattagtattattatttttattagatgataaaacataagataaataatgcttgacttaaataagatgcacagttaaatattagaaaaaaaccaacaaatacacgtaaaataaaatggatggagtactacataaggtatatgaggctagctccattttgaaacacgggaaaaccacataaagtttgaaggatttaaatactactactctcctataagacaattttcactgagaccctttggataaaggattacagtaggtacctataatttctttgaaatttctatggatagatatttcattgcaattttagaggatttgtagcataaactccaaacctccttcaaaattttcctttcttcctagctacctctcaaattcttcaaatgacgtgttttgcccgtgttcaattcaaatggttcttatgctgttttcctatgatctttgttgcttaaagattcaaggtgtgaagacagtctctaaggtctccttggggagcaataattttgtaaaggaatttaacgaattgaaatcctatgagaaaatgtcctttgagccctgtggattttatgaatggatttcgaaatttggattgaacgcacacatgcataccatatctgtatgagcatctcagaaagacttgtccagtaagtcttgacattgatgaagtcatcatggatatctgccactaaaaaaaataattagccataaatacgggtacccgtgttaagtctagaacttgaatctatgtggacttatttcactataaagagcctaaccaattaaattaagttacattcactttgcttaaggacatataattacacatactgccctcttcccatcaaatattttaaaaacttctatttttataaagtagtaggtcatacttttatctttaaggacttacttcttccatttcatattataagactttctaatattgcccacattcatatatatgttaatgaatctagacatatatacgtgtatagattcattagcatccatatgaatatggataatgctagaaagtcttataatatgaaacagagggagtatatggtaaccaacgaaacatctccttaaattattttagaaagcaagttttagtaaaattggtttgtcttgaaacttataagctcaaaccaacaagttatagtatccgtaacaatgccttcggtagtgtacggtgatagcacctttaaaaaatcttagtgctagtattattattcttttccaattttggatttttggtttccgtttgcacgctccataagttcctaaatagtgtgtttcctaaaatacttattttaaagcaactttttaattttgtagtaatttatttatttgtttgtgtccttaaacatatactactcccgtctaaaaaaatccaatgattggattttttttttctttaccaagggggtagctatcaaaaatcagataattcatctgtccattaatttcagctatctcatagggttattatatatacttcttctatccataaattaaatataagcatttaaagtgttttaaaattatctataaatatacaacctgctatacgtacgactcacgtcctactgtctcacgtctaccaatcactgagcttgttatcgtgtgggccagacaagcaacacctacttcctccgtccctaaaaccaacctagtactaaatgtgaccctaggactatgaatctagatacacatatatccagatttatcatattagaatatgtcatatctgattctagattcgttttttctggatagagggagtatgcatttagtacatgcatacggaatactaggttgtaggagttgtacataaagattggacgcataggagtatatcatttctcattcttatttttttcattttaacccgatcactctttcaccccaaccattctcactaaagtttttcacctcatccttaatctctttaaaataaacccgaaactagaaatactcatatatatatatatatatatatatatatatatatatcgggtggagggaggagaaatagtattatcttatttataaatatatactagttttttaatgtcctgtcagttagggcctgtttggcacagctccaccccttctagagctggagctcagccaaacagtttcagtaccaccaaaactgagagtggagttgggtggagctatctcacatctcacaaaatgtcctagagttgtggagctgggtttaggcagctccacaactccactccagactcaattcctggagcaatatttaggagttagagctgtaccaaacagaccattagacaatcggtcttgctctatatgattcagctagtgaagtcttttataatttgttttctctcaggaatacttcgtctttgttaattagcgcagttagtgaattacacatcactcattttgcaaaagtaagaaaaaagaattacacagcatatatcactcgcaattttctccatcttagtcagtcattaatattttgacagaattattggtcgatgatatgacgcaagttggtactatactccggccggctgctagggttttccggttactggccaactccaagccgccatggcggcccccgccatgagagatcgacagtgacagctagctagctggagctagcacgccggcaacggtggcccccgccggcgacagatgcatccgccgttccaggacgccgtacgtctcgatcgatcgatctcactccggcggccggtgacgaagacgaagggccggttcaagttgaaccaaactgattactactattacactgaaaactgacgcacacgtgatatggatccggccacgaagaaattaatcgcgttacaaacggacaaattttcctacattgataattaagtactagtacgtacagggttgtttatttagttgcgctgttagtttaatttgctgcttaattattaattaatcgtcacacgtggctgttcctcttgtctcttgtgacgactgatctactactagcaacgtagctagcgaagccattcccaattcaaaatactagaacatagacggtgtttcctgaaattggagagaagtttagaaaaagttaatagtttagaaaaaaagttaggagtttatgtgagtagaaaagttttggatgtgatgtgatgtgatggaaagttggaagtttgggggaagtttggtgtgaactaacataccatagttttcataaactttacatcataaaaaaaaactatcactagatactactctttcaatgcaaacaccacttttttatatttaaatttaataatactacttatctcacatgatatgtagaaactatgtctcatacaagacctagttttcttctcttttctcatttattcatttgtcacatcatctttcatcggtagcagcttatttaatgctatggtcactattctagtcattgggttgggaatgagggtgtgttcagttcacgtcaaaattggaggtttgattgaaattgaagtaatgtgatggaaaagttagaagtttgtgtgtgtaagctgagtttccaaactttatcttccaacttttaactttttcaacttttccatcacatcgttctaatttcaacaaacttctaattttaacgtaaaactaaatatacctaaagttttgatgtgatagaaaagttaaaaattcaatgaaaaagttggaactaaaccaggcctgacctgatatgacttgatttgcaggcgctcctgacctgatgcaacgtacctgctccaattaaatgcaaacagtgttcgtacttcgtactactacgatcccatcagctggtaggagtaccggcccgttgtttgcaatactcccctccgaacaaaataacttatactatttttttcctcaaaatatagcaacttgaaattaaataggacaaatcctaatcaaataaatatggctaagagagtgtgtagattcgttaaactatcggccgtcatctttccgcttatgcttattaagtcaaaatttaaactttcgactttaaaattagagttgatgtaggggagttttcatcgaaatttatttttcagcatttacttttatgtcgctaaaaatacatatataaaatttttattcacaaattaattttttgtttgcaaatatatcgtttcgcttatttgctgaataagcgaaacgatggagccatatgatatatcccatccaatactagattgttatattttgggacgaaggtaataactttttttacagagagagtatgttattgtgtatttccctcgtttcataaaaacaaacctacataatgtaacacatcctttacatcatagtgctatgaatttagataataatttattcacatttataatattatgatgtgcgacatcttatatcatttattttttatgggacgaagggagtgtgctaaattaaatacaacatgtctcaaaacatatctatatagcgtttgatttatgcacggagtatataaagtgaagtggtggatggttgaaatttgttgagatgagaagttttttttttgtcgaccagacggtgtgataattcattgtatagagtaggaaaaaaattacagagcagacaagaaagaaagaaagaaatgataaagatagctgctacttctatagttctatgtactccccccgtcccataaaaaaaccaacctagtaccgaatgtgcacaatctagtcctacgaatctggacatacatctgtctaaatttataggatgtactaggacgtgtcacattcggtcttaaattcattttttatggaacgggggagtacctcggagcccgaaattaaatactgatttaaaaatgtttttactaatatttgtgtactaatttggaacttacgtttggaaaaataagcgataaatttgtccctcgatcgactctcaaggttattgctaaaaaaaaattttggtactagtaaacctatacaccaatattccagtacttcggaagctaatctttatattgctgacttggaaaatagtagtagtatgattcatcagaatctagctgcatccgactgcatgtagcagtaatatatattttcttcatgtaataatataatttttctcatggattatcttgaaatgggacaaaggaatgtttcctactgttcctttctaagttggcgcgttccatttgacttcacgctgcatatacgctctttctcgaggacaaccagttgaatagtagtaatactcctgtcatgaaattgtactcttgattaaactaatccagtatattaaccatgttaaccactgctagttaaataaatcaagagacgtcagacgaataacagtaacaagcagtacagacgcaagcaatctctctccccatttcaagttccaacgccagctagctgtagaaattctatgcatatgctgtgggcctatttggtttccatggacttatttcaagtccctaagttcctatcacatcggatgtttagacactaatttagattattaaatatatactaattacaaaacctatttcataaccttggactaattcgcgagacgaatcttttgagtctaattacgccatgattttgacaatgtgatgctacagtaaacttttgataattatagattaattaggtttaaaaaattcgtctcgcggattagctctcatttataaaattagtttttttactagtctatgtttaatactttaaattagcgtccaaacacccgatgtgacatgggctaaaaagttttaggcccatataaacaccccctgtattctctccagtggtaaaaagaaggggaacgagatatcgccgtccaaattaaattgcatttgttttggccatatatgcaaattaggccctgtttagatagaactagagtttttaagtccctatcacatcggatgtttgaaaattaattataaatattaaacgtagactattaataaaacccatccataatcttggactaattcgcgagacgaatctattgagcctaattaatctatgattagactatatgatgctacagtaaacattctctaattatggattaattaggcttaaaaaatttgtcttgcaaattagctttcatttatgtaattagttttgtaagtagtctatatttaatactctaaattaatgtctaaatatagagactaaaattaagtccctggatctaaacaccaccttatagttggaagtaacaaaaactacgagtaaaattcttacagtactataaacggacttaggttacgttggagagtgttggagaggaggagaaagaagctgattggaaaatacgaaatatgaggttagccactagtatataattaattgattatttaattatcttaaaggtaaaaatgattaatatgatttttaaaataactatttatagaaatatttttgaaaaaaaatatatggtttagcagtttaggatgtgaagtgcgcgaaaaacgaaggacatatttctcgccattgtgcttcaaatggacacgctcttagtgtagctcggcccgttactagtttccgcttgtggagaaacctgtcaatccgaatttaagttataggcttagtacatgtgcttgtatttatgattattttttttttctagacaacgaacatgttgataacaaggtaataattttgatgactcatcgaaaacaatatgttagcctagtcattaaagttgattgtgaaggtagttgtgaaggttttcaagtaccgagtttgatttgtgaagttgagaacctttccctcctagatgtaaaacgaaatagctctttagcacataattaattaaatattagctaaaaaacttgaaaactaaattagtatgattttttaaaaaaacaaaccatttaatagctcgaaaagcgtgcacgtaaaaagttgaaggtgaggttaggaaaagtcatccccgaactctacctaatttttttcttcagcaataataaaaattgcagattttagcaactaacaaataccactttattcataaggataacatcacagttcacatatcactttgtctcatactttgagacaatttccaggtaatttttcaaaaattttctgaccgattcggcttcctgacaatgggtagtggccttgttgtatctgtttcagttttcgacaaaaaaagtttcaaatttgttttcgcttccgaaaattttcaaacaatgctttccgtttcttacaagaaaacatagatatttttatagttccaaatttgtcttaccaccttcgtcccaaaataaattcatttttcacccattccacacgtagcaatacaaaatcaaaaaagactaaaatacccctactttatcaaatcacaatataattattcctcattttatcttctctcaatacaactaatccctactttcacaaattgcaatgcaatggttgctctaaaaatgaacttattttaagacaaacgaaaggagctaaaaattaatttaatatgagacggagaaagtatatatctatttctctacctacttactcacctcacccaattgtaattttccatcattcaattccatctcctttggctcccatcttttgccctccaactaataagccgttaacaaatttgatttttaaaacttgattttgatggtcttttttttaatcaaagtttatatttcccctttggcttttaaatcactaagaacacatataaagttttatccataaattactcttattgttaataaattgtacggcttataatcaatcttaggcgaatcgataacacaacccttcatcaatcctctaaaattatttatatttagagacaagtgagtactctttctttctgtttcataaaaaaaacaacttttagccgggaacccaaaaattagttttgcaggggacaaggggagtactccctttgtaaaaaaaaatatcaacctcgcactataatgtgatatattttactacaaagaatctgatatagtatgttgagattcattatattaggatatatcgtatcctagtgcgaggttggttttttaggaagcggtagattttaagatggcatgagtgccgcgtcttttctatcttgttcgttcaatagtctgacaactctactaaaacactgttctttctaagttcatggaggtatggaatattcgcattacacttataaaaaatgatttactaaaaaatttctataaattaataatgtaaaattatttagataacgtacttttcacctactatttgctaatattataatctataaattttaatcaatccagcacacaggctcaaaatcagtaaccaataaccattaacacgaatcacctcatcgcacgtttaacatcagatcgcattgaaaaattaccatttggaggaatacataatttcacaccagaattgcacatcaaccagccacgaaaaggactctttgtgagcttgaggaaagggaagtgtgccgactctttgggctccttggctccacacacccacgtgagatcgatggggacctttgcacagatttttcctcgccggagaggtagctatctcctcctcctgtttcttccaaattcatcttccacgacattgccaaccaaagttcaatgaacatgcatggacgatgtcaccgtgcagatacagtgctctccttttcgtggatgtatacaaaagcagatcaccgttatgatatatctgcgtcttcgtgtcgcgacgacacttcccaagacataatatctgagccttataaattttcggaggaaatagtttttgtcctcatggatagggaacatttcataggcatatcacatcggatcaaataattaggaggtgcatatagacatatggacaacatattcatttaattaaggaggaggatattttgtaggtcatggtatgaagtactcccccgtccctaaatataagagattttggttggatgcgacacattctagtacgatgtatttggacagtatatagctgtgttcggaactgttgcttcccagctccaccgtctcgtcttccgcgtacacgttttttaaactgctaaacagtgtgttctttgcaaaaagtttctatacgaaagttactttaaaaaatcatattgatccatttttgaaaaaaactaaacttaattaatcacgtgctaatgagccgcttcgttttctgtgcgcactgtgcttgttgggaacccatggttctaaacacagctatagaccttattatcacggtaatattcagggtttgccacctatggtggatttttagttttttttaaccttttggtttttaatttataaaatacactatcctgaaacttatttctaaatctgaactttttgtacacgccactccaccagatgtggcaaaacaacattgtcatgtcacgcacaatgcacatgctagtgttgttttgccacatcaacttaggctgtgttcggcatcactttttactaacccatctccctcgtttttcgcgtacacgcttttcaaactgctaaacggtaagtttttgcaaaaagtttctatacgaaagttgcttaaaaaaatcaaattaatccatttttgaaaaaaagctaatacttaattaatcacgtgctaatggattactccgtttttcgtgcatacttgtccggttgggaaactaatgccaaacacagccttagctggtgtaacgaagaataacgctatcacgctaaagaggtagctatggaaaaaaattgttccaccatgctagcaagaatgtcatgattaaaaggtttagatttaaaaataagtttttagaatatagttttaaaatgaaaaatgataaaaaaaagattaaaaaatttctcgtatggtggcgtttcatgattcttggttccacgtatctatggtatctatgacatatgggtactaatcccacaaggcataaacacattaattatagggttcggagctttatgtacaacctctaaatccacatctttaacttgtgaggaaggattaaaaagaagtataatcaggcactttatgtacaacctctaaatccacagctttaacttagtgatttcatcatctccgttactatgtctgggaaagacagacaacttataatcaggccaagaaaattaagaataaaaataaagagggttaagttggtacgagttgtaagatgaattatatttaaagaaacaaattcatataaattgtgcatattttgcaaagcgagtgtattcagttagattccttatggtgtaaccagctcacccaattttaagattttagatttgatatgggtgttcgcgtttatgattaattattcttttagtgatagacccatcgatgtaccgaactagtcagttttaagatataccgaactagtcttttggagtattttttttattttttagactttttattttttttaattttattaatagtcctttccaaaaagtatgacactggcgtggctaaaaggttcagtttttggaaatatttttttaaaccatctataaaaaaattttcaaaaaaaatctctttcagatgtgctcataggataggatagagtatgcatgtgtgcttgcattgtgtttttttttaaagaaaatattgtacgtatttttcattttaatgggaaccagaataggagtacgagtgtacaacctccactagacaagggaggaccgaagtacttaagccaagtgcatataggggttgagaaggaccaaaggctaggcgcttaggttgatggagaggcttcagagtgccacccgcgtgccattttgtcggtgaagcgtactatttgcgttgccagaaaatggtgaccacggtgccatgcaaaatcgtcaatctagtatatagatgtctcattctcacgcattcatcagacatgtgcgtggatgcatgttaagcttctcaatttgtcgtgtggaagactgaaaagaaattaaactcagcagattttatggcaattctgcttggagggcttttcttttttcttttttggctgcataagacaagacaaggaagatacaccaccgatatagtgaaaagtaattttaggataagacttttttacacttgtactcgtggcggttaaaaaatcaaggctgagtttcaaattcgacaaaggaaaccataattaattctaaagttcaaaattagcaatggcttttaagctcaaacaaacggggcaactctattacgatccttgattgggagtacttggtagatatatgcaaaaatgaaggaagaaggaaaaaaaacatggtggatgtttgcgggagcagagtagtacagtttctattttacagctcgagctcatcctaaaaacctctgtatagttgtagctgcagtttttctaaaatattttttactactatattcaataaaattgacatattttgtgttagttcgttaaaaaatgcatgtgcttgtacgatactgtgaaataggataaattaattcatgcaaaactgtatttgtgcaggtggtatagtttgcttacatacctagcttctctttgtttaacttggagtatttgttggaagtaggaactgcaaccggatctggggcaacaaatagtatagcagacctttgctctcatagattctgacaaagacatttacaagcatttccttccaatttacgatgccgcagcaggaatccacaacttctattccggtacaaaacaatttactttgatttcattttgtttctttcgagatggttggacacgtgttcatcctgtttatttctgcaaaataagggctcaacaggtactccataaaatatgaaaatagcaccaaccaagacccatatcatcaggacaatgacaacacaacagcatttcttaaattaattaacatcgcaattagttctttgttccatgtgcttgtgctctcgtgtgtcccagcactacgcccatgttctgatcgttcgaagaggacaaggataccactacaacggtagcttcaaaacgcatgagacaagatgaaaaagcgtttgattaagcatgttaacgtacgtgcgtgtgtgtgctgtgtgagcatggaatttgctcggttttagtgtaagctcctcggttattgcagcttaagagaaaaggactaatcagggtgttgttaaatgctgagatgagtacctgtgaatcgtgtgagatgctgaagccaacaaacaaaacgggacggacatgcaccggtcaagaatcttgaatttggggtttcaaaaattggcatcgaacagaacaattggagatggtgtgtggtgcatgtacgaagcagcagcattgaaaaacaccactggggagaagatgtgtttgctgggtgatattctcagttgaagtagtggccgttctacagcctgacatgaaagctgtaaatgttagtaggtcccaagcattattagatgacactaaaagtacgaactaaaatttgggaggcaagcagcacagcttaaaagccaaaagtacacacttttcttatctaaaaagtactaaatgtatggaacatttccagttatttgacagatgctgtaaaacagtggtcaaatttctaaaactttgaatgctctgttggaaaaacatatatatatatatctataaatgcattatgcaaatgataggatattagtgattgacttccatacttccatattgttactttgctcgtacagggaaaaaaactcaaacgtgtgtaccagcactaaatcaattgtcaatgtgtctaaaaagtcaacataagaaaaaaggaggtatagtggaagcatacagagcaaaacaaatatgtgtgctgactagtatctgctacatcactacgtatatgtatgagatcagattggtaggtagactgtttaaccttcctaaatatcctgttcattttcaggactggattagatgccgatttctcatgccaattccagatttatttggccattaaaaaatggcatcctcccttggatgtggagagtgagagaggaggcattgtaccttagttttgattaactaaagcaaaagaggttccatgatcaagtaggcagattccataaggacgttgtaattcataactcaccaacacagagtaattgttcagtaaatatacaaggaacttgcaagcagattgcaaactcaaggaaacttctaggaaaattgcagttaactttttgctggaacaactcactagaactagattttcagcatcgtcaggtttcatgtgacacattgctttgttagctgtctgtctcttgcatgctaaatttcagtttcaaaacattggatagaacatcttatcagtagctgcaaaattttccagatgtaagaacgatgtaaaacatgcaagaacagtgcacttatatagttgatgggctctcatattccatagcagaataggctcaagttatcgaccatggccctcatgaagacaggtttatcaagattgcaatgccaaggggtgatccaacacaattacacaagttgctatcgatagtacgacgccaatatgcaaagcaaaacagatgaagctgtagtcacaatcaattcctggcataagatagccaccaattagttttacttcacctgaaaacaacagcaacaatattcactagcattcttccattacatgttctccaccagaaaaagagattgcacttattgcttactccagtattcttattagagtttttaacttttagcctccagcgaaaaaatattattttcaggaggcttgtctgtctttttaaaaacactaacaactttccagtttctactttatgacagaagtgaaattttttaagtgtgtaacttagcaaatgggagaaaatttaagtgtggaacttatcagcttaatggcctcatcttttcgcttatgcttatgcttatcagtcaaaatttgaattttcaaacttaaatttggatttgattttggggtttttttaacgaagtttatttttcagcctttgcttttagatcgctaagaacacgtatataaaagttctattcacacattatttttcgtttgcaaatatgccgtttcgcttattccccgaataagcgaaacaatggggctgtaaatgtgatcttggtaacaagaatgaatataaaaatgtggcactctgatccaataaaataatcccaaacaacatcagatatgctcaagcataacatacctggaagttataaacaacagatggaatatactgcccaagaaactgagaaaaattggctagcccagtgtagccctgaaaaggataaaacattagggtgaggatacgaatactgagaaacagtagagaaaactggcagataaaccaatagtttagcatctagatagcactgtatccgaacaacccactaaccagggatacagcaagtattgatccaagtaccaaacccaaactacggagtactcgttttgccatgtgtatgccacgaccttcaacctcaccatactcctgccacaaacattttatttcaatattatatttaacaattaagactacaaataataaatgtagcgcaccagcacagatacaaggataaatggtttaatattccaaactttggacaatatctacttgttccgaacgatgcatcatttaatatattatttttgaacctaacagcaggagggctgccgctttgtattaattagcatgcaagaaacaaagagcaaatccttttaaagactttagaaaacaaacgcatactgactacctggtaaacaaaagctctaagcaggacgcagccacccaagagcaggcatgtacacccctgttctttaattttgtgagcaggggctgatagagtcaatcgacattttttttaaaaaaaaagttgatacaggcatcatttggttaaacttgttgtatatgtagttttgtgaatttttctctggaagcttcaccacttctgtattgctatcgttatttacatatagatgagtagatgggcctctagctaatgggccagcacacaaacacacacacactattctatttacagcccaacagtatacacatccatctttagagtaaaatgtgtatcttcatgactaaaagaaattgtagcaaactcaaaagaagggtaccctcatgcaatgctttccccaatcaaggggatgccacattatctatccggaacattagctagacttcttctgtgattctgtcaagctgaactgcaaagctaaaaactagtgaccaagtaatctaagatccttaatacaagacaagcatgcacttatgtaactttgtaactaaaaaaggagccacatatatcaaatatatgcattcccaactcatgaaaagtaagaattccatcccatctaatagctccatttccctagtgtaccttttgctcttatcatatctgaactacaatagagtaaagcaaactgaaccaatttgattatttgatatgtcattcctgtaagtgcagggattccatagaaaatgaaaagggaacagcaaataaaattatttagtaaaccgcctcacattgtatataggagtgctagctgactcggtagccttcagtttgtcaagtattcgatagaaataggcaaaacacaaaaactgcatgggcttccagtctgcatggcccatggtagatatatacatgatctgcaaaaaaaaaaggataaaaaaatgtccattaataaagtaccttttctccatacacaaaatgacttgcccaagataggaagtttggcaagctgatgattaaaaaaatcctatgtgaaataatgctgaaattcaaattattttctattgtgtaatttcaagtttaacaccaatgcatataacaaagttgagtacagaggaacaatccactgggattcataaaacattgtgtttgattaaaaacagtaattattaatatttcaatgtggtacttgggatgatacagaaaataattttcttacaaatgttgctgatattgccatattaatgcgcaggtccttcccagtggatcttgagtatctgcaagatgatcatgatgatgatcatgaaatggcaatagcatagcactaaagctaacaaagaagtggataggtgttaatgtgtgatgatatttccagtggcccagagttttaatatttggaactaacatgtgaataatcaacagttatgctagagaaaagttaaaatttaaaaacaataagggcatgggcattggatcatcaagttttgctagagaactgcattaagtaacaaggatgcccaattcatggatgcaggattgcagtcaagaattaagtctgttaagtctcctaagattcatagtgtatagatgcattggaaaacaaaatgtacacagtatatattgaagaagcacatgaagagattggttacaaaatgtgaactgtaaggtacctaggcccccaaggaaccactggttgattatcagcatatttaatgtcctttgacacctaatgttcagaaagagaactgaataatcagtgaaagaaaacatcagaatagagaattatcatgagactcatttcattattagccatatgttggaaggatcctcttaaacatggcaaccgacagaggtctcatgaagttcactccagtaaggagactagaagagtcgatgcaagataagtcatctaagatctccgtcaaattcaccatgctaaagtaaccatcaagcttaatagcaggcaatgcgttgcttggttagatatctctgcatctcaaactacgtcgctcaacagtaaatatcagtatgtgtttattttagcatgaaggaatttaaccaaggagtaccaaacgaatggtaacagtctgttaccatatacagaacaaatcagttttgcaattacaaatcaattttgtgaatatgaatcctcatatctaactctaattggatacatatgccaaattgccgactgcatgggattgaacagtgctaccgtaaacggtggagcacatacaaaaaaagggcagtaacgcgcaagtgcaaactttgttgctgtagaccatgcatcatcaatgtgacaaggaaataatagtagagagtaacctggattgatccatatgccaccccattcttccggttctgaagctgctccatcatgaccatatcgtatgccctctctaactgaaattcgacaaaactccatcactcatcaatacattaacaacacaacagtaaccaaattctgaacccccatgacccaaaaccaccttgaacaggtgctcggcatctttgttgctctcggcatcctttcgcctccgcttataggccatcttcacctggtcgaacccatcaagtggactgatccccaaaatctaacaaacagggaccaaccatcacaacaagaccaggagccacatccaatcactgaatcacctgatcaccaacgaaggctgatcctaaacatgaacatagccactcccaataacccaatcattctacctcgtatggattctcactgtccccggcgccaaactgcgcgctccccgccgccgccgatgcagccgcaacaacaccacctccaccgcgcttcgccggcaccgcagataacctgtttttttttcctcatcgtgatttaccgtgaattaacaactgcttgtaaaaaaaaaaaaaagcaaacccccaccgacaactaataaagtgtgcgaaaccgacgaactctaccaacgttgggctacgatttcacgaggcacggaaccaattattccaacaacgcgggcgtaatttacctagcggggcgcgcgacgacaatgggggcaacccaatgaggcaggaagacctggcgaggggaggaggaggaaagactccggcggaggaagaggctcgcagccgccgta

SEQ ID NO: 94014 - DNA, 1932 bp, Oryza sativa
  unsure (1)..(1932): unsure at all n locations
cctgataattcttctgatttggatgagatattggctgacgaagaaacagacgaggaaatgttttttcgtggtcccacacggatgccaccgcgacctacccgagatgaggacaaacctgtgctgactccaaaaagagataggtaaatagggtaattttggtatgtttcattagtcgaaatatgaaggcttgatctatttgttcattgatttgcacaggcaatggcaagctaatgattttgggggcaacattcgggtccccactggcatcctgaccgtgcttattaagcattttttccctggcattgtcaagtttaaaggaagagatgagccagcatggagttggaaacattacaggattgcaccggacgatccagaaagcgctgtactgaatcgcttgccaagccgtctccatcgtgttgaggaagatttctgggtttgttttagagcattaccttctccaatatgaagtacactatgcattttattgtgtcttcagttttcatagtttacggccaatttgtactgtacaatagtaaagtatcttaataccacacttttcaatgtcaaacaggctaactttttgtagttgcagctttacttcaggtgggcagagggaacggaacaagctgctagaaaggttgtccgcaattgtatcaagcgccttttttcgcacctgatttatgaaactcgtatcctggctgtgctcaattaccaaaggaacatcttaaaggtagaaacttctcgggatattgcttgcaggacatatctaacagaagaagagtacctacaggtgctatggttgttcattgataatttgttgtcatctactgatcatattagtaattaataaatctgtgcttctcctataggtagaaccatggtggttcctaaaggcaaaaaatgagtggcgggagttgatacgattgaagtggtgtaatcctgaatggcaggctagctcacatgctcataggatacggagggagaaaatgacatggccatctcaccgccaaggcagtgctaacttgagtcgtttccaaaaaaatttgttatgtgcatctatgttgaaacatgtagcagatcatgcacagcagatcatggtataatatatatgggtataatatatatggtacccatgttctgttttaggagaagaagaaaaggcggatagtgtctcaaatggaggcctacacagaaggaaggggggaatttggagaggatggaccattcagatgtaacacgcatgtaactgggaagcttgtaagtgctgaatatttagtggtagtttatcatttgtgcatgagtactaatacactatttgatctgactgtagnaggcctataatgaagcttatgttcagctgcatggagcagaaagtgattggcgcaattctcccattgatccaatggctgtgcacatggctggtggtggaaagaaacatggtcgattcatgatcggtgatgggctcattgactcatcagcaatctttggtgacagttcacttgatgatccacgtcctcgcagaagactgtgaacagatcctgacaacacaaaccaaattgaagaccttgagcggcaactacaagaggagcgcgaggcaagggaacgagagcgtgaagaaagggagcgtgagaaggagagggagcggcaggagcgggagcaggagaaggagcgtgagtgtgaagagagggcacgggagaaggagcaggatagaaaggagagggagctggagcgcaaggaaagggagttggaaaagatagcgtttgaacagaaatcatcgttctttgaagttgctttaagagtaagtggttatgggatccatctagtagtgttttcattatttgagggcttgaattctgtgatggtcgcactaactagtgtacatgtgaaatggattgcacgctatacaacttaagctgaacattgacttacctt

SEQ ID NO: 94015 - DNA, 531 bp, Oryza sativa
gctcggtacccatgtgaaacttccacaagtagttgctgacgctgtcaatagatatctcaaacaagagatattataatgaaacacctttgcaaatttggttggaggccagcatatactgtgtgggtgtatcatggtgagacatatcctgcacgtcaaagcgatatatgccaaagcactgaagatgaagatagggtggcagagattgatcggatggatgagatgatagatgatgtccatgatgcttatgtctcagttgaggaggaagatccagagcctacagcgcaagctttttttcaaatgctgtctgcagcaactcaacctcttcacgaacacacacaagtatcacaacttgatgctatcacaccactactagctgtcaagtctcaatatgctatatcaaatgctggatttgatgcccctttaaatgtgatatgtgctcttcttccacaaaggcacaaactaccagcaaacttgtatgaggcaaaaaaagatcttagtgcattgaacatgccatatgaaaaagatagatgc

SEQ ID NO: 94016 - DNA, 2168 bp, Oryza sativa
tgtttgccatctctataggatcaaactgttttgcgcaaagtttgcgataaaagaggctcacctctgctaacacttcccacacatgagttggcaagtattcacggaacatgactggaaagatacgttccatcattatgtggtaatcatgggctttataacccattgatccgcatggttttcaaattcactcctctccttaggttcgacccatagccatcagggaatttcaatgtttgaaaccattctaatacttccttcttctgagctctattcaagcaaaagtcagctcttggctttacccactgactagatgcatgtttttggaccaggttcaattcaggtctgttacaaagtgctgcttgatcaaggcgagccttgacattgtccttcgtttggtctggaatgtcaaagcaagtattgaaaattgcctcaacgacattcttttcattgtgcatgacatcgatgttatgaggaagtactagtttgtgaaagtacgggagtctccacaaactagatatatgtgtccaatggtgatccttgccatagcctacaaacttatctccattagcagcaaggacaaggttatctaaccgggcacggatctcttgacctgagagacgaagaggtggttcattgctaactgtagtgtttgatagaaaagaatttgaatcacttctaaagctatgatcaattgggaggaactggcgatgacaatcaaagaatgagtactttccaccaaacttcaacctttttccttggagtgcctccatacatgttgggcatggcatctttccatgcacacaccaaccggaaaatataccatatgctggaaggtcatggatagaataaagaaatgagactcgcatgatgaaattcgtcttggtggcacgatcatatgtcaacacaccttgctgccaagcatgtataagttcatcaactaagggttccatgaatacactaatgtgtttgccaggataatttggcctaggaattatcaaggtaaggaacatgttgtgctggcgcatgcaaacaccaggtggaaggtttaaaggaatgacaaacataggccagcaagtgtacgaagaagaacccataccaaatggacagaacccatctgttgctattgctattctaacattgcgggcttccattgaaagcctgtgaagtccctatcaaatttcttccaggcctcaccatcagctgggtgtacaatcttgtcagtatggtaccgatgaccattcttgtgccatgtcatttgcttggcctgcgattcagacatgtacagccgctgaattcttgggatgaatggaagataacgaagtaccttcttggcaacagttaattgtttcttgtgaccattactgtcttcaacctccacatacctactctctccacaattatcacagtgtgtcttctgcgtattctctttcctaaagagcatgcaatttttagggcatgcatctatcttctcatatggcatgttcaatgcactaagaactttctttgcctcatacaagtttgctggtagtttgtgcccttgtgggaggagagcacatatcacatttaaaagtgcatcaaatccagcaattgatatagcatattgagacttgacagctagtagtcgtgtgatagcatcaagttgtgatacctgtgtgtgttcgtggagaggttgagttgctgcagacagcatttgaaaaaaagcttgcgctgtaggctctggatcttcctcctcaactgagacataagcatcatggacatcatctatcatctcatccatccgatcaatctctgccaccctatcttcatcttcagtgctttggcatatatcgctttgacgtgcaggatatgtctcaccatgatacacccacacagtatatgctggcctgaaaccaaatttgcaaaggtgtttcattatcatatctcttgtttgaggacgtgtgttgttgcagtagttacatggacacaacacaccagcacgtcctgtctccctgctgaatgccttgtcaagaaattatgtagtcttcgatatccactcagcggtaacctcgccacgctttcgacggcccttgtacatccaactgcgatcagtttccattgtacctagttatgacaaagtgacagaataaatttatgttaggaaatgtccttctattcatgaaaggttcaag

SEQ ID NO: 94017 - DNA, 1115 bp, Oryza sativa
ccgctgtagctcaagtcggcaacaacagtatcatcatcagtagaaacactatttagtccccctttgattcaaaggaaattcataggaattttagagaatttcattcctataggaatttttcctatatagccctttgaattaaaggaatggatcttatgtaatcctatgaaattcctatggaatgtctaatgccatgtaagttttggaggaaatctagcatgaggtagaacctcatggaaacttccctttcagtctttatctctcctctaattcctgtatttttcctgtggtccaatcaaacggtctgtcagggttatggataccacatacctaatagtagttgactaaatctcggcaggacccaccacataccatgtcctatacggaaacaacctacggatataggaggtgttccggataaggaaagacaaccagagttctacatggaaacgacaaggactactcggattgtatccatattggttttcctagttctacttggacaaggggacacctatgggtataaatataagaccccctagaaggagacgaccacctcaatagacacctaccacaatcaacatacacggaacaatagaagccacaagccaatacaagccaacatacgccaagacaagacgccggaatatcgacttcagtaataagcacggctagtcccctacagtgtctccggatattgtcaggagagacgaaagcgttatctctgatctcgtcgggcacgaactcgaggaggaagactaccttgttgtcgactacaagtcagaccttcagaccgccatgtcgacaacagttagataggctaccccaaatattgtactggtgtgattatggtgaataagagcaataccggctttggccaacaggatgtagggttattacctgaaaattcaggggcccgaacctgtataaaaatcctcgtctccatctcttttacctcagtctcacgtataccctaataccaatgatccccataccatgcaaataccggaatcgcgacatcaaacgtcgacacggtcattcctatgtttttcttgtgttttacaatcctcagttttacacttacatttctatcaaaatcctacatttttcctatt

SEQ ID NO: 94018 - DNA, 727 bp, Oryza sativa
tctcctacctccagctccatccccaaccgccgccatggccaccaaatcctcccacgtcgctgcctctcccgcgcgactccctctcccgcgcgtgcgtggacgcggtcgtcgcccacgtccgcgccgtttccccccactctccccgcaaaatccggccacgtcgccgcctcccgcatctctctctcctcccacgtcgccagccggtttctacctctctcgggctcgatcccgcctcccctcccctataaaaacattccccgcacctccctctccattttcccctctctcccgagccctcccgtgcatgaaaaccaccccgccaccgtcgcacctcccgccgccgctcgccgacgaccctccagccggtcgccacagccgctcccaccaccgtcgttccgcgcgaccgccaccagcggcttcgccgcgtcgtgccacaccccggcgtccgctccatttcccctccccacctccgaagtaccgtcgccacgtgcaccacctccttccaccgaagccgccgactccgccggtcctagccaccccaagtcgcgctgtcgccgccgctcgcttcacagtgccgaggagcaccttggccgccgcttttcacggccgggatcccgccggaacacggttcccctcgcgccggtacttccggccgccgtctgccggttctcgctcacggaacgccgccggggccgcctttccgccttcatcccgaggagcgccgacg

SEQ ID NO: 94019 - DNA, 541 bp, Oryza sativa
tgacggagcgtggggctcctcactgggagaccgcgcaggcccccctttgccggttcggccgggggcgctaagtgaggttcttcgccctcgatctgaggaacgtcagcgagagaggaagtgcacaagacacgggcgacgtagacaggttcgggccgctgagaagcgtaacaccctactcctatgttctggtggatctgtgtgtgaaggaatccagcgagccggagagcgagagagagttcaggctctagaacccctttttcttctcttctcttctccccttctaggcctgggcctcctttttatctggtcaggggtcaccacatgggcctctagctgcctaagaaaggaaacatgctttttacaatgagggctagtctacagccggaagtgacctctgacaagcagagcacacgcctcctgcccccctcgccagctttcccggtggacgcccatttcaaccttcattcaatggccagcgacttccttgccatgcttgcgctgaagcctggactggatctgaccgggactgacataccaactc

SEQ ID NO: 94020 - DNA, 2468 bp, Oryza sativa
agacaagttgcgaaggagaagacgtttggcttataccccagttgagctgcctgtgggagtggagccggagcttcgctagattttattttccgctgcagttttcttcttggtgaggactaagtgcctcttaagtaagtacttatcgttttagttaatttgatgaatctgtatattaaattgtcagtttgtgtacctcggctgattcctggacgaggattttatgcacaaataagtttggaaattacttgtgaatttccgagcgtgacaaccgagcagtccggaatacatcccacagcagaaatagataaagcagcggcatgccattgccacaggcaacgaccgtaactaagacctattgagcgccatcgtctgcatcaccctcctggtaataggcatagggatcctccgaagcttcatctccggcctctgattaagtttatatttgcaagggtgagtaccaaccgtactcagcaagccaccacatcaacaatgcacatgataggggtatttcaaaggatggctatggttcttttgcgcaaagcaagttttctaattcttttcacaagcctaagacctagcattgactgatcaaattttagtactagtgtttatatttaaacaacgatggttctgtccatcatccattgtgatcccaaggatagcttcccgccattgagtcgtcatagttttctgagaacgtccaccttcccccttctcaggaagtggctccaacagcataaaattcatcatgcaataacccttcccacacaagttaagaatttagagtctagccaagtataatacatgtcccggtgctcaataaccgcgagcacggctaatcgaatagatttgttttactcacactgcagtggatgtacactttacccacactccgcgactgcccaacacatgagcctcgtcccaacacatgagacgtatcacggcaaagcttttcgataacctcgcattggcagtacccgctccatgaacttttcatcctcatgcactctaggtgtacacagtttctagcagtgagaggagttctggcgcaccgggaagggaagactcacacacatgcattaagttataattatgtttaaattatcacatggcagtcctaccaatggtgacaccactgtagagcccctgccttacacatcaagaaaccactatgcatggatactgcctccgctcagctatttactctgctaggtctatccccatacgagaagtgtggttgtacggggtcgtttcatgcttaactttatggctcggtcctcaattgaccggggacggtactagcctttcccagataccacccaatcttaccgtcggccccagtctaaaacaagtgtttaatttcatttctattttcacaattcatgtcatcatatcatggcaatgtggcgctcatgtttccacatgccgcatctcaattaccttcccaaaggtaattgcccaagcatatagtatttgataaaatatgagcatgcatgaatctaaaatagcatttctaagcaattgtcatagttgactaggggctcgtacgtatctatggttacaaagatttaaaggtgaacaataatcaaggcatggcatatttcacaagtgggatgttcatcattgcatgcaatcttatttgtaaacaaaataaattttgcaatcgggatcgacatgctcaaagaatagtgatgacttgccttgctcaaagtcttgcgggtcttgaccttcgctcggatccgcaactccctcgggctctacaagtacgtgcgaagaattgatttgaattccattagaattcaaataaaatccaataaagaccaaattgaaaaacgagcgcgagaggcgaattctatatcaactatattattcgtgaaataggactattcctcaacctatgatattttgtgtctcctaagtaaattcctaagaattcaacgtatttatttagcgcttaaataaatctaatttcttacctaaaattaattactcatagagattaccaaaatataatttaattttgcaattttacgactataattaatctatacttaaataattaattattttaaattttctatttttattaacctccctatcctatttctctttttttttctttctttttctctcctctctttctttttctttctttttctctcctctctttttccttccccttttcttttctttcttcctcctctccctaccggcttctccctttctctctctctcggctttttgcccacccgggcggcggcggcattggacgcgaggggggggggggaaagacggctcaccggcggcggcggcgcaaggcggcaacgctcggcaccacacctggcgcggcgcggtggcttcgaggcgacggcgcggcgcatgaaggcggcggcgcggcggcaccactgcggcggcgcatggagaaggaggagagagggggaaaatggagaggatgggtgtggggtgga

SEQ ID NO: 94021 - DNA, 6341 bp, Oryza sativa
attcaattgttaccaatatggtcgcgataatattttatttatttccaaactcacctaatctttattttaattagttattttgccaatttaattttagtgtttattcctaaataattattccttattcgcgatcggtaaactttgaaaccaaattccaataaaataggcaaataaaatcggcatgatgcaatttattaaaaagtttttgaaggcccatatttctagtgttacaatcgggtggtgtgaacttattcctttgttatggtctgtttgcattgattactctattccttgataccttgggttattataatttgactagttgagctttatatatttgttcagctagatgttagacataattacttagccatgcttagaaacattagcacacaattgggataactaatgtttcactattacttaatgatggatatttaatgatagctcacgatgatcaatcgtgattggttaattaattaatgtgccaactaaaacttgataatggtgtgttgtgagcacatggttttgatggtcgtgctcatgacaattaaggaccggttcacgagtttcggttgtgaaacattaaccgtgccaaccacaagccagaatgggcaacagctggacactttgtataacaaggctcattgcggagcaccagactgagaagtggcggagataagcccacgggggtcgctggggagtccatgcctctggtttttgagggggtgactacaatccaggaacggtgcactgctttgggttaagttatgcgaggggtcttgtcacaactacacaaatggtgacatgttcagcatgggcacatgatgatatggtgacatattgtggagatgtgtcttgtgggtacagtagtacacctctggccagagtaaaactattcgaatagccgtgcccgcggttatgggcgggtcgaacaatgtctttcgtgattagtcccacactactcattaataataatgtggtaattgatggtaattaatttagctcctagtttggaatggtacattcctggtttggagatagatctgtgcagccgggtatggttgttcaggatggttgggcctgtgcagcatgggtgtgctgttcagtgttgattaatattgatgattaattactctattgttttacaattctcaaatgtttgctaaatgctgcttttgcaaatgagccctgtattatgccattctttggtatccttgtgcacttgcatatttgctgtgtggcttgctgagtatgtcatatgctcaccttgcaataatcaatcaaacctcagttgaagacaagttgcgaaggagaagacgtttggcttatacccagttgagctacctatgggagtggagctggagcttcgctagattttattttccgctgcagttttcttcatggtgaggactaagtgcctcttaagtaagtatttatcgttttagttaatttgatgaatctgtatattaaattgtcagtttgtgtaccttagctgatttctggacgaggattttatgcacaaatgtcacatcctgatttttgtttcaggatttataaattatttaataaattattattagaatttatattaaatgttcattaatttacaagtgaagttaaatgtgggaaataaaatttcctaaatataaagcatggatggatttaattttgattaaattctccatgattaattacactctctgaaattttctcagatgtttcggagctcaattcttaacttttaatcatacaaagagcatttcagtaattacccacatattaaattaatcattaaatggtctgtttttaatattgttaaatactttgggtctccaagtatgttcaagatttttcttggaattatttgagcataggaattatttttaacaattcaaagatcatttcattgattaatttaattggaaaagtaataataatcctcttcctagtcttgggccctttccagcccatctccctcttttgtctgcacggccgtgcagcccaagtcggcccagccgagcttcccccttctctttctttctttgctttgttttcagccagcccaagacgaaaagtctaatttgcctccctccacactgtttatcttctacctctagcagccgaactgagaccgatttggctcggtttttctcctccaaatctgacctttccccttgtgtttttctaaaattagttgaggggaaatattcctcttatcctcctctatctttatccccaaaaatcggagctaatcgttgagtatcttatccgaatcgaactcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgccgccgccacgtgctccaccccgccgtagtcgccggccgagctccatccgcgtcgcgccgccgcctccgccgtcgccgccggtctccgtcaccaccgttaggtgcgcgggagggtggagaagcccggccgctatctccccgaagccgccgaccaccgcagccccgtcgccgccgtcgaccgaagccgcgccgccgctagacctcgtcgccggccgtcgtcgttcgtcgtttggttcgagggtgggtaccgttgggttcgtctcgtcgtcctctacgtgttcttgtcctccaaagtcgcagccgaccatccaatctccggcgaggtcgccatcttggttcggccattgatgaggtgacgtcatcatcgtttttttctttttcctgtttttctaatagattaaatcttcggaaattcataactaaatcatcgtaactcggttttgagtggttcaagttgctaaattcatctaaaatcaggatctacatgtttgtttactttatatgtactgtttatttggtttttattagtcttattcttcgttttgcgtgttagtttgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggccaatttgcattgattactttattccttgataccttgggttattataacttgactagttgagctttatatattggttcagctagatattagatatgattgcttagccatgcttagaaacattagcacactattgggataacttatgactcattgtttaatgatggtttaatcgtagctcacgatggttaatcgtgttatgataattaattgataactaaaacttgacaatggtgggttgtgagcacatggttttgaaggtcgtgctcatgacaattaaggaccggttcacgagctactgttatgaaacattaaccgtaccaaccacaagccagcatgggcaacggctttaccttctgtatagcatgattcattgcggggcaccagactgagaagcggcgagaagtccgtgggggtcgctggggagtccatgcctctagttatatttatagagggggtgattatgatccaggaatggtgcactgtggtgagttgtgttgtgcaaagggtattgtcacagcctctattcgggtactttccagtatcgcgacgcatggtagacatgatgaggaggctgtgtcttgtgggtacagtggtacacctctggctagagtaaaactattcgaatagccgtgcccgcggttatgggcgggttgagcaatgtttttcgtgattagtctcacacctctcacaataattatggatgttatatctggtaataatttgcttagctcctggtttggagttagatctgtacagccgggtatggttgttcaggatggttgggcctgtgcagcatgggtgtgctgttcagtgttgattaaaatttctgattaattactccactgttttactcctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggagtggagccggagcttcgctagaccgtaattccgttgcagttttcttttcttttgaaagtatgtaacactattattgatgattctgtatattaaattgtcagtttgtgtacctcggctgattcctggacgaggattttatgcacaaataagttcggaaattactagtgaatttctgagcgtgacaacaaactagttcggaaattactagtaaatttctgggcgtgacactaactttgccctttcaaattatctctaatcttttgcagtggaggaggctcttcaaacctaacgatgagatcaagctagaagctatgacagaagaaataaaggtgatgacaggcctacggcatccgagattaggtgtgggttagttggttagcgttagctgttggtgtgttggctttagaggttgttgtcaagtgtttgttcagcttttggtctgctcctaagctccttgctgtggttaagcttactagtcttgttttgctcttgtatggttcgctggcatccccagctgttaaaagacaccgccgatgtggctttcaagtaaaagccaggtctctgaccttttctctaaaaattagcgagacgtagagccgccatgccgaagaagttgcgcacgatggttgtgccggtgtcggagccgatggaatccgcgctgatgagctccaacatcatggagccgaagccgatttccgttgggagttcgtcgtgacagaggcaagcatggataacagcatggagctgaagcccattcccactgcgtgctagccgttggtgaagagagaggggagagaaggcagaggaaggtgatatggcacttacatgtgggccggccccatatgttctttttaacttttttttccgatgactaagatgccacgtcatccaaaacaaatatccatactgccaagggacctcacttgaacggttttgtaaagttttattttttttttggggggaggtgaagatttatggtattgcagttttgggatgttaattaaactcgacataaagatgagggacggcaagtggacttattcattttcaaaaatagacaagcttctgggcttcgccgcaatataaattattttctgggctctcaagtttgaacattgagcgtccgatccaccccttcattatcattgcatttagggatggcaggcacgacgggcacgggtagtgactacccatgctcgtgcccgcgggcatgcccgttactacatgacgtggaaggaacattgtctatgcccatcgcccgcgggcgccatgtgctcgcgggcatatccgtttacccatcacaggcttacagttcaatccttcaaccacaaatctctacagcagagagatattatcacagtttaaagatagggtacagttgtaccaagttctacaatacaagcattacaagtttatcaatcctagacggtggcatttatactaatttgactgagagcccacatgtcagttggtttttgcgggtaaacgggcgaagcgggcatgggtcactacccatgctcgtgcccgtatgtcacaccctgaagttctcctcccaggcctaaaatttaatttataaacgaccccccaagaaaatgcaggtgcaaatcaagagaaaaccctaagaaagtaatgcaaataataatcggatttgacatgtggaatttttcttgagttctacatgtcgaaattcattaacaggatttttagtggaattttcagagctctagaaataattttaaccaattaaaattgagcaagcaatattttaattccagggaaaatcctttttccttcttctttttctttttcctccctttttttttcctccttttttcgaatgggccgccggcccattctctccttcctccccctcctccctgctgggccggccgcaggccgaggcccagccaggccgggcggcttccttcttttcccggggtcggcgacaggtgggggccacctatcgggccctttcccaaacttcgggcactcgcccacgttggccattccgccgcgaaaacggcggaacccggcttcttcggttcacgttgggcacgcccgtgcgtgggccgtgcct

SEQ ID NO: 94022 - DNA, 2235 bp, Oryza sativa
acattagcaacaaggcaaaagcatgtggacatcttagatgttgaggatcctatttctcagaaaactgaagtatcagcacagggcagtcttttgaaaccatcttcgtcacgagttaaggagtctttacctaataactccaactgcgctgctaaatttacctccgccgcaaaagacagcaatactgttgatgctacatctgacaaatcagctaaattgatgcccaaggtaatgtttggatggcacctttttcctcctagggtacataatattttatcaacatactgacattttctttattgtaggattggttggagatggataactgtaggggaagtacaaagttgtcactcaaccaaggaaatgataaaactgagagaaagcaatcaccaatcccagagaataatgatatgagttctggaataataaacaaggagaaacctccaacattgcctttgagaagtcatgctccttcaaatctagtattatccagtgaaattgaccgaaacaaaatcctagcatcatcaaatggcttttcattcccggttccggctgctctgactggccattctcaggcccctccaacacctactttggcatctccacctgtactatctgttgagaagcagcagctgtctgcatcatctagtgcaccagttacttcagtggaaagtattccaaggttagtttctgatcggttgtttgaactgatgtagttacagtcaaaagcatagttttaaatttgaagtacctttgcaatgaaaatgggcaatggttaccaagtaggttaacacataagtacttatgttatcattttatagtgttttttgacttgattgtcgttttatagttgagatatggtagtctgacacatgccaattatgcttcagtttccaatttatgaggatactcacttatttccagcacattaatctgacatgtctttttctccagggttttcaaaccagtttcagaagaagcctcagtttctaaccaacgtgatacaaagtcgaatacagataaaccaccaatttctcaaagctctgggcaaattgtttctttcactagtaatccagtatttaacgtcatctcctcaaaaccaacaaccttaagcaatggcctggcagatacaacaaaatctgcttctgctgctgtatttccttccaatggatcaaccaagtcagtttgttctacaaatgctggctcttcaacaccttcgttcccaaagttctcatttcagcctggattccgaacatcaacctcttcagtgcaatctagcggtattcaagagcctgctataacagctccattcagcactgtgagtagtttagctgggggcagttcatcgccatcctcaatgatatttgctggtgctacttctcaatctagttccatcaccaccagtggcagtgttcccttccaattctcttctcaatctagcagtgaaagttcattagctggccaagacaaatccaaggcagcaagcagcagtgccccttttagtttctctccacagtttggcagtacaagtccgtttgcaggccagggcaaatccaattcagtctcctctcagtctactttgctgtctggaagccaatttagcaattcactatctgcacagacttcaacaagcaattcaaacctattatcttcagaaaaagtaaatcctgggagctcgccaagctttgcatttggttcatcagcaccaggctcaagccctgtgttttcgttagcagttggttctggcactacttctgcaacacctgcttcagcatcttcaccaattttttgcaaccgtttaactagcacaaatgctccaccttttggctcccctgccacttcaccttttagctcaacctcgagccctgtattctcatttacctcagctacgcctacgataccaaatgcatcacctacaacaccactttttggtacaccgagcccgactgttggtttaagtacaggaactgatcagatgaatggaggtcagatggctggggacaagaacccgtttgctttttcagcagcttcaccctttggtcttccaagcagttcaccatccactccaactctgtttagtacgccagcaactcagtttgcttcagctacatccgcttcaccgggcatgttccaatttggccagcatagtcaatcatccccaggtggcttctcaataggcactactggtggcaacagtgaaaagtctgcaagaagaattctaaaagttaagcgaaagaa

SEQ ID NO: 94023 - DNA, 814 bp, Oryza sativa
gccaagtctggtttccaggcgtgctcctttctcgctttgttggaggtccgctcttgtgtgccacgcgtagtttggaaatcaaacttccagggaccagaagcccaaccgcccggtgtccgtccccgtggttccttgttgcccaacgctttcgtgaggaggtcgtcctcacgtctttgagagcaggcctcttgcgaggcttgttgctcggcaaccaactccatctgcattacaatttagtggggttaaataaactgcacgatgggaaacaatgcgaacatctagtttgactagacacttactatagcttcgtacactcgttgatcttctgcatttggcatgaagattgtgccatcatcattcttctggtacctggccctggcccagttcctagcccgagggtgtgggatatcgccaaacacgagcggtgtgcatgattcctccgcttcttcatcctcacgttgccattcctcttccttactggcatatccggcggtgcccagccggtgcggatgctggttcctggtctggagcaagagatatgcctcgcttctagctctggactcgggggtcgacttcttcgcatgtaattcctcccagacctgttccgtgatccaaggaaatttctctcttggatctagattcgccgggttgtagacgaactcgccgactagcttagtcttgaagttcttccaagcattgcccataaccttgaaagcagcccgcctgagacggtcctcatgctccacaggataatcaaagctctccttgaacattagccaagcaatgtccttctctgcggccggcatgagcttga

SEQ ID NO: 94024 - DNA, 1666 bp, Oryza sativa
actaccaatacgggactaaagatcgctatctttagtcccaggtgaaataaccgggactaaagatcgatctttagatcgagctgaccttttttttttgcatggccctgttgctgcatggtttatatatatataaaccatgcatatatatgtttcaatacatatatacatgattaatatatatgtatttatatatatatatgttatgcaaatgcatatgtgtgtatatatacatacacaacacacacacacacacacacacatatatatatatatatatatatatatatatatatatatatatatatatatatatatatatatatatatatatatatatatatatataaacaaaattttttttatctttaaagaaaatgtgctcacatgcattttgaaaaattaacttgatctatatacatatcattatgttgttctatatagatactattacgacgatatatttatatctatctaagaagctaaagacctatgtattgtttttccgccgtagtagaattcacccttggcatcaaggatttgttcgttgatgaatcccatgagttgttcttgaaccaccgtgataaattccttgtgtgtgatcaggttatccctcatacgaataaactatatgaatgtgtgaaattaattagtaattaaacaacaaatcgatacgtaatgaaattttgaatttatttgcacgtacatcgagctctcttgtggtgatgatttggtctgcaaggcagtggcaatactcgcacacgtagtagccgcacaagttagttccctacttttgctttgcgcactataaataaatgacaaatggcgagagatctaattaatatacacttgtatgtatttgaattggagattcaatataaatgtagagcatgtgtactcacaggaaaattgaacttccgcataagtctttctctcatttttccgcggaccaaatgatggaaccgataccaagccctacatggagtttaaagctatgattcgtagtagcaattaattataacaagattcttaattaacataggaatttatgacagtacctgtttataagttcgaaaaccttgtcaaacgtagactcttttttatccattgagtcatatacgttgacggtgcaggcctccaggtcgaagagtaaaagcacccagtggaatctgcaatgtgcgtgggatgcattatatatgaaacacttagcatgtttgtacgggaatgaaatttggtataggaagacagtaaaattaaactaactctgtgttgtacggcaacagtatgaacgtcttgtaatgctgcgccttcaggagatggacgagattgtcctctgtgtcttgcagataccggtcgagcactgtgacgtttactttccgagggtcgatgaatccagtatcgaaaaccccccaccgtcgggccctttgaatctccattctacaacgataaaaggaagtatatattatatatagtctacttatatacaaggacctaattatttaaaggaaacgtaataagaaatctaactgaacgatacttacaaaatgcagcaactcataatagaaacgtcgagggcgtccagctggtatagttcgtagatacccttgaaattgatccagagaatgtcatctccttgcaagaagtccgtgtccctgatcctcgctctgat

SEQ ID NO: 94025 - DNA, 775 bp, Oryza sativa
  unsure (1)..(775): unsure at all n locations
tgtaaataaatatatatatatataaaatatagatatatagatatatatatatatatatatatatatatatatatatatatatatatatatatatatatatatatatatatatatatatatatatatatatatatatatatatatatatatatatatatatatatatatatatatatatatatatatatatatatatatatatatataaccaaaatatatatttacattaaagaaaatgtgtacacatgcatatagaaaaatagacatgtactaattacaatccattatgatgtcctagctagctactatttcgacgtagtagtagtcgctatctcagaagctaaggacctatgaattgtatttccgtcgtagtagaattcacccttggcatcaaggatttgttcgttgatgaatcccatgagttgttcttgaaccaccgtgataaattccttgtgtgtgatcaggttatccctcatacgaataaactatatgaatgtgtgaaattaattagtaattaaacaacaaatcgatacgtaatgaaattttgaatttatttgcacgtacatcgagctctcttgtggtgatgatttggtctgcaaggcagtggcaatactcgcacacgtagtagccgcacaagttagttccctacttttgctttgcgcactataaataaatgacaaatggcgagagatctaattaatatacacttgtatgtattggaattggggtaccaagcgcgntgtcgcactgtgatcaagcaggtcacaagcgcggg

SEQ ID NO: 94026 - DNA, 1062 bp, Oryza sativa
ctggaccacgatcagtggagatagcactgctgccatcgagaggtatcctagttagagaagaatgagtgcaccaggttagctcacgtagaggaggggaatggcaagggacaggctgcgggttaagaaatcaacaggggcggtatctttagcgatcacagctaggttgcactgttgaatgaagaataaatgtcaaagcaagagaaagaaggaataccttataaggtcctcatgcagccagtgttacaacagttcactgctctaaattggataaagtgttcctctgattactgatctgggcattccgcatagtgcaataaataatgtttcttgttcaaatgctcgtaccacatacaactcttgttccaataaataagttgaacatggagcactactcatgataaattttcaacagagaatgtgaattaagcagatgaattgacaataaacgaatctgagaaggtccttcgattccgcaattgccattttgactggagaacagaatcagctagcttgtacttgccctccatattcagaccatggacaacagttctgaagttcactgcactggggatgataccactattcagcatgtcatgaataagctgcaacccatcctctgatctacctgccttacaaaggcatgacatgaacattgagtaggtctcaaagtctggcacaggtcccttcagtttcatgcgttggaagacatcccaagcctctgaaaccatacccattgccatgtgaccacggatcaatgcagagtaagtgacaacagtaggctcacatccattttctgtcatctccttaagtacatccatcgctttggaaacatcccttttccccaagtaatagatcatgaatgaggtatacatatgtgtgctttgagctatacctaaattcttcatttctgcaagcttagctgaagcatcttcaaagcgatccctcctcaacaacgcgtgaatgagactcccatacatgtatgcacttcttgaacatccataattcttaatattatcgaacaaactgagagcttcggccattctatcagacctgcacaatgat

SEQ ID NO: 94027 - DNA, 995 bp, Oryza sativa
ccatcaagtgagtaatattaatcattaattgagcaatttcatcacgtcttacttttgcaatactgatcttataatatgtgcctctaatttgttttttttattttgtagcaattgattgaagttggatgtatgcgaaaaatttgaaacgtcattctacggagtacagaaagggcgtaataaattttatgaacgccgcgaaggaggatcggatcagaagaaacagtgattacatgtgttgttcatgtgcagattgcaagaatgagaatatgtttgatagcggagaggacgtacatggtcatctgatacaacgaggattcatggagagctatacatgttgggtgaagcatggagagcaagaatcaggaagtggagtagcagcagacagaagtggtgcgcataatcaggaagatgaagatgagcatgacatgtttataccttctccattgggcggtgaaatggttgatgtggatcacgatctgctgcaagacatgttacgtgacgttgaggacccagcccagaatgagagagatggaatgaagttcagcaggttggtaagtgattccgagacgtctctgtatgctggatgcaaagcaaaacacactaagttgtcagttaccttggacctaatgaagctgaaggcaagtagcggatggacagacaagagtttcacagaacttttaggaattttgaaggctatgcttcctattgagaacacattgcccgagacgacatacgaagcaaagcaggttctgtgtccactagggttagaggtccgtagaattcacgcttgtcccaacaactgcatattgtaccacaaggaatatacggacttggatgcttgtcctgtctgcaaggcttctcgatacaagcgaaagaaaagtgctgacgaaagaaataagtcaaagaggggtggtccagcaaaggttgtgtggtatctacctatcattgatcgtttcaagagaatctttgccaacccgaacgaagcgaagttagta

SEQ ID NO: 94028 - DNA, 1665 bp, Oryza sativa
acgttgacggtgcaggcctccaggtcgaagagtaaaagcacccagtggaatctccaatgtgcgtgggatgcattatatatgaaacacttagcatgtttgtacgggaatgaaatttggtataggaagacagtaaaattaaactaactctgtgttgtacggcaacagtatgaacgtcttgtaatgctgcgccttcaggagatggacgagattgtcctctgtgtcttgcagataccggtcgagcactgtgacgtttactttccgagggtcgatgaatccagtatcgaaaaccccccaccgtcgggccctttgaatctccattctacaacgataaaaggaagtatatattatatatagtctacttatatacaaggacctaattatttaaaggaaacgtaataagaaatctaactgaacgatacttacaaaatgcagcaactcataatagaaacgtcgagggcgtccagctggtatagttcgtagatacccttgaaattgatccagagaatgtcatctccttgcaagaagtccgtgtccctgatcctcgctctgatcatctctctaccggtggcgctcatctccatgtacagttgatggaacttgtacatttgagtgggtaggaactgcagctgctcaggcttgataagcggtttatcgagttcgtacatgtatttcactttcgccttttcgattggtgcacctcatatcaattgatccgtagttagcccggtgtcatcaataaattcttgtattccaaaatcttcaccggtcaccaacggctcgatctcctggcttgcttgctctccaagctgagggactggtttggactttccagaagatgctttctcgagtgttcgctcatagtccgatagctttatggccttcttggcaggtgcagacatacccctgaagaagttcttaacactcgagtctataggaatcttcttttctggacttcgaggcttcaattgtctcctgacttctgatgccacataagcgtcaagctcctcttgcgtgcaatcgtaccctagatccttgttcttggcggtgtgaactttcgccttcttcgttgcccttgtgggggcaggcggtggagcttggggggcccttgacttggaaggtgctgaacgaggagcctgcggaggagtcggtgtaggagcctgaggaggagtcggtgcaggagcctgaggaggagttggtgcaggagcctgaggtggagacggtgctggagcatgaggagacggtgcaggagcctgaggaggagatggcggagccggaggagatggtgcacgagacgccgcttgtcgccctgggaggatgatgtatcgcttgcgccatagtataatggcgtggcttgtgtctcgtagatgcgtctcaccgtctcctccagggtaatccaactcgaggtcctcgtacgcgccttcgaccaactcaacttcgaccttggagtatcctgctggaatcgtcctacagtggtaagtacctaaagggtccgttgggatggccatgcccgacgccaccctcacgtggtgagaggttatttattagtaatcaacgtttataagcagcaacttggcgaatgtaccaaatctaaaattattaactacgagcctacccttattgataagtttttgagggaatattcagctcaaatggtgcccgtgagtg

SEQ ID NO: 94029 - DNA, 1085 bp, Oryza sativa
cgtgatatattgttgttagacaacgatgaacctactacctacgaggaagcaatggtgggaccagactctgagaaatggcctggagccatgaaatccgaaatagaatccatgcatgtcaatcaagtttggaacttggttgatccacctgatggtgtaaaagccattgagtgcaaatgggtctttaagaaaaagacatatgtagatggaaatgttcacatctacaaggcacgattggtggcgaaaggtttcagacaaattcaaggtgttgattatgatgaaactttttcgccagtcgccatgctaaaatctattcagattgttttagcgattgctgcctatttcgactatgagatatggcaaatggatgtcaaaacagctttcctcaacggaaatctcgatgaggatgtgtacatgacataacccaagggatttgttgatccacaatcagctaaaaagatatgcaaattgcagaaatccatttatgggttgaagcaagcatctcggagttggaatattcgttttgacgaagtagtcaaggcgttgggctttgtcaaaaatgaagaagagccttgtgtatacaagaagattagtgggagcgcactggtgtttctaatcctatatgtagatgacatattattgattgggaacgatattcctatgcttgaatccgttaagacatcgttgaaaaatagtttttcaatgaaggacttaggagaagcagcatatattatgggcataaggatctatagagatagatcaaagaggctaattggattaagccagagtacatacattgacaaggtgttgaagaggttcaacatgcaagattctaagaaaggcttcttaccgatgtcacatggcattaatcatggcaagaatcagtgtcctcaaacgactgatgagcgaaacaggatgagtgtgattccatatgcctgggcaatcggatccaatatgtatgctatgctatgtacacgtatagatggttcatatgcacttagtgcaacaagcccattaccaatcagaatccaggtgagagtcacctggatagctgtaaaagaattatcctaagtacttgagaaagacta

SEQ ID NO: 94030 - DNA, 660 bp, Oryza sativa
tacgtacttcctgtttcatccatacagtgagtgcaagccttgtcccccttgttggactgtccggatgggttgctaagtgcaggccaatcgttgatggttacgaacagtagcactcgtaggttaaactcctcctgtttgtcctcgtcctacacggggacaccttccttcttccacaacagtttaagatcttcgaccagcggtcttaggtacacatcgatgtcgttactaggttgcttggggccttgaataataatcggcatcattatgtacttcctcttcatgcatagccaagggaggaggttgtagatacacatcgtaatgggccaagtgctatggccgctgctcatctctctaaaaggattcatgccattcgtactcaaaccaaaccgtatgtttcgtgcgtcctttccaaagtctttaaattttctgtcgatgtttcgccactgcgaaccatcggcgaggtgtctcagcatcccgtcctgttgacgctcttcagtgtgccatcgcatcattctagcattccccttgttcctgaacaaatgccttagacgttgtattatagggaaataccacatcaccttagcaggaattccttttttgttagctgcccatcaacttctcctggattgtctcgtctaatcatgtatcatagcgctttgg

SEQ ID NO: 94031 - DNA, 1585 bp, Oryza sativa
atgtcactgtcaaggcggatgttgccgcgaccgttgacctcgccattacgcgccacggccgcctcgacgtcctctacagcaacgccggatcataggagcacaggctccggactcgctcggcgtgctcgacatcgacgagtacgaccgcgtcatggctgtcaatgccaggtccatgttcgtatgcgtcaagcacgcggtgcgtgtcatggcggcatggtggcgtggatgcagcctctgcacggttagcacggcggcatggcggccatgacgccggccggcaactccgacactccgcctcctcgacctgttggctctgccgtccgcgacgtcggcaagctgcttttcaaccactcggcgtccgtctccatcctcgccggccgtggccgcagccgctccccgcgctcgcgaagttctcgccggcggccgcctcgtcttcttgccctcgccgtgcctacgtgagattagaggatgacgacgtgagagagaacgacagaaatagtgacggagtggcatggtttcaattttaaaaatttgtagtggcacctagccaataaaacaaatagtagtggtatttttctaatttgccacatttacagtggcatggatccaattaaccctaaaaactataacaaaaatataccaaaaagctcatagctcgtgactaactcgactcggctcgtttgtatttattaacgggctaagccagggttagctcgtttgctataacgagcgagctcaagctggctcgcgagctaaatgagccatggaaaaacaaagcagcccaggagtgctgaggtggatcgcattgttatttgtaggcctaaggcccatcagatccactgatttccactaaaccctagttatatcaaatagatcgattgatttccccattccccaatctacagcgcacgctgtttctgtccagtatcacatcgccatagtgtcgcccaagccctcacgccggcatcgtcgacgacctggccgtcaccaccagcctctagggggcagcaacagcgtggtttgtgagctcacggtgccgcgcttcctctcgtcgccgctccagccggtcggccaactccgtggcaagcgtggccttgtctcagtctcgtcgtcgtgaggaagacgaacaagcagggtgaaggtcccctgctgcaggatgcaagagcatgcaactccatcgacagcgctacaagttataaatcaaggagcaaaagttcaatcttgccgtcctcgtcgccgtcggcagttcggcacttcggcaagtcaatctcccatgttaattttggttggtctaggattcactagggtgtttgcttggtgttttgtttggttccaatatgacgagactttcagatctgtttttatggatgcaatgtgtaaaaaaaaatttgtgccaagtctttgtgatttgtcggttgtttgatttcttaagcaattgcaaaaaaaattgttggcagccagaatctcgaagtgagagatttctattgagtcacggatgtattggctcgcgagctaaacaagctagctagagttgccagtcgagccgagttaggattaggctcgttatcctaacgagtagaccgag

SEQ ID NO: 94032 - DNA, 2530 bp, Oryza sativa
tcaaagctggtaggcagacttggttattatgccctacattgtcataattccagattaattgatcgatcatatataagtactaaaatatatttagtctatcacaattgagaccaccgacctcaaactcagccaaagtcttcaccttttctctatacagaaggcgcatgttgtggcacacatggaatctgcactggtcacctatttgttgcttcaccgggaagtcttttttgtggatgagggtgtcatgtcctgtcttcctgaggtctcctctttgcacatattgggcccacgcttcatctattgctagttgaattggggtccaattatatgcgttcttatcaattctggagttcaggtagtgacatgtactccacttaggtgttatgaccagaaggatccaatgggcactgcggcattaatatagtgaaagttaattaagtactcaaggaatgtgtgtcattttgttgtgtatatttagttaacacacttactattgattataggcgcacataatgtactccttgtctcggcaggaccacaaggtgtcgtagatgtagttgaccattccttgacggtcattctggagatttgtgacagtgaccacttgtggatcaaggaaggcaacttccggtgcatgcttctgacaccattgccaacttaacctacacacaggataaacgatcttgtaagcaagttaaaccgattgttattaccagaatgagttgggcgacaatacttacaaggagtagcacttaaggaggcttgtgtccaccgttcggagcctgtagaggtcgaaaagatccttgaagtcgaccacgacataatttgttggaccaaggaatggctttccatcgtgctctccaaggatatcggtagctttactcggcttcctggcgttagatttctccatgtagtataagtgaaggtccttccaagcggtgcccattgtggcaagcacgtcatctccaaccaatggcatgcctagtttgaactcctgtggagcaacgtatttcttcttgacctctttgcccttagtctcttcctggcccttgcccagatctagcttccttggagctagaagcgaggcctgcacctttcctccccttcctctcccctttgcttcgggtttattgagagtaattctctaaggggaagagtgtgccttcctgctcttcttcatcagtgggggttcatgaatcgccttgctgtcggcctccgttcggtcctccccaaaatccgtgtcgtactgcaactgcacatcgtaagattgtgcatgacaatcttgagcaggaggggctgaaggagcagaggcgggtctctttgctgaacgacagcctggtgcaagtggttagcctcactgtaaccctgatctcaatgaggtccttgggccattggatgaaggtaccacgagcatttcctagtgagaggacctcgtcgtttggtagatacttcaaagggaacagctcgtattcgggcttcaccgagtcgacttgaacttttgcacagtcggccctgagttgcgctccatgcacttttgtctatggggtcggcttgtacgcaagtccctcggctgctggaaccgtgaaggtcggcatcaccctaactatgagggtgcagctcgttggttcctgcgatagattaatcaatttttttagaatattatatatcatatggattcggtaagtctttcatgtattgagtaagttcatggttaccgttatatggtcagcggcgctgtcgaccgatgttggattttccgccaactcagttgatgcgcaactgctgcgtttttgggtgggacttcctaactcttcgtgcgcagaagcaacggcggcctgggggttctattgctcttctcggatctcttgcctaatcttggccctcatcgactcgagcttttcatcgaattcagatgtcagctcagctcttatcgacgcccagatcttggcttcaaggcgtgcatctttctccgccttgttggaagtccgcttcttgtactgccacgcgtagtctggaaatccatacttccagggaacagaagacccaacgccccgtgtccgtccacggtgttccttgttgcccaacgctttcgtgaggaggtcgtcctcacgtctttgagagcaggcctcttgcgaggcttgttgctcggcaaccaactccatctgcattacaatttagtggggttaaataaactgcacgatgggaaacaatgcgaacatctagtttgactagacacttactatagcttcgtacactcgttgatcttctgcatttggcatgaagattgtgccatcatcattcttctggtacctggccctggcccagttcctagcccgagggtgtgggatatcgccaaacacgagcggtgtgcatgattcctccgcttcttcatcctcacgttgccattcctcttccttactggcatatccggcggtgcccagccggtgcggatgctggttcctggtctggagcaagagatatgcctcgcttctagctctggactcgggggtcgacttcttcgcatgtaatt

SEQ ID NO: 94033 - DNA, 717 bp, Oryza sativa
aatggacttgttcatcatctgctggaagattttctgagcctcttctatttttcctgaaacacagaagctccgtagagcttccagataacaatactcctctggatacttcatgctcttaatcatatcatctctgacataaaaaacaccttcagcattatctgatcctgcgagacaacacaatagaagtcgaaaaatgtcagatccaacctccgtgttccttgccatatctttgtagaactcaagagcaagctcggactttgcagaattgcataaagcatgaagtatcgtcctataaactttactatctgctgccacatgtctcgatttccccatagcctgaaaggtagatagcatcttgccaatctgccttgccttcccataactggatatgacgattgtccatgtcttgatgtccttcaaacacatctccttatccatctcatccatcaacttctccatggccccaaagttcctctcctcacccgcaatgtacagcattgcgttgtacgtcttcgtggtgtgctggaatccaggaacttgcctaacccagtcaaagaatttgaaccccaaatgcctctttttgaagcacctgttgagcaccaagctcacaagcctctgggtatatgtaactcccaggttcttcaagcttttgttcacaaacaatccaagcacctttgcccccaaaacttttgtaccctatgacaaactcactgtaat

SEQ ID NO: 94034 - DNA, 1695 bp, Oryza sativa
cacagatgtcccaaatgagacagtacagttgttggggatgggaccgtcttggaccgtagacacatggcaaggatacgatataaatggatattttacaccgtcaaacaagatgacaaaagcacagtgcaaaacaacggcgtccgtatagatgcgttccaggatcaagttgggtcaaacacatactacggccgcattgaggagatctgcgagctaaactacgtcaagttcaaggttcgtttgttccgctgccattgggtgaatctaagcactggtgtcaaagccgacaaggaaggtttcactttagtagatctatctaaggtgggatacgtcgatgaaccatttgtacttgcgaaacaggtcgagcagatattctacataaaagacccttcaaacaggaagatgcacatcgtgagggatggaaagcgccgaattgtaggagttgacaacgtcgtcgatgaagaagaatacaaccataatcttcatgtaagacctcacattgaccttgacgatgatccccaagagcctgtggcatatgctcgttcagatcatacggaagtcataaccttgtgacatgcatttgtacttatctattgtaatgaatgaagtattttgttttattacaaatgaccaaaataaaagttgtagatcctgatgagaggatcaactttgtttttgaccatatttcaatttgaaatcatgtagtatttacaaatgctgttaattagatttgttatattgtcaaaatcaatttcaagttgttgggaaaaaaattatatagaaaaatgaccaaaataaaactagtagatcttgaaaggctctacaactttgttgttgaccatatttccatttgaaatcatttactatccaaaaatgtattatgactaataaaatgaattattacacagcagctatatattttgcacccacaacaaataaaagatggaaaatgagtcatcgtgacgggccttagttcaagcccgatagagattaatctatctctatcgggcattatcttagggcccgtcacagatgagtcatccgtgacgggcctaaatgtcatctcaatcgggcattattatggagcccgtcaccgatgagtcatgtgtgacgggccctacggcaaagcccgattgagatgactcatcactcttttgtaactagggtttctcagatcggattgaaaaattttctaagtcctgctatagtttcccgcctccttagaaccctagcgccgccgccaactcctacttcaccgccaccgccaccgagaccgtcaccgccgccaccgagcccgccgccgcctccaccgagcccgtcgcctccaccgaccggcgacgccctccaccgaacctggcgccaccgccaccgagcccgccaccaccgccctcgccaagcctgccgccgtcgccaccgacgttgagcccgcggctgccgccaccgagcctccttggcccttcattcggaccaccgccacttcttcactgacgacccccaccgagcccgcgccgccgccaccgagcctctacaccgactggaccggtgtcggccttcctcgtcgtcgccgcccgcgtcctcaccgacgcacgttgccaaccccccaccgagcccgacgccgcccgcccggcgccgacctacccgaccggcatctccactgaccggcgccgccctccaccgagcccagcgccgacccccagg

SEQ ID NO: 94035 - DNA, 1030 bp, Oryza sativa
tcagtttattagatttgtgagatgtgcaatttagtttatttatgtgaataagtgattttagaactttggattctaagccattgaagcactgaattgtgtattttcgttattttgaaaaaaagtagacgatgtctcagcaaggtgaaccaatgtcgacgacaactagtgggtcctcaagggcacgtactcctaggacagggaacaaaatccctaaggaacggttccgcataacagtggtggacgccgtagggttgccgacatctccaaggaaaatattgagccgatttaggtctatctgtggggtcatagggaggcagaaattcagtattctgcaagatgacatcaagctcatgccggccgcagagaaggacattgcttggctaatgttcaaggagagctttgattatcctgtggagcatgaggaccgtctcaggcgggctgctttcaaggttatgggcaatgcttggaagaacttcaagactaagctagtcggcgagttcgtctacaacccggcgaatctagatccaagagagaaatttccttggatcacggaacaggtctgggaggaattacatgcgaagaagtcgacccccgagtccagagctagaagcgaggcatatctcttgctccagaccaggaaccagcatccgcaccggctgggcaccgccggatatgccagtaaggaagaggaatggcaacgtgaggatgaagaagcggaggaatcatgcacaccgctcgtgtttggcgatatcccacaccctcgggctaggaactgggccagggccaggtaccagaagaatgatgatggcacaatcttcatgccaaatgcagaagatcaacgagtgtacgaagctatagtaagtgtctagtcaaactagatgttcgcattgtttcccatcgtgcagtttatttaaccccactaaattgtaatgcagatggagttggttgccgagcaacaagcctcgcaagaggcctgctctcaaagacgtgaggacgacctcctcacgaaagcgttgggcaacaaggaaca

SEQ ID NO: 94036 - DNA, 1207 bp, Oryza sativa
tataataccacgtctaaggcatttgttcaggaacaaggggaatgctagaatgatgcgatggcacactgaagagcgtcaacaggacgggatgctgagacacctcgccgatggttcgcagtggcgaaacatcgacagaaaatttaaagactttggaaaggacgcacgaaacatacggtttggtttgagtacgaatggcatgaatccttttagagagatgagcagcggccatagcacttggcccattacgatgtgtatctacaacctcctcccttggctatgcatgaagaggaagtacataatgatgccgattattattcaaggccccaagcaacctagtaacgacatcgatgtgtacctaagaccgctggtcgaagatcttaaactgttgtggaagaaggaaggtgtccccgtgtaggacgaggacaaacaggaggagtttaacctacgagtgctactgttcgtaaccatcaacgattggcctgcacttagcaacccatccggacagtccaacaagggggacaaggcttgcactcactgtatggatgaaacagaaagtacgtatcttaagcactgtaggaaggttgtgtacatggtcatcgtcgattccttgcagcaaaccacccggtacggaagaaaggcaagcacattgaacataaggcggaccaccgtacgaagcctaaacatcgcagcgggaaaacagtgtttgctgtggttaaagatcttaaagtagtgttcggaaaggggcctggaagccagcctatagagagcgaagatggtcacgcggcgatgtggaaaaagaactctatattttgggagttaccctatagggaattcttggacgtccgccacgcaatcgatgtgatgcacctcactaagaacctttgcgtaaaccttcttggcttcctaggtgtatatggaaagtcaaaagatacactggaagcacgtaatgatctgaagcgtatggaacaacgcggcgaccttcacccggaaccaaaggagaaaggaagccattacttgagtccagccagctacactcttagcaaggcagagaaggaaagtatgtttgaatgcttggagagcataaatgtaccgtctggatactccacgaatatcaatcgaataataagcacgaaggagaagaagttcacaaacctaaagtcttatgactgtcacgtgttgatgacacaactgctaccagttgtaataa

SEQ ID NO: 94037 - DNA, 2469 bp, Oryza sativa
tgcagaaatccatttatgggttgaagcaagcatctcggagttggaatattcgttttgacgaagtagtcaaggcgttgggctttgtcaaaaatgaagaagagccttgtgtatacaagaagattagtgggagcgcactggtgtttctaatcctatatgtagatgacatattattgattgggaacgatattcctatgcttgaatccgttaagacatcgttgaaaaatagtttttcaatgaaggacttaggagaagcagcatatattatgggcataaggatctatagagatagatcaaagaggctaattggattaagccagagtacatacattgacaaggtgttgaagaggttcaacatgcaagattctaagaaaggcttcttaccgatgtcacatggcattaatcatggcaagaatcagtgtcctcaaacgactgatgagcgaaacaagatgagtgtgattccatatgcctgggcaatcggatccattatgtatgctatgctatgtacacgtatagatgtttcatatgcacttagtgcaacaagccgataccaatcagatccaggtgagagtcactggatagctgtaaagaatatccttaagtacttgagaagaactaaggatatgttcctagtctatggaggacaggaagagctcgtggtaaatggttacattgacgcaagctttcaaaccgacaaagatgattttagattgcagtctggatttgtgttctgcctgaatggacgcgctgtgagttggaaaagtaagatacagtgtctgattctacaacagaagccgaatacattgccgcttctgaagcagcaaaggtttggataaagaaatttgtttctcaactaggtgtgatgactagtgcttctagccctatgaacctctattgcgataatagtggtgccattgtgcaagccaaggagcatagatcgcatcaaaagtccaaacacattttacggcggtatcacctcattcacgagatagtgggtagaggagatgtgaagatatgcaaaatacatacggatttgaatgttgcagatctattgacaaagccactccctcagcctaaacatgaggcacacactagggcaatgggtataagatacgttcatgattgactctagtgcaagtgggagactgttagtgatatgccctagaggctattatagagatgattgtatcacacactatgtttacatatttatctgactttgttccttgaaatagataaactcattattggttaatgaatatgtgattctttcatgagactctttatgttatatgttgctatttctaaaggatccctgatcaaatatcatatatggaacaaatatgtttagatgatcaacacatgtattaattgatgatcatgtctcatggatcatggtatagagataccaaattaataatgtggacacatgttagtgaacatgttgttgaatagacccaacatgagacactgcaagagccatatgtgttgtgtcatcagtgatctcatttagtgttggtgttgaatccatagacctgatattatcatggttcccaacatgtgtagtagcttacttagggacagctaaacgctactccgtaattgggtagttataaaagtagtttttgggtatgctatgaaacatgtagtgggatatgaataatcaagatgggatttgcccctcctatagagagatatctctgggcccctcgatgttgtagattatggaagtgcatgaccatgccaaaggtgattgagtagtcaatcacaagttatataatctatcaacaggttcaagtgaatgattgagctattagaggatggcacatatctagccttgagcttaatcgatatcgtgaggcaaaggggttcatacaagtatacagtagaggttcagccgatatgatctttatgtatgcccggtaggtcaatacgttctgctacgggccactgttgacgcgtggaccgaaaaggagttttcgggttacagccgagtatacatgaacctaaagggtcgcacacttaatgggccggaataaggggattggatggagatccaatatgagcttaattcggatagggatccgaataggagtcctacgggccatgtaggcccgagtgatggatcctatatattcgtgaggggtgtgaccggcggaggcattgcatcacgtgagaaaccctagccatcacttccctccccgagcaaaaaattagccgcacgcgggtgctagcacatctgcgcgtggcgttccgtccttgtacgtgtggataccggtagaggcgccgctggtttgtggtgctgatcggcgtgggagtacggtgaggagaacgcacgaagagcagaaggtcgagctgatgccgatcgactacttcctttacatcgacgcgcgctacttcgcgagagttccttcgacttctcagcgtcttcttccgctgcgcagcgcgtcgagtggtaacgatctatgatct

SEQ ID NO: 94038 - DNA, 773 bp, Oryza sativa
ctctcaaaaggcaatgtagaaggtttctcctgtttattatttcaagaactcatatcattattctctgggattggtgattgctttctctcagttttatcatttccttggttgagtgacaactttgtacttcccctacagttatccatctccaaccaatcctacaataaagaaaatgtcagtatgttgataaaatattatgtaccctagaaggaaaaaggtgccatccaaacattaccttgggcatcaatttagctgatttgtcagatgtagcatcaacagtattgctgtcttttgcggcgaaggtaaatttagcagcgcagttggagttattaggtaaagactccttaactcgtgacgaagatggtttcaaaagactgccctgtgctgatacttcagttttctgagaaataggatcctcaacatctaagatgtccacatgcttttgccttgttgctaatgtgccttccttctgtgaaggaattatcgtatcaagctgcttcaatatctttgcagccatttgaattgactgtgctggtgcctgaccaaaactgctatcatttgctctgtcatgtacaccacttcgagtaatatcaccaactttatccagacacctacgtttttgactttgtactgagtgttccaaaccttcatcaagtttgctagcatgactaccactatatccacggtggcctgaccgagtttgcaacagtggtgacactctgttgtacctctgatgcattttgcgtatgggaccaacagaggcactctcgtta

SEQ ID NO: 94039 - DNA, 1360 bp, Oryza sativa
cacccggtacggaagaaaggcaagcacattgaacataaggcggaccaccgtacgaagcctaaacatcgcagcgggaaaacagtgtttgctgtggttaaagatcttaaagtagtgttcggaaaggggcctggaagccagcctatagagagcgaagatggtcacgcggcgatgtggaaaaagaactctatattttgggagttaccctatagggaattcttggacgtccgccacgcaatcgatgtgatgcacctcactaagaacctttgcgtaaaccttcttggcttcctaggtgtatatggaaagtcaaaagatacactggaagcacgtaatgatctgaagcgtatggaacaacgcggcgaccttcacccggaaccaaaggagaaaggaagccattacttgagtccagccagctacactcttagcaaggcagagaaggaaagtatgtttgaatgcttggagagcataaatgtaccgtctggatactccacgaatatcaatcgaataataagcacgaaggagaagaagttcacaaacctaaagtcttatgactgtcacgtgttgatgacacaactgctaccagttgtaataaggggtatcctttccagacaatgttcgggcaacaataacaaagctatgtgcattcatgaacgcaatttcgcagaaggtcaccgatccggatagattagaagcccttctgaatgatgtggagttttgagttgatatttccaccttcatttttcaatataatgacgcatctgctttgtcaccttgtcaaagagatcagtattctcgggcctgtgtacctacacaacatgttttctttcgagaggtacatgggcgttctgaagaagtatgttcgtaaccatgctcgtccagaggcaagcattgccaaggggtatggaacagaggaggtcatcgaatttcgcgtagaatttattgaagaccttcgcccaatcggggtacctgaatcacgccatgaagggagactacggggaaagggaactcttggaaggaaagcaataatgacgatagacaacaatttattccgtaaagcccatttcacgtttctgcaacaatcttcattggtagctccttacatcaaggagcacttggctctagttcacgccagaaaacattggtaagtcccatgcatggattacacggcatcacattgatactttccgcgcgtggctatgacaacattttatgggggacgagacgatcaaaccacaactggcctttctggtgagggggaccatttggtcaatcgcgacattttcagggtattagaacaagggggcaccatactatacgagaggcccagaaatggagaggaccaaccaaaacagggttgttggat

SEQ ID NO: 94040 - DNA, 657 bp, Oryza sativa
attgccactgccttgcagaccaaatcatctccacaagagagctcgatgtacgtgcaaataaattcaaaatttcattacgtatcgatttgttgtttaattactaattaatttcacacattcatatagtttattcgtatgagggataacctgatcacacacaaggaatttatcacggtggttcaagaacaactcatgggattcatcaacgaacaaatccttgatgccaagggtgaattctactacgacggaaatacaattcataggtccttagcttctgagatagcgactactactacgtcgaaatagtagctagctaggacatcataatggattgtaattagtacatgtctatttttctatatgcatgtgtacacattttctttaatgtaaatatatattttgggtatatatatatatatatatatatatatatatatgtgtgtgtgtgtgtgtgtgtgttgtgtatgtatatatacacacatatgcatttgcataacatatatatatataaatacatatatattaatcatgtatatatgtatcgaaacatatatatgcatggtttatatatatataaacccatgcagtacagggtcatgcaaaaaaaaaaggtcaggtcgatctaaagatcgaacctttagtcccggtattttcccc

SEQ ID NO: 94041 - DNA, 737 bp, Oryza sativa
  unsure (1)..(737): unsure at all n locations
aacgacaactataaacgattcctagttgttaaacaacataatggttaaagaagccttgccgagcatatgtgctaccgtgggacaatttatacttgccaacagaaggaccagatttaatactgtaaagcggtcaattagcgcgacacgattgatcttgatctgcgcactgattaggtacaccaggatcatcactgtaagaaatccgttgggcttggggacataaatcctagcnnnnnacancntgncncnnnaaanaattatgagcttggtgacttcgggttagcaaggcttgttgagcatgggggagagccacaaacaacacaagttgtcgcagggacccctggatacattgacccagaattcatcaacaaccgctggcctcgcaccgaattggatgtgtacagcttcggtattgtcctcttagagatagcttgtggcaagcggccggcatcgaggcagctgccaaatggagcttcatcactgctagcctgggtgcgtgatttgtatgaccagggcaagattcttgacgcagcagatcagagactgaacggcgagttcaatcatcagcaaatggagcgtgtgatcgtcatgggtctctgctgttcacatcaagacccgatccagcgaccgtctatcgtgcaagctatggatgttctgtgatctgcatacacagagttgccggtacctcccgcagcacatgatacaggacacatgcggtccatgcaagaacaagcttt

SEQ ID NO: 94042 - DNA, 824 bp, Oryza sativa
atattttgggagttaccctatagggaattcttggacgtccgccacgcaatcgatgtgatgcacctcactaagaacctttgcgtaaaccttcttggcttcctaggtgtatatggaaagtcaaaagatacactggaagcacgtaatgatctgaagcgtatggaacaacgcggcgaccttcacccggaaccaaaggagaaaggaagccattacttgagtccagccagctacactcttagcaaggcagagaaggaaagtatgtttgaatgcttggagagcataaatgtaccgtctggatactccacgaatatcaatcgaataataagcacgaaggagaagaagttcacaaacctaaagtcttatgactgtcacgtgttgatgacacaactgctaccagttgtaataaggggtatccttccagacaatgtccgggcaacaataacaaagctatgtgcattcatgaacgcaatttcgcagaaggtcaccgatccggatagattagaagcccttctgaatgatgtggagttttgagttgatatttccaccttcatttttcaatataatgacgcatctgctttgtcaccttgtcaaagagatcagtattctcgggcctgtgtacctacacaacatgtttcctttcgagaggtacatgggcgttctgaagaagtatgttcgtaaccatgctcgtccagaggcaagcatcgccaaggggtatggaacagaggaggtcatcgaatttcgcgtagaatttattgaagaccttcgcccaatcggggtacctgaatcacgccatgaagggagactacggggaaagggaactctcggaa

SEQ ID NO: 94043 - DNA, 711 bp, Oryza sativa
acatgcatatagaaaaatagacatgtactaattacaatccattatgatgtcctagctagctactatttcgacgtagtagtagtcgctatctcagaagctaaggacctatgaattgtatttccgtcgtagtagaattcacccttggcatcaaggatttgttcgttgatgaatcccatgagttgttcttgaaccaccgtgataaattccttgtgtgtgatcaggttatccctcatacgaataaactatatgaatgtgtgaaattaattagtaattaaacaacaaatcgatacgtaatgaaattttgaatttatttgcacgtacatcgagctctcttgtggtgatgatttggtctgcaaggcagtggcaatactcgcacacgtagtagccgcacaagttagttccctacttttgctttgcgcactataaataaatgacaaatggcgagagatctaattaatatacacttgtatgtatttgaattggagattcaatataaatgtagagcatgtgtactcacaggaaaattgaacttccgcctaagtctttctctcatttttccgcggaccaaatgatggaaccgataccaagccctacatggagtttaaagctatgattcgtagtagcaattaattataacaagattcttaattaacataggaatttatgacagtacctgtttataaagtcgaaaaccctgcaaacggagactct

SEQ ID NO: 94044 - DNA, 719 bp, Oryza sativa
agcaattattaacccttattatgcattggtgatgatgaaactctgaggtttagatttaaggaaaaatttcctaggtttatgttaaaacttgcttaaataaatatttgatccaattaactcggttttgcaggtgaaatatgataaatatttgaataattgtgaaatatgtgaatgaatgtaaaatatgagatgcctgtgaatgtgtggttgtgtaaaatatgttaatgtgtgtgtatgtgaatgcatatatatatgaatgggtaatgctggggagctggggatattggatatctgtgtttgtttctgttatttatgcagcgggcatggctagcaaaggcctgaggctagccaaaaaacaaatttttttgtgaattatagccatttgtgacgggccataactaaatgcccgattgagatgaggtgtcacgcccagaaattcccgaatagaattccaagcagaatgtgcattaaaacccccgtccaggaccggtcggggtacacaaacgacaaatttgacatacagatccacgtcttacaaacattataaaagtattacataaatgcagcggaaaataaaaagataactggagctaagccttgacttgcaccgcagcgggaacaccactccacaagtatcctcgacggcacggacgaagcctactcctcggagaagccaccatctgacgcatactcaaactctggggtttggggaaaatata

SEQ ID NO: 94045 - DNA, 2988 bp, Oryza sativa
atgtataccacaaagacaacatcgaaccggatgatctagcacggcgtgcgtccagacgagagccacagccaattgaacctggcacctttcctgaccaggccatcagtgaaagaggcaagcggcgaagatagcccggtcacccctaacatcagctcgggggctacagaggcagagcgcgccgttgccgatatcgagagcacagatgactggcacaccccactcattaaattcataggcagtgaagagttgcccgaggacgacacagaagccaagaaaatatcccgtaaagcaaaagtctactgtatgatcggcaacgatctatacaagaaggcaccaaacggggtacttctaaaatgcgtctcgtccgacgacgacagacacctcctccttgacatacatgaaggaatccgtggatcacatgccgccggtcggacattagtcggaaaagcttttcgacaagggttcttctggccaaccgcccttaaagacgcctgcgacatgattcagcggtgtgaagcctatcaattctacagtaaacacacaaggctaccagcgcaagcacttcagactatccctctcacttggccgttctcgtgctgggggctagatattctcgggctattcccacgaggatagggcggctgcaggttcctattcgtggcgatcgacaaattcactaagtggattgaagcgacacccacgagggaaatcaaggccgacaacgccatcaaattcatcaaagggatattctgcagattcggattgccccaccgtatcataacggacaacggctcccagttcatcagtgccgattttcaggattactgcatcaggctgggagtcaagatctgcttcgccgacgatgaggaggaattttgaacggagggtaatttggtcaaatttatggttgtaatggtgtggaatcaatggtgcgttgatggcgatggcatttctggaagaaaaagacttgtacgatggcattttatggattttctctaatttaaaattttaagtaatactctctccgtcccaaaatataagcattgttggacttcgacaatgtcttcgagatgctacattgatcaacaatatctataaaagtaagatgttttaaataaaaaaagttacacattatgataatttgcttaataacaaatctagtaacatcaaatttacatgattgatctgtttttgttcgtttgctattaatagtcaaaatttaaaagtttgatttgccactattctaagaatgcttatattgggatggatggagaattttttttcttgtatactaaggatgtatgtgaggtgatatttataagtggacgtgccgattggatgggctaggctgcgttattctagagcacagattgttaaaaattgtaaagtaaaattacttgaatcacgtcgtcttaaatttatgagaaaaaaaatgctgcaacaatagatgttgactttcgcccagggatcaaactgccggggagcaacgaactacctttggcgtaaactcacgcgagcacacaacacacgcgatggttcagatgaacacagggaacacaagcaagctttgcggcaacaaatgcccttttctctgtttatctgtgactcacacacttaactgaaaatggatcagagcacggcttaaatagccttacatgcacgaactgttgccggtcttcatgcgcacgcacgcactacctgaatacatgagccactaactccatgcattacgagacccactcgtccaactaaccatgcatgcaactaactatctgctaacttgccgcactcaactaactacacaagctaattactcggtcaactaatcaccaagtacatggctgtgacagatctaatctcctatatgcatgcatcatatatgcaatactccactacgtgcatgacacacatacacgactaactactgcagatatttaaaatatgtaagtcaggattaatgctaacaatagagctggttcatatgaaactatcatttatactacatgtgtagatggataatagatagatagatagcacaaaactatgaacaaaatagatgtgtgcctatcagcaatcttgttgacaaaacaatctaaacaggcgcatgtaaacataactaatattgctattcaaaagagagaattcgttatccttcagcaagtagataaactgaatccttggaagtaaaatacgtacttcgggtgacagtatgcacagaatgatcctcaactggcaggtcggcataagcctgttcttgcatggaccggatgtgtcctgtatcatgtgctgcggaaggtaccggcaactctgcgtctgcagatcacagaacatccatagcttgcacgatagacggtcgctggatcgggtcttgatgtgaacagcagagacccatgacgatcacacgctccatttgctgctgattgaactcgccgttcagtctctgatctgctgcgtcaagaatcttgccctggtcatacaaatcacgcacccaggctagcagtgatgaagctccatttggcagctgcctcgatgccggccgcttgccacaagctatctctaagaggacaataccgaagctgtacacatccaattcggtgcgaggccagcggttgttgatgaattctgggtcaatgtatccaggggtccctgcgacaacttgtgttgtttgtggctctcccccatgctcaacaagccttgctaacccgaagtcaccaagcttagcattgtgtgacacatcaagcattacatttgcaggcttgatgtctccatgcacaatgcatttctcgcagtcatggtggaggtagagcaaagcagagcccagatcaagtacaatcttgtcagttgaattaaacaggttagcaaatttaatttggtacctttgttgccaagttaaaattttctcagggtcgtagagatgcttgtcaaggcttccttgagccataagttcataaacgagaaggagctgtttcttgctgtcgctccagccca

SEQ ID NO: 94046 - DNA, 2628 bp, Oryza sativa
aatgagcataccatgtttataccttctccattggccgttgaaatggtgaatgtggatcacgatctgcttgcaagacatgttacgtgacgttgaggacccagcccagaatgagagagatggaatgaagttcagcaggttggtaagtgattccgagacgtctctgtatgctggatgcaaagcaaaacacactaagttgtcagttaccttggacctaatgaagctgaaggcaagtagcggatggacagacaagagtttcacagaacttttaggaattttgaaggctatgcttcctattgagaacacattgcccgagacgacatacgaagcaaagcaggttctgtgtccactagggttagaggtccgtagaattcacgcttgtcccaacaactgcatattgtaccacaaggaatatacggacttggatgcttgtcctgtctgcaaggcttctcgatacaagcgaaagaaaagtgctgacgaaagaaataagtcaaagaggggtggtccagcaaaggttgtgtggtatctacctatcattgatcgtttcaagagaatctttgccaacccgaacgaagcgaagttagtacgttggcacgccacggagagaaggaatgacggtatgcttagacacccagcggattcgattgaatggaggaatatcgatcgaaaacacaaagactttgatgccgaccctagaaacatgaggatatgtctatgtacggatggtatgaatccttttggtgacatgagtagtactcacagcacttggccagttcttattgcgaactataacctcccgccatggttatgctttaaacggaaatatattatgttgtgcttgttaatccaaggtccaaggcaactcggcaatggtatcgatgtattcctggagcctgttatcgacgatctggagattctttggaaagaaggtgtggaaacttgggatgcatatggtcaggagaacttcaagctaagagttctattgttctgcacaattaatgactaccctgcactcggtaatctttccggacaaactataaaaggaaagaaggcatgctccgattgcaaggaatatacacaaagccggtggctgaagaaatcacgaaagatggtatacatgggtcaccggaggtggctcccgctacgtcacgcatttagaagaaagaataaaatttttaatggtaagagagaacttcagcctgctcctaaagatttgtccggagatgaggtccacaatatggtcaaggacataagcaatgagtttggtaagaaaagaaaacgtagcaagacaaaggagaagggtatgtggaagaaaaaatccatattttggcggctaccttactggaaagatcttgatatccatcattgcattgatctcatgcatgtagaaaagaatgtgtgtgagagtttggttggcctgatgttgaatattcccgggaagacaaaggatgggttgaacgcgcgccttgatctacaggacatgaatattcgcagtgaactccagcccatacgagatgcagagacaggtaaagtgtacctccttccagcctgccacacactgttgaaggatgagaagatcgcaatgttatcatgcttgaaggatattaaagttccatcgggctattcagcgaggataagtaagtatgttaaattggacgatctaaaacttgttggaatgaagtctcacgattgccatgtgctaatcacacaaatcttgccagttgctatcagaggcattctagcaccgaaagtgcgtcacacgatccaacgtctgtgcgccttcttcaatgcaattggacagaaggttatagatccagaagatctagatgggctgcagaccgatattgtgaatacgctctgtcacctggagatgtttttcccactgtctttctttgatataatggttcatctccctgttgatatggtgaagcaaacaaaactatgtgacccggcttttctaagggaaatgtggccgtttgaaaggtacatgggagttctgaagtcgtacgtttgtaacagagctaaacccgaggggagcatcattgaaggttacataaccgaggaggctattgagttctgtgtcaattacatgtccgatgctgatcctatcggagttcctgcgtctcgtcacgagggaaggttgtcacgtgttggcacaattggaaggaaaagaatcaggcctgatcaagcatcgtacgcgtaggctcattacgctgtgctccaacatatggcagaagttggcccatactttgaggagcacttagcgaaaatctgagatgagaacttggggcgatctgatgcatggattaacagagaacataattctcggttcaacgaatggttcaagaatcgtgtgataatgtccacagatgtcccaaatgagacagtacagttgttggggatgggaccgtcttggaccgtagacacatggcaaggatacgatataaatggatattttacaccgtcaaacaagatgacaaaagcacagtgcaaaacaacggcgtccgtatagatgcgttccaggatcaagttgggtcaaacacatactacggccgcattgaggagatcttggagcttaactacgttaagttcaaggtttcgttggttcggttccaattggtgaaattaaat

SEQ ID NO: 94047 - DNA, 728 bp, Oryza sativa
tacacagtattattaatcaaggccgtgaaccctcacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaataggttatactctgatcagaggtgtacatctttacccacaagacacatcttcctcacgcgtaaccacgtgccacataccaccacggcatatggacggaagacatgacatagtttccaacccatcctagccatagacaagagtaccgacccaaccccacctacggccggaacctccgggacaggtaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttggttataaccagactgagccacaaactaagccttacccactagacatgtgaaagtaccgtagtgctttgcaacagaagccccgaagaccggtccttatattggcgaagtgctactattcaaaccatgcaccccgagcccagactaaaaccattttggggggtttggaataaggggg

SEQ ID NO: 94048 - DNA, 690 bp, Oryza sativa
ctaactctaaatacaaacatgtaatggtgtcaagtcacgcaattgcaaagggaatttctcattatttgaaaagaatgttaagtaggataggtttcacattactaatcgaagaccatgcaaattactgtttttctagtacattatacttcgcaccaggtaaattacatcgtgtttcactttataccgggatgatctaaggtgagttgcactttactctagcatcatatttcaattggatacatacctgtcagtagtattctcaccagataacatatataccagtaccaaattgaacaagaaataggaatgtgttcacttagaaagagaataaaaatgccatcatcaatggggttgcctgtaggctaggactgttaatatggtctgaacaatggtacagagtaggacgaccactgcagccaacacacctaatgctaaccatggattgctgaagtgattacgccagagccaagccatccatctgttcagcctgctttggtaatggtcctccaaaacataggataaagtttgaaggtagtggtaggtatcagaaccaaatatcaaatgtgtgctgagcctggtgaacatagctgacacttcatcgtcattatccagcatatgaacaattatccctctctcagtaagtagagtggcatcctcagaagtgcttacaagctgagacataaaagcgat

SEQ ID NO: 94049 - DNA, 905 bp, Oryza sativa
tgaagtttatatgctctttaattgaatatttgcgaatttcttcatttaaattttaatttaaaatcggaattattgcgtcagccgaggggagagggcgcgcggaccgggtccacgggagtggggcccacgcggcagcctcacggtccacggtggaccgggtgcacccggctcacaccggccggcgccgtgggtcccacgcgtcagccgcacccgagggcgcgggcggcttacggccgggccccacacggcagccactcgacgcgcccgagggcggccaagccagcgcggccggcgggaggcggcgtgtcacgcccagaaattcacgaaccagaatttctaagctgattgtgcattaaacccctgtccaggaccagccagggtacacaaacgacaattgttgacatacagatccacgtcttacaaaaatataaaagattacaaatgcagcggaaaaagataaaagcgagctaagcctgaagacttgactcctgcagcgggcgactccattccacaggcaatccttgacggcagcgacgaaaccaacctcttcgagacatcttcaactgggaaggacttcaactctggtgtgggggaaaagagagcaagactgagtactacccactgtactcagcaagtcataccggaagaggaggtatgatgcaagatatatccaagggaggctaaaggttcttttgcataaagccggcatttcaaaacagtagttgaaagcagtaaaacagttgtagtaattaatccatattaaccaatcactgtccaacgttacaccacgaaacaaaaggcacaaaccaccacctaaactaatcagttccaaaagctaactagggtgaaactaatcacggggtaccgagctcgtattaggcgaatagcaattgatctcacccctt

SEQ ID NO: 94050 - DNA, 1187 bp, Oryza sativa
atgtgtttgcatggggtacctaagaagattgtatctgatcgagggagtcagttcacttcaaaattttggcagaaactgcaagaagaattggggactcgtttgaatttcagcacggcctatcacccgcaaactgatggtcagaccgaaagggtcaatcagatcttggaagatatgctgcgagcgtgtgcgctcgattttggtggagcatgggataaaagtctaccttatgcggaattctcttacaacaacagttatcaagccagtttgcaaatggcaccgtttgaagcgttgtacggacggaaatgccgcactccgctcttctgggatcaaactggagaacgccaattgtttgggacggaagtattaactgaagcagaggagaaagtcagaaccgtcagagaaaggctaagaattgcccagtctcggcagaagagttatgctgataaccgccgaagagagcttactttcgaagcaggggattatgtgtaccttcgtgtcactccgctcaggggagtacaccggttccaaacgaaaggcaaattggcaccacgctttgtgggaccatacaggattttggaacgccgaggtgaagtcgcttaccagcttgagctcccatctaatatggttggaatccacgatgtgtttcatgtatctcaattgaagaagtgtttgagggtacctgaggaacaagctagcttagagcacattgacatccaggaagatctgacttatgtggagaagccgattcgtatccttgagaccagtgagagaaagaccagaagcaaggtgatcaggttttgcaaagttcagtggagccaccactcagaagaagaggccacctgggaaagagaagatgaattgaaggccgcccatccgcacctcttcgccagctcttccgaatctcggggtcgagattccgtttaaggggggtaggtttgtcacgccctgaagttcccttcccttgctctaaattcataaaataaatcgtccgaagaaattgtttaatttaacctagagagaaaccctaaattaataaatgcaaatattaatcggaatcggcatgtggaatttttcttggattctacatgtcaaaatacgctaacaggatttttagtggaattttcagagcattggaaataattttaaccaattaaaattgagcttgtgcaatatataaatccctggaa

SEQ ID NO: 94051 - DNA, 740 bp, Oryza sativa
tgaaacacatcgtggattccaaccatattagatgggagctcaagctggtaagcgacttcacctcggcgttccaaaatcctgtatggtcccacaaagcgtggtgccaatttgcctttcgtttggaaccggtgtactcccctgagcggagtgacacgaaggtacacataatcccctgcttcgaaagtaagctctcttcggcggttatcagcataactcttctgccgagactgggcaattcttagcctttctctgacggttctgactttctcctctgcttcagttaatacttccgtcccaaacaattggcgttctccagtttgatcccagaagagcggagtgcggcatttccgtccgtacaacgcttcaaacggtgccatttgcaaactggcttgataactgttgttgtaagagaattccgcataaggtagacttttatcccatgctccaccaaaatcgagcgcacacgctcgcagcatatcttccaagatctgattgaccctttcggtctgaccatcagtttgcgggtgataggccgtgctgaaattcaaacgagtccccaattcttcttgcagtttctgccaaaattttgaagtgaactgacttcctcgatcagatacaatcttcttaggtaccccatgcaaacacatgattcttgaaaggtaaagctctgccaacctttctcagtataggtagtgtgtacttggaataaaatgagcaacatttggtgagtcgaatcacga

SEQ ID NO: 94052 - DNA, 717 bp, Oryza sativa
tctggttagcattgtactgaaacaaacctgtgaactgctttaacaagcaagatcagagatctgacgagatcgctcactgtcacagttactgtacatggcttacttcggcggattaacataagccagtatgccaaaaacggtttgcacaattgtgcagatgaggacaatgacagtcgcactcgcagccaaagccagccatggattgctgaagtggtttagccagagccatgccatccaccgattgatgagactttgatagtgagcttccatagtctggcacagagttttaagtagtagttaccattgaaatcaaaaaccacgtctttgctgagcatggtgaagagatcagacaccctttcatcgctatcaagctggtgcacaatgatttttctctgaataagcagcgtaacgtcctctggcatgcttataagttgagacaagaaaacaatataagcagtgaagtcatctccaaattgagggcaggtttgttcaaacgcaataaggttcctgaaaagactccctgtgtactcatcaacaacaatacacggaatgtccatggaaccattgctaaaccaaatgtctagcagagaatggggttttaatttatcatattcccgtttcttaaactttattccggcttctagatattgtgcagctcgtcgccaacgattaagctgatcccctccttgtgccagatccacttcgttctggaatgat

SEQ ID NO: 94053 - DNA, 1286 bp, Oryza sativa
atctgacggcactatttattggcaaccgctgtgaagtttacactgatcataagagcctaaagtacatcttcacccagcccgacttaattctccggcaacgaagatggctggagttgattaaagattatgacatggggatacactatcatccaggcaaagcaaatgtggtagcagatgctctgagcagaaagagctattgcaatgcagtatgtaccgaaggcatgtgtgacaaattgcagcaagatcttgagcacctaaatttgggcatcgtagaacacgggtacgtagctgccctagaggcacggcctacgctcgtggatcaagtcagagcagctcaagtaaatgatcctgaaatagctgagctgaaaaagaatatgagggtcggaaaagcccgagatttccatgaggatgagcatggcacaatctggttgggagaaagattgtgtgtgcctgacgacaaagaactgaaggatctcatactcacagaagctcatcaaactcagtattcaattcatcccggcagtactaaaatgtaccaggacctcaaagagaaattctggtgggccagcatgagaagagagatagccgaattcgtcgcactctgcgatgtttgtcagcgagtcaaagcagaacatcagaggcccgcaggactgctacaaccccttcagatcccggaatggaaatgggaagaaatcggaatggatttcataacaggtttgcccaggacatcatcgggtcacgattcaatctgggtggtcgtggatcgactcaccaaagttgctcattttattccagtacacactacctatactgggaaaaggttggcagagctttacctttcaagaatcatgtgtttgcatggggtacctaagaagattgtatctgatcgagggagtcagttcacttcaaaattttggcagaaactgcaagaagaattggggactcgtttgaatttcagcacggcctatcacccgcaaactgatggtcagaccgaaagggtcaatcagatcttggaagatatgctgcgagcgtgtgcgctcgattttggtggagcatgggataaaagtctaccttatgcggaattctcttacaacaacagttatcaagccagtttgcaaatggcaccgtttgaagcgttgtacggacggaaatgccgcactccgctcttctgggatcaaactggagaacgccaattgtttgggacggaagtattaactgaagcagaggagaaagtcagaaccgtcagagaaaggctaagaattgcccagtctcggcagaagagttat

SEQ ID NO: 94054 - DNA, 1607 bp, Oryza sativa
attatactaatgtatataccttgcggcctgcaagcgtgggccaaacccaccgactaattatgctgtagatggcttcattatgcttgctggtgacacattgcactgggagtgagacatactcggagtgatttacccaacagatgctattggagagaatactgattctgggcccgattcacgttgaagctgctcagctgcagcaatggatgggttgtttgcaccatggtggagggatgatgcaagaggcatatgtataggaatcacacggttcactaacaaggggcacattgctcgagcagtgctcgagagtatgtgctttcaggtgaatgatgtcctcagctccatgcacaaggatgctggggaggcaggagaagtgaagagtgcagaaggggagttcctgctgcgcgttgatggtggtgctactgtcaacaatcttctcatgcagatccaggtaataatccttctcacgagatttaaaaagaataataaatactctgctagcttttccattggaacagtggaacatttactatcacgcagatgcgaaatttctgggttgatgagcaactacgtttaagagtaaaataattcaaataggttatcaacgttgatgttaccaccacctgaaatgttcatgcttatagttgtgcttttgacttggtgaaaatgaatgaaatgcaagatgttggctctttgtgtccctctttctatttaagggtaaccaaagcaccaattgttaccttttgcacataatgacctcttacttctgtgagtcatacttgacatgattgcagccacatctgtacagcactatgctatcaatctcaaacaggaaaaaaatatataagtactgtcttcatctgtaaacaaaacagtagtgctatgaactgttatttcaaaattcactatcttattgataactgatctttggctaatttacttatatcctcctacagtacagcttactgaaattagaagcttgagctaattagttaaatcctcttatagtattgcttactgaaattgtcttgaaaaacaatctttttaaatgcactgggtgtaattgtagctgtagcttagtgaaacgtttctctttgcaattgtaaaatctctccaaattcccataagatcactgattttgcatgcacacctgcaggctgatttattgggtagccctgttgtcagacctgctgacatcgagacaactgcccttggagctgcgtatgcagctggattagctgttggagtctggtcgaaggaacaaattttcgctggtttgcacaaggagaacaccagagtcttccgcccgaaattggatgaggcccacaggaggaagagagcagactcctggtacaaggccgtttcaagatcatttgatttggctgacctttctctttagaatgacgagggatttgtgaattacttctggattgtataaggtgcttagcacttgttatgtccatgaataagttggtcaatggaacatccttcaaaagaattagttgattccccacgctttgctgctggaattattaagtaattttcaatatacttttttaacaattgagataggagtaaaaagaaaaaataatgaaatgtcagtgttt

SEQ ID NO: 94055 - DNA, 739 bp, Oryza sativa
tgccatttgcaaactggcttgataactgttgttgtaagagaattccgcataaggtagacttttatcccatgctccaccaaaatcgagcgcacacgctcgcagcatatcttccaagatctgattgaccctttcggtctgaccatcagtttgcgggtgataggccgtgctgaaattcaaacgagtccccaattcttcttgcagtttctgccaaaattttgaagtgaactgactccctcgatcagatacaatcttcttaggtaccccatgcaaacacatgattcttgaaaggtaaagctctgccaaccttttcccagtataggtagtgtgtactggaataaaatgagcaactttggtgagtcgatccacgaccacccagattgaatcgtgacccgatgatgtcctgggcaaacctgttatgaaatccattccgatttcttcccatttccattccgggatctgaaggggttgtagcagtcctgcgggcctctgatgttctgctttgactcgctgacaaacatcgcagagtgcgacgaattcggctatctctcttctcatgctggcccaccagaatttctctttgaggtcctggtacattttagtactgccgggatgaattgaatactgagtttgatgagcttctgtgagtatgagatccttcagttctttgtcgtcaggcacacacaatctttctcccaaccagattgtgccatgctcatcctcatggaaatctcgggctttt

SEQ ID NO: 94056 - DNA, 712 bp, Oryza sativa
ttcggtccattacatggatcatccaggaggcatcgttgggttataactagttttatcatccatcgcaataccacatttaattaaacggaaacatagtaaacgagtggtgataagatcgtaaaacaagaattttgtgtctctctcactcttcctttgctttttatttaagcgttccgaccatagttcatcagcagttcgacaatacagagaaaatggcagatatagaaagatattttgatcatctcagcgacgtcgcatgcagcaaaagctgtggttgatttagcaggttcgtgagctgcacggtgcaaggcgcgtcggccagacaaaattattgggcccagtcatgactattttctcttcggaactgaatccgggaccttgagctgtcaagaaaaagagagtccagcgtcaggtatgaggtgtgcaaatactctaacatttaagcgagtcgaaagaatcagaaaaaaaaagattaagcgattgtaatagaacaatgaaatgctaaccagtcgtgggcttgtattcggtcatcttctgcacagttgacgctgagtagacgtgacccgtttcttcaggaaaagagttaggagggtattcggagaccgtgtggaacagaaacgagcatattggttgtgagcaaaacatggcaactgcgaacgctgctttgacaaccattttttgttgcaaggagttgaaaccagatgatgaatat

SEQ ID NO: 94057 - DNA, 715 bp, Oryza sativa
tactgagagagggataattgttcatatgctggataatgacgatgaagtgtcagctatgttcaccaggctcagcacacatttgatatttggttctgatacctaccactaccttcaaactttatcctatgttttggaggaccattaccaaagcaggctgaacagatggatggcttggctctggcgtaatcacttcagcaatccatggttagcattaggtgtgttggctgcagtggtcgtcctactctgtaccattgttcagaccatattaacagtcctagcctacaggcaaccccattgatgatggcatttttattctctttctaagtgaacacattcctatttcttgttcaatttggtactggtatatatgttatctggtgagaatactactgacaggtatgtatccaattgaaatatgatgctagagtaaagtgcaactcaccttagatcatcccggtataaagtgaaacacgatgtaatttacctggtgcgaagtataatgtactagaaaaacagtaatttgcatggtcttcgattagtaatgtgaaacctatcctacttaacattcttttcaaataatgagaattccctttgcaattgcgtgacttgacaccattacatgtttgtatttagagttagaattataatgtgtgcaatactgtgtttgttggttaaaataaaattgtacttctctcaacatttgttggataaatat

SEQ ID NO: 94058 - DNA, 712 bp, Oryza sativa
atctgaagtggctcagtgcgctgtctttggttaccacatgaagatactgggatgctgacaatcctcctcttacagttcttcatccgattatgctcactttcgagttgtatggctttgtccacaagtttctcaaaatcttcatattcctctaggagtagttgcactgcgatctcatcttttaacgcctggagaaacttctcttggatgtcttcatcattttccacatcttccggtgcatagtgagccaaacgatggaactcgtgcaggtactctgtgacggtcaaatcttcttgattcaggtagcggaactctcgttttctcagtgtgatcattcctgcgggaacatgtgatatcttgaatacagatgaaaactcgtcctaggtgatggtatgtccttctggccgtgatgcttcgtagctatcccaccattctgaagccagtccaaccaactgatgagttgcgaagacaacccgctcctggtttgtgcactgaaccaaccccagcttcttctcgactgtgcgcaaccaatcactgccttccataagatcgacggcaatggcaaaggttggagtcttagtttttagaaattctgataactggcactgttgctgcactggaggttcttgaacgtcggttgccctgcttgggtggttcaattctgaatagttgaaagggtttgccaacttttggtttgttaaccacaatttgaata

SEQ ID NO: 94059 - DNA, 705 bp, Oryza sativa
  unsure (1)..(705): unsure at all n locations
cttctgagtggtggctccactgaactttgcaaaacctgatcaccttgcttctggtctttctctcactggtctcaaggatacgaatcggcttctccacataagtcagatcttcctggatgtcaatgtgctctgagctagcttgttcctcaggtaccctcaaacacttcttcaattgagatacatgaaacacatcgtggattccaaccatattagatgggagctcaagctggtaagcgacttcacctcggcgttccaaaatcctgtatggtcccacaaagcgtggtgccaatttgcctttcgtttggaaccggtgtactcccctgagcggagtgacacgaaggtacacataatcccctgcttcgaaagtaagctctcttcggcggttatcagcataactcttctgccgagactgggcaattcttagcctttctctgacggttctgactttctcctctgcttcagttaatacttccgtcccaaacaattggcgttctccagtttgatcccagaagagcggagtgcggcattttcgtccgtacaacgcttaaacggtgccatttgcaaactggcttgataactggttgttgtaagagaattccccataagggagacttttattccatgctncaccaaaaatcaaccgcccacgcctcgcagcataatcttccaagatctgattgaccttttcggtctgcacatcaattg

SEQ ID NO: 94060 - DNA, 682 bp, Oryza sativa
tataggtgtactcatctcatcataataatccttcctaaagatggttagcgctagaaaagacaaggtcatcatccttgtagtaatataaagctcgtaaagactccaatagatattttgatcagcataataccacccaatatgtcttgcttctctaccaattccctcttcctagatgcgaaattatccataactacagacgtatgatctacttcacctttactgccgagctctgggcagagactttgacctaaagaacttaaagaatctgggagtagcttcaatgaatcacgaaacaccatcctcctgagtagtccctttggcgactaaacgcgctttgtaccgctcaatcgtacagtcggacttgcgtttggttttgtaaacccacaacctaccaattatattgtagttaggactaggtggtaccagtacccaagtgccattatttgcaagagctgaaatctctgaagccatagcagagcgccactgtggatgtttaacagcccctgaataacatgttggtttagtctcttgattggaaggaggcaatggatgcagggtagatgagtaggcaatgaaatcagggaatttctgaggtttcatagtgcgatctgtggttcgagtggtcataaagtgtgtcggttggtgagagtgttaacgacatggggaaggaggaggtggacct

SEQ ID NO: 94061 - DNA, 511 bp, Oryza sativa
gaacattgctctgaaagcgggaacgctttctcataaagagtaacagaacgaccgtgtagtgcgactgaagctcgcaataccataagtcgtttttgctcacgaatatcagaccagtcaaaaagtacaatggggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcgttttaagtgtaattcggggcagaattggtaaagagagtcgtgtaaaatatcgagttcgcacatcttgttgtctgattattgatttttcgcgaaaccatttgatcatatgacaagatgtgtatccaccttaacttaatgatttttaccaaaatcattaggggattcatca

SEQ ID NO: 94062 - DNA, 694 bp, Oryza sativa
tgcaagtagttcatcattggcttagttcttgtgtttcgatccaacaagtggtatcagagcattgttttcttctttggattttaactgatctagagttgttttgccatggctaataaatttacaactacgccccatgtcttcgatggaacggatttttcttcttggtgtagtaagatgcaatcttacattatggctgaggatcttgatatttggagaaaagtttctaatccttatgtgattcctgatcaaattaataatgctgctttaaaaattgaatttgaaaataattgcaaagctcgcaatattcttttgagtgggatttctcgttcggattatgatcgtgtttctcatcttcaaaccgctaatgagatttggattgttttgagtaattttcatcaaggaattaccaatattaaagaacttcatcgggatcttttaaaaaaggagtatataaaatttgagatgaaacctggagaagctttggatgactatctttctaggtttaacaaaattttgagttatcttagatctattgattgttcttatgatgttaattacacacaatctgaggtttctcgtcactttttgaatggtcttgacatgtctatttgggagatgaaacttacatcaattcaggagtatgttgtcacgcccgaaatttctatccaaaattccaaacgcttacatgtgtgtg

SEQ ID NO: 94063 - DNA, 642 bp, Oryza sativa
gcaagtagttcatcaatggtctacaccaggaatggtagccgcgcaacaggcgagggcagcaacggcgaagagcgcactgatggggcgcatccccacagcgattccggcaatggtccgccaccacttcccgagaatccgacgctagtccaagtaatggcacatcagacccagatgatggcagccatgatgcagcaccagcaccagcagatgcaccagcggatgctgcagcacgccgaacagcagcatcaacagtttggtccccctccccctcagtccaagttgccagagtttctacgtgtcaggccacccaccttctccagcaccaccaaccctatggaggcgaatgactggctccatgccatagagaagaagctgaatctcctgcaatgcaatgatcaggagaaggttgctttcgccacacaccagcttcaaggtcccgcgtcagcttggtgggacaatcacatggccacccgcccaccaggtactgaagtcacttgggtagagttctgccgtagcttcaggaaggcgcaagtgccagatggggttgtggcacaaaagaagagggaattccgggcactccatcagggcaacaggactgtgacagagtaccttcacgagttcaatcgcctcgcgcgatatgca

SEQ ID NO: 94064 - DNA, 646 bp, Oryza sativa
ttttctattaactcaatccctgcaacagtactttttgattctggtgcaacgcattcgttcatttcaaagaagtttgttgggatgcatgggttaataagagaggaacttagcacaccgatgcgggttcataccccagggaatagctccacttcggttcaattcagcccttctataacaatagaaattcaaagatcaccatttctagccaacctcattcttctcgaatccaaagacctagatgtcattcttgggatggattggctgaccaagtttaagggggtcatcgattgtgcgaatcgcacagtcaccttgaccaacgagaagggagaaaccgtggtgtacaaatcactagtctcaccaaagcaaggggtctctttgaatcagattgaagcagaaatcccagtggacaccgtggagaagaatttgaggaaattggaagatatacccatagtctgcgagtatccggaagtgttcctcgaagacctcactaccatgccacccaagagagagattgattccggattgacttggcaccgggaaccgccccaatttacaagagaccgtacagaatggcggccaacgaattagccgaggtcaagaagcaggttgatgagcagctgcagaaagggtacatgatgaactactg

SEQ ID NO: 94065 - DNA, 8103 bp, Oryza sativa
atatttaatagagattattggaaatataagcatttcaccacaatatttaactctgagataaacagactaaaccatgatagcgtaaatgtaaatcatgataacgtgaaccatagacggattactctcaataataagaatacacaaaatagacatggtatatgtgtaaaccaaagaaacaaaaatatctaactcatttgcgcataaaaactgaatcaaccgaaagcaacaaaagagaaaaataatatgcggtgttgtaacattatttgcaatggtagtgtaaggagaatttttctgttgccgttcccgccatcagaaccgctaccattgcactcccgttctcgccaacaatagttctcatgaagagaaagtagtcgatgtagtcgttcactggaaccagcgagcagtcgcatgatgtgctccaaaaacctaatccgccgcctcctctcagtgcaatatcaaggagacaagggttcccgaggcctgctttcctagtgctgtgcatacactcatggggataggaagacctagcaacggcattagtttgattcaaaggttttggcgtatccctcgtggtgagtaaacatgatgagtaatcagtccattttataggattactcaagaatatgaggaatagtcaaagagagggaaaacaatggacaattgattactcgcgtaacaatcatccatttctctcctactctaattgagtaacaaccgaaggcgaagggcaatggtcacttcgtttatgtcaacagtagttgtgcaatgtaaaccccatcgtttacttcaaaaccaactgcgtaacttaagctatccatatactagccgtgcaaagcaattatgcattgataacgacttcagtaatatgtctgatagtgttactgtatcttgatatttattggagatattgctatttagtggtaagaatagatgcatatagcaattatgcatactgcttggggtcagaattttttttttgtgaactttagttcctgtacagttgagttctgcatttgagtatgtcatcatatgagttgagtttcttttaatctaaatcgtagtacaatatccatatgaatttgacagaacagtgcatatattgttttttgcatgatgatgactttcttaacgataattaactggaagtttttctttcgatttattgtctatttatgttctttaagattaatcccttgaattattatgtttcactgtgctacatataaatataagtggtcaatcttacataccactaaaggtttcaaaagaaaaaaaaaatgtgactacctcttcatcctaagacattaggccctgttggggcagctcctgatattaaagtttctcccaaaatctccagctccccaaacggtccagatttcagaatttatagttatagaatccaataaataaactagaaacaatccaataaataaactagaaactagattttcactagctaaaaattgaatatcatgctaaaaatttgttacacacccaaaagcacagaaatattaatgccacgtctcatttttatataagagtccatgtcatataattaatttttgcattcaaaatcaacgtagaatacattacacagtttacttacattaatcttttgtaagtattctgagccatgcagtgaaaatttcttttatacgacatggtgattactgaaaattgtgacataacttttaggtaatggaatttgagtttttgtggcatctgcaacaaaacaacaaatgtttttagttgttgtgctgagtcatcatcctgtcacatgttcaactcttctccaaaccaagctaaaaaacaatactccaaagctcaactattttttaacaatcctatcgtgacatggtcgatgaagaagctttgcaatggaaacttctagaattattttgtacaagttagttggtgaagcgtatacatacaaaaaaaaaagcacaaaatgatgcatatttgtatgactttctttttcattttgtcagaggcaagctgaaaagttctagccaggaacaaacatcagaagttaagaagaaaattctagggacaaatgtgccctactactatgaaaaagcagatgaaaggataggaacagatcagaaaggaaagcctaatatccacaaaaacatagaatattatcaatcgtttaagagaaatgaagtaatatatctgacaatttactataccttaagatttatcagagatggtgctatttagtgataagaataatagcataaacgatgcagtcatgcatgtcggcttggattttaggatttttttctgtgtttgtgaaatttagtttccacactatttgattttgcatctgagattggcatgaaaaatacatgttgagtttttttcatctaagttgctgtcaatctccatttgaattcgacattacaatatatatgataattgttctacatgatgttgaataaattggaaacttctttgaactaatattttctagttatatgttcctcaagcaagtcattcatatactatcatggttcattatgtttcatattaaaaacataaaaatactacaaatatacaaaatcaactgaattgtatagacattcaattattctctgactttgcatttgtacataattggtcttacatactgacttatcaaggtcgatcctgagctcctttaatttgtaatgcagggatgcaagattcatgttagaactggttaccagttcaattttctacattccctatttaaactcacacattatgaatcaaaagcatgagattgagcattattaattgtaacaattatttaacatggccgatataagcatcttctgaatagaaagttgttgaaccatactcccgatgcatgacacactatcgacggttgaacctgaaaaaaaaaaagaacaggttgcatgacatctcttcatattaaagctctcatcatagaaaagagacagacagatgaacctccaccggaagcaatgcatacataccaacttgaaaaaaataaataaagagaaagatgaactccaggtagcaaaaaataaaaaatattccctcctcctcccctgccacagctaacaccactcaacaacataaaagaaagaggacagaggaattgaaaaggactagctaagctagggcaagttgggaggaggagagactacttcaggctttggctaatatatggcatcacatgattggatgtcatggtttttattcctcatcttgtgaagcgtcagagaagtttaatagtatagctaactaatagctattatctcatgttatagctaacatatacagtagattaattaacttataaggttggctcaatttaatttttctctcatctttctttctcactacgaatttagcgtaaatatcttaaaacatgtgtatagttagttctatcatgaaaaccaactctcgtcacttttctttatctctctttcatataagtttatagttatcgtatatctcactatatataatcctgcatatgctacctcagcagctagcaaattaaggagagaatagttaaacagccatagggcaggtcagctccaagctaggggcgctgatcgagcagctggtggtggccacgttccggcgcgtgctggcacgggcacctcacgcggcggcgcgagcgctgccacgcagctgtgctgtccaagctcgccgtcgagattggctaggatttcgatggtttgttagagaataaaatatgattaatattttatgtgtgacttgtcattttaatttttttttatatttttttcaaataaaacggacggtcaaacgttgaatagaaaattagggtttgtcgtttttttaatggagagattacgtcacttcaccggccagtttgttttaatttactgccagaatgtatgcggtacggtggctgctgttgcattgcatcaggttaggagatttcatcaggaagataacatataagtatatcgtcagcactcagcaaatggcaaagttgcagccgttgtgctgaccgcggccttcgttcgactctattctcgactgcgttcacccaacttagcgagtgttatctaggggtataaagttttggcgtgtcacattgggtattatatagggtgtcgtatggggtgtttgggcgctaataaaaaaactaattacggaatccgtcggtaaaccgcgagacgaatttattaagcctaattaatccgtcattagcaaatatttactgtagcaccacattgtcaaatcatggagcaataggcttaaaagattcgtctcgcaaattagtcgcactatgtgcaattagttagcatatatttaatacttcatgtaggtgttcaaacgttcgatgcgatatggtgtaaaattttagtgtgggatctaaacacccccttaataaaattcacactggggttttccccatgcctcttcatctaatatctgtgaaatggcatccattggttaccgtgctcaagtagcatcactgaaaaaaaaattcacttgccgatccttataaaaatacgtgtcaaaatttgacctatagaggatgggccctcgtgtaggagcaggggcctaggtttgtggctttactcaaccggtttggttaaaagtttattcttcttaacaaaaagccatggggtggtcatttctccgttggtcgagtttatttctctagcaaattttaaaattgtgcatacaccatatggcaagatgtagtaagtgtgctgcctgcggcccatactcaaatctccataacactcttactctcaataaaattatcgttaggtttctccttttgtacgggtcttttcaagtaaatttcacaaaattgtagattctttaaccaaactatcacaaatatatatagagagagagagaaagatcgaagatattgtatcataaaactatagacttggtattaaatttattagaaaactacgtatttaagatgtctctgtcgatggggaataccctagaccggatgaatagggtattagggtacgttggtatgaggatctacacgatacgacctcaagcaaacaagaagacaaggattatactggtttaagcccctcgtaaggtaatagccctaatccagtttatatgagattaatatggaaagaccatagattacaatagagaactggcgattccgagattaccggcgagatcccttgtcgagatggtttcgacgagatctcccggcgggtaggtttcacgtcctcttgtaggctatggtggttgtgttggcactatgattcgatcccccaaccccttaggaggtgtgccttttataccgtgaatcacctcagtttccaagtagaactcggaaactatggacccgtacgatataatataaacctaaacctaatcctctccgagaaggactatgatattcacttgtctgtgaatataatttccacaatatcttgttaatttccttatcatatatgaaaatcatatcatacgcacgaaggtataccgtatccgtatattccataagtcatatgataggaggtatgccttatccgtaaccatgacagtatcagagaactacagattaagcattaactttataaaaaaattatattattttaaagctaagtatcagaaaactactgaccctagagtataaaactctatcactacttctatgttggagctataaacggtgtaactttacaaactaaacctgtagttttattataactttaatattaaatttgtagttttataatacctcatcttaattaaatatgtatttccgtggtaaattactactaaatgtttagtacaacactttaaacttatttttttgataatttaattcaagtatccgttaattttacgaaatttattttctctctctctcgatcatcagcaagatagtaaggcatgttttgtgcatgcagattcatgctgagcttgatctgacaagagaaccatcgaatacagtatactcgtagtcgcatcagatgttcacatcagtgatggcgagttaaaggttttggatgtgtctgcaggctgcagctctgcatgcgtatgattaactgaacatttaagtatttgacaggctcaaaccatgccaccaatgtgttcaggtaatggtccgacgtgtgatcagttccggcctggccagacatgcacacatatgatgccctttatttctttttcagatgaaaggcatggaaaggtttctctccaggatattgccgggtagaatgtagcatttgcttagagtcattagaaaataaagaaaagtttaatccttaacagtctagggatgaaatatggatgtgctctcaaattaagttcagctcttaatgcatgtgctcgagtcgcacgttcaaaatacatgattaaaaaaatagaggaaagaactcaaatttataacacagaaatgatcattcgattagaccatggaaaaatacaggaattatatgagagatactctaaggggattgtcccagagatttgagctcttattatttttctccaaaatctctatataattgtctatttcataggaatttcaagcaaaatgatagaattcaatccttcgtttccaatatttatatatgattttttcaataggattaaaatcatccaaactccctatgcctttccttttcctgcaaattaaagggaccattatggaaaccaaatcgatttctaggttttccagctgaaaataattggttttctctacttccatcacatctataagattaatctgcatagtcatgtaaatgtgaatcttttctaaaattcgtatccttggcacttgtttgtgcacatgcccgctcaacacagcggcagtatgataaccaagacacatacgcatatcagacaaaaaaaaacagtctatccgtactaaaacagataaacagaccactcaagtctgaaacgaacatttcctaaagattcagaaattctagttctttgtttactcctagcttcctttcatttcactgttctgtcacaaatcacaggaaacaaaatactcatcgccattaacaggaaaatatttctacagtttcctttgcctacagatttctatttgcaagtgttcactgttcagcatacaagttaaagggcatggtggagctacagattacgccagctatgtacaacacatacataggttcccaatgtttgtagccgttagatcagaaagtaattaggtcatcgtttcctagaccgctgcttgacatcaaactagttgtcttcgtcgagctcatcatcaatatcatcaagaattgactggttaatcttctttcttgatacccttctgtgctttttgagttgaagacgaggctctgcttgctttacacccatgacacctgttttgtatctgaagcaagacgtatatgttttcattgttaggaacttaggatagcaagatttagcatatcaatatcccatcttaaatagaaactgtgacacaagatcaatatcaaggtgaaaaatcgtatgcgagttatgtgattttttttctttttcagttaaggccagtacagatcaatatattttctcacaaagtatagattgtggatttgtggagcaccgtcactcttgcataggtggagctagctaggtggcactgtggtccatgaaacatattatgatttgactcaaggttataactatagtatatatattgcctaacatcataaaaagttacatatggaccaccatttgatctggctcattacatctagatggaccacctttgctctaaatccaagctacgccactcttggtggacatagaatttgaaaaccatggcttaaagaacataaacattgtcattggtgtaaaaagtaaatttagcttcataagtcatcaaacctaacaccgtactagtgcaagagaaggcatgaaacatccatcacgaaaaataattaagaaataaatacatcttgatagcatacctgacatcaccctctctttttgttccaaatgttcttaactggaatgattctctgattttgatttcatcaagcaactgtagatagtatggatacctttcccagtcacctttcacaacacatccacgctcaccaaggtgaacacagtcattaaataaacattttgagggctcattctctgcaagcatct

SEQ ID NO: 94066 - DNA, 3687 bp, Oryza sativa
aatgaaacatgacgtgttgtgtgctttcctttaccgcttttcttcgacccggtaccgacccgttgttccccaaaccatttcctattctgaaagcgatgtgcgcaagaaagagacttcagtgtccacatcaagaaaggatttgacactgttagattttacaggaacaacttgcgtcattttataacaatgataggagaagaagatgccaaatctaactgacgtatgatttctaaggtgtcgagaatttctaggatgttcatatcaagtgtgggtcacgttacatcattctgattctttgcacgattagtgcctctccaagccaaacttaacaaataatgtgtgaatccctaacattattgtcagcatttaactattaagaatgactaatcgatcactctgtagtagggagcacatggtttttttttattagccatgcaacatggatggtaaagtgcatgtcccaaaatgcaatatactatctattacttttagttctaaatttatgtgttttactccaatccaagattcagaatttctttcaagaatcatcttcattacaacaagactaagaaggtaaatcgatagcaaatattaactggttatatttgtcaacagcttgtccacttgttgcactcaatctttcagtttgctgcaaaccatcttcgtttttgttgcaatgaagttttagctttgcttcatgaaacatggctatatgggaatgacagtactgggcatatatatatataaatcggttccgactgttgcagtaggaattttctttagtgcatatcataacttcttttattgctggaactatgttttgttgcaatagcatattcacctctttatgtgggagagcccttttttttttcttattgcaactaatatgctatttgttgtggaagaaatttccttattttcttagcctatatgatttgttgttatcattgtccctacatatatttgtcacaattgtatatttggtttacttgtatggcacataaaaaggagtagaaagataaggggaaccttctctgtgataacatgaaaaaaaaatcatatgtaaacatgccaggcccaccaaaaaaaatccatcataatagtggaggcagaaatatcaatgttagacccatcagaaaatgttgaaaacttgtagcagttattcgcccataagaaacctattactgaaagcatgtgcaaaaggaagctcataagaaataacacgaaattttaattgatgaaatatgcagcaagttgctttcgtttttgcacgaaaagaaggctacagcttgcaattctattaacagaaagtgcatactcgttttctctgcgacacatgtgcaccatagataacctatgatgacactacatttgcaagtcaaaattagccctcaattcttaataagatgcaaagtttaataaaattcataatccaataggcaggatcttgtgggtagctaaaatccattaaatgcagtccgaggagctcatcactaattcgttacccaacaaagagcaaagaaacaatcactaaaaatgtaaaaggtcagagtggaagggtaattgttgaaataattgaagcaggtaaaggaaatgaatgacataatagctacctgctcaactagtttatgtatgggatcttcttctgagatgttctggttgcttctcaaagcattgatcagactggactttccaacaccgcttggaccaacaattacagttgtctgtccttccaatgtttcttcaagagcggataatcctgatttctgatcaacacttaaaaatagtggatcgtatccccaactcttcatcctatctctccagtatgatatggtctgcatacagattaatataagtaatgatctgaactatgtaaatatgaagtgaggaaaaacatgagacagcacacaataaatggactatcctgtaaaaaacaagtggaactatgattccatcatgatgatttaaaaaataatggagaaaattatataatgtttaagtaaaaaagatgtactcatgtacaggcatctgagtgttttagtaaacataccagcatcaaacttagcgcccattgttagcatttaccattatcagctaaacacaaagaacataaacactattgtttggtgaatcgaaaggaacatggtccccaggatgtctagattaatgtgtacatgttggatgaatcagggaatcaatattatgtcccaaccatgcttactattggcctgtttggtcttttactcaaaaaggttcccgtagtggcacatttgcataacaaagtatttagttgaaagtcacacgacatccatctgatacagctaaaataacatttctttcattcaacatgagaacaccagagcaacagaaaaaggtggttgctgttcctgatatacttttgtcccttcaatttttcttagagaaatgaatgtccaattctgataaaaaggaagttgaaccagtgatatgtatgctattgtgctgagcatattagtcccactggctcagtgagtcagtgcaaccatcttcaatcttcctaagaagtaaacgcaccaggcgccagggacaacacccaatgtcctattgaaactgaaataagttcttcctctacattttcaagacacctaatgccctattgaaaataagttcttcctctacattttcaagggcagcggtgatcccaaaacggggcacggtgggctcaagcccctcctacagttggtcaatcgagcatataatatatatttcaattgtagacatgtttatgcttgctagagagaaggaaaggtaaacaatgaaaacataatttggttctctaatttttttaacaactactacctctgtttcaggttataagattcattaacatatatataaatgtggacaatgctagaaagtcttataatatgaaacggaggaagtactatatattcccatgtatacttatattagtttacctcgttccattggcaaccccctaaaatttggtcctacgttccccactgttcagggggaaaacatttcatttgtctcttatatattgacgatgtcatggcaaattacgaaatgagcatcagtacatcataatccgtagttcaatcaccaatgcaatgaagaatgaactatacagcgcaacaaagaggtaacaatttagtaagcaattgaaatcgaagaagcaattgttggctaccttgtcgtccacaagctcgaccttgttgaagacgagcacgaaaggtatcccggtggactcggcgtcgacgaggaacctggtgagcgtagcgggctcgggctggggctggtcgagggcgaagaggaggacgaggcggtcgacgttggcgacgggcgggtcggccacctcggcgcggcgctcgaagacgccctcgatcaccccgcggccgccggcccagtcgacggccccgatgagcaccctgtccccgacgaggacgcggcggcggatcttcttgaggagggcgcgcaccacgcacagcaggtccccggccgggcgcgccccctccaccccgcgcggggcggcgccgacgatcacccgcatgaagttggcctgcgacgccgccaccagccccgtcgcctggtccgggagcagctcgtccggggatgacggcggcggggggaggggcgccgccgcccccacggggagcaaccgcaggtggagggggccctggtgggagg

SEQ ID NO: 94067 - DNA, 748 bp, Oryza sativa
  unsure (1)..(748): unsure at all n locations
ccgcgcctgattgagatntcgatttgaaagaaagcaccccatcagnatagtggaatcctttaacgccgtcagctccctgattctgggtcaatctgaaaactttattgcctataaagatatcctcggcaaaatctcccgtaatcgtatgtacaccatggctgccacggcaatgtgcaccgagtcgatgtccatcgttggtgcatacatgaccatgctggaaccgaaatacgtcgttgctgcgctggtactgaacatgttcagcacctttatcgtgctgtcgctgatcaatccttaccgtgttgatgccagtgaagaaaacattcagatgtccaacctgcacgaaggtcagagcttcttccaaatgctgggtgaatacattctggcaggtttcaaagttgccattatcgttgccgcgatgctgattggctttatcgccctgatcgccgcgctgaacgcactgttttgcaccgttactggcttatttggctacagcatctnctttcaggggcttctgggctacatcttctattcgattgcatgggtgatgggtgttctttcagtgaacactgcaagtgggcagattatggcgccaaactggtttcaacaagttgtgggaagatgatttgagaaattggtgccgcttcttcgcggctgaagcatcatttgggttctgggttctcggtactctctcattcggatattgagtgcaattaaggcttatgagagcaggtactggtttttccttagg

SEQ ID NO: 94068 - DNA, 601 bp, Oryza sativa
  unsure (1)..(601): unsure at all n locations
cgccccctttgaaccctttgattagcttctactgcaagtacttcatcattgcaattcctagtgaggtacttaaaaaacttgattaccttcgatctaggttttattggcaaggggatggacataagaagaaataccggcttgctaagtgggacattatttgtcgtcccaaagaacaaggggggctaggaattcatgacctcgagataaagaataaagcgttgattagtaagtggttatacaaactacttaccaccgatggaatatggcaacaaccgctacgcaataaatatttgggatcacaacatttatctcaagcctattggaaagcggggggattcacatttttgggctagtcttatgaaggtcaaacatgatttttccgttttggatccttnanaaagaggcgcagctcccaagttannttctgnaaaacaaatggttgggtaatgcctcgntaagagaacagtatccgtgtctctataacatagttaggcataaacagtcgactatcgcacagattttccaaacccaatcccccgtgctttttcatggcgacgggnatttaattggtgcaaaactagctgcttggcataccctatgg

SEQ ID NO: 94069 - DNA, 1465 bp, Oryza sativa
ccctcccctcgctgacgtcagccttgggctttattgcgcaataaattgattaaggacttttctttattagtaaaaacacagtttatcttctaaaattcataagtaattcatccgagctccgtttaagtccattcaagtctcagtaaatcaagaaaaatgcaaagaatccattaaaaatggttttgttccctgtttcagtagtcttatagcctgttttgcttgtgtgctttgtttgtcgcgtaggtttcggccgttttgtcgatccacggtttctcgaagacgttgctgaggtctcgtcagtgcgagagcaaggcaagtcatgaaatacgtttgatcatattgtacccaatttacaaatatcccgcatttctattaaatgttgcattcttttacaatgtaatgtgggatgggtcctaatcctcagccacatattgtttaccatatgccgttgataacttgggtatcaaaatgactagatgttggtttaggaaatgcttagccatgcttagttcaactagcacacaaatggggatcaccttattacatagactttgtctattggcatagctttagattggtgccaccgcaatggtgttagttaattaaaatacactgaatggtgggctgtgggtgcatggttttgctggtcgcacccatggcagttaaggaccggttcacgggaaaccctgggagacttaccgtgctttccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatgattaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcattcctagtttagcttaatgaactggtgtagttcaggtggttggttgggcctgttgcaacgtggggtagcgttggacagtgtttggttaatattgattaattactacaactgttttactgccttcaactactgtttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttagtcgctgccgtcaaggattgcctgtggagtggagtcgcccgctgctgaagt

SEQ ID NO: 94070 - DNA, 624 bp, Oryza sativa
gtgaattgaatttaggtgacactatagaagagctatgacgtcgcatgcacgcgtacgtaagcttggatcctctagagcggccgcctactactactatacggctgcgagaagacgacagaagggctaaatccatgaagtttgtggatggcctgatgatccacagcggagaccctgttaactactacgttgacactgctgtgcgccacgtgttgctcagacagggtgtgctgggcatcaaggtgaagatcatgctgccctgggacccaactggtaagattggccctaagaagcccctgcctgaccacgtgagcattgtggaacccaaagatgagatactgcccaccacccccatctcagaacagaagggtgggaagccagagccgcctgccatgccccagccagtccccacagcataacagggtctccttggcagctgtattctggagtctggatgttgctctctaaagacctttaataaaattttgtacaaagacgaaaaaaaaaaaaaaaaaaaaaaaaaaaaaagtcgtatcgatgtcgagcgatcatgatgatgatgtcgacccgggaattccggaccggtacctgcaggcgtaccagctttccctatagtgagtcgtatta

SEQ ID NO: 94071 - DNA, 2118 bp, Oryza sativa
cgctgcacgtgctcgaccccttcgcggctgcggccgtgcccgccgctaccgaggctccgttcggggaggccgccatcgccgtggtcggagcggcgacggaggaggcaacctcgacgctgatcgacgactccccgcagcaagcagctgccccaccatctcctcctgctacttcttctgtctttgccaactggatctggactccacgacgccaccgcagctgtccaccttgccaacgccactacacccggtgcaccacctcgtgccctcgtgagccacgcccatgccgctgcgtcgcctctgccatcaccactgtgcacccatccttccttctcttcgaagccactgcaataaaatcccccacaaaaaatccccaaacacatcatcctccccatttcacttaccattcaccgccgccaccatcgcctcccagtccccaccatcggcccgagcgccgccccgcgcgcggctattaggcccgcacaggcgctgcctccgcctccgccgaaaccgccgtcgccgccggtttcttcttcctccggggcgccgcctcctcgcgcgctcctttgactagccgtcttcatcaggccgtcgttatcgcgtcgtggccgccttcgggcgccaaccgcctatgcctcgccgccaccatcgcctccccagtccccaccatcggcccgagcgccaccccgcgcgcggccagtcggcccgcacgggcgccgcctccgcctccgccgaaaccgcctctgccttgccgcccttctcggtcgccgcgccggccgccatcgccgtcgccgcgccgactgccgccgtcgccacgcccatcgccgcccagcgccggctctgtctcagcatcgacaggaagagcagagagaagaatcgagaggagaagaaaacgagaagaagggaaaacgtgggtcccaccatttttttattattttctgtgtgagaatgacatgtgggtcccactacgctgagtcagcttgtcaaccgggtcaacaacgccacgtcggacgaaaccgccagcaaaaccactgagggaggtgatttgctctggtttgagagatgaaggagacgttatacccggttttccggttgggggatgttatttacacaagcacaagagatgagggacgcacaatggacttattccatcaacagccggtggaacacacggaaaagttttaggccggcctaatcgactgtatgtaagcagttgggcccatcatgatatctctcgggaataagttcaccggaggtccctcgaggtcccttaacctcgccctaaactcattcacaggagctcccttggcagtataggtggtttcgcgtacgtggcaccctagtcagaaaaataaataaataaagtacgtggggcccacatgtaagtgagagaaaacggtgcgggccccacatcccttctattttcccctttcttctcttctatcgtcttcttcgacgaccgagacgggtggggcaacggccggcgagagcggcggcggcggcggagggcgagtgtggccgcggcaggcgaagctggcaagagcgactgcgggcgaccccggcgggaggtgggggcgggatccaggacgggctcctgctccgggaggggattcccgcggtgacggatatgtcgccgccggtggcggaggaatcaaaagggggtggcggtcgaatgccgagcgcccaaggtcgggcatgagcttgccggggatgctcatgaggtcgaagaacggcaggtcgccgggctatgggcagaacggagacgggcggcgcggcggcacgcgaagcggcgttggacggcggcgggcgagcggaaggcaagcgcgacgggctgtgggcagagcggacggcaagcgagcggacgagcatggcaggcggaggagggggccgcaacggcggaggtggccgaaggaggagcgtggcggcctactccgccggtcgcgtcgtcgttggcggcgagagcggcacacaaagtggacagagcgaacgagcacgtcgttcttgccgctggtacccgtcgccgccgtcgcactccttggaggagcccagcgtggtggcgtgccgcagcggcgggaacggacggagcggggggagatgaggccggcgggaggggggaaagag

SEQ ID NO: 94072 - DNA, 1128 bp, Oryza sativa
ggcctgttgtcgtcaggcacgatcatccaacatgagtggttgtgtgctattgattcagctgtggatgtggttaagactaccggttggaaggcttaagtggaggcaaagctttactccttgcccctacaatgagccagacatggagaagacagtggcctacctttttgagagtactaccactgcacatgctcaccgggatgtggcatacaagcatcatgtcaatgagatggactgcttacagcctcaacatgtaaatacttccaatatcacttctagttagacatttacttctttaattgatatactaaccaacgacatctcttcaacttttgcagattgagtggttaccatacatacaaatgaggcttcaagcctgaccctgaactcgatgtgcaatcgagactctgactacttcatgtaccagtgcccattgatttgtttttgggcagttgagtaccaccttccgcaccgtgtcatgcgaaagttcgggaagaaacaagactggccggttgaggacatctcaactagagttgaattacacaagtaaatatttcttatctttgtttgctttcattgtcaatgttcaattttgtaccatttaacccttgtcgatgctcactattgtttcatcaccttccacttgtctaggtatgacagggtgagaacaaagaaggtgaaagactgggggctagagcataacagatacattgatgaatggaggacagccggaaggaacgacaggtacatcgagactatacaccaaaatcatcttttctcagagtaccttcgttggctgctcctataatgctgctctcctttggccgattgctctgatcattcccaaccaggcatatactgggctgaacactgttctggttaattacttggggtacggggcggcggagtttttttttttttttgtcggtaaacacatctaccgattgttcctgagtccatccgaagatactcattttatgatttattgatgcgggaataatctattttttcgaagaaacatcacttgggaatttttgccgtatcactgaccgcggctagctaaaacaaggtgcaaagtaagaatgcgtgccgaaatgcttaacctgctcatgatgggaatgacaagtgttg

SEQ ID NO: 94073 - DNA, 561 bp, Oryza sativa
tgcaagcagctcatcatggaattgcatttcatgaataatttaaatagaaaaatgtttttaaatcctccttttggctttgggccgaaagacggcccaaaacctctctctttctctctccctccccggcccagtcggcctagtccgccgcgccccttcctcctctctctcggccgctgacaggtgggtcccacctgtcaggttcgtctttctcgcgccgccgccgccgcccgaaccctagccgagccgggccgccgtctccttccaaattcggccgcgtctttcccgatcgggtgaaattgattgagggcaaatgatccttgagatctcctctatcttttctcttatggaatcatgagctaattcgggttggaaatccggggattcgagtttgattcggatcgatctctctcctctaacctaaatctttccttctcgccgccggtcgccgtgggcctccgccgccgctcgctagcccctttaaaaggacccccgagctctcctttaaccgccgccaccctcgctttgcctctcgtggcttggagcgccctagcgccgtgccgc

SEQ ID NO: 94074 - DNA, 7272 bp, Oryza sativa
cccactcccacctcaacccgggaccttaacccgtaaggtcctcaaccggagtctagggtctcgtcggcgctgaagaagaaagaaggtcgccgaagttggaggagaaggcctggagtacgaatcgcaaagttcatccggtggaccaaaatctgcaagtttttgaggtagattttctttcaacagatcgttagcattcccataatattaaatggaggaagcactaaagtgatgttgtgtaaaaaggatggcgattaagatacagtgatatatggagttcattcttcacaagtagggatggcagtcgggcatgacaggcacgggtagagactacccatacccgtgcccacgaggtaattcatgcctgcgggcatacccgttactatatgacgggcaaggaacactacccatgccccgttgcccgcgagcgccatgtgcccgcgggcatgcccatttacccatcacaaactcacagttcaacatttcaaccacaaatctccacaagcagagagacattatcacaatttaaagaaagggtagagttgtaccaagttcaacaatacaagcattacaagttcatcaatactagatggtggcatttatactaatttgactgagggaccacatgtcagttgattttcgcgggtaaacgggcgaagcgggcatgggtagtgactacccatgcccgtgcccgtatgcccgttgggtataggttttgacccaataaaaaacccataggtactaaatgtagaacaaacccaactctattagggtttttacccatggataaacgggttaaattgccatccctattcacaaggtaccaactttggtgtttgggattattttagaaaaaatggtgttttcagggggcagagccagagtgtagtcaccgcctcaccggaagtctgggctggtcgacgctgagagccttttaattacttccgttgttaaaatcatcttttgaatgggtgtgcatgtatgtatttataagagtgaacatgcacgtgttacgagtgttcgtgtttctactgtgctcttgtaaaaaaaacagtctatactaggaagacgactcacagtggcgcagctaggggggtgccaaagggtgccaacaccccctatgcaaacactgccaccattacaccccatgtttttactctatattaaggttaactaagataagtatttatctaatttattttgtgtagcttgaaagtattatcagtttagttagttagcaagtctaaaaatattagcaagaaatatgatctacaaaattagtttgtgatttctcgtctttttcaaagtaaaatagatgatacttatttgtgagattattcaatattatttgtgagattattcaatagtttacattaaaagaatttagtaataaagagtagtttcatacttccaatgatattattaaatagctaaaattcaagtttttcttaaaggactactttacgcattacttgttattgatggtgactatttgacatcttttgctatcaatattagttattcgatctcatgatttatctttacccccacacccctctaatctcaaatcctgcttcgcccctgacgactcatgtgctttattagtgcgtggtgcgattggaattggtacgtttgctttcctttttcaactctggacattggccgttacagtacatccatcgctttgcaaagcgcgtcccgtgccttcagatcgttggcacaggccaggaccagccaaaaaggagaagaactgcatgcctatgttttcggttacctccgcctccgcgctggcgcgctgcgcttgtcaaccagggtaaaatctaatcttagggcatgtacaatgttctttattagtggtctctctctattgacatataagtaaatttgatgacatggaagaaagagaaaggagaaaaaagaaatatggttgttatgcacgacaacggcttagagtcgactctagcatttattaaagcaaattttgttacatagtggtgaaagaaaggaaagaatagtaaaaaaatattttgatacattaatgattagagtccatattgtctccaactattgtactccctccgtttcgaaatgtttgacaccgttgactttttagcacatgtttgaccgttcgtcttattcaaaaacttttgtgaaatatgtaaaattatatgcctacatcaaaatatatttaacaatgaatcaaatgatagaaaaagaattaataattacttaaattttttgaataagactatcagggttatggataccacatacctaatagtacttgactaaatctcggcaggatccaccacataccatatcttatatggaaactgacctcgagggagttccggataaggaaagacaaccagagttctacatggaaatgacaatgactactcggattgtatccatattggtttccctagttctacttggacaaggggacacctatgggtataaatacaagccccaagccccccttggaggagagaggacacgagagaatcaacacccaccatggaggatcaacacctaacacaatcgacatagaagcctacatacgccaagacacgccgccggatatcgacttcagggataagcacggctagtaccctacggtgtctccggatactgtcaggagagacaaaagcgctatctctgatctcgccgggcacagattcgaggaggaaggctaccatgttgtcgactacgagtcagaccttcaaaccgtcatgtcgataacagttagataggctatcccaaatattgtacttgtgtgattatggtgaataagagcaacgaccggctccggccaacaggatgtagggttattacctgacaattcaggggcccgaatctatataaaaatcctcgtctccgtctcgcatatatcctagcaccaacgatccccatactatgaaataccaggattgcaacatcaaacgtcgacaaagacgaacggtcaaacctgtgctaaaaagtcaacggcgtcaaatatttcgaaacggagggagtatgatgctagcctctaaatagcgtagagctcatacctgactctacttttatacatgcccttagcatgtaccgtctaatcggtacgcgtaacacacttgctatatatttcccgcgccgtggcccgtccgtgcctgccgcacctgcagtcctgcacacgcattggcccgtcaggacaccgggcggcggctcgacgggatgcgctcggtttccccccagaagagagcagcaaatcgccggcttgtggcatggtggcctttcgcctccgccgacgtgcggaccgcgacgctgagcgcggtgaacccgcgccccgcgaatgtaaggcgccggcccaccactgccaccccggtgcgtgacgacgggctgacggcccatgacggtgcggagcccatcgaccgagcggatgcgcacggatgcaacgcggcccaggcgcacgctgttgcgtgcgtgcgtcgtccctgcggttagctcgcttgctccgtgtccgcgtgtcacgtcacgtggtgtatcacccggttgcgagcgtcgtacgcggacgcggtgcgtagtacaataccaattctactacgacggattaggccggaatcaatggcccgtgcctgtcagcccaaaagattcacctggccgtgtaaagcgcctgccacctgcagctcatgctccgacggctgtcgcagggctcgcctgacacgtgttgagcccggcgacaggtatattcagatccgctacctagctagctttgctatcgggttggactctctgcaagtccggcacatgcatgatattcaaccgggggctcacacgatctcttaaaccgttcgtgtagattattagtcgtcgcctactcgcctgtagtactactccgagtatagattaattaatcgaaccgctgcaacgacactcgcgcacaacacatgcattcgctggacgtgtgcgtgggtgtgggcggccgggaggcccggacaccggacacccgcgcgcgtgcagcgaagaaacgcgagggccggccgcatgcacacgcacgggcgggcgcaagatacaggagcataccgacgagcaaccgctttgttgggtagtagcttcgtcgccgagagcacgtacacaagcatgcatgcatgtaaagaggtggtcctgtatagcctaattttgtctcagctccttggacggagccgtgcgacgaccctgtgactatccgatcgtaacccagattattataaaaaaaatcatatatatctaattaagctacgcgcgtaaccgagggagttaaacgtgtacgtgcaccgatcacaggtaggttaatatactgtacttagtaaaaaatcactgcgagggagagactaacatgtgtgtgtacgttttgtttttacttttcaccgctgcatgcacgatggcgtccggtttgacggtcaaagcttcggcaggaagcgcgggaaccgagcgcccggaccggtcctggcgcccaatattctactcgcgcgccgcgaatactctactggtgccgtcgtactacgcactacgccgaggaggatcccatgcacagtagcgccaccaccgcacacgcacgcacgcacgcacgcatatgtgtgtgcaccgcatggggaaccggcctgcccggctccccccccctcctcctcctcacgtgcaccgtggaaaacaccaacaccaagcatcccttattgcagaggaccatgccttgcatgtgtcaaccgctgcatctgcatgaggcaagacagtgagttcagcagccagccagcgtgagacaatctgcatgctgtgcccagcaaccgacattttcctctctctgcagggcagaatcacggaagctagccctgtgtatttacattgatcaatgctagattcgcaagttggtaggtagagagacctgctgcatatggttattcctcttctgcgtacgtgtagagctacccagcgtaattggtaaccaacgaggaatgtgaaaatagcgtggctgacaaacaaagcttgcgcagagtactgttggtaagtcctgccaatacacacacacacacatgatgggtttggatatgacggcaagcatgcaatttgtagttctatacctgcggagatagactcatagaggagcaagttgttggcagatggtatgatgatcgaggtcacctgttgtagctacttatatcccaatgaccagcctagccattagctaactatagctagttgcaagcgagatagcattattaacattctccctgtaatcatgtatatgcatggtcctggagctctgcacatgcacggctagctccccggccggggcgtgatatgagggatcgaggagaggacgggaagctggggctgatcaggcaggcatgttccgtagaaacgttcatggcactcctctcctagctctctctctctctctctctctctctctctctctctctctgcatatgctgcgtgcgtgtaggcactgttcattcctccgtccccagctggtgtgtgtgtgcatgcccggaagacaagggtgtgtgtccttgtagagggcacagcttgcaaccccagctcccctactttattcggggtcaccgtgacctttctttagggttaacctttctcgctctttggggttagctgggcgtttctcgatacggagagagagaagagagagagagagagagagaggagaggcccgagtgatgcggggaagacagtgggtttggatcatttgattatagtaccaaggaatgatcaagaaagataaacagtggagtgaatataatatgctcagagtgagattcacaccagattgacactttctgttctagtcttgcattttcagaatatagcaagtaggttttcaaatgtacctgtacgtgcatattggatagatttctttaaagagttctataagaaacattgatgcttttgcattagccttgaagttttacgttttcacctattcgcttaagaatttaatatctaaaataaatcacctcattttttttgaaaactatcaaatataactgtagtttaattgtagtataattacaatctaactatacaataaatgtatatattataacttagtttcatataacctgtacatataagttttataaaatttataatgtaattacactatagttataatgtagtagctgtgtaatacagttatagtacaatgcagtatatttatatttgaaaaaaatacctaaaatattgtgacaatttttagcaattcacctttgcttagagcgacatcgctccatgcaataatggcagaagaaccatctccactcccttcaggggggctctttttctattatgggtggccatctagataaaaaaaacttatgagagatatatggtgattttctctttcaatttgttgaaaggagttgaaggtttttgttccactcccttcttttgttatcgtaatatttaataaaaacaaaaaagtattttaacctacatatatgtaaattaattgcatattatgcctaacttaccaaatgccttaaagatacatagacgaaaacacaatagtagcttacaaacactcattgcacatatgttgaagtgtcacatcacgcaatccaaggggcatacaaatacacaagttagagcaagtttaatagtatagccaacttgacggagctcgtggctcctcaccgggagaccgcacaggcccccctttgccggttcggccgggggcttagggtgaaatctcaagctctctcggtatgtggaaagatcgccagctaggaagaaacgcgagacacgggcgatgtatacaggttcgggccgctgggaagcgtaataccctactcctgtgttttggtggatttgtgtatgaacaagtaacaaagtgtcaaccagcccccaatcgctctgggatcggatctggagaaggccttgtgtccaaaagtcctctcctatctaagtgggccaagtgtgagccaacctctcacttgttctaggttccgaatctggaaaagatcatcctctttccccatgggcaaggtcctccttttatacttcaaggggataccacatgcacccctccttttcaaactggacttttcttcccttcataaatggacggagatttgcacggttgccctccgaacgtccttctgatgggacggcacatacctacctccacttctgccgggggcaggcgcgtcgtgggaacgtggctgtgcgctgacgacatgagcagtgtcagaccggtcacaaatcggtcattcttgtccaccacgcgtcagcctagcaacgtgcatgttt

SEQ ID NO: 94075 - DNA, 1383 bp, Oryza sativa
catctgcttatctcgatggcaattcaagactttgtggaggagtgacagatctccatatgctctcatgccctcaagtttctaatagaataaaaagggattctgatataacaaagagggactacaatctggtcagattattagtaccgatatttggctttgtgtcactcacagtgctgatataccttacatgcctagcaaagaggacatcaagaagaacagacctattgttgctttcttttggaaagcagttccctagggtttcttacaaggatctagcccaagctacagggaaattctcagagtcaaacttaattggaagaggaagttacagttcagtatatagagcgaagttagctccgactaaactacaagttgctcttaaggtttttgaccttgaagtgagatgtgcagataaaagtttcttatcagaatgtgaggtcttgagaagcattcgacatagaaaccttcttcctgtcctaactgcatgttcaacgatagacaatagtggcaatgctttcaaagctctgatttatgaatacatgcctaatgggaatttgaatatgtggttgcataaacaatttgcaagtgttgcttcaaaatgtttgagtttagctcaaagagtgaatatagctgtggacattgctaatgcattgtcctatttacaccacgaatgtgaaaggtctattgtccattgtgatttgaagccaactaatattcttcttgatgatgatatgaatgcatatttgggagacttcggcatttcaaacctcgttattgagtctagagtcacctcacttggacattctagtccaaatagctcaattggattgaagggaactatagggtatatagctccaggtatatatggttatttccacatcttcgattcatgaaaggcaatttgttttctgcattaatacttcaacattacattgtttaattagtgtgatttttatcttttcttttagagtatgctcagtgtggccatgcatcaacatatggggatgtttatagttttggaatagtacttctagagatgctgacaggtaaaagaccaacagaccctatgtttgagaatgagctcaacattgtcaactttgtggagaagaacttcccagagcagataccacagataattgatgctcaactccaagaagaacgcaagagatttcaagcaacagccaagcaagaaaatggtttctatatatgcttgttgtctgtattgcaagtggctctttcttgcactcgtctgatcccaagagaacgaatgaacactagagaaatagctattaagttgcatgcaattaaaactttctatgcagaagcgaccaagcgagaaagtacgctttgcaggagagagttagagtgtgtcatggaactagt

SEQ ID NO: 94076 - DNA, 1571 bp, Oryza sativa
ttcgaaccactatgtgtatccttcattgggaaaaagctctcaaagaaggtagcattacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagacttgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtgcacatagcaaaatctagtagcattatcaatcaatgtcatgaaatatcattttccacctttcggcaacaccccattcatttcacaaagatctgaatgtaggagttctagtggtgccaagtttctctcatcggtagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcatgttcttcagctgcacgatcttttccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggattgttgttgttcttcttctgcttcttgaagttggtggtctgctgagctttgtatttccccttgctcttgtt

SEQ ID NO: 94077 - DNA, 1953 bp, Oryza sativa
agttatcaagctagtttgcaaatgtctccgaatgaagcattatatggtcgaaagtgccgtacgccgcttctttgggatcaaaccggtgaacgtcaagtttttgggacagacatattgcgagaggcggaagaaaaagtgaagattatccaagaaaggttgcgcgttgctcagtcacgtcagaagagctatgctgacaatcgtcgcagagatttggcttttgaagaaggagattatgtataccttcgggttacgccgttacgaggagttcatcgtttccaaaccaaagggaaattggcaccgcgttttgtgggaccttttaagattgtgagtcgaagaggtgaagtagcttatcagttagagttgcctccgtcaatgacaggaatacatgacgtgttccacgtgtctcagttgaagaaatgtttacgagtacctacggaggaagcagatcctgatcgtatagagcttcaggaagatttaacttatgttgagaagccagtcagaatcctggaagtaagcgagaggaaaaccaggaatcgcgttatacggttctgcaaggttcagtggagcaatcattcagaagaagaatcaacttgggagcgagaagatgaattgaagtcagctcatcctcatctgttcgccagttcttctgaatctcgaggacgagattccgtttaaggggggtaggtttgtcacgccctaaaaatcgactaaattaaaaatgcatattttaaatcatttttagaaattgttttaaaagcctacaagctaaaccttaattttctaggaaaattttcaacataaaaatgaactagataaaattttattaaatactatgcttgctcctctattttctagaattttctaggaattatttgagcaagggaagtatttttaataattgaaacatcatttcacaaattgtttttatttaaaaagttcaaagaaacccctcctaggccgttgggccgatttcggcccaacttctctctctctccgcgcgggcgaaccggcccagccggcccagccgacgccgcccgcccctcccctctccagccgctgacatgtggggcccacatgtcagggccgtctcctacctccggccgccgtcgcgcaaccgcgcccgagccgccgttttcccccttcaaatccgctccaatccggtctcctcgagtccgattgatttaggggttttgttcctctcgttctcctctttcttttcccccaagaatcaaaacgaatcgttgagtattctctccgaatcgaattcgttttgattttatccctaaaaccgagtttgatttcttcccgaatcgattcctctcgtttggagttcgatctcttcgatccaatgccatataaagcttccccttgttctcctcttccgtttgccccctctcccgtcctctctcgtgcctcgtagcaccgccgcgacgcgcgccaagctcgccgccgccgccggccgtcttcggtcacgtcgcgccgccgtctccgccgttgccgccgcttgccgtcgccgccaagaggtgcgccgtggtgagaggaagctcggccgcccctcctctttcgccgccgaccaccggagccccttcgccgccgtcgacccgagccgccgcgccgctttttctcgtcgccggccgccgtcgtgcatcgtttgtcgtagtggtgagtaccatcgggttcgtctcgatgccctctacgcgtagatgccctccgtttccgcggccgacctccctagctccggcgagctctccaacccgagccggccgccattgccgacgtcagcatgacgtcatcaccagggctgacgtcatcattagggctgacgtcatcgtctccttttctttttctttttcccgattttctaatagattaaaacttcagaaaatcataactaaataaccgtagatccgtattaggtggtccaagtttctaaatttttttaaaatcaagatc

SEQ ID NO: 94078 - DNA, 11244 bp, Oryza sativa
ggttcggtttaagtacggatggataaatccattctgagagatgagcagcggccatagcacttggcccgttatgatgtgtatctacaacctcccccctggctatgcatgaagaggaagtacataatgatgccgattattattcaaggccccaagcaacctggtaacgacatcgacgtgtacctaagaccactggtcgaagatcttaaacaattgtggaagaaagaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacaatgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttataataaggggtatccttccagacaatgtccgggcaacaataacaaagctatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcaagaggtacatgggcgttctgaagaagtatgttcgtaaccgtgctcgtccagaggcaagcatcgccaagggttatggaacagaggaggtcatcgaattttgtgtagaatttatcgaagaccttcgcccaatcggggtacttgaatcacgccatgaagggagactacggggaaagggaactctcggaaggaaagcaataatgacggtagacaacaatttattctgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtcgatcgcgacattccagggatatgacatcaatgggtacacattctacacgagagcccaagacatgaagagcacgaaccaaaacagctttgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggtaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgcatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatatattggaatttttattaattataagtcatatatttgcttattacgatttatccacttaatttattatagacaaaaataatttttcgaagtaattgtcattaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttcacaacaaccgggagtaaagatccgggggtatatatattcccggtgcgccctcgtcttcttcaccaacacttagacgttttcggccgatcgatctctctcggcctctctccttcgccgccactgcctagggcaaatccccgcgccgacgccgccgtatctcgccgtcgtctcgagctcgtcgtcctcgccgccgcctccgcctcctccgctgccgccgcatctctggggtgagagccgccgtgtcacaccctaaaaattcaaaatatataaattgttgtttaaatggaatttctagaatttattttaaaagccttgaagagaaaatctaattttaattaataaattccaatataaaatggggccagataaaatttcattaaatactttgcttaattctataattcctagatttttctaggatttatttgagctaaggaagtatttttaataaatggaattgcatttaagaaataatttaaattgaaaaaggttttaaaaagtcctcttttggctttgggccgaaagtcggcccaaaacctctctctctctcctcggcccagtccggcccagtccgcagccgccgcgcgcgcgcgccctcgctgtcgctgacaggtgggtcccacctgtcaggcccgtcgtcttcctcgggccgaaaccctagttttgcgccgccgccgccgctttccaatccggccgtccctttccttctccggccgaattgatagaggggaaatgatctccgggatctcctctaccttttctcctttggaatctttggctaaatcgttttggaaagcgttggattcgagtttgtctcggattcgttcttcccgatctttccttcctcgccgccggccgccgtgggcctttgccgccgcctccgagcccctttaaaagcctccccggtgtctcctctacccgccgccacccttgccttcgcctctcgtcgtcggaatcattctagcgccgtgtgccctagctttgccgtcgccgccgccgctccagccgtgcgccgccgtcgtttcagccgtcgccgtcgctcgagaagaccaccgtcgtgctcgccaagtcgtcgccgtcctcgtccaccacttcgccgtcgccggagatcaccagagcagcatcgccgtcatcgacccgaaggtttccgccgcttcctcctcgtcgccgtcgccgcccgttggtcttccgccgccgttttggtcaccggtgagttcgccgcgttgtcctctccgtcttggtgccctccgtttgcgtcctagcgccgccgttcgccggcgagcgtgcgccgttcgagccgtctcctccgccgagccgccgccgctgtcggtgacgtcaccgctgacgtcatcggggtcgtccgccgtgagccgccgtggatccgatcgatctcggccgtccgttttggattggttcgatctcggccgtccgttcgtgtgaaccgccgcccgtgcgcccggtccaccgaaaccctagcctgctgacgcaataagccttcttttccttttcaaaaataattcattattgcgtcataattcaatttaaaccgatataagtgttttaatccgatttaatctttaaaaattcataactaattcatcttagctccgatttagttggttcaagtctctaaatttttctaaaattgagatctacacattaaaaatatccacatgtactgttcatgcttgtttatttgctgttttggtgattttgcttctttctgtttagattccgtcgtttccggagagtccgtttttgcagaagaagagtttgaagagttccaaggccagcaaggcaagtcacacagatcccaaacaaccctttgagcatgttgatcctatttaaagctattgtttctattcaactattgcatttattttcgaatgtcattgggtggaattaacctattctttgttatggcccttttgtacttgattacttcattccttgataccttgggctattacaatttgactagttgagctttatttatattggttcaactagatactagatataattgcttagtcctgcttagaaacattagctcactattgggataactatgactcactattatttaatgatggcttgatgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttaagggggtgattatgatccaggaaggtgcgctgcagtggattgtgttgtataaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtcgaacaatgtctttcgtgattagtttcacacctctcatcctgataacaaatgctataaatggtaacaatttgtttagctcctggtttggaatggtacattcctggtttggagatagaactgtgcagccgggatggttgttcagaatggttgggcctatacaacagggtatgttgtatagtgttggattaatattgtttaattactacttaactgttttattaaattctgaaatgtttgctaaatgctgcttttgcaaatggaaccctactatgccatcatttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgttcattttatttttccgctgcttagatctttattgattgagaggaactatctacctctgtaatgacattttatacgcttattaagtagagtaataattgtactctattatcaatttgttattgtgtgcctcggctgattcctggacgagggttcacacacatgtaagcgtttggaattttggatagaaattccgggcgtgacaagttggtatcagagcccccttgaccctaggttatgccaaatggttatccatagaagccctctaaaattattggaaaagtagaactgttctcctccctttctcttttaattaaaccaaactaatggcacaggcacttcatatttttttttaatggttctcattcaaaatttattccagtgttattagtaccgtacatctattactgtactaatggcttatttatcagcaaaagttttacaatattgttttatttaatcttgctgcaataaaataaagttagcatgttgattttataactttcttttatttcttttgaaacctgttattcaaaagtacaaaatttgtaaccttgtttccaactgttttaacttatcttgcaagtttggtttactttatttacttaccttttactttgaatttctaaactttgttcaaatcaatccaaaaacttgtgctattaattggataaatgtcttaactccctcctttcacttgtctttagatgccacgcttcaagcctgagtacctgtttggtgttgagggttttgtccaggagttgcgtacgatgtcctttgccattggatttgggactgcccctttttatgcccagattcttcatgatcgtcatgaagagaagtgccgagtcaaagtcaccttgaacagcaatagtgaagaggtcccctcagtaatgtttgaagctggaggaagaaactacatccatgcatgtcaggaggtggcaaggatcgccataggagagctccgcgatcgctacagtaatcagttggccgacactgagtatcgctaccatcctcgccaaccccagggaagtgaccgtggcagttaccttgagactgaaggaattgagaataacgctaccacaaggcatttggtcgagatgctgtgggctatggatgaaagtcgtgcggagactgtgttagcagctcaagatcgtgaagatcggaatcgtggtaagatttgcaagctagaagacaagatggatcgtttggagaaggaactagccgcattgaagggagaagcaccaccgcagaaggccaggattcgtctcaccgcaaggaagagagctctatttgtccctcgctaccaattggcgccaaaagttcgtgtggtggagaaagaagttgccccaaccttagcagatcctccggttatcatcataagtgatgatgaagaagaagaatccaagcgcaaccattccaagattgagtgggtagcaactcaagatgatgaagacgagccgaacgagccttcaatcgacctccgatgctcggaagaactagagtgatttgttaagtcgttgtcttagatcgttgtgataggttgtttgctttaagtttgcttgtgtgtgtctcgcgtgtgatttacatcagtggtgggatgtaagtgcatgcgtttgtttgcttttgagtgttaggaagttggtgagtttagtggtgtgagagtcttcagtttgtaataatgaaactcagttaagatcaataaaagttaaagtaattctctgtcctaagtagtttccctcggtttctcttcttatcctgtctatgccagatggtgaacactcgcagcaacgggaatggtcccaacaacctcaataacaacaatggagagaatcccactcttgctcaagttcttgctcaacagactcagcttatgaacatgatgatgcaacaacttcagaactagcagaaccagggaaataatcatgcacctccccagaataagttagcagaatttcttcgtgtgaggccgcctattttctctagcaccactaatcctgttgaagctggtgattggctgcatgccatagagaagaagttggatttgcttcagtgtactgatcaggagaaggtctcatttgcatcacaccagttgcatggccctgcctctgaatggtgggatcacttccgcctgaataggattactgctgaacctatcacttggcttgaattcaccgctgctttccgaaagacgcatataccatcaggagtagtgtctctcaagaagaaggagttcaggtcgcttacccagggatctcgctctgttacggagtatttgcacgagttcaatcgtctggctcgttatgctccagaagatgtgcgcaatgatgaagagcgccaagagaagttcttggaaggacttaatgatgagctttcttacccactcatgactggagattattctgatttccagaagttagtggataaggctattcgtcaggaggacaagtataatcgcatggagcagaagaaacgccggatggctcacttcaaggcacaacaggggagtaatcagaagccgcgtcttactttaggaccccagtctgtgccacaaggaggttcttcgtctgttgttcgtccgcagcgtcagttcttcaacaacaatgctggcaataacatccgtaatcaagtcccacgtcctgttgcagcctcgacacagcaacaacctgccaagagggagcaaggcagcaagcccgtggtgtgtttcaactgtggagacccaggacattatgctgacaagtgtccgaagccccgtcgcgtgaaggttgtccctgcccagagcaactctacagtacctgtgccaaaggcccgtgtcaatcatgttgctgctgcagaagctcaagatgctccagatgtgattttgggtacgttccttgttaactcagttcctgcaacagtgcttttcgattctggtgctacacattcattcttatctatgagttttgcgggaaatcatgggatggaagtagaagatcttagacgtcctttgatggttagtaccccaagtaatcaagcactctctttgcaacgtagcccctctgtcagaatagaaattaaaggagtaccatttctggccaatcttatcctgttagaatccaaagacctagatgtcatcctagggatggactggttagccagacataaaggtgtgatagactgtgctaacagaaaagtaactctcaccagcaatgatggtcgagttgtaactgttcatgcattgtcatctgagtctttaaggtcaagactgaaccagataactttggaagagattcctttagtccgggagtatcccgatgtgttcccagatgatttacctggtatgccgcctaaaagggatatagagttcagaatagatttggtacctggaacaactctgatccataagagaccttatagaatggcagccaatgagttggcagaagtcaagaggacagtggacgatttgcttctgaaaggatacatcagaccgagttcgtcaccatggggagctccggttatttttgtggaaaagaaagatcatacccagaggatgtgtgtggattatcgtgcactaaatgatgtgactatcaagaataagtatccactacccagaattgatgatttgtttgatcagcttaaaggtgccactgttttctccaagatagatcttcgatctgggtatcaccagttgagaatcaaagaggaagatatacctaagaccgcttttaccactaggtatggcatccacaacgtgttccacgtctctcagttgaagaaatgtttgagagttcctgaggaacaggcaagtccggatcacatcgaaattcaggaagatctgacgtatgtggagaagccgactcgtatcctcgaaaccagcgagagaaggaccagaaacaaagtaataagattctgcaaggttcagtggagccaccactcagaggaagaggccacttgggaaagagaagatgagttgaaggccacccacccgcacctcttcgccagctcttccgaatctcggggtcgagattccgtttaaggggggtaggtttgtcacgcccggaagtttccccttttgtttgctttaaaaattggctaaataaatcgtccgaagaaattatcttaattaacctagagctgaatccccagttaataaatgcaaataataatcggaatcggcatgtggaatttttcttggattctacatgtcaaaatatgttaacaggatttttagtggaattttcagagccttggaaataattttaaccaattaaaaatcaccaaagtgcaattttaatcccaggaaaaatcctttcttctttttctttttcctttttcctcctttttttcctcttcttgggccgtcggcccagtccatccctctcccgcggtccctcctccttgtgggccggcccaagccgcccctccctcctctctctcgggacgccgacaggtgggccccacctgtcggtcgtctcccacctccggccgctggagccgaagctccaaccgcccatgccgccgccgaatccgccgcgccgccgccttctccgctccacgtcgcgcctccactccgcgcccgcacctcgcgcccacgtcgccgccgattcccccgcatctcccggcccgcgcgcgcgctcgagagggcgggattcgatttcgaatccacctctctcactctctctcctccccacgtcgccggccaaatcggccacctccccggccacgtccgccccctcccgcacctataaatcgctccccgcgtcttcctctctcgtttttcgcactcgccgcgccttcccgtgcttcctatcgtcgccgcgccgctcgccccttgcgccgccgcctaccgccgtctccggccacgcgccgccgcctctatagccaccgccgtgccgcgcagtcgccgccgtcgcgctcaccgagcccgcccgcacctcggccaccattcggttgccgccaatcgtcgccgaagcgccgtttccctcgcacgccggtgagctctccatttccacccaactccggccggctgctctagccgccgtggtcgctctccctacccctaacccctctttgttttctcctagcgtgccgccgccgcccatccgcacctcggcatcgccggtcgtcgccgccgctttcttccttcgcgccggccgtcgtgctcatcggtgaggaatcccctctcccccttcctttttccccctctcccgtgtgcgccgccggccttcgcgcgtgtgccgtcgccttcagccgctgccgccgcctttcgacagtagccgccgcttcccgcaccgccggtcaccgccgtcggtggccgtgcctcgccgccgcctcgccttg

SEQ ID NO: 94079 - DNA, 702 bp, Oryza sativa
ccatatagtgagtgcaagccttgtatcccttgtttgaccgtccatataggttactaagtgcaggccaacagttaatggcaacgaacagcaacgctcgtagattacattgctcctgtttatcctcatcccacacagggatgccttctttcctccacagcacttttagatctccaaccaatggttttaggtacacatcaatgtcgttaccaggttgcttcgggccttgaataatgatcggcatcaagatgtgcttccgcttcatgcatagccaaggaggaggttgtagatgcacatggtgacagaccacgtgctatggccgctgctcatctctccaaatggatccattccatccatacttaaactgaaccttacattcggtgcatactctccgaagtctttaaatgctctgtcgatatttcgtcactgcgacccgtcagcggggtgtctcagcatcctgtcttgttgaagttcttctgcgtgccaccacatcattctagcatgcgatttgttcctgaaataaatgtttcagccgtggtattatagggaaataccacatcaccttagcatgaactctcttcttcaaaggttgtccgtcaacatcacctggattatctcgtctaatcttgtattgtagtgctttgcaaaacgggcatgcttctaggtttcgtactcctcaccgcgatagaggatacaatcgttcgg

SEQ ID NO: 94080 - DNA, 507 bp, Oryza sativa
cactcacggtgaattgaagcagccacctcttcgtaggtccggtgttgcggtggtgtgccaacggctcgagcgggaggtgcggtgcgcgctgtaatagtgcgaaacgtgccgtcagatcgtcctgtcagtccacagccatggtcactggcccaacagcgtctcccgcgagcggtagccccaacaagtacgatacgtcctgtagggtaggggctatctcaccgcacggcaagtgaaaagtgtgcgtctctggcctccatcgatcgaccaaagctgctaggagggacctgtccacagtccatcgtctgggcgggtccgcgtcgccggccgcagcctccaccagccgacacatcggtaggaggccggcctcacgtagcctgcaataacaaattaatatgtaattataaaaaatattacagtgcaactaacttatagtaaaacactgttcgtacctctcgacaaaggagtcgtgaaccgtgagtagctcaccgcacgtccgtgcccggaacg

SEQ ID NO: 94081 - DNA, 546 bp, Oryza sativa
ggtactggttcctgaaattggttaaaacaaaagttgttggtatgaggccaaatgtgtgcctgatacatgataggcacgctggcattctgcgagcgatagaagagtttctgtttgggagcatggaacgaggataccctggtgtttgggacgatgtacagagtaggtggtgcatgcgtcatatgggagctaatttcttcaagcaattcaagaacaaggagctcatgaacatgttcaagaggctgtgcaatcagaaccaggagaaaaaattcaatgagctttggaagagattagatgagttgacagccaaatgcagtaatcagcgtgcagcggctacatcgactgccgttgatgacccttctcaagctcttggacctctcccaacagatagtccaactttggttagaagaactggattggagattcggaaattttcttagtggattctgcatgaaccaaaagagaaatgggccaaggtgtatgacaccggtggtgctagatatgtaataatgacaacaaatttggcagaagtttacaactgggtgatgc

SEQ ID NO: 94082 - DNA, 679 bp, Oryza sativa
ctatttgaggaataacaagtcaataaagcatatatatagagcatttatagatcaaaccatatgctagcatcgacattgcatattttcttaattcaagtatagaatttaagtgtcatgcatcatctcacttaaaagcaaaatctagatctcatgaaaagactagaatacatacaagctatgctagagacaaataaaccttcaaagtattgctagcatgcacaagaaaataccatatgcataaataaagctctcttttctcaatttttctcattggcatattattgcttgataaaaccatgaggtacaaactccccctcaaaccatgccaaaaggatgaattatgcccaattcaccacgaagaaaagcaaagcgattagaatccaaagatttagtgaaaatatcaacaatttgcaacttggtgtcaaaaaactacaattcaacatctcccttctcaacatgatgcctcaaaaagtgaaaacgaatatcaatgtgctttgtgcgtgagtgttgaccgagattcctagaaatattgatagcactagtattatcacaaaagagaggtactttctcaaaagtaagaccataatctttcaaagtagataaaagccaaagaatctatgaacaacaactagcagcagcaacatattcagattcagcagttgattgagcaacactagat

SEQ ID NO: 94083 - DNA, 694 bp, Oryza sativa
ccccagtggacatagaatctgctttacttcgtatgtcgtcttggacaatgtgttctcaacaagaagcatagtcttcaaaattcctaaaagatctatgaaactcttgtctgtccatccactacttgccttcaacttcattaggttcaaggtcgctgacaactttgtgtgttttgctttgcatccggcgtacagaagcgtctcggaatcactgaccaacctgctaaacttcatgaaatctctctcattctgggctgggtcttcaacgtcacgtaacatgtcttgtagcagatcgtgatccacatttcaccgcccaatggagaaggtataaacatgtcatgctcatcttcatcttcctgattatgcgcaccacttctgtctgttgctgcaccacttcctgattcttgctctccatgcttcacccaacatgtatagtccttcatgaatcctcgttgtatcagatgatcgtgtacaacctcttcgctatcaaacatattctcattcttgcaatctgcacatggacaacgcatgtaatcattgtttcttcttttcctatcctcccctgcggcgttcataaattttattacgccatttctgtactccggaaaatgacgtttcacagttgtcgcatacatccaacttcgatccattgctacaaaataaaaaaataaattagaggcccatattataatatcag

SEQ ID NO: 94084 - DNA, 2060 bp, Oryza sativa
gatcagagtttaaactattccaatagccgtacccgcggttatgggtgagttgagcaatgtttttcgtgattagtctcacactactctttaatggtaataatgtggtaattaatttaattcctggtttggaatggataattcctggtttggaggtttaatttgttcaactggggttggttgtacaaatgtggttgggcctatgcaacacgggtgtgttgtatggtgtttatttaatattgattaattatacaactgttttactattctcttaaatatttattaaatgctgtttgctgcaaatgaactgtattatgccatcctttgttatcctgtgcacttgcatatttgctgtgtggcttgttgagtatgttatatgctcattcttgcaatattcattcatcagaagaggagtacttcagtgaaggtgatgatctggaggattaggcttgttcttggttaagttgcctgtggagtggagtcgccatagctgttccgtagtttgttatagttttgttttccgctgcgtagaatgttatttgttttgagaggaactatctacctctgtaataattttaatttgcgaatattcaatagttaattatttgtactctattatcaatattgtcattgtgtgcctcggttgattcctggacgagggttaacacacatgtaagcgtttggaattttggatagaaattccgggcgtgacatcagggacacaaattctctcacctaaccatacagttccttgctcgtcctccaagaaaccgatagcttttcctcttctcatattcttcttaatttcttgaatatcaggatcattaatttgggcttctctaacttgatcaattagagtgggctttgcttctaaggctgcaacgaaacctctactgacaattcccaaatttaatctttcaaattccttgcataattccaatggcaactgtcgtccttctgtagcattgcaatagcctttcctgctaagagcgtctgctacaacattagcctttcctgggtgataatgaattctcatgtcataatccttaattaattccaaccatctcctttgtctcatgttcagatctggttgagtaaagatatactttaaactcttgtgatcggtatacacctccgtacgagtaccgaagagataatgacgccaaatcttcaacgcatgaactactgcagctaattcaagatcatgagtagggtagttcttctcatgcggacgtaactgacgagatgcataggcaaccaccttcccatcttgcatcagaacacaacctaacccaagtttagatgcatcgcaatacactcggaaacccttctttggatcaggcaaaatcaaaataggagctgatattaaacgactttttcaactcttgaaaactctgctcacattcttccgaccacttgtacttcacatctttctgaagcagtcggtgtcatgggcttagcaatcttggaaaaattctctataaaccttcgataatatcctgcgaggcctagaaaactgcgaatctctgaaactgtctttggttgcttccaattggttacggattccacgttactaggatcgacggcaactcctccggctgagatgacgtgaccaaggaatttcacttcagacaaccaaaattcacacttgctaaacttagcatacagttgatgttctcgtagcttctccaatgcaaggcgaagatgttcttcatgctcttctttggttcgggagtagataagaatatcatcaataaagaccaccacaaacatgtctaggtattccataaatactttattcatcaagttcatgaagaaagcaggagcattgataagtccaaaagacataactgtcacgcccagaaattctcgaaccagaatttctaagctgaatgtgcattaaatccctgtccaggaccagccagggtacacaaacgacaattgttgacatacagatccacgtcttacaaaaatagaaaggattacaaatgcagcggaaaagattaaagcgagctaaaccgggaagcttgacttcagcagcgagcggctccactccacaggca

SEQ ID NO: 94085 - DNA, 758 bp, Oryza sativa
  unsure (1)..(758): unsure at all n locations
tgatgggnannnnnnttgaagtacagctctatgaacnacnncataatgtgtaagcgctaccctggaaaagacgggaaggctgcgctgttgacaggcggaccccacatgtcaactctaagggaccacggtggaccgagtacatagagacggtccacgggtcgacgaaagcggaccccgtgtgtcaaccgaggcgagtggccgcaaacggactccactagacaccacgcgggctacacacgtagaaaccatgcggctaccgagcgggcacattaacacggacaccacacgcacacacgaacgactaccgacaccggtacacgggtaccggggtcgacaaccgcacaatgggcacagggcgataccgaaaggacgaggagggacccttaccatcacgcgacaaggcgtggaatgacgacgacgaacgggcgcggcggagatggctcggggacgacggaggcgaacagcgaggggacgactttggcggcgattcttggacgaaagcgagacgcggccggcgcagggcttgacgacgcggagccgaggacgaagacgacgaggaggctacagcacacttgacgaaacgcgggcggcaaacgcaaacggcttgacggagggacgaacgccacgacgatcgggaacgacgagaggacgacgacgaccaaggccagtaaagaggcgacgatggcagccgacagcagttgcatagaggtgaggacggcgtgnaacacgccgctacaatgccgacgacggaagtggcg

SEQ ID NO: 94086 - DNA, 521 bp, Oryza sativa
gattcatctatgcattcttccatttcagggatgtgtattcactaaagatatcaacaaagcgatcatgatcagcgatgcgatggagaccggaaccgttcagatcaactctgcaccggctcgaggacctgaccatttccccttccaggtattgttaccatgccattgactcggcttgccatcattttgttcaatttaccttttgctttcttcagttgtttgtaatttctatggggtttggactacagggcttgaaggacagtgggattggatcccaggggataactaacagcataaacatgatgaccaaggtgaagagcactgtcataaacctaccatctccatcctacaccatgggctgaggtgttccatatagatgatcagatttctataaccacatgagtacaatgtagagaattcaaatgttttgtaaccacgtgagctttgtacgctatttgcaccacagttctccctgtatgttgttggctcttttacaattaagaataatgcatgttgaagtatga

SEQ ID NO: 94087 - DNA, 530 bp, Oryza sativa
attcatcagctaaacagggtgatgccattgaaaccggtagcatcatcaggttgcaacacatgaggacacggaaatggttacatagccacttgcatgcttcaccattatccggtaacctagaggttggttcaacatgaatatcccatgtgatatctggcaacatttagttcctaaaatttcataggacctcagttgttatattctgagtttattttttcccaaaagcttgagtgctcttcaaactgattgagctctcttcaaatgattatcagtaatagtacatgggattagaagacctacttatccttccctatctgtggacatattgtgtctagctgatctcatattgttgtacacaccagctgaaagatgacagcgtatctgccaatttgatatgtattttatccgaaaccaagaccacaaaccaagaagcaatagtacatcattcggccatccactgtctggatttgctaatgttcatgaattacatggccaacagtgcctagaattgctttgcaactaatgagact

SEQ ID NO: 94088 - DNA, 677 bp, Oryza sativa
  unsure (1)..(677): unsure at all n locations
ctgtagacagagttgtcatcaatttttaccattgaaacaaagcggaaggttgcaagcagcagttctgcctgttactccacctttgttagatgatgaagaaaaacggaagcaaatgtgtgaagattatggattcaaacaaattggagaacagttgccagataatgttactcttaaagatgtaatggatagtctgcctaaagaggtatatgagctaccaacaccagctatgctgctgtggcttcctatacacaaattcctctaatgtaaaatttcttgtctgctaggtatttgaaatcgatgatctaaaatcttggacttctgttttaatatcagttacttcttatgctcttggtattttcttnnnnnnnnnnnnnnnnnnnnatcttcttcccttagcctgggcatggactggtacagcagttacgggggtaagaaccctcccctccctttgtaagcttatataagtttgtgttcctttcatgtgctacatgcttgcttgctgttttgtctattgtccactatttaattgatgcctttgtaaagttctttgtcataggtcatgattgtgcccacaaatcattttcgaggaataagctggtggaagatatttgtggaactctagcttttttggcattgatatacccctatgaaccttggagatttaagcatgacagaca

SEQ ID NO: 94089 - DNA, 600 bp, Oryza sativa
gtagagttaggactgtgcatgctgaattgtaattaccatggttagttcagcagaatttgcaaaaagaggccaccagaattagacaatcgtcatgaattaatcaaggtacaaaccaatggttgctggtacatcagtagcaaatggctgtagcactagcgtgcccatatttatattccaagcctccaaggtatacaatacatatttgatgtaccgaacaactgaaaaaggcgcttggtttggaagcgcactatttttaaatttataggataacttctgacagcctttcttctaaatgaacttttggcaaccgctctgaagccgtgtaacacaatccaacaaagcaatttgcagtcaaaatttcgggcatgtgccgttctagttagaatttaggatgtgactcactaagtaattgtgattgtttctctatgcaaacaccagccaacagtattgatttcatcatgcataatctggcatgaccttcttgaggaatttaattggttgggattcctcaggcgcaacctcatcaaagggaacatagtatctatccttgtcgtaaacatggcatttagtcagtattgtcttcatcaagcgccagttcca

SEQ ID NO: 94090 - DNA, 5154 bp, Oryza sativa
ggttgattccatcccctttatttgggggcccgtcaggctttctcttcccttacacggcctagcaaggatgtggcccaactgatccaaccgtctccttccttccaaagggcccatgtggcacgtgttagcacgtcgttgccgcccctgccgcaagggcactgcctccgttttgccgagtcaagaggaaccaccaccgtgtcgtgctcctcctcctccactgcttctactgcctcccttgctctagcccgttgccatgcctattgccgctacaaaccgtgggcaagacgtgtcgccatgggagcgccgcctcctagtgcttcctctatcgcccatcatttccgtcgccgacctcagctgctgcgtcatcccaccgacgtcagcaagccatcgccatcaagcccagccaccatggtcagccaatctcaagacgatgccccgcgcctccttctccaaccagtcattgcggtcgcctttcttcatcaacatccacgctcccatctccctccactgcacccaagcttgagctctgccataccgagctaccgtctcgtcggagtgatatccttccctagagcgtatctcgccactagcatcttcacacttgagcgagtctgttttccccattttcccttctctcccacctcacatcaagccaccctggagttttctctctcctgccggtgctcccaactctttcctcgctccccacgctagctgcctccttcctccatcgggccatgttcaggatcacgtcaatgcgccgccgttgtcgctgttataccaccggatgctgacaccattcatccgctcttcctttgcttgctcgacctgaaccgaggaagaagaagaggaacgtacgtagccaggtgtggggacgtcgccactgcttcatccgatcacgtcctaactcggacgacgaaccaaaattgcgtgtgacaataggaaagatacaaaattttgaagtagttaagataagataagatatacgggtgcagccatgcggcctaatttgtgtcctctgatttcgtagcaaacctgatttgggccgcagcctcgggccgagagcacgagcccacggagagttcggcccagtacattctataggccgatcgacgtggcagacccgagcccaatacgacccacctgctccttccctttcccctcccccaagcgaaagccgcaaacaaatccaaccccccaccaccgcggccgatgtccaccctctccccggacggcgactccgactacggcggcggcggcggcggcggcgaaacagccggagcagtgatggccgacgtcctctccaagggccgggaagcctgctacaaggtgagcgacccaccccctgagaaaaccctacctccaccgccgcgctcgtttactgatgatgatggaggcgacgcttgtctttctccctccaaaccctaggcccgggacgccttctacacgtgcgtggagaagcacgcggacaagaagcccaccgagatcgccaccatggggctcctctaccccgccgactgcaagaagtcccgcgccaacttcgtcaacagctgccgcccctcctgggtcagacgcgggcgatccgaccccttttcacgattcgcgtcgttctcttgattttttttttctgacattggtttccttgggcaggtgaagcacttcgaccggcagtactccgccaagaagcgggtgcagcggctgctcgacggcggcgacgaccgccggggccccatctcgctcccccagccgtacacgttcaagcaataggtagctagctctgctgctggttccgtccctcggtaccgagctgaattacatctttgcgtcggagactggatgcggcagtatttgtttcagatttggtggtgttaagatggaaggcatatgcctctgctttctagtacgttggtatgaattgtgaatggatgagaaagaacttgcctatgacttttatcgcaatcaagatcttgttgtggtagtgtttatatctttgttgcaatacattggtactgtccataatcctcactataatttctgctgtttgatgctttatttcaacggacaaagtttagaagcaaagataaatggttcgatcaagctgcatgttggcctcgttttctcattatcatcttggtgctgttgtcatccacataaatgataatagtatggttaatacatactcgtaatgtttcatgtttgctgtgtgagttccaaagtgtggcttcagtagtctcattcgtaatatttctcttatatgataaaatgtaattagtaaccttgtcttagtatgtgataattcgaaatttgaaatactgaattgataccaatgatatgccactgttttgtgttatcaaatcaacatctcattaagtaattcacatataattttgttaaactgtaagatacagttattgttgaacgcacatgtgttttttggttcatattttgagaaaaaatgctttagtatgcaatgtggatttcacctatgcctactaaactgttgaatgcatcaaaacatcgagtgttagctcttgttgtgattttccttgggtcctatggacagattttgttaagtcgaaatagaccactttgatcatccatcaaaattctacactgactttcattggatcgtattaggagatgatttgagcattatttgactgtttgcaacctcttattgctttatgctgtaaattccttggatgtgtagtccatccaacataccagctggtcctttgcatatgagttttgctcggattttgtttgggctttctgtgaatcttgctttgggtagttcggcctgtgattcataataccagacgacagataagttgaaagcaagatgccatgttgatttgtacgatgacaggatgtagtgccatttcaggcttactccctacatgcagttaatgcttaatgcaaatactaaaatatgaatttatggtaacactgggaactatttaaaccttttttcttttagggtgatctgaagattctgtattctgttatatgcttgggtttctccaataattcttcgatttgttcatctgcattgctacacttttttctggtaaaatgtgttcatgacctgcagtgctatgctttactttggtaatgatgtgtttgtttatacatagatccatactttcgtactgcctttctagtttatactttctagtaaatgcaatgtcattttctatgcaatattcagcttacacatttaggatatccagtgtcccaggtgttgctagatgtgatggataaaattggaaatgcaaatacaaaaaggagggtttacttagttaagtgaaagtgtgaaacagaaaagtaatgttacatacaaatggtgaactctttatgattcatatgaacgataagtttacagagaagtatatatgaattgcttaaattgcacgtaaattgtaaagctttcattggactacaaatctgtgaacctatttcatagaactacatatttaagacattattgtgtcactaagctactcatttaaactgagtagtcaaatactacctctactaattactatagtaggaatttctgggttttaattattgggaaatctatttctgtcatggtaaaggctgttttagatttatcttttgtcttggcagaaggctattttagattatttgttcacacgacttgtcatgcttgcatgtttggaattggttattagatccagtttttagaaattccttcctatgtatttataggcttttgtttcattgtcctgttgtggcagaggcttgttaaagaatcaaaattgcttttgtaacaaatgaaaaatgctaaagtatgcaatgtgattttatctatacctagtaaactgttcaatgcatcaaaacatcaggtggctcctgtgatttttgttgggtcctatgggcagatttttttaagtagggatggaccactttgattttgcatgctttgactgtgcaacctcttatagcttatcctgtaaattcttgtgtcctatctggtagtccatgtccaacatcccattcggtcctaaacatatgaattctgcttgcttttttttttgggttatctgtgaatcttgcaccttgggggggggggggtagttcattgggttgacaaaaaacatatgattgaatattgttatttcagttttttttgtgtgcagggaatcgttatttcagatgattgaatatcgtatttcagtttgacatatccatagagaaccacttttagatattagaaaagtgaaagcaagatcccatgttgagttgtatgacaggatgaagcatttacactgtttcgtgatatcaggcttactccctacacagttaatgcttgatactaaactataaatttatggcaatactgggcacaaatttaaccttttgctttagggtgttctgaaaagaaaataattatgttatgtgcttgggtttctctaataattcttggatctgcattgctaggctttattctggtaatgcgtttatgatcctgagtgctatgccttattttggtaatgacgtgtttgtttatacattgattcatagtgcctttgtactttctggtaaatgatatgtaaatgatatgtcatttaccatgccaaattcaccttacacatctaggatatttagtgccaagggtagtgtcaagggtattgatacttgatagatgtgaaaggtaataatatggagacgcaataaccaaaaaggagggttcagtgaaacagaaaatttaatgttacattcaaatgatgaacttgtttttactcatatgaaggacaagttttacatgaacgtatatatggtatatgaattgtaaattgcgttaagctgcacataaagcgtatagcttccaatgaactacagatttacgaacctatttcatagaactacatatttaagacatttttgtatcgctaagctactgatttaagctgagtggtcaaatatctttactaattagtacagtaggaatctcggttcttaattattgggaagcctattttatttctggtgtcatgatgaagactatttcagatttatcttttatcatgttgaaggctattttagattgtttatcacacaagttttgtcattacttgcatgtttggaattggatattagttccagttttggcgcaaaacttttttt

SEQ ID NO: 94091 - DNA, 586 bp, Oryza sativa
tacggattaaggcccttccgcgaaaaggggaaataattttatgaacctttcttattttcgttaggttcaagtctgacgagaataatattctacgactaagaactcatttattttcaccatttactaaatattattttatttactagtcctttatattggaatgagtcactagtcaaatgttttggcaattcctcgtgggcggatgatgcaatagaattttgaatcagcgttttgatctttggttatccttcatagtaataatatctcggagtttgcaacgaaaacttagtatatcgactagacgaccgtgaaataaaatatgtctatctatggttaactaattgcctggctccgggaatggtcgaagccatacccaatcgaaaaaggatgttatccaaacgcatttcaagtagttgtagtcaaacccgacctgttgacccttttgcttttccagcaatatgtacatatctaagtaattgtcgttctgtcagaccatcatgaaaacgaaatttccgtttttcttctagacgaatacgatattgcgatcttttcccagaacgcaattggtttttaaagatactaggat

SEQ ID NO: 94092 - DNA, 971 bp, Oryza sativa
  unsure (1)..(971): unsure at all n locations
tagctccatggcaccgaaaatgtctcagggctcaagtgattcaccgaagcgacgagaccttgaaagctgctttttcaagtgtcagtagcgggacgttctgtcaatcggggaaggtttttggtgacaagacnnnnnnnnnnnnnnnnnnnnnnnnnnnnnnnnnnnnnnnnnnnnnnnnnnnnnnnnnnnnnnnnnntgccagtggaaggctttctgcgttcagtcaatctacgcagagtgaatcggtccctaaggaacccccgaaagggctgccgtccgatgggtacacgaaagtgacgaagttgctttgactactgaaccatgcctggatcgtccgagcgaattggatgatcgggccgagggctgccccctcttcccctcgctctcctttccttaatattcaccgtcgagtcatcaaagccgtcaactaattcagaggggctcggctggcccggtcgccctacgctactggcgcttccaaaggcgaagctctcgtctttggcgaccagcaaactctgggctaaaacctgtagttttgaagcaagggatgagcgcgaaagccgttgcgcttccgtacacgcgcatacgttttcttgctccgtcgcgcgttagtacaataacgcgcagccgttttcttgctggggcggacacggatttctctctaaaggcgaagactcagaagtgggcgaacactcggcccagcgggcgaacatgccggctccggctccgcgcacctgctgacacctttcgaagcactttcacgtgtgaaccgaagtcgtcttgccgaactccttcctttctcatttcagtcctcgcctttttcatcttccgtaggggcctttagtcttttgattagagtagaggtcgcgagagagcagagcgtaccgccctgccatagtcgcgaggatcttaatagtcggtcgcgactgttgtcatagtcaacgacggttgaaacttccaggaaaaaactt

SEQ ID NO: 94093 - DNA, 576 bp, Oryza sativa
tttttcccgtttgctgtccccgttattagttctcgttggccgcggcctataggaaccaggctacccctggcttttaagccggttgcatgggttagggcacagttttgcgttcaataatcctgggggctttcattttgccacgtgtttggttcgtgttcgctttaaggccccttttccatcaataggtactcccagggcgtcgtccaccgggcctaccatggcctttcctgcaggagcttccccaatagatccagtgcgcttgacaagatgtccttctttaatagcggtatctcttccaaagccaccaatacttactttctcattctcaagattcgaggttattcctttctctccgctggcaaattccaccatttctccagcgtgtatctcgttctatccatcaacacgtgcaattccatctccaactgagaccactcggccgatctcatccacttgacaattcgtgttaaagttggtcattctactttctaatagagtcgtcagttcggcagctctgggtgagccctccatacttttccgtagccgatggatgatagaagggagaaatccgctttt

SEQ ID NO: 94094 - DNA, 682 bp, Oryza sativa
acccgaacaataatattccagagggaaatgcacctaagatcaaatattttgagccggcttccgtggaaaattcagactttctttttgatgctgcgatcacataaaaacataaactttgaagctcaatagctaaatacatggcaattaaatcatgagccgggatcattaagagcatactgcgagtaggaagtggaattaatacaatgaattcagaagcatcaaacctctctttttcgaaagaatcgaaacacatcgaaatggtaccagccgtacttaataatagaaggatttggcagaaatatgtaaaattgtccctcctaaaaaaattattccagaataaatgggcaatagttaggagaggtgcgccagcggcgagcagaagcaaggttattagataccgaaggaaagcccggccagaaccacacgtgcaagtttccctgcatgtggctcgtccgtgataacttcttcggatttgcgtgaactagcggaccgatcactaagtggttagtacctccagcatgagcgaaccttttcagaactggttaggaatgggcgccactatcccagcccggatccagccaggttctattgatcatgtccccttcccaacagttgtacccttgtcttggggtctttggctttactatcaccggaaaaataaaagtctttctcttcccgttcc

SEQ ID NO: 94095 - DNA, 680 bp, Oryza sativa
aatctagtagcatcatcaatcaatgtcatgaaatatcgtttttcacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatgaaaaacttaggaattaaacacatgctggaaagccgagacatcaagccgaaattaatatgacataaacgtgaatgccaaacattagcctcatcatccacactgccacaaatatggttcacagacatattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacattcttcagctgcacgatctttcccgaagtaaacttcagatctaccgtgccaacaacatgaacagaagcatgtgacccattccccattaggacggtggaaccccgtgcgacctgataagaagaaaacaatgagatgtcagcacaaacatgtacattggccccagtatcaacccaccaattagtagattg

SEQ ID NO: 94096 - DNA, 542 bp, Oryza sativa
atacccaatcggcgatggactttattctcggcgcggataataaagagcagcagagcaaacttacgggctggctcggtgaaatggcgtcctattactcagctgcgcctgttcgcctgggtggggcaagttccacacctgttgccgggtgattctctcaaccttcagtcggcgcaggataccgataacggctactcgactttgaacagtcacctgctgcgttatattgccgctgggcttggtgtgtcgtatgagcagctttcgcgaaactattcgcagatgagctactcgaccgcacgcgcaagtgctaacgagtcctgggcgtactttatggggcgtcgcaagtttgtggcatcccgacaggcctgtcagatgtttctttgctggcttgaagaggcgattgtccgccgcgtggtcacgcttccttcgaaagcccggttcagtttccacgaggcgagaacagccttggggaatgccaactggattggctctggtcgaatggcaattgacgggctgaaagaggtacaggaggccgtcatgctcat

SEQ ID NO: 94097 - DNA, 655 bp, Oryza sativa
caaaatgaccatgcatatgtcctcacctttctgatgtcaatagccatggccatcctcttgctcgttgcgttgttctatcggatcaagaagcaggcagctgccatggcggccaagaggaagcaacaacccaagctaccacccgggctagctaccatgccggtggttagcaacatgcaccaaatgctgatgaacaagccggtgttcaggtggatccaccgcctgctcgacgagatggacaccgagatcctgtgcctccgtttcggtcgcgtccacgtgatcgccgtcgcctcgccggagatggcccgggaggtcctgcgcaagaaggacgccatgctcgcctcccggccatcgtcgttcgtgtcgcggacgttcagctttgggtacaagaacaccatcatgtcgccggccggtgaccagtggaggaagatgaggcaggtgctcacgtcggagatcctctcgccggccatggagcggcggatgctcggccggcgcgtcgaggaggctgaccaccttgtcaattacgtctacagccactgtaatgatggcactgtagacgtccggcacgtaacgagacacttctgtggcaacatcatcaggaagctggtgtttggccggagacacttcaactccggcgagggcatatctggcctggccg

SEQ ID NO: 94098 - DNA, 550 bp, Oryza sativa
catgcatcctgtcaaccgctggacctccctgagtcttgtgggcaatttcatgttctcgattccctttatcttttcagggttgacctcgattccttgtccggggactaggaagccgagtaatttccctaacggttctctgaatgtgcacttctccgagttaagcttcatttgatatcgtcggaggttgtcgaacgtttcccttaggtcgtcgattagcaaatcgcccgtcttggttttgacgacgatgtctaccacgtaggccccgatgtttcgtccgagttgatcaccaagtgcttcctggatcccgcgctgataggtatttcctatgcttattaatccgaacagcatcttggcgtagcagaatacaccgaagggtgtgatgaatgccatcttctcctcgtcctcttttgccatgttgatctggtggtagccggagtaagcatcaagaaaactcaacgactcacaacaggctgttgaatccactagttgatctattcgagggggagggaagtggtccttgggacacgccttgttaaggtcggtgaagggg

SEQ ID NO: 94099 - DNA, 540 bp, Oryza sativa
tgctagtaagccttgccgacaatggtgcgtgcagcagcgtggttgccatagataccaaaatgtatgtccttcagcaattgtctcccttcttctaaggatacgcaacgttgcagaattcttgatggacttttcttgtacagctcggtctcatgaataatataaagcctgctgcgcctagaaatctgctcggcttcatctttatcttgagggagttcttgggaggtcagaaatcgtatgaggggctctctccagttggcttcgaccatagctatgtcttgagtgtccgcggcttcagctgtttgtctcttgggtatggttggctcataaagatgttcgacgaacacatcagaaggggccgcttcgtgtttggatccaaaatttgctagtctgtcggctgcttcgttattgtgccgaagaacgtgggtgagttcgagtccattgaacttatcctccaacttgcgtacctcttgtcgataagcgatcatattgtcatcaaggcaggaccactctttcataacttggttaacaacgggtaccgag

SEQ ID NO: 94100 - DNA, 3188 bp, Oryza sativa
aatttaaactttctctaaattaggttctcagcgtctaatgacatggggctcattcgtcagcgcctcggagaggccaggcagacagagcagcggccgagccggcgccggcaacaaacggcggccgttctcgcgatgcgaccaaaagagaaaacatagaggggttctaggcgaagctaatggtgatgtttatccaagctatggtgactggaatcgatggtgccggcagtgcgagcggcggtggttctcaggttgatggtgcatgtgtggatggaggtcaattccgagcgaaagtgatgtatgcatgtggttttctagtctccacggtgctcaccgagggctcagatggggttgccaaagtcttggcggcagcgacgacttgcagaacggctcggcgacggcgctccacttcgggtgaatggcgacggctcgaatgggacgacgagctgctaaaagaaggcatgcacgagggttgtgaggtcacaaggtgtcaggtgctagtcggctgcatctacagagtgggttgcatctacagttatccaagttggacccaagcaagcccaaggaagagaggacagtataaaggcagcaacaacacttggaagaagcatcgaacaaaatagaacacggcacggcggtggccacggcggcgacttggttcgggcttgaaccttgttgatctccttctttctccctactcctgctagtaacttgtatcccctattcactcccatttccaccccaaagcttgagttgtagtaatacaattgcagctcaaaaccaccacaacctccattgcttgtactggatattggttcattgagatttgggtattgggttactaacaatctggtatcagaggcatttagttcactgggattcttgtcatggaattgttggggaggcagccatgaaagagggagcaggaattgggttggaaaagttctcatccaggcagcgcccaccaactgtttgatggaatgtctagccaacctgagatgcccaaggaaaatcagaggatatctgagcatgtccccaacaattccaccatgaacaaagaggagaaatggctagatgaagctctagatcggatattggagaagtttaaacaaatggaggccaagcgcatgcaagaggagaagatcaatcggatatttcaaaagttgtaggagatagaggttcgtaggagcaaggcttccgaggaaatgattgctgccatcagggcaaccaccgccatcctcaaggttgcatcatctccaacacccatggcaccacctcctccagcacccaccaattgtttgatagaatgccccaaacacaacatcaattgggtgacgacgaattcaagtcacattggtgaggtgcttgttccgacagctgaccaggagttaggagacagcgaggacaaggacgacaccccctatatcatcaccaaggacttttccgaagtcacgcatgacaagtgttcgacagtgggctttgtgatcaagtgtggcgccaaccaagccgatgacacgtttcaagccatgacgggtgcatccaaggtcgttccaacatatgctcaacctatggataacttctcgtcaaggatgaatgacgacaacaagttaatcacattgatttccacaaggtgttcggtgaaatggcatggagaagacaagaacgtatggaggtgtacaaacatccatgttgtgcccctactatcttccctgctcacctcattgctgctagtgaaattatctagagggcacatggtggttattgggcaatgtgtacaaacatccatgttgtgcccctactatctcccctgctcacctcattgctagtgaaattatctagagggcacatggtggttattgggcgattcccattgcaacactttgaacttatactatagccacctccatcatcaaaggatccaagcttgggcttaagggagtatccttgctgttcttggccaagagcacacttgatgcaaccttggccacctccgacttcagatggattgactagaggaagggaattgcatcctatgctagggtcaggattcaaattctattgcgtaggagtacatttgaaactgccatgccccccaccaagtttagaactgcaagagtttggaaatccatgtgctgagatggttcaccttcacataattttcctggatcctcggcttcaacaacataattttcaattaaggtgtagatggtggataagtgagctatttgtggatgttaaaagtgctaaagtttatgcttttggggttagttttacaattgttagcaaggaagataacctggttgttgggtgctggttgatgaaatctattggaacagttcagagatgcaactgctatctagggccatcaaattaccatttagctacctacttgaaggcacaattatgtaagcaaggttccgaaacctatgcttgatgtggagagaataacaccattgtcagtatctatttaaggcaaccaaagtggctttaccacagaagcaaaatcaacacttgtgccaccttctaaacacacttgtggttttgtgcagaaaatatggcagtggttattgtacttccacagatattctatcaagttgccatggctagcaaagtgggaaaatgggatatgagagtaatttgcatggtaatgttaggaattgaatcatggcagccagcaaataacatggtcttgaatagtaaagaggaaatgttaaatgaaaatgcaagcttttatgccaaggtgatttgtgagaagcaattagctaagggctacagaagaacgagtagcactagagaaggtgctaattcaattcaagatgagatatatccttttgatctcgtttctgcaaacgtacttgaagaggtggtgtatattacttcagggtatacttggccatgcaaatgcttgatgggtggaatgagaatgccaagaaatgttctgaatcataacacgtggactcagcagttgagtaagctagtgtgtttgctaccaaatggttggggctctttgttgccaagcaaattgcttcaacactgctatcatgcaacacataggaaggatgcaaatgcagcaagaagctatacagggtgtcagtacttgtttattacacttcatttggtggttttaatttctatcattaaagagttcgagcagccacagggtttcaaaaggattacttcattggcttgtg

SEQ ID NO: 94101 - DNA, 2239 bp, Oryza sativa
caaaagaggctatcacaacattctgcacgctgtttaacaacagggcagctaacaggtagcttaaaatcacgagcttacagccacaaaggcagctaacttaacctcggatcatacaaccagttaagtacttaactagagataaaagttattggcagatgtaacgcatgccttcacctactttcatggttcttatttttcccccacaatctcagccagctcaccaatcttacctagagttcagatcgagttctcctgatctgcgccagtcctcttgcatatcagagttcccattctcaggttcattttcatcattaaggaaatcttcagatggatcttcatcgtccctttgagcatttccccatccatcttcaccttgctcttgcatcatctcatgactagggccatcttcgccttgggacgctgcagcatgggccctcaaagggccatgacctatcatctccgagtgcgcttgggcctccgctcgagcttgttcagccattgccatacgcatcttagcttcagcagcctcacgacctgctttctcccttgattctatctctgctcttagccccatcatagcttgcttttcctccattaacaaagcctgctccagcatgagccgctcctctgatctgaactcgccgatggctcttttcttggtcattatattgtacgccaaaacttgtttctcaaaagtagttgtgaactcagcaattttgaccagaatgttatgatcccattgctgcaggcgcgaaggaatctgtccagttgtatcactgtcaaggattctgtcatcttcttcagcctcatagtcagcaaccacatggtagggtagtagcctagtatgcacaatacataagatggtatcagtaacttcagatgtcatgaagcgatcaaataatctaaaagtattgaaaccgcacatttgagcaaataaactcaatccaagttatctgccaattcagaacttatgctcaaacatggcatatttgaaaatatctaagatgaaaaatgttcttgaaagaatggttgttaacattatcctgtcagaaggatttatataattgaattctctgacatgtaaagtgaaaatcattgattcccatagttgtattttcactgacagttgatgaagtgcacccatacaggaaaaagagaattggatgagacaggtgagatggtctacccacattggggacccccaccatactcagcacataaagaatttctgcatcacaactaaaatgtttgatcatgattcgatgagctatttcatcacaacactcttggctgcactcctttgcatccttgcatgtgatatcaccagtgaagagtgtctttcttctatcacgaggctaccccttcaaagcatacaaggctattgttgggataatggcccagaagaatttacaggtcaacagatttttgttttgacataactgttagtgtaatattctttactaaatgatttatcagacttatcagttgtttaatgtattatgcagtgttaagagttgtaggcccatatgccatgaggaaatagggcttcactcctgctatactaatcactctttagtgacatttggataggtgatgggtttaggaaaagcatatggagtaggatacaaaagactgggtttggcagtctgggtctataggtgttgatgtttaattctcttcccatattttgtaatcactccacttattttggttcggaaaataaaagtaaaaggaaatcacagaaaagaagaccagatcaaggagcgagagcagtcgagattagcagcaacattaattaggaatacgaccggctgaatggatgcgcagctggcaaagaaacgacgatcctgtatcaattcttcacgccatctcgcctaggaaatcagatggcgagtatctcagagtcaaaatgaactcaaggggatgattcatgaaggtgggtcttcagccgatggctaccgacaacagaacaacccacagagcaacaggcccagtgaatgggtgtcaacagcagagacatcacgctaatgctcaataggtgagtaaaaaggtgctgatgctctttttccacagcccaaccacccaaccaaacacacattccattgtgtttaggctttagaatcatgaaaaaagaactcatttttgtcccaaatcccaaatcaaaacccacttctcttccttttcctcctaagtcataacagggataggagatcccccgaaccccccttttcatttccac

SEQ ID NO: 94102 - DNA, 1355 bp, Oryza sativa
catatatatatacatatatacatatatccatatatatacatatatatatatattatatatatatagtatatgttgatgcgaaaaacacacactggcataggagatctacttaattccagtgcaggtgctaaatcttgctcttgggttcaaaggcgtgccagttggtttgatcctgtaaccaacaagaaacaaagaacgaaataaatgaggttaaatccataaacgatagccgatcggctaatggccgatgacatatcgtttatcctttagccgatgtcatcttgaattcgatcggcaatgaataataaagcaaaataagattaaatctactcgatcggctgtagatattagaaatatataatctatgtcttgacatatgtttaaatcaagtgattgggatagatcgaacatcatgccgagatagtataaatcacttatatccaaaagtacttcaagatagggattatatatactcatagcttagccgatgaagattggtctaatatgtatcagctattgctccgatacttctctatattaagatattaaaacaagtaaaatacaccgaacggtaggcttaatatattttaatgcactaagattttaatataaagggcagatttagtatatcaagtaaacatatagatgacatgataacttaatcagataatatcggctaaaaccccgacactatctctattgatgatcataaaacaagctagatattatggttctaaatattacctaatagatcgaacctaaccgatgcagcattaagcataacgagaaacaaaagatctaggcaagttgatgaaaacctcttgaagatgaccgatatgttatataacctagatcaacgatggcatctagccctattggtcgctttctgatcgcagatgtcagccgattcaaggttagatgacaatatcgatagagattatataacatatatgataactcgacgatttacttaaacaagattagagtatcatgaagatgtaagcactaatcccgagaacgcaagccgccataacaagttttacctcttactggagatcgaaactgatgcagcccaacttgaagcaagaactcgtcgaaagtaatgaaaatagaaaagggtggcgatgcgctgaaagtgttattgaaccgtcgttgttgtttacatgggatcgggctatatttatacctgagatacataatgggtccttgccggacataactcttatctctaacaaactctaagatatgaacaagtctttacggcagactcttaccggaacatatctctaaaggaactatttaaaatatcttaattaatagatacaattaccttcccaggactcaatccatacgtg

SEQ ID NO: 94103 - DNA, 8789 bp, Oryza sativa
  unsure (1)..(8789): unsure at all n locations
cgcattgtagattggataagtaatttacgagaaaaatcgttttgaatatcgttaaaggtgcatgtgtgtcatattggagatagagatataggcttggatatttgcatgtgcgtcagaggcagcatagttattgtctgcccgatttttctcgtgtccgggcatctgaagatggagagtgctacaaatcggacgtctgatatttttcaaaatatcggacggtgttgcactgtattattgcaaaatgtttcacatgttgcactcctcgataaaaaaatgtttcacttaaaaagttttagatgttttatcgatcgaggaaggtgttgaactgcactgttgaaaaatgtttcacatgttgcactcgatgaataatgtttcacttggaaagtttaagatgtttcatcaatgaaggaaaaatgtttcatcgcttcaactggaaagtttcagtttcagatgtttaatcaatgaaggaaaaatgtttcatcgcttcaatggaagtgtttcaaccaaatgcaatcaaaacgtattgattgcaacatgaagattcaatatgtgcaacatcaaatcaaacaaaaatgaaacaccttaatacaatggagtgccacaagctaaaataataagatgcaacgtccctaaactccaaacaaaacaaacccacctccatcttctccgagaatacaaacccacttcaatcttcctcaactccggtcgccggcccccgagaaaacctacctctcttcttcttcaacaccggttgctggtccccgatgaaccactctcttctccattccgctgcgatggccgccgctgccgccacccccaacttcctcctcctccgacgcccgacggcacccaagctggccacggcagcctagcagctccgtctccccacgcgggctgctaggaatctcctgcatggcagtggccacgcccgcgcagtcttccttctcccccaccggcggcggcgtcgccgctaaccgcaaggtcttcaacttcgccgtgggcatggccacgctgccgttctccgtcctccagaagcgcaggcggagcttgtccactaccatagctccggcatgaggaagatagatggaaatgtgtggggaatggagtaagtagtcagtggggaggagagagagagagagttaggaagttgaagggataaggctaacatgtggctggtggagttgaaaagtgaaccagtaaaatagatgggatggtggagtgccgaccgatttttttccaactgccggacgttcggcttaaagcattatagatccgaagatgctcctatgcatacttggatggaaccaatcctcggatgcctatcgagggcttccctaaatgaaaccaacacattattgtaatcagatgtgattatgacgtcttcaaggctgtgaaggtgctgaatgccatatagagacttggtatcttgttctgcctggccaaaaacaataagatgcataattctaagctttggcattgctcctggcttgatcgacaaactggaggtggaggatccataggtcaactttagttctttgagaactgaaaatgatacactatctataatgatctccatgccaggaaccatgaacacttgcaagtcaaggtaagctaggcagggtaaccttgagagaactcgcatatcatcacccttgagttcaacgaccttgagacacagactagttaaggtctcaacctgttgtatccaatatggaaccctatggaacgccttgtaaaggtgacacctctgaaggaattgtggaggaggagaccagctgcacaagaagctaatgggtggttgcctgatattcccctctagaacaactctgaaatctagacagcggaggttgcagccgcccagttccctgagagaagtggcaagagcagcaaactttaccatatctatcaggtcatcttcatcgttgcctcgacggcgattgtagatgacaccaagcgtccttagattggtcagcaccccaagatgtcggatgttttcaacaaagcaattgcagaagttaattccttcaagtgtacgtatagaggtcagcctggtaatccccctgccgagctcttcactccctgcagctctcagatgccgcaatgatggtaaacaagcatcacgcagaaatccacccacgagtacgagattagtgccgcaatttatgtcaaccacttgcaaatatcgcagttccccaattgtatcaggaaactggaaaaaaataccttccaacttcagatacctcagttgaaaaaggttacatataggagacaaatcgtatattgcacggaatgaaaaataaccttctattctcatatgtagaaccctcaaggctttaaacatgcgaagacgaggcaagctttcaccacgctgatggagccaattcccaaaataagtgatagatcggacttgatgtaaagactcacttgcttggattatgttaccacagtttgatcggtagttgagccggcgaatcaaaaagttacctcgtcttgagcaatcttgatcagtactaattacagtcacaaagttttcctccgtcgacttctcaacaataagatcaagtaacaaattgtgcacaacacgacaggagacaacctcaccatacttaaactgaactggctttatcaggcttctatttatgaggtctctgaagtagctctcagcaatatcttccaggtctcggttatctctttgggtaataaatccttctgctatccattgtcttaccaagtctttcttcatgatgttaatgttttcaggatacatatgaagatataggaggcacgtcttcagatcccaagataaattattatagctaagtttaagtatatgcttcatccatttagagttaggatttgtttccagttcaaaccccatagagttttttatcttcaaccaattatccagtttgttaacttctctttgactagccaaaagactagctatgacatctatagccaacggaactcctccacattttcttaaaatatcaacaacaattacgagttcttcaggttcagggatgtagttatctgacccatataatcttctgaagaataagcttctggagtccgtccaacctagtggtttcatcttatagacaatgccacggaagctagagcagcaggcatttgctacatcctttgttcgcgtagttgtaataattctgcttccactgttgttttcgacaaatgcaccactaatactgttccatgtttctatgcttgatatgtcatcgattacaactaggaacctgagaaacaaacatagctataatcaatagcagaaaaccatagatatctatagaaaaccatatcaagctatttttgttataaaccatatagttaaatcctggccttcatactcattggtatatctatatctatacctaccccgggcattatcttgtccagataataaactgttaaaatttctatcaagtctacaatcagatagagaaacgatgactgaatgcagcatgggtacagaacatgcgctgcaacagaaaatattagtacagattcgtaacgcccattacaaattaaaaatggttctcggttatgtaagttgagcatcttcattgtttttagcggtatggttaactggtcaaggtgatattgttacttatcatattactgaaaacaacaagatttataggtttaaaaagaatgccctaaaacaaaatcagaaactaccacatggtaaacatgctgatggtgtaataaatcaagataatttagtattaaaccttagacattaagttttcagaacatttatttggtgaggcatttcaattattatcagcaagaactacacatgatgattatcagtttgttgcaagaataaatttatccatttatttttattttagatatattttatgacaagaaattcattattcatcaagaaacaaagtggctagctcacactgaaatccaacagtattatctaaaggaccttctgtagtccttgttgatatagtactagttcaaagtccaaacctacttactcattgttttagcaatactaatattgttcttgtgtgcaacagtacagatcttgcaaactatagtctttttatagcacttgtgtgcaacagtattagaaggtacaaaattaaatttctagtcgttanttctgggtaatantttgggacttatgnaagatcanantttnacatannnaatatgagtacctcacaagtatcnttatcnagtnaccataaatatctcacaagtataatgtacctctataggacccttaaagagctattcaattgttgttgctgctgctgcatgttattgctgtcattgtttttgcaattttaaacctagttcaatgttatactcaacataatttacattgaagctgaaatcactcatcaagtagtaagtttgtgtgctagtgtgacaattatgatattttatatataattcctttttttttgcagcagttgctagaaaacattggttaaaatcttttgtgatgtttgataaaaaggcaaaattagatatacagttatttgatggttcttcatgtaatatttgcatatgatttgttcttttatagggaaaaaaattatcatatccaatcacaacatgttaaaaagaaaagaagatatattccctaggatcaaccaactatcctctcgttcaagaattggccatcggctgattttgtggattgtggaactaaaaaataattcttctgacacatgtgtagagttgttgataaacaaatagatgcaaaggggtggatttttttcgaagttctgactaaaaaggacaataattcttgaagagctttcatgaaagtaaaaggtggtgcaggagtattgtgaaaagaaagtattaaacaatggggaatgcacaagttttgcgaggaagtttgggttgttaaagttactttgtgagtagaatatcctaagccatgagtctcactctggtgccctctacctagagtagaaaaaaatctgaactgttgatctcatttgatccaaaggttcatatctatttctactaccaccacatttagtggtagtagaattgtggagggctactttgtccaggaaaaattatctgcggagggatattttcgtcctttaccctgaatcgcgcatctggagccgatgcggagagaaccccgcggctcccatcaccgccttgacgacctcgcctgctccaccgccctcgacgcctcctactcccacgcctccgccgcactcgccgcctcagccaccctcgacgagctcgcatctccgtctgggattgccagagctgcgccctctcccaccgctctcccgcgttggcccaccttccgacgagttcgcctcccggatctccgcctctgacccagcactgcgccaccggccgtcaccaagacctcgtcctcctcgctatccccttcctcgtcgtcggcctcctcccccacgctcggctccagccctgtccatctccgcccgccgttgatcccacagccgcgagggcaagcccccaatccatcgcctcccaagcggaacccgcagcctccggagccaatgactaccgatctctcgacctccgaatcatccaagactcctctcgctggctatagcgctgctctccaacggattagctgacatgataagactcttgttctgctttgcaggtcagatttgatttgttttttttgctgcttgcaggtttgcagctcgaacatctgtactgaatcttcttttttgttggcctctagttctcgaatagtttttctgcttgtctgctcaagctctgaatttcttggtcataatttttcctcctagaagaagggattcaagttgaatgctagtaaactgaatccggagcaagtgagcttgttcagaatagctgagcttgacaaggtggacaagctaatgatcactacgtcaatcaacgcttgagagattcctggtgtgttatgtcctgtaattcctgtgaatccattatctcaagatggctttgggtggctttggcttgttactgatggccatgttttttttcagcttgtggttttgaaagtgcctatctgtgtatatcatcgtttttgtggttcaatgtatattacttgttgtaattgcaattgtaaagtctatgtaaaacaacataccggattattcttccgttgccttgtatctgtcattgctggattggagtgtttcgatttgtccattgtgtgtaatattcagatatataactagtatatttaaattttatatgaaataatcaagctgaatggaaaccaaatacctacagcaagaaacagtacatctatggaacgcgatgcacaagcgccggcggtggctagacttcgcgatctgcttttctttttctttccctgcgctctccttttcgattaatgaggaaacggccactctgctgtacgatggagagggagcgagcgacgcttcaaatgagaaaaaaaactaagtgccaaatttacccctattcgtttttagcactttactaatctgccctttaaaataaacggtcaagattaattctacttgtagtagaatactgcaagtaaagggcaccggagcgtctctctatgttattagcaatcaacaaaagtgatcagttaaagatatggttttacaggaggccttccgaagaaacttcattgagaatgaataggagcatattatgttcattactggagaatgtagaattaaactttgacagcgatgggttatctttgcctcacagcacaaatgggagatattctctacaagatccttatacagaatataatgtatggcaataagagatagattacccgatggccgctctcttttacctgtttttatataagactcttgtattggctttttttaaagtaaagttgaattgatattcttgtgagtttctcaactgtttaaatcccaggccattggacttgacaattcaaagaaaattggggctggcaacgaactggctccgctgtaagtttttttttttataaaactatgaaactattcttgtagttacctaggaaatattaagatctcgaatgtgtcttttgctgtaacaaaatttttgtgctgttgtttttgtatatatgtggttcctctttaatagttttcagaacaatatatatttgccagaaaacctgaaacttgaagaaaaacattggaacattttgctcaagcttttgtcatataatgttgggaactacaaaaaaaatttcataaattttagaagcatatgatgaggccaactatttattacttcttccgtttcataatgtaagtcattctagcatttctcacattcatattgatgttaatgaatctagacaaaatgctagaatgacttacattgtgaaacggagggagtaggtcatctttgtccataagggcattatggccttttttttcagaaacatatctgcttatacgtatcattaacatgactaggaagttgatttatcgatcgtatataaggaatagagacaaacaaaatgcaaataattgattggtactgaactgagtgccaaggaatataattctctttaaacacctaagtaggaaaacccaaaatattatggactattatatcaagctgtttgctacatagacctttgatggtacactaagttgttgtgatccatccattgccaattggaatagttgtattgacacaacgaaatagaaacatagaagcatatgctctcatacctcttgcaagcgagtttttctctggttgcgtcgatcagactttgtatgtcatcagccgatccatcgtatttgagttgtgaaagaatgtcctttaaaatcactgacgcgctacggtttcgtgatgcaaacacaaacaccacgcactcaaatctgccatggattttattataaacctggatggccaaagttgatttaccaagacccccaagccccacaatggagagcaccttaggatgctgtcctgactctccttccatgtcctccattagcaactgcgtaatcacctcacacgggacattgatgccgacgagactatttgcctctccacacaggacaggtgaaatatcatcatcgatttcgtctatctgtctcggattagagctgatacactcgtcaacgtcgagattgtatctctctactcttttgacttcctcgacagcataataatccttgatttcgtcgattttggcgaacaagttagggagcatcagctccatcgtgtcagtgagcaaggtggccttgtcaactgcagtgccaaaactgtgcatgaacatgtcaattttgtcctcgacaaagtaggccagctcacgtaccttgttcctcagctccctctcctgaatattcagagcctccatgtcaggcagcttctccagtagagcattcatgcagctcaactcctctttcaagttccagatattgttcttgaaatcaaattgggtagaaaattggaactctgccaagtcgtatcgacacacctcttccagcttcaccaggagtgagttcatcaccccagtcgaaatgttcacggccatggctcgatcaattcctctctctctctctcgctcgctctttcttgatctatgcttgtcaatgatcttggcactgcgtttgaatgtcagtagctagcagatcaaccctccagttatataacataagatactagctaattaattgttctttttttttctttagaatgacagctactaatttggaatgttcacgaactttcctacgtgaagagtattgtacgtcgatccgtataaaaaaaaatgaaccgtgaaaatcttataattattgctggtgatgcacatgcatgtt

SEQ ID NO: 94104 - DNA, 601 bp, Oryza sativa
cacgtctttgatacgtaaatccgaatccagtcgagggaagaagatggtgacgccggacaagaagaggaggaagaaactcgcggagccggagccgacgccgacgccggcgccggagccggtacctcgtctcctccgcgttcgtccagggaacaagaagaagaacaagggggcctcacctgagaagcagccgccggtgtacatggtgttggcgcacggagtcgaggaagagcccaccacccactccgtaatcgaggtcgccgcctgcgccgccgcccgccgcctgcttaacaccggcagcggccgcggccgcggccgcggcatgtcgttcgccgcggtggggacacgcaccgtgggcgtcggcgtggagttgaccaccgtctacgaccccgagacatccacggagcgcggcggcccgcgactcatcttccccaaggtgaaccccgtcctcatctcgatctctgacgacggcggcggtgtagtcggcggcggcacgctctacgctctctcccgcaccccggccgtcgtgaggccgctggatttcgagccatggttcttcgtcctcgacgacctcagccacaccgtgtggcgcgaactcccatcg

SEQ ID NO: 94105 - DNA, 655 bp, Oryza sativa
ctttgctcatgtatgttctaggccatgcatgacattctctaccacaactatcatattgagaaggtaatcatttctgctagtctatcaatacaacatgcttgatgcttatttaatttctttcttcaatttgctgcagtatgatcatttagaatttcctggtgttgtccctcggtcatttataggtaatactatgttcacttgaagccttgatctgtgcactatgctacaatttttccgctaatgaccattgcttggctcaagcataatgaaatggcaagtagatggtcaaggtcagatggcattaccagtttaccacaatatactcctactagatatgcctgtagtgtctatatatggtatgactggccttgcagattttgtaatctggacatgacgcagatcattaacaccgtttactacatatattcttcaggagcattggttgtatctgttatctcatcgcctgcagtcttcgtaatgcatttatgtcatgttccaaaggtttatggtcttctagcaggtgctgtcaataacttagcacatgtcttcttgcatgttggatctggttttggtgccatattgatgttcttctattttgcccttttagttcggatagtgttgggtagtattatcctgatgactttgagacttctcc

SEQ ID NO: 94106 - DNA, 659 bp, Oryza sativa
gtgttcattttatagtaccacaatatgggtgtctgaaatagcaccttagaacccacaattccacaaacaaacaccatgggtgctgatactatccgcatatcatacctgatgctctccatttgaaccatcgtacggtacctctatccggttctgtaatctctgcagacaacactcctgcagggcagaaaaaaaattccgtcattcgtgaagagaacttccatgcctcacttactaccacattggcatcacattatcacaaccaccttcgctagccatctctccaaatgccaattaaggttcgaattaacctgattcaattttatttttcttataaatcacaatctacgcttgcagggatcgatcataccaatactaccataggccgatttgcatacatacatatacccaccatccatccaaaaaaacaacttcaagctacgtaaaaaccgatcgcatgatcacatcacgacatggctttaccaagcattgacgaggagcagagtattttgtttgtgcattgtggagtttcacctgagcggggctcaaatcgaaggagatgcgctggtcgctgtccctcctctgcgcgcagacgcaagagaaccccctcccgatccacgccgttgaccccgccacgacctccgctgcggcgcgcaagccaa

SEQ ID NO: 94107 - DNA, 624 bp, Oryza sativa
taatttcatatcgaacttaaatttgttggaccagattggtattgttgagttaaatcatatatttacccacagccaaagattaaacagtgatgccattgttgcttttgtgaaagctctttgcaaggtctcaatgactgagttgcagtctccaacggatcctcgtatcttctgccttacaaaaatagtagaaatcgcgtaagaatttcctagatccacttgtaaaacctacctttcactagcagatagtagctgtgacccagtacttgtcaactattctaattctgaactaaattcgtgcaggcattacaacgtgaaccgcatacgtttggtgtggtctcgaatttggaaagttctgtcagaattttttgtatctgttggactgctagaaaatctttctgttgcaatatttgtgatggattctctgaggcagctggcaatgaagtttctggaaagagaggaactggcaaactataacttccagaatgagttccttagacctttcgtgattgttatgcagaagagtaatgctccagaagtacgagagctgattgtccggtgtgtctcacagatggttctaagtcgtgtcaacaacataaaatcttgctggaagggtgtttttatggt

SEQ ID NO: 94108 - DNA, 1390 bp, Oryza sativa
tgtatcttgcaattcgttaattgtgatatgtagcttaagttcagctctattagtttagaatgttaatagcctgatgctaaacatgttcatggtttctttcttccttttttttttctcaactaaagaaaaggtgataatttgtagcatgtagcttgtgaggttattcctaatactcagttctcatactactcagaacatgaagacaagatagattcttggatgtaactgttgccttgtgcattgctgttgtatctgtataactgaattgacaactgtgcctgaccatcccttgaaactattactgatggtgtatcaattgtttttagtgttatcttgaaacgagtcttagttctaattggctaactacgtgaagtgaaatatcacagcgttgtcaagtcagttaaaagatgagaacaatgctgttctctcttttcttggggattggccttggtgcttgcagaggattcagaacctcgttgctttactagtactacattgcttataatatatcttcaaaattattgcagaaattttgtttcattattgtgttattcatgccagtgatagcaaatgaaattaccctttcagggctcttcttgtcctatcagtctatcacaatacaagagctactatttaactacaaggtgctgaatgtactagcaaacgacaaacacaaaaccatggtacaaatatatgatgttgaaaacaatcttaagaaattctgcaattgcaacgtagaacacgaggtacacggttcgttattcacccatgatacgctgataggcactacgtactgacagagacagacaccaccagaatcacacacaaactttaaacttgttacgtggagcaactttgtttagccactatgcttacgtacggcttgattagatttagatcacgtgacaatttcgcataattacgagatggatattattttggtcatcctcatggctccccttttggttttgtgacgccgctgctgccgtggttgccaccggttgtggtgatcttacgttggccattgcctgtgccatctccaccatgcttgcaacggtggctgctacagatgctcggaccaggtacaatgaattgacgaacgccattagcatcatcccctcctcctcctcctcctcctcctccggcgccacttacatcgcctctgccaccgccaccaccactactctcccagccgccaccgccatcaccgctttgcgcattgtcgctaccgccatcacctccacctcctttgtttccaccaccgatgacatttctgctaccaccattagatccttttattttgcctctgccaccactgttgattcctcgatctccgttttgaccatttccacgacctatgccactgcccatacctctacctctaccctac

SEQ ID NO: 94109 - DNA, 4259 bp, Oryza sativa
tgagctaagctgccattttggggtggctggctcgcgtatttatagccttcagggcgactttggtgagcagagcactatagagtatagagatccatgcactttgtatcggtaagaacatgtcggcgaagtggaggagttccgtgtaaatcgcttatgctacaagcgatgatggatgtgtgcgtccgtcctactacagaaatgattttcacggaccataggtttttcttttcggaatcaggaactgaacaacacagtgacagtgtatgattggttaattatctgacgactctcaggatccccgatgatttatagatggtgatcactgagctcataaccaatttggagatttttataggttatgaaacggatgtataaaaaatgtgccagaccattgtcttacaatatatatatcctttgctttcttggaaaaaggctgcaaaattccagcatgggtcatcgatcaatcagtgcctctttgctttagcaacaaatcaaatacatgcatatatactcttacataggctacggtagtagccattcttcaacatcaaggatgaccacatagcgtaaaaggaatcaattggaatccatctcccaatcttaacgaaattggtcgaccgaacttttggccaacccggcaaaatcaataggaatccatgactctctaagtatgcccgtaaccataacaggttaacaaaatcggtcggttttcatgaaactgtcagcggttggtttgtaaaaaccgattaatttgtatggagttgactaacagtcaaacaacttttggcatgttttcgtttagttcttggcaaacggcggtggggactgattttcactttaaaatatctgaaggtaaacactaccttatatcaaggcttagtaccatgagaagttaaaaccagtgggtcaccatgctaagcacaaatgaacaacactgcacggtttaatcaatttcatatacacattatatgattgatacaaggggagaagcaccgataatatgttggtgaagttgtaatgtatgagtctacccaccaagatttaaatattggtgtccataaatattacgtgcatatatgtacacgcttttagtaagatttttaaataaggtggaggatttatcgttggtcttcatctcttgcagacacgttcgcagggacgtggcgctgggttgtttatctatggactattaattttgtggagagccaatacaaattttagcaagataagggatttatagctagtctccatatcttgagacattcgccggggtgtatggctaggctgttcatttgtgaactatttattttgagagccaatgagctaatccactagccgttgagttgttcttctaatcttgggcttaagattgctcgatttggttttagtcggttcgaaatggaactaggtattagcaccccaattatgtgatgtatagtggtgagtgcacatattgatacatgtttttccatatctttctttactagtttaaaaccatagttggtcttctttctctgtaaaaaaccgcgccctcttcttcctttaaaaaactccctagaaaaccactcccctttttctgaaaaaccacccatcaaatccgtaagtagtaataaaaaataacactcagatttgatactttcactatgcaattaagcatggcaaaaaccatgcaacacagcacccgttgatctttttagataatgaaagcttaaatacaccaagatgatatatttcaatcgagtctatccccggcctctgcatagaatgtacacagccaaaaaactagatctaagaagacttctctatcacaaaagacagaaactagtggctattaatccgtaaactagacctccacccatgcttctgggtaaaatccagtaaaaaaaaaagagcaagaaacctcacgtacgtgagaacgaggcaactagcagatcgaatcactgtgatcacggcgggcgccgacgaggccagctagcggcggcggcggcgacgacgacgacgtggttaatttgatttctgttcgatcggagtcgcagctgtttgttagatcgctaattgttttgtcgacgacaacgctttctgcctgacttcctgccaatgggaagcccacgtacgattgaattgcttgtacagataaaaagaggaagcatatatatacatcgatctggatgtgattaattagtgagtgccagcacggcatgcacactaattacttaatttaatcggttttgctgcatgcataatatgcatcagtgcgtcgtgttggtaggtcaattatattagtcatttgagttcgaatgaaattatgaactcctttgcaatgccaatgcatatatagtcagttagtaacacaaatacactagctagtagcaagtacatgagcaataattgcgagccggccgccatcgtgatgattgctctggccttttagctaagaaacaagaagaaaatgaaagaaatgtttacagcaacaacctgttggtctctcgtctcttgatgaaagcaaatgtaatatcaggagagtgtttcgagtataacccagtgttttccctgtttaggtaagagaaaagggagagaactaatggtactcaactcaccattacgtgaaagcattgggcaagatctaccatctcaaatgacaacgaacgaaacaattcgtctggaaatagcttcaaatgatacagacacctcgtgttttgtgcacctgatcagccgccatatttggggggaccaaaagaatagatctcaccagatcattttaaacaggtactaccaattttaaataagtactccacacactacagattcacagcatctaaaagtaaactcacctttgccagtaattgcttatccctattactttttttctttaatcatttcctaatcataatgggctagcagcaatcacaaggctactgccaagataagagaacgaaggctagactttgcttgaaaataaaggctttcatatttcataactttatctatgcaccacttacagtggaacaaagctgactcactgaagcaatccatccttgtgccttctccatttcttttgacttgagcagaaatgctaacaaccttgaatatgacaccaggtaaaacagttcatgcgatacgcgatctgcttcagtcagcagatcgctccgataattaccattatttgtcaatgatttctttcagtaatctgacaattctacaatgatacagatcacattgccaacgctcttaacttacacatctaaactaatgccctggtgtgccttgtgtgatctaggctcttacatgttacatctactgctacaaaactggaaggttaatggtacatggtcgcgccccaaagagagttagtccacaggagaagcagattacgaacagcacacggtgcgcattcttccttgaatctccaggttccctcgggaagcagtgaagcacacgcagccacgctggctacaaactcgggaagcacaggcatgccaatcaatgttggttcctcccctctgttcttcggagtgagcttaaatctcatcatcatcatcatcatcatccataagttcatctggaaggtgtactttctccattgcagactgttaaacatcagatggacatggacatggacttgtgactcggttattcagacgcagatgaattgcagcattgagacttgtacgataatggtaagatactaaaactgagaaacaaaattttaactagcaatgattgctggaccaccgtaggaagagacaccaagataagttctttaaaataatatgtagtgcaggaaacaaaatgggggtggagggaggcaggtggagctttgggagtgggataagcaaagatagtgtactataccttgattatagcaacgtcagcagcaggaggtttcaaatccagggcaatgccaaagcaaaatacagccttgtcaagaatgttaagttgcttgtaaatctttcccatcagtgcatacatactactttcatgaggtgcaatttcctttagccgttccaactcatccagagcatcagggtatttttgtaggcctagaaggattaaagccttttgatacttggggagtggattcttcttatcagcaaatatagcgttctccatcatttccaaggcttcctcattcctctgaaagtttcgattcagaaagaaggttcatagttaatcattgtccagatgatgatgaaaattctagttttgagggtaagtggaaaccaaaaattagtatatggtactccctccgtttcgaaatg

SEQ ID NO: 94110 - DNA, 532 bp, Oryza sativa
gggaatcggtaagtatctagtcttaaaattgatagacaagatgaacttgattatgagtaatggagctaaaatgtgcaatgctccttttggcagcctgattcagagacacagctattgactattcagtttgagtggcacggtgttctgaaatcggtatccagcactctgattggtgtcagccctgagtttgaggttgcactctacacgctctgcttctttatgggaggggaagataaccgcgttgagattggcccgtacggagtaaacatcaagtgctaccgaatgggaaacagcaaaattgggtcagcatttccaattgcagataactgaattcgttccatgcctgctcctgcgtgtatgtgattccttcagctttcagtttcacgaagttattagtgtgctgttcgatttggtcgtttacacaaaagaaccacattgttcaatttgttgtcacaatgtctctactgaaaattgtattatttggattaaccatgctgtacaagttgtagtcacaaagtcctgtaatttgttt

SEQ ID NO: 94111 - DNA, 1869 bp, Oryza sativa
aaatccgagcgaatccgatgaaaagagagagggaaaagagggggaaagagggagggaatcacggggagtgatttccccctctttatggcgcgcggggacggcgggatgcggcggattcggcggcggcggcggcgctagggcacgggcgggcggcgggcgcggcgcgaggtaggcgatgacaggtgggccccacccgtcagcgagggtggcgggcgggcccgcctgtcggcggcgcgcgcgcggggaggaggccgatgggccgcgggggagaggagagagagggagggagttgggccgagccggcccaagagggaaagggggggggaaagaagacttttagggattttctttttataaaacctttttaactttgtttatttcttctcaattattatttgctctgaaaattccactaaaatttatttacgcattttaggcttttaggaaatatacaaaaatcctccaagccttatttgacttttaaatttgcacattttaattgttgaaggctttcacatgaattttaattattctcagcacgatttcgaggatgtattttagagtcgatttgggacgcgacaaacctaccccccttaaacggaatctcgaccccgagattcggaagaactggcgaagagaccgggatgggctgccttcagctcgtcttcacgctcccaagtagcttcttcttcggcgtgattgctccactggaccttgcaaaaacggattacccggttcctggtcctgcgctccatggtgtccaggattttcactggcctctccacgtaggtcaaatcttcgcgaacttcaatttgctctgagtcggcctgctcggatggcactcgaaggcatttcttgagttgcgacacatggaacacatcatgcacgttgcccaaggaggcgggcagctccaactggtaagcgacttctccgcgtcgagcaacgatacggaaaggacccacataccgaggtgcgagcttccctttcgtctgaaacctgtgtacacctcgcaatggcgtgacccgaaggtacacaaagtcatccactgcgaattccaagtcacggcgacggttatctgcataacttttctgccgggactgtgccacctttagattatcccgaatgattctgactttagcttcagcttctctcaggatatcagtcccgaacacttggctttctccaacttggtcccacaatagcggtgtccgccatttgcgcccgtacaacgcttcataaggtgccatttgtatgctggcttgatagctgttattgtaggagaactcggcataggggagactcttatcccaggtcttcccgaaatctagtacacatgcacgaagcatgtcttctaggatctgatttagacgctcggtctgcccatctgtctgcgggtgataggcggtgctgaaatttaatcgagtacccagctcttcttggagcttcttccaaaagtgagaggtgaattggcttcccctatcagatacgattttcttgggaacgccatggagactcacgatcctagcgaagtagagctccgctagtttgttccctccataggtggtcttcacaggaataaatcgagctaccttggttgggggtgcaaagaaaacaactggttgttccggccctcggtacagagtaacagtgcgtctcgcgcaatccactactccttggaattgagccaaccaattcatcccaagaatcacatccaaattcttggtgtctagcagaatcagatccgagggaaaaggaatcccctgaatttctatagggacggcagggctataatactttgctgtcataacccctccaggggtggtgatgagcagagggtttctaagcctttctacccccaactgatttctc

SEQ ID NO: 94112 - DNA, 2012 bp, Oryza sativa
aaaaaggaaggaagtttggcccgagccggcccaagagggaaagggggggggaaaagaagacttttagggattttctttttataaaacctttttaactttgtttatttcttctcaattattatttgctctgaaaattccactaaaatttatttacgcattttaggcttttaggaaatatacaaaaatcctccaagccttatttgacttttaaatttgcacattttaattgttgaaggctttcacatgaattttaattattctcagcacgatttcgaggatgtattttagagtcgatttgggacgcgacaattatcttttcggtactcgtacagaggtgtataccaatcacaagagtttaaagtatatctttactcagccagatctggacatgagacaaaggagatggttggaattaattaaggattatgacatgggaattcattatcacccgggaaaggctaatgttgtagcagacgctcttagcaggaaaggctattgcaatgctacagaaggacgacagttgccattggaattatgcaaggaatttgaaagattaaatttgggaattgtcagtagaggtttcgttgcagccttagaagcgaagcccactctaattgatcaagttagagaagcccaaattaatgattctgatattcaagaaatcaagaagaatatgagaagaggaaaagctattggtttcttggaggatgagcacggaactgtatggttgggcgagagaatctgtgtccccgacaacaaagatttaaaagatgcaattctgaaagaagcccatgatactttatactctattcaccctggtagtacaaaaatgtaccaggatctcaaggaaagattttggtgggcaagtatgaagcgtgaaatcgcagaatacgtagcagtatgtgatgtttgtcaacgagtcaaggcagaacatcagaaacctgccagtttgctgcagcctttgaagattcctgaatggaaatgggaagaaatcggtatggattttatcactggtttgcccagaacgtcatctggccatgactctatttgggtaatagtcgacagacttaccaaggtggcacatttcattccggtaaagacaacttattccggaagtcgcttagcggaattgtatatggcaaggattgtgtgtttgcatggcgtccctaagaagatagtgtctgatcgaggaagtcagtttacttcaaatttttggaagaaacttcaggaagagatgggttctaagctgaactttagtactgcttatcatccgcagacagacggacaaaccgaaagggtgaatcaaattttggaagacatgttgagagcttgtgctttagatttcggtggaagttgggataagaatctaccttatgcagaattttcgtataataacagttatcaagctagtcttcagatggctccgtacgaagcactgtatggtcggaagtgccgcactccgcttttgtgggatcaaacgggagaacgtcaggttttcgggacagatatcctaagggaagcagaagaaaaggtgaaaatcattcaagaaagattgcgtgtggcttagtctcgtcataagagttatgccgacaatcgccgcagagatttgagttttgaagagggagattatgtgtatattcgtgtcacacctcttcgaggagttcatcgttttcataccaaaggaaaattggcaccgcgttttgtgggaccttataagattgtcagtagaagaggagaggttgcttatcagttagagttacctcaatctttggcaggagtccatgatgttttccatgtgtcgcaattgaagaagtgtttaagggtacctaccgaagaagctaatcttgaacagatagaagtccaagaggatctgacctatgttgagaaaccaatccgtatcttggaaacaaatgagagaaggaccaggaatcgagttatccgtttttgcaaagtccaatggagtaatcactcggaagaagagtcaacttgggaacgagaagatgaattgaagt

SEQ ID NO: 94113 - DNA, 1093 bp, Oryza sativa
gttcgggaaaaatgaatccgagacgaactcgaatccctcgatttccaaaccgatttagccgatgattccaaaggagaaaaggtagaggagatcccggagagtgtttcccctctatcaattcggccggaaacggaaaggggcggccggatttggaaggaaacggcggcggcggctcggcggcggcgcgctagggtttcggcccgaggaagacgacgggcctgacaggtgggacccacctgtcagcgaccgaacacgcgcgcgcggcgcgggcggctacgaactgggccggactgggccgagggaaagagagagaggaagcggttttgggccgactttcggcccaaagccaaaagaggacttttttaaaacctttttcaatttaaattatttcttaaatgcaatttcatttattaaaaatacttccttagctcaaataaatcccagaaaaatctaggaattatagaattaagcaaagtatttaatgaaattttatctggccccattttatattggaatttattaattaaaattagatcttcttttcaagacttttaaaattattttctagaaattccatttaaacaacaatttatataatttgaatttttagggtgtgacaaacctaccccccttaaacagaatctcgtcctcgagattcggaagaactggcgaacagatacggatgagctgacttcaattcatcttctcgttcccaagttgactcttcttccgagtgattactccactggactttgcaaaaacggataactcgattcctggtccttctctcatttgtttccaagatacggattggtttctcaacataggtcagatcctcttggacttctatctgttcaagattagcttcttcggtaggtacccttaaacacttcttcaattgcgacacatggaaaacattatggactcctgccaaagattgaggtaactctaactgataagcaacctctcctcttctactgacaatcttataaggtcccacaaaacgcggtgccaattttcctttggtatgaaaacgatgaactcctcgaagaggtgtgacacgaagatacaccatatctcccttaggatacaa

SEQ ID NO: 94114 - DNA, 1738 bp, Oryza sativa
gcagaaggccaagatttgtcttaccgcaagaaagagagctttatttgtcccacgctatcaattggcgccaaaggtccgtgtggtggagaaagaagtagccccagcggatcctccggtcgtcaatgtaagtgatgatgaaggagaagaatcgaagcgcacccattccaagatcgagtggggagcaactcaagatgatgaagacgagccgaacgagccttcaatcaactccgatgctcggaagaactagagtgccttgttaagccgttgtcttagatcgttgtgttagtttgcttgttttaaatttgcttgtgtgggtcttgcatgtgatttacatcagtgatgggatgtaagtgcatgcgtttgtttgtttttttttttgagtgttaggaagttggtgagtttagtgttgtgagagtcttcagtttgtaataatgaaactcagttaagatcaataaaagttaaagtaattccctgtcctaagtagtttttccccggttcctcttcttgtgccctgtccatgccagatggtgaacactcgcagcaacgggaatggtcccaacctcaacaaccccaataacaacaacaatggagagaatccaacccttgctcaagttcttgcacaacagactcagttaatgaacatgatgatgcagcaacttcagaaccagcagaaccagggaaataaccatgcacctccccagaacaagctagcagaatttcttcgtgtgaggccgcctattttctctagtaccactaatcctgttgaagctagtgattggttgcatgccttagagaagaagttggatttgcttcagtgcactgatcaggagaaggtctcatttgcatcacatcagttgcatggccctgcctctgaatggtgggatcacttccgtctgaataggactactgctgaacctatcacttggcttgaattcaccgctgcttttcggaagacgcatataccatcgggagtggtgtctctcaagaagaaggagttcaggtcgctcacccagggatctcgctctgttacggagtatctacacgagttcaatcgtctagctcgttatgctccagaagatgtgcgcaatgatgaagagcgtcaggagaagttcttggaaggacttaatgatgagctttcttacccactcatgactggagattattctgatttccagaaattagtggataaggctattcgtcaggaggacaagtataatcgcatggagcagaagaaacgccggattgctcaattcaagatacaacaggggaataatcagaagccgcgtcttacttttgtaccccagtccatgccacatggaggttcttcatctgttgttcgtccgcagcgtcagttcttcaacaacaatgctggcaacaacatccgcaatcaagctccacgtcctgttgcagctccaacacaacaaccgcctgccaagagggagcaaggcagcaagcccgtggtgtgtttcaactatggagacccaggacattatgctgacaagtgtccaaagccccgacgcgtgaaggttgtccctgcctagagcaactctactataccagcatcaaaggcccgtgtcaatcatgttgcagctgcagaagctcaagacgctccagatgtgattttgggtacgttccctgttaactcagttcatgcaacagtgcttttcgattctggtgctacacattcatttctatctatgagttttgcgggaaatcatgggatggaagtagaagatct

SEQ ID NO: 94115 - DNA, 854 bp, Oryza sativa
cccatggcaaggcttggagcaaaccacctttgcatcaagccatgtatctttactaggagattcttgaagcaatttttctatgctggcaaaactaaaacctgatgatccacctgtgcccatgcccacaagcctgatctttggcctcctgtccctgttgttatacatgtggtatccacgagcgaagctccaactttcaataaatctatgccactgcttagagacaagtttgaactgcacggcataatcacccggaagccgtagtagggcctcctttatcaccttggcaaggggagatgacaatgctatctcttcattggttttacacacaggagcaagactgtcttcaaacaaactgatcagtccaagagcagaacgtgcagtttggtaaggcaaaggagttcccttgatctcaaggattgtttctagtgtttcagatgtaggatcataggcgatcgccttgcgattggatgtagcaatgattacattcttcttccctgacataccactactgccagcagaaccaataactctgataaaatctggtttcattaaatctcgggcaacatgctccgtcgacaaatcgatgcgatgctccaatgaccaatcactggagtaaagatcattcagctttcaaatctccagcgtagacgacatgcgacgaaggtcccggaccatgcacaggttaccagagagatccaccaagtgcactcctgaaacctgaaagggcggtgacctgaccaatctgaatgtctcttctgtcacagagaaggataagatggcagcatgtggccttcaagaaagagaacaaagagccaggtagccagtgaagaaacccatcacaaacactggaagaa

SEQ ID NO: 94116 - DNA, 1047 bp, Oryza sativa
aattgattgcaaatgggtatataaaattaaaagaaaagcagatggttctttagacagatataaagcaaggttggtagccaagggcttcagacaaaggtatggtatagactatgaggatactttcagtccagtagttaaaattgcaacaattagacttgttcttggtattgctgtctctagaggatggtcactaagacaattagatgttcagaatgcctttttgcatggtattctagaagaagaggtttatatgaaacaaccaccagggtatgaaggtaaatcaaccttagtttgcaaacttgataaggccatctatggattgaaacaaccacctagagcctggtactctaggttgagtcacaagttatttgaactaggttttacttcgtcaaaggcggatacttccctgttcatttataataaaaatggaataactatgtatatgttaatttatgtggacgacattattgtcacaagttcctcaagtgatgcagtcatagccttgcttaagaacctaaggtctgattttgccttaaaggacttgggtgagctacattatttcttgggaatagaggtgaagaaagtttctgatggtatactgttgaatcaagcaaagtatgccttagacttgctaactaaagttggtatgaaagattgcaaatcagcttccacgccgctagctgtgacagagaagttgatggcacacaaaggaaatcctcttggtactgaggacagtactcggtacaggagtattgtaggaggactacaatacttaacactcaccagaccggatttggcgtttgctgttaataaggtatgtcaatatcttcatgctcctacttcagaacatttgtcggctgtaaaacgtatactcagatatatcaatggaactgttgatgttggtctgcactttaagaggtctagttctactctagtcagtgccttttctgatgctgattgggctggtagtctagatgacagaaggtctacaggagggtttgtaatttactttggacctaatattgtgtcatggagtgctaggaaaca

SEQ ID NO: 94117 - DNA, 2020 bp, Oryza sativa
gctaaaagctgcttttgcaaatgaaaccctattatgccatcctttgttatcctatgcacttgcatatttgctgcgtggcttgctgagtatgtcatatactcaccttgcaattattcatcagaggaagagttctacagtgaagctgatggtgtggaggattaggtgtagccctggtcaagctgcctgtggagtggagtcgtccgcgccgtttatctttttccgctgcttagatctttattgattgagaggaactatctacctctgtaatgatattttatacgcttaataattagagtaataactgtactctattatcaatttgttattgtgtgcctcggctgattcctggacgagggtttacacacatgtaagcgtttggaattttggatagaaattccgggcgtgacagctaggaggcgacgacgaaggcccatggcggccggcgacgagatggaaagctcgagctcgaagagagaaaaaccgatccaattcgaactcgaatccaccgatttccaaaccgatttagccgatgtttccaaaggagaaaaggtagaggagatcccgaagatcatttcccctctatcaattcggccggagaaggaaatgggcggccggatttggaaaggaacggcagcggcgcgaaactagggtttcgggcggcggcggcgcgacgaagacaacgaccctgacaggtggggcccacctgtcagcgggagagagagagaggagagcggcggctcggactgggccggctgggccgaggagagagagaagggttttgggccaactttcggcccaaagccaaaagaggacttttaaaacctttttcaattaaaattattcatgaaatgcaattccatttattaaaaatacttccttagctcaaataaatcccagaaaaatctaggaattatagaattaagcaaagtatttaatgaaattttatctggccccattttatattggaatttattaattaaaattagatcttcttttcaaggcttttaaaatcatttctaaaaattccaattaaacaacaatttatatatttaggatttttagggtgtgacataaggttattgaaaggctttgccgtgacgcgtctcctgtgttgggacgaggctcatgtgttgggcagtcatggatgtcacatcctgattttcgcctcaggatttataaattatttaataaattaataatagaatttatattaaatgttcatcaatttacaagtgaagttaaatgcgggaaataaaatttcctaaataaaaagcatggatggatttaattcttattaaattctccatggttaattatactctctggaatattctcggatttttcggagctcaattattaattttaatcatacaaagagaagttcagcaattatttaaatattaaattaatcatataatgatctaattataattgttaagtgcttttcctgtttaaaatccttaaattataaattgttgtttaaaaggaattaatagaaatgattttaaaagtttaaaagagaagatcttttcttttaatttgctaaagttcaatataaaattgggttagataaaattttattaaacactttgcttgttcctctattttctagatttttctgggaattatttgagcaagggaagtatttttaataaatgaaacaacatttcacgaattattttaattgaaaaagttttaaaaatcctctcttaggccgttgggccgatttcggcccaactctctctttcctctctctccccgcgcgcggcccacgccggcccaagccgccgcccgcccctctctcccagccgctgacatgtggggcccacatgtcagggccgtcttcctcctccggccgccgccgcgcaagagcccgaaccctagcgccgtttcccgcgccgatttcgcccaaatccgagctcgattccttcgattggttgaggggttttgttcctctcgatctcctatttcttttcccccaagaatcaaaacgaatcggggagttttggatcccaatcga

SEQ ID NO: 94118 - DNA, 1041 bp, Oryza sativa
tgccggcaggtcgactctataggatccccatgtacccaagttagtgttttaattcctaaaacctgcttaacaactaaaatgtggaatggttggcctgggttggcttgggacgagctgggacccagggtcgggttgccagttcggtctgaatcatcataggccttgggttaaggcaggttcgtgtgggttcacggccttgattaataacattgtatagttctaggatcgcgtttacaaaatagccttgagcaactaaatgtctttaaatgctgtttactgcaaccctaaccctttatattataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttctcgtttgtctttgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgtgacaataatgacgccaaattttcaacgcatgaactactgcagctaactcaatatcatgagtagggtagttcttctcatgcggacgtaactgacgagatgcataggtaaccaccttcccatcttgcatcagaacacaacctaacccaagtttggatgcatcacaatacacctggaaacccttttttggatcaggtaaaatcaagataggagctgatattaagcgattcttcaactcttgaaaactctgctcacattcttccgaccacttatacttcacatctttctgtagcagtcgtgtcatgggcttagtaatcttggaaaaattctctataaacctccggtaatatcctgcgaggcctaagaaactgcgaatctgtgaaac

SEQ ID NO: 94119 - DNA, 1288 bp, Oryza sativa
ataaattggacaagatgttggaggaccacagaacttcgttgtacccaagttgcgagcaggggcacaaaaagttggataccactctggagttgttgcaatggaaggcaaaaaatggggttagtgacaaggcatttggcgatttattgaaactcgtcaagaacattcttccggggggaaagaaattgcccgagacaacgtacgaggctaagaagatagtctgcccgttaggactgaaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtattttcctataataccacggctaaggcgtttgttcaggaacaaggggaatgctagaatgttgcgatggcacgctgaagagcgtcaacatgacgggatgctgagacactcagccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacct

SEQ ID NO: 94120 - DNA, 709 bp, Oryza sativa
gtcttcagatggctccgtacgaagcactgtatggtcggaagtgccgcactccgcttttgtgggatcaaacgggagaacgtcaggttttcgggacagatatcctaagggaagcagaagaaaaggtgaaaatcattcaagaaagattgcgtgtggctcagtctcgacataagagttatgccgataatcgccgcagagatttgagttttgaagaaggagattatgtgtatcttcgtgtcacgcctcttcgaggagttcattgttttcacaccaaaggaaaattggcaccgcgttttgtgggaccttataagattgtccgtagaagaggagaagttgcttatcagttggagttacctcaatctttggcaggagtccataatgtgttccatgtgtctcaattgaagaaatgtttaagggtacctaccgaaggagctaatcttgaacaaatagaagtccaagaggatctgacctatgttgaaaagccaatccgtatcttggaaatagatgagagaagaaccaggaatcgagttatccgtttttgcaaagtccagtggagtaatcactcggaagaagagtcaacttgggaacgagaagatgaattgaagtcagctcatccgtatctgttcgccagttcttccgaatctcgaggacgagattctgtttaaggggggtaggtttgtcacaccctaaaaattcaaattatataaattgt

SEQ ID NO: 94121 - DNA, 579 bp, Oryza sativa
cgacgatttttcttttgcatgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccgtatgtcctcgatggcaccgtaatacgtggcagttgttccatcgtgtcccatggcatcgacacaaacagcgctgttttggttcgtgctcttcatgtcttgggctctcgtgtagaatgtgtacccattgatctcatatccctggaatgtcgcgatcgaccaagacggtcccctcgccaggaaggcaagttgttggttgatcgactcgttacccatgagatgttgtcgtagccacgcggggaaagtatcaatgtgatgccgtgtaatccatgcatcggacttaccgatgttcttggcgcgaactagagccaagtgct

SEQ ID NO: 94122 - DNA, 561 bp, Oryza sativa
ctgcagggacccgcatctctatggtgggaccatttccaggctacgcagccagaggggcaacctattacttgggctcgcttcaccgccgctttccgaaggacccatgtgcccgctggagtcgtggcacttaagaaaagagaattccgagagttgaagcaaggcaaccgctccgtgatggagtatttgcacgagttcaacaacttggcccgttacgccccagaggatgtgcgggaagatgaggagaagcaagagaagttcttggcaggaatggaccctgagctgtccgtccgtctagtctctggggattatccggattttcaacgactggtggacaagagcatccgcttggaagccaagcacaaggaactggagtcgcacaagcgccgcttggcaaatttccgcaatcagcagggtgctaaccaaagggtccgctacaccaatccctatccagggggatcctcctcgcgcagcagcaacaacagcagcagcaacctcgctccgcgcctcgacctcaattcgtggtgcgcgtcccacagccgcagcagcagcagaatcagcaag

SEQ ID NO: 94123 - DNA, 1612 bp, Oryza sativa
atgtcatcctagggatggactggttagccagacataaaggtgtgatagactgtgctaacagaaaagtaactctcaccagtaatgatggtcgagttgtaactgttcatgcattgtcttctgagtctttaaggtcaagactgaaccaagtaactttggaagagattcctatagttcgggagtatcctgatgtgttcccagacgatttacctggtatgccgcctaaaagggatatagagttcagaatagatttggtacctggaacaactccgatccataagagaccttatagaatggcagccaatgagttggcagaagttaagaggcaagtagatgatttgcttcagaaaggatacatcagaccgagttcatctccatggggagctccggttatttttgtggaaaagaaagatcatacccagaggatgtgtgtggactatcgtgcactaaatgatgtgactatcaagaataagtatccactacccagaattgatgatttgtttgatcagcttaaaggtgccactgttttctccaagatagatcttcgatcagggtatcaccagttgagaatcaaagaggaagatatacctaagacagcttttaccactaggtatggattgttcgaatgtactgttatgtcttttggacttaccaatgcccctgctttcttcatgaacttgatgaataaggtgtttatggaatacctagataagtttgtggtggtctttattgatgacattcttatctactctcgaaccaaagaagagcatgaagaacatcttcgccttgcattagagaagctacgagaacatcaactgtatgctaagtttagcaagtgtgaattttggttgtctgaagtgaagttccttggtcacgtcatctcagcaggaggagttgccgttgatcccagtaatgtggaatccgtaaccaactggaaacaactaaagacagtttcagagattcgcagtttcttaggcctcgcaggatattaccggaggtttatagagaatttttccaagattactaagcccatgacacgactgctacagaaagatgtgaagtataagtggtcagaagaatgtgagcagagttttcaagagttgaagaatcgcttaatatcagctcctattttgattttacctgatccaaaaaagggtttccaggtgtattgtgatgcatccaaacttgggttaggttgtgttctgatgcaagatgggaaggtggttgcctatgcatctcgtcagttacgcttgcatgagaagaactaccctactcatgatcttgaattagctgcagtagttcatgcgttgaagatttggcatcattatcttttcggtactcgtacagaggtatacactgatcacaagagtttaaagtatatctttactcagccggatctgaacatgagacaacggagatggttggaattaattaaggattttgacatgggaattcattatcacccgggaaaggctaatgttgtagcagatgctcttagcaggaaaagctattgcaatgctacggaaggacgacagttgccattggaattatgcaaggaatttgaaagattaaatttgggaattgtccgtaagaggtttcgttgcagccttagaag

SEQ ID NO: 94124 - DNA, 1168 bp, Oryza sativa
agtacaagtggtcggaagaatgtgagcagagttttcaagagttgaagaatcgcttgatatcagctcctattttgattttgcctgatccaaagaagggtttccaagtgtattgtgatgcatccaaacttgggttaggttgtgttctgatgcaagatgggaaggtggttacctatgcatctcgtcagttacgtctgcatgagaagaactatcctactcatgatcttgagttagctgcagtagttcatgcgttgaagatttggcgtcattatcttttcggtactcgtccagaggtatataccgatcacaagagtttaaagtatatctttactcagccggatctgaacatgagacaaaggagatggttggaattaattaaggattatgacatgggaattcattatcacccgggaaaggctaatgttgtagcagatgctcttagcaggaaaggctattgcaatgctacagaaggacgatagttgccattggaattatgcaaggaatttgaaagattaaatttgggaattgtcagtagaggtttcgttgcagccttagaagcgaagcccactctaattgattgtcacgcccggaatttctatccaaaattccaaacgcttacatgtgtgttaaaccctcgtccaggaatcaaccgaggcacacaatgacaatattgataatagagtacaaataattaactattgaatactcgcaaattaaaattattacagaggtagatagttcctctcaaagaaaataacatactacgcagcggaaaacaaaactataacaaactacggaacagctaaggcgactccactccacaggcaacttaaccagaataagcctattcctccagatcatcaccttcactgagatactcctcttctgatgaatgaatattgcaagaatgagcatataacatactcaacaagccacacagcaaatatgcaagtgcacaggataacaaaggatggcataacatagctcatttgcagaaacaacatttaataaatatttaagagaatagtaaaacagttgtataattaatcaatattaaataaacaccatacaacacacccgtgttgcacaggcccaaccacatttgaacaaccaaccccagttgaacaaattaaacctccaaaccaggaattaaccattccaacattaatac

SEQ ID NO: 94125 - DNA, 741 bp, Oryza sativa
actctagaggatccccggattaccacgatctcatcacgaagggaggcttgatggtgttggtactgttggaagaaagactattaggttggatcggaaggtgtacgataaagctcatttcacggtactacaacatatgactgaggtggtgccgtacgttgacgaacaccttgagttatccgacaagagaacccaggccgatcagagagttgggtcaggaataagcacatgtcttctttcaacgagtggctgaagaaccgaattgccaggttgcagaacttgtctagtgaaacacttcagtggttgtcacagggtcttgaatggagtgccaccacctggcaaggatatgacataaatggatacacctttcacacggtaaagcaagacagcaaatgcacagtgcagaacagtggttacgcatcgaggctgctagtgacggtggtcgtcgtgatcaatactatagattacttgaagttcaaagtcccgttgtttccgttgtcgatgggtcgatcttcgcaatgtaaaagttgacaatgaaggtttcaccactgtcaacttggctaacgacgcgtacaagcatgaaccgttcgttctcgccaaacaaggttgttcaagtgttctacatagtcgacccgtgtaacaagaaactacatgttgtttgtgaagggaaaagtagaattgttggattggtcaatcttgcacccgaggatgattgcaaccagcacgtccacggcataggtcaag

SEQ ID NO: 94126 - DNA, 2081 bp, Oryza sativa
gccatctgacattgaagtttgattggtctcggattcagtgctgctgccatcaatctcgctgccggttgatatgatttcatgtgagctttgcatcagatcttcaccgttttgcctcagatttccaccattttgcaccaaattttcgccagcgatctgtactgctcctgtgcttgatcatcacaggcagggttagtagaacatgttagcatatgatcattagtaatttctcccccttgatcggtgatggacagcaaatgagaaggcaagagagagatctctcgctggagacgggcgccggcattgggatgcagggaggcgaacggaaagactgtctcatcgaagacaacatcacgcgagatatagacacggccagtggatatctcaaggcacttgtatcctttgtggagaggactatagccaaggaaagcacaccggattgatctaaaagaaagcttgcgatgattatatggtcgtaggtttggccagcaggcacacccgaacacgcgcaagtggctgaactcaggagttgcagagaaaagttgttcaaacggcgttttgaatgagatagcagaactaggcaacctgttaatgagatatgtggcggtaagaaaggcttcatcccagaattttaaaggaaccgaggcttgggatagaagagcaaggcctttctcaactatgtcacgatgcttacgttctgctgagccgttttgctgatgcgcgtgagggcaagaaacatggtgagttatgcctatcttctggaaaagggagtttaatttctcgtactcaccaccccaatcggtctgcatggtgagtattttggttttaaactgtcgttcgacatactgttgaaagtttaggaaggcttgaaagacatcggatttctttttaagaagatagatccatgtgtatttgctaaaatcatcgatgaaactaacataataatcatgtcgcccaacagaagtgggcgccggtccccaaacatcagagaatacaagagcaaacggaacattagatgaactcagagatttagggtacggcaattgatggctcttggcccgttgacatgaatcacaaatgtgttctacattattggactcgctagaacaaggaagctgaaaacttttaatgactcgactaacaatcggaaaagctggatgacctaaacgataatgccacctagtcgaagatggcttgacaatgctcaaggcatgtttattgagacttgaatcaccgggtgctggagccaaaggataaagccgtcccttacttctgccgtgaagaagcagcttcctcgttgcctgatccttgatgttaaagaatttggggtaaatttcaacgaatgcattgttatcaaaggctaagcgatttgccgagacaagattcttatttgcagatggaacataaagtatatttttcagatgtaaatctttgtttggggttgaaattactgaatgaccaatatgactaatgttcatacctgtgccgttggctgcatggacttgctcctgtccattatacttctcacgaacagagagcttgtcaagctccccagtgatgtggtcgttggcaccgcagtcgacataccagttggtatctatgccgtaggcggagttcgtcgctgctgctgcaaccttctcttcgggctgataggtttgatcaaacctataccagcacttgagcaccgtatggccagttttgccacacagttgacagaccggacgtggtccttgtggacctccaccgcgtccgccattgccacgaccacggcctccattgccgccgccaccacgaccgcggaagttgttgccgttgccgttgccacgtccgcgtgaagcggcgttagcagaagattggatttgtccgcctacttggagatgatccatctggttgtcgtagctaaccatctgagaatacaaatcactcaaggagattggatcagatcgacctaccacggtggaaaccagcggattgtagtcgatgtcgaggcccgcgaggatgtacgacaccagttcttcgtcatccaggggcttgctagccgacgcaagatcgtcagccagccccttcatcttggagaagtagac

SEQ ID NO: 94127 - DNA, 2046 bp, Oryza sativa
acgcaagatcgtcagccagccccttcatcttggagaagtagactgcagtggtcatggatcccttcctggtgttggcaaggctgatcctgaggttggcgatgcgtgcgcgagattgagatgcatacatgttggtgagggcattccaaacttgcgccgaggtgttgagagtcgccacttgttgcagaacgtccttggacagggaattcagcagataggcaagaacctgctggtcctgagccatccactttgcgtagtccgggttcttggtgacgatctccttgtcgttcttgtcgacggtggtcctcgtcttggccggctccacagccgtgccgtcgaggtagtcggtgagcagcgctccgcgaagcgcagggagaacttgtgcacgccagagaacgtagttgtccctggtgagcttctctgtcaccggtggaccaagtgcagccggcgcagatgtggaagaggaactcgccatgacgagaaaaggatctagggtttgtgttgggtagaagagagaggctctgataccatgtaaatgtggaagcgttctcacctcccggaggaggccgcgtaattatatttatactgttaagaacagcccttgacgtggcacttacaaacatcaaggcaccaataagtagaagcatcagttttgttcgcccaccaacgcttcacgtgctgaagtactaagcttgtaatgcagcgtgatgaggagctggacttcatttgccacctctgatcaaggtagtccttgcacccaaaactgtcgcaaagctcctaatgtaatgcctttggttacagatgaagcatccaatgaggttgtgttggtaaagcatggcatccatatgctgggaaacattgccatccataccagttttgcttctccctatggatgaactcgacttcctttcagcagtgttaacaatatccagagcaagttggccaaaaaaattcaagtgctgcagtacaacaaagcaaggcatatgtaaccttcacatccctatcattgtaagcttgtctgtgactgtggtgaaataggcctatggctccaaattgcaggtataaagctatcatacgtagcagtgaaccaacaattgattttctaaataaccccttcaaccaatctcgtttgacattttgcatcatttgttgaacacgaccttcaggaggaaggtacatctttcgtttcgtgtagagaagatcgaaggtgtgagataaccctttctgcagccaaccatttgttttgtctgcgtcaagtgctgagaaccactttagtttcttaagccgataatcaaaagaaggagatgaaaggtctacaaatatttcacttgggtcaaagttcaccgttgttcctggtgttccattaacatcagaataatagcccctcaccatcgtcacgaaatcatcaattgaatcaatcttgccatttctgcctgttgtcctccgaacattttgcggagagttcactaggctattaatgctagcactatggagggcccaaggtttctccaagcatttcagaaccccagggatgaaaagaaacaccgctgttagcagcaataatgtgtcaccacctgaccatgatttatagaacacatagatggctatggtgatctgagacaacgacgtgagggcgtgccgcgtccacagctcgttatcttcaacattgtagcggtaatgctgtcctgtccaccaaggtgtatgaggaggataggtgcccaaaccacctataggatgctcctgttctgtgtgtatagccatcgtctttctttctatggcgattgaagagtgttgcaagtgcatatatcgctagggcatcgctgctgaggtatgcaagccagataaagtatctcaggtagaatttcataggaatcttacgccgaggagacatgatgaggaggatgtactgaacaacgaggctgctgagggcgagtatgcgcagctgccactcctcccaccgttgcagagcacttgagatacccatcctcttcttctcctcctcctagtctctttgtctatgtgtctgtcttgtatactcggtggaggttc

SEQ ID NO: 94128 - DNA, 705 bp, Oryza sativa
ccttcattgttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgctaagggttatggaacagaggaggtcatcgaattttgcgtagaatttatcgaagaccttcgcccaatcggggtacctgaatcacgccatgaagggagactacggggaaagggaactctcagaaggaaagcaattatgacggtagacaacaatttattccgtaaagcccatttcactgttctgcaacactcttcattggtactccttacatcgaggagcacttggctctagttcgcgccaggaacatcggtaagtccgatgcatggattacacggcatcacattgatactttccccgcgtggctacgacaacatctcatgggtaacgagtcgatcaaccaacaactgccttcctggcgaggggaccgtcttggtcgatcgcgacattccagggatatgagatcaatgggtacacattctacacgagagcccaagacatgaagagcacgaaccaaaacagcgctgtttgtgtcgatgccatgggacacgatggaacaactgccacgtattacggtgccatcgaggacatacgggaacttgactatgg

SEQ ID NO: 94129 - DNA, 1496 bp, Oryza sativa
gcctcctccagctgccgctcatccccgtcgtccacgcttgtcaacttgtggatgagagagagagaagaaaagaggaagagggtagatgataggtggaccccaccatttttttaataagaaaatgctgactggattgccacatatacgccacgtaggcaaaacagctctaaattgggtcgaggggggtaatttgtccggtattaaaagttaagggtgaatgatgtctggtttttgggtttagggagtaattcggacgaccgcgatagttaggggggtaattagtacttttttacttattttattgactatggactaattttgaagtacattgtggaagccctaacatcgagagtggtcatttgaggagagtcaagtccatggttgcatagtcttccccgatagcatcatgagtgcaaccaggaggtgcaccaacaatggccccatttatgccagtaaggctatttgtctcgaaccaacaatgcatgaaactataagatgatatctccactactgtttacgagtattttttctttttacaaaactacatatactttgaccaaactatcaccaaactacatatttaaagatgtgtttcataaaatcacagatttaacaccaaaattattatattttacaaagcatcgtatcacacaactacagatgtagtgatgaaattatcaaataactacagactttaaagttcatatccatagcactagtgagcttacaaagtagttttataataaaactgatgtttaatttgtagtttttttgataccttaaatttctagtattgtgaagaaagctatagttttatgatacacgtggttaaatctatagttttgtgatagatttatcatagtatatgtaattttgtgaatttactcactgtttattgggtgctatatgtatctatgtataaaggctgcccgatgttatcagaattataaaattggcagaaaacgttcatacaaagcagtctatgaagctcctcatatcacatactgcagaattgaggagagtgaactttgctgaaagcgttgaataagagaagagtttttaatgattttacaagtttttgggacgaacgcatgttctttgcaatacagcagaggatctcaatacttttgagactttcttttcttcctctcctacctgaattttcacgttcttttaagattttttgtttgcataaacatagcacaaagacaccctgtgacgtatatatgtagagcttgctagaccataaaagaacaatttcaggctgaaatttcaaaacttacagtctgcaaccacaatttttttctatctccaccatattggatggtagtgtcaaccatatactagcaatagttatactcttgagacgatataaaacgaagtgcatagatagcataaataaagacgatactccaatatgcgtatggcttgacacattgagagcagcgctgatagtgcacatagtgaactagtgaagctgcagcagccactactag

SEQ ID NO: 94130 - DNA, 581 bp, Oryza sativa
caaatgtgaaactttgggttgatgtccaaatcgaagttcataagaagtttttccaagtttagatctcaagaaaacccaatttgaaatataacatgcagtgttaattgcctcagcccaaaattttctaggagttttatactcatccaacatcgttctagccatctcaaccaaaacacggtttttcctttcaacaacaccgttttgttgaggaacacgaggagaagaaaattcatgttcaagacctcttttattgcgaaattgttcaaaagaagcatttttaaactcaccaccattatcacttcgaattcttttcaaagaaccaggaaattcaagatctaatcgaagaaacaaatcatgaaagtgttgaaaagcttcatccttagttgccataaagaaaacccaagaatatcgagaaaaatcgtcaacaataaccaacacataccactttcctccaacagatttcactctagctggaccaatagtgtccatgtgtaataactgtcccagtgcatccgtcatcacagaaacaatatgagcatgtgaagaagcaaccatctcagcatgatgacacggtgtacaaa

SEQ ID NO: 94131 - DNA, 1836 bp, Oryza sativa
cgacaatatcgcctcatgctcaatccagagaagtgcacgttcggagtaccgtcgggcaagctgctcggtttccttgtctctgtcagaggaatagaagcaaatctcgagaagatcaaggcaatcgagaacatgaagtcacccacaagactcaaggaagtacaaaagctaaccggatgcatggcagcactgagcagattcgtcgctaagatgggagaacgagggcaacccttcttcgctctactgaagaagcaagacaaatttgtatggacacaggaagccaaagaggcattcgttgcactcaagcgctacctatcaaacccccctgtacttgttgctccccaacctaatgaagaaatattcctctatattgctgccacgccatattccgttagcactgtcattgttgtcgagagagagaaaatacaacgaccagtctattacgtcagcaaagctctccacgacgcaaagacaagatattcctcagatccaaaagaggatttacgcggtaatcatgacatcaaggaagctacgccactactttcaagcccacagagtcacagttgtctcctccttccctctcggtgaagttgtgagaaacaaagacgttgtcagccgcattgcgaaatgggtagtcgagctgagccagtttgatgtccactttgtgccacaaaaagccatcaagtcccaggtacttgccaacttcgtagccgattggactatgcctgataacaaatcagacaaccaagtcgacaacgaaacgtggacaatggcgttcgatggtgcactcaacagccaaggagcatgggcaggattcatcttgacgtctccttccggagatcaattcaagcacgcaatccacctcaacttcagggcgaccaataacacagccgaatacgagggactactcgccgggataagagctgcagccgcacttggggtcaagcgactgatcgtgaaaggggactccgagctagtcgcgaactaggtgcacaaagattataaatgctctaaccccgagttatccaagtatctcgcagaagtcaggaagctggagaaaaggttcgatgggatcgaggtccgacacgtataccgtaaggacaacatcgagccagatgacctagcacgacgtgcgtccagacgagaaccgctcgagcccggcacttttctggacatcctgacaaagccatcagtaaaagaggttagcggcgaagttagcccggccgcccccgacattagctcggaggccacagaggcagaacgcgccgttgccgatatcgagaccacatacgactggcgcatcccactaatcaaattcatcgacagtgaagagttgcccgaggacgatacagaggccgagaaaataacccgtaaagcaaaaatctactgcatggtcggcaatgatctatacaagaaagcgccaaactaggtacttctcaaatgcgtctcgtccgacaacggcagacacctcctccttgatatacatgaaggcatctgtgggtcacacgccaccggtcggacattggtcgggaaagcttttcgacaagggtttttctggccaaccgccctcaaagacgcatgcgacatggtccagcgatacgaagcctgtcaattccacagtaaacacacaaagctacccgtgcaagcgctccagactatccctcctacttggccgttctcgtgctgggggctagatatactcggaccattcccacgaggacagggcggctacaggttcctattcgtggcgatcgacaaattcattaagtggatcgaggcagtacccacgggggaaatcaaggccgataacgccattaaattcatgaaggggatattttg

SEQ ID NO: 94132 - DNA, 1290 bp, Oryza sativa
taacgccattaaattcatgaaggggatattttgcagatacggactaccgcaccgcatcataaccgacaacggcccccagttcatcagcgccgacttccaggattactgcatcgggctgggagtcaagatatgcttcgcctcggtctctcatcctcaaagcaacggacaagtcgagagggcaaacggcatagtactacaagggatcaagacccacgtctacgataggctcatgtcacatgacaaaaaatgggtcgaagaacttccatcagtactatgggccgtacgcaccacaccgacaacatccaagaaggaaatacccttcttcctcgtgtacggctccgaggccatgctccccagcgagctacgacatcagagcacacgagtacaaaagtattccgaagaggatcaggaggagcaacaaaacatcgatgtgaatctactcgaagaacatcgcgaatgagctgccattagagcagccagttacaaacaagttgtaacgccccgattttcgttcgggattaaaaatcaattaataatgcatttttagaaattatattaaaagttaaatcaatttaatcaagtgaaattatagaggaaattaaaaatttcctttaaaaaagtctttggccgggaatattttgtaatattctttgtgccctaatgtactctccggaattttccgtgaattttcggagctcgagaaatagttttaatagcacaaagatcattgcatcaattaaaataaaaagaaaaaaaaaatcctccttcctctctttgggcccctttcggcccaatccctcctttctctcccgcggcccgtgcgccccttatctctccctctcgggccggcctcctccctcggcccgctcggctctctctcttcctcaagtctgctttacctccctcgcccgttttcccctctctctcctcgacaggtgggacccgaggccccacctgtcatcttcttctcctacctccagctccatccccaaccgccgccatggccgccaaatcctcccacgtcgccgcctctcccgcgcgactccctctcccgcgcgtgcgtggacgcggtcgtcgcccacgtccgcgccgtttccccccactctccccgcaaaatccggccacgtcgccgcctcccgcatctctctctcctcccacgttgccggccggtttctacttctctcgggctcgatcccgcctctcctcccctataaaaacattaaccacacctccctctccattttcccctctctcccaagcccttccgtgcacgaaaaccaccccgccacc

SEQ ID NO: 94133 - DNA, 663 bp, Oryza sativa
cttatcaaggtttttaacgaggcgattcgtgtgacattgcaagcgtatgctatgtactctttctctaaatttttcccactggatttttctgaagttttgatgaggcatagacatcacgcggtgagtgccaagggggagtgttaggaaacctatggggttgggtccatgaaggcccaacccatatacactaattgggcccacacctaaacattccatatatgcaatatggctatataaagaggaggctgctcactttgtacacttgtgcttaatcaatgaaaagagtgcctcaccctatatcttgtgtctccacttttgtagaactatgcaatcccttttggactacctcagtagcaggaggggttgcataatactttcttttttaaaaggaaaaagtacgaattaccccccgaactatcgcggtcgaccgaattacccccttgaacccgaaaaccagagattactcaccctgaactttcaatactggacgaattacccccctctcctaatctagagcgggtttgtcctatgtggcatacgcatggcaatcctgtcagcattttttttaaaaaaattggtgggacacacctatattttctctctacaattcaagatcacacacattctctctcttctcatcatcaatgtcggcctcactcactc

SEQ ID NO: 94134 - DNA, 3401 bp, Oryza sativa
  unsure (1)..(3401): unsure at all n locations
ccctcccccgcactcttcttttgcttgtatcgagaagccttgcagacaggacaagcatctaagtctgcgtattgcttgtggtacaatatgcaattgtttggacatgcgtgaattctccggacctctaaccctaggggacatagaacctattttgcttcatatgtcgtcttggccaatgtgttctcctgaggaagcatgtccttcagtattcccaaaagttctgtaaaactcgtctgaccatccactactagccttcaacttcattaggtctaatgttgctgataatttggtggcttgcatcttgtgtatagaggagtctccgagtcattgaccaacctactgaacttcatggaatctctctcgttcatagctaggtcatcaacgtcacgcaacatgtcttgcagcatatcagggtccacatcaaccattttaccgcccaatggagatgggacaaacatgtcatgctcttcttcatctccttcttcatgattgtttgcaccacttccatctgcagctgcaccatcagtacccagatcttgctctccatgcttcacccaacatgtgtatctctccatgaatcctcctgtagaacgagacgcgcattcaacccgtcctttgttttgccaggcatattcagcaatagccccagcaagctatcgcacacattcttctctacgtgcatcagatcaatgcaatgacggacctcaagatcttgccagtaaggtagccgccaaaatatggatttttttcttccacatcctcttcttgtcctccttgctatgttttcttttcttcccaaactcattagtaatgtccttcaccatgttgtgtacctgatctccggacaaatccgcaggggcagacccaagttttttcttaccattgaaaattttcttctttcttctaaaggcgtgccgtagggggagccatctcctatgacccatgtaaaccatctttcttgatttcttcagccacctactgcgtgtatgttccatacagtcagagcatgccttccttcctttcacggtttgtccagaaagattacccagcgcaggataatcattaatggtacagaacaatagaactcgtagcgtgaagttctcctgaccatatgcatcctaagtttccacaccctctttccacagaatctcaaggtcatcgtaataggctccaagaacacatcgatatcattgccgggttgtctcggaccttggattaacaagcacaacataatatatttccttttgaagcacaaccatggtgggaggttatagttcgcaataagaactggccaagtgctgtgagaactgctcatgtctccgaaaggattcatgccatccgtacacaaacatatcctcatgtttctggggtcggcagcaaagtctttatgctttcgatcgatattcctccattgaatcgaatccgcagggtgaggagcatttagcgaaggtccgacaggacaatattggtcgatcaaatatttggatcaacagagaacatggtgctcgcttcaacaaatggttcaaggatcatgtagcacggtcgaccgatggcccaagtgagatattacaaaggttggcatggggtccatcttgggatgttaacacatggcaagggtacgatatcaatggatacatattttacaccgtcacacaagatgagaaaagcacagtgcaaaacagtggagtccgtatagttgcatatcaggatcaggctggatcaagcacatactacggccgcatatagcaaatatgggagctgaactatctgaacttcaaagtccctttgtttcgttgcagttgggtgaatatctgcacaggtgtcaaggtcgacatggaaggcttcacattagtggacctggacaacgttggatatgcagacgaaccattcgtactagcgaagcaggtcgaacatattttctacataaaagaccccgcaaacaagaagatgcatgtcgttagggatggcaagcgaagaattgtgggggtggacaacgtcgtcgatgaagaggaatacaacaagaatcttcatgtcagaccttagatcgaccttgacgatgatcccaaagacgaagtggcttacgttcattcagaccattcggaaggcatatcactgtgaatgatatatttaatttgtattggagccttaatgaatgaattgcatatgtttcatgccattccagttaaaactctttgaagaaatggatttgttaattatgtggttttaaaaaattatacttgttatttaaaactacatgtgagaaagcaaattgttaattgtatgaatttaaaaaaagtaatatgaattttaaactatatgtgagaaaggcatttgtcaattagatgattttaaaaaattaataggagttttaaactatatgtgagaaaggcatttgtcaattagatgattttaaaaaattaataggaattttaaactatatatgagaaaggcaattgtcaattatatgattttaaaaaattaataggaattttaaactatgtaaataagacatttgttaattatatgtgataaatcaaatgtaatagcaattttaaatcgggtagaagttaattataaatgatttttataacttaaaaatattttaataagtcatctatgatgggctttagtactatgcccgatagagattattccatctctatcgggcttagtgctaatgcccgtcatagatgactttcatccgtatcgggcagagtactaacgccatcacggatgagtgtcatacgcattgggcatagtagtctacccgatagagatgaggattgactagggtttacttagtgaatcctcatcccgacgccgcctctcactctctcacactctcactctctcagatccaccgccatcggcgccttcctccacacctctcagttctagatccaccaccgccttcttcttctcgacgccgccaccgccttccagttcaacatccaccgctgcctcctccctcgtcgtggatccggcatccctgaccaccgccgccgccttccggttcaagatccggccttcccgaccgccagcgccttcttcgcgcccaagaccgccggcggcgccgaccttcttttcaagtctgtgtccttcacccccaagaccgccgccgccggcttcctctccggctagtcctcaagaccgatgccgcggccatttcaccgaccgccgctggctcctcgtcctcaacgctgccgcctcgtcctccctcgaagatccggccttactgaccacggnccgctcacatcctcctctccagatctacgcccgacgggcgtcgacctcatcctagccgccgcgtcgacctcctccacgccgctggcttcctctaccgattgtcgaccaccgccgttgcggaagaccgccgtccttgaggccggggccgctcaaga

SEQ ID NO: 94135 - DNA, 2634 bp, Oryza sativa
ccgtccttgaggccggggccgctcaagatccagcctccccgacggccaccgcctccctccacgccgtccccgagcccggccccgcccaagaccggcgtccccgagccaggtgcctcccttcatgccgtccccgagcccggcgccgcccaagaccgccgtccccgagcccggcgccgcccaaaaccgccgtccccgagcccatgtcaacctcatcactgagcccgccactgtgtgaggtaggtactcctcaccgatgatgatgcataatgtgatgatttgctgtgtacatgttatatgtgatgatttgatgattcgatgataatgtttaaattcgacaatgtgatagtgcgattatttgttgattcaatgtttagatgctaatgtctacatatgatgacttgtgctagcgatgaatttttgtatggctgtgatgacttgtgcatttttatatgtgttaactagtgatgaatttttatatggctgtgatgacttgtgcatttttatatgtgttagctagtgatgaatttttatatggctgtgatgacttgtacatttttatatgtgttagctagtggtgaatttttatatggctgtgataacttgtgcatttctatatgtgttagctactgatgaatttttatatggctgtgatggatgaatttgtgaatttgggggagaatgggatgttgggaaaaatgtttagatgtgggctgtgatgatgaaatattataagctatgatggatgaatggccagtgatgattgctcaagaacatactatttttgggatgaattgttgtgggctgcttttctatggcagtttttttactgcataaggacatacacttgttcttatatagttgtttgcaaaatttttagggtattttgggtccaatgggatggatgaattgatgtgggctgtgatggttgaattattttgggggaaatgtgagttttggtatgtgacctgttgtcacacccagaaattctcgaaccagaatttttaagctgaatgtgcattaaatccctgtccaggaccagccagggtacacaaacgacaattgttgacatacagacccacgtcttacaaaaatataaaagattacaaatgcagcgggaaagataaaagcgagctaaaccgggaagcttgacttcagcagcgggcgactccactccacaagcaaaccttgacggcagtgacgaaaccaacctctctgagatagctccaactgagaagaacttcaactctggtgtgggggaaaagagagcaagactgagtactacccactgtactcagcaagtcatatcggaagaggaggtatgatgcaggatataaccaaaggaagctaggggttcttttgcataaagcaggcatttcaaagcagtagttgaaagcagtaaaactgctgtagtaattaatcaatattaaccaatcactgtccaacgctacaccacgtttcaaaaggcatgcggcggcgctagtggcgagcggcgcgtgaccggtaggaggcacaggagagcgcggtgaaaaggggaaaagggagagggagatgcggggaagctttataggggctcgagaggggcggacatggccgggaaaccccccgatttggccggcgacgtggggggagagagagagagtgggggggattcaaatcgaatcccgcccatttgcgggcgcgcgtgcgggcgggaatggcggggagggcggcgacgtgggaacgcgaagtgggggcgcggcgtggagcgaagaaggcggcggcgcggacggtttcggcgacggttgccgtcgtggggcgggtggctggaggaaggggacgacctgacaggtgggccccacctgtcagcgtcccggagagaggggaaaagggaacgggccggcccaaagaaaggaggccgagcgcgggagggtgtgggccgacggcccaatagagaaaaaaaagaaggaaaagaaaaagaaaaggaagaaaagatttttcctgggatttaaaattgcactttggtgatttttaattggttaaaattatttccaaggctctgaaaattccactaaaaatcttgttaatgcattggagcatggggaactcaagaaaaattccaccacgctatttccgattattaattgcatttattaactagggatttagctctaggttaattaagataatttcttcgggcaatttatttaaccaatttttaaagcaagaaaaaggggaaacttctgggcgtgacaaacctaccccccttaaacggaatctcgacctcgagattcggaagagctggcgaagaggtgcgggtgggtggcctcttcttctgagtgatgactccactgaactttgcagaatctgattactttgtttctggtccttctctcactggtttcgaggatacgagtcggcttctccacatacgtcagatcttcctgaatttcgatgtgatccggacttgcctgttcctcaggaactctcaaacatttcttcaactgagagacgtggaacacgttgtggatgccaagcatgtttgagggaaagctcaagctggtaagcaacttcacctctacgttccaagatcctgtattgtcccacaaagcgtggtgccaacttttctttgttttggaaaccgatgtactcccctga

SEQ ID NO: 94136 - DNA, 655 bp, Oryza sativa
accactagtggaaaattgtttggatggcttcaacagttcaattttcgcttatggacaggtaaatgtggcttcagccacctttcatttttctgctctactgggggttctgtaaagcaaattgactaatacaatcaaatttctactttgtaagactggtagtgggaagacttacacgatgtgggggccactgtctgccttgtccgacgatacggtcagcaaagagagggggctgactcctcgtgtttttgaactactgttttcacgcatcaaagaggtacgtcatgatttgctatatagcttcctttttttctgattgcaaattaaaggtccatatgtactggtaatttgcaggagcaagctaaacactccaattaacaactagtataccattgctgctgctctttccttgaggcaagtgctatttaagccttttaaatcacaataattatgaatctctcttgtgatagaaattcagaattactttttaagatatgcagatctacattgaacaaattactgatttgttggaccccgtgcaaagaaaccttcaggggaaatggggtttcaaaattaattaaaatacttcctaggctgcttctgttctgatacgtctcgtacattttcagattaagagagatgtttgtacttcttctgt

SEQ ID NO: 94137 - DNA, 648 bp, Oryza sativa
tggtcaaattgcattccccacatcaaagatgatagtgatgaggagatggagatttatgccaatgatgttaaaagccctgtaatttagaaacaagtcctcatttcctcacggggatgttaaacaagtagatgcaagtcaaacttgccagcaagcatccagaagggccttcaagtcattgaaagccatcggaatagtgttacttggaggagatcatcattaggtcttaacactagacttatggacgctcatctttcagttccagtttgcaaagttgatgtggctattcaaaccgaccccgaagaatctgaaccaagacaaaacactatggctctaattcctagcaatcagcctgaagcaactacagatggaaacagagaaatctctgattgcataaatctacagttagtaacagttgatggatcaataccctctaatgatctaaagcaacaggaacaagtctttaaagtaggttactaacttactatgcagatgtgtgcaccatttatctgcaatatcagcatgacaacttatgcaagggtttgttttattcctataggctgtggagaaggtccttgctggagccatcagacgagagatgttacgtgatgaacagtgtgcaaagcaagctgctgaaattcaacagctaaa

SEQ ID NO: 94138 - DNA, 815 bp, Oryza sativa
  unsure (1)..(815): unsure at all n locations
agcgggcaaaccaacggtgtttttgagttcccctccaaatacgttcggacatggcacactcttttggtgtatttgctcaagtgcccgtcaatggccaggtccccttgttttggcttgatccggctccattactggggacaaactcttctctcatctcccccattatttcctcccaacatttgattaacctttgcccaataatcaatcaaatccctcattgaaagcaatcactaggttggtgtgtctgatcatcgccaggtgtatgaagtctgaccaaagaatctcagcagtagcaggatacatcagagcatcagagttgcagaacagagtctgcattgcatcttacaagctgttaatctcactcgacctgtggattcattcaagaaccgattgagagttgacatgagaaatgtgtttgatgatctttgatgcaggatacaagaggggcgcgctgagggcgtgcttcgtcggcggtggtccgtacaactacaacatgagcgcgtcgtgcgggctccccggcgcgacgacgtgcgaggatcccgacgctcacgtcagctgggacggcatccacctcaccgaggcgccctaccgcttcatcgccaacacctggatcaggggcccctacgcccaccctcccctcgccagcgttgtccgcgacgacatggtctattagattacaggtgatgatgacctccatgtttttttttcaatttttggatcaccagagatgaagaagaaggatatggcgtatggacttgccttgagtcgagttgggttggnctgagagagagagagagagagagagagagagagag

SEQ ID NO: 94139 - DNA, 502 bp, Oryza sativa
ttttcaggtacctcagagacacagctaatgcttgcttgaagtttggcaggactaataaggggcttattggatatgtggattctgattttgctgcagatttagataagagaaggtcactcacaggttatgtgtttaccattggtagttgtgctgtgagttggaaggcaacattgcggcatgttgttgcccagtctaccactgaagcagaatacatggctattgctgaagcatgtaaagaatcagtttggttgaaaggattgtttgctgagctttgtggagtttattcttgcattaacttgttttgtgacagtcaaagtgctatatgccttactaaagatcagatgtttcatgagaggacaaagcacattgatatcaagtaccattatgttcgcgatgtagtcgcgcaaggtaagctgaaggtatgcaagataagtactcatgataatcctgttgatatgatgacaaagcatgttcctgttgctaagtttgagctttgctcaag

SEQ ID NO: 94140 - DNA, 1673 bp, Oryza sativa
aaattcgtcaatcttaaaatattcttgccgtctttcagaaatgcttatagagatatggtatacatatgtgcgttcatatgggagagtgcatgtgcgttatcatcactaacgtttataatgtgtttcttaaaaaagattaaaatattattgaccaccgataacttctcagatagttagtaaaagaaaagaagaagtgattacatagatttttgtttcttgaaaagcacattctatatacttactagattttgaaaatcttataatataaacataaaagtcaaagttttaaaattttgactgaattttatcttaaacataatcggagggactaacttgtttcaaacatacttgccaaaatttttttgtccgacgatataaaatttacatatctctcgtcccatgtcaatacactccatatgtatagcaacgtaacaatgtaatatgtcattacacttcatatctaataatacgagtcttaagtgctcttgtattattttgaaaaatccattatcttagaaaaaagaaaaaggtaacttatctgacttggccttgcaggtttcacgcagcaaccactgaaagcttgctgcggcgggggcgggccgtacaactacaaccctggagcggcatgcggctcaccgggcgcgtcaacctgcggcgacccgtcggcctacgtcaactgggacggcatccatctcaccgaggccgcatacaagtacgtcgccggcggctggctcaacggcgtctacgcttacccgtccattcttagcctcttggcccaataaccaaggtagctagtgcggatgattttgtacgtcagtagtatgtacgtgcattttgtatgtcaatagtctgctattgagcttgactttgaaatgaccggataatttggacagcgagtatatctaaattcatagtaataaaatacatgatatattcttggacggagcgagtacgatgtaacaaggtaagagcacttgtttgaactatttgttaggtctaaatatataatatcttcagtcataaatattaagaaaaaattactagacaaaagtaaaaacaaaaaactgcctaaatattatgcaatatgcaccatgttagttaacggaaagctacaaaagctgcctatgtctgatcaaaactacatgtcttatgagacattttacctcacaacagcttggtgcttcaatttactgaaacaagacacgaaacaacaggttgtcttcttcataattcaaaacccaatcagctatttaaattaagctaaataagaaccatcggattcttgaataaatacgaatgataaataagaaagtgtttccttacatccgtcagtccatcacacgactatgtacatttgctactatcgcaatgctgcatgttactgcgataactgacaatacccacgtgctaccaccaaacctgaaggggttagcctgaagctgcatctgatacttccatttaattgtctcaacaaaatggccatgtaatggttggtgaattctggcagtgggaggtggatctggatctcagtcgttttggtcttttgaacccttgcttgaatcttgggggggggggggggggggcttatctattattcttaattatttccgtcattttatatctattgcattctttgtacttttacgtctttagtcattttcccttatgtttct

SEQ ID NO: 94141 - DNA, 5269 bp, Oryza sativa
tagcagatcatccatttctatctatccctttaacgacaactacttaaacctctgggcaattaatcatcatcatcatcaattaccaacttgtgtcttcttttcagaccaggcttttgatcagcaaaagagctttccatgtccccagattcggtgatatttatatcatcgattaccctttgctcagtattttcaacgttatctagctcaggctcaatgaagtcatccaaaagttctgtttcaccagcaccgccactgttattagacgaatttaatccatggtgcagattatccctgaaaagagaagttatttacagttgaatcagtgtatcaaataataaggtactcttactgttatttatattctagctacttagttttcactaggcataagtgcataatatgatatgggtaacaatagaggaacaaccaaatatgcagcacccttcaatattgaacagcttcagtttcctcagcttaatagttctgcttcacttaagtgcaagtttactggcaaacaatatttggggatgccatgtaaaaaaaaaaaaaaaaacagttcatgagaagcatagaaacattcaagaatctatcactggttaggggaaaccattcttccaactgatgtattttccaaagcatcagtctacaacttcgagaatccaccacttgtgatgcatgaaagaactaacaaatatattttatgtgcaaagacaaaagtagcaggatcaccataattcacagcagtctattctggtgaataagtttcacacagcctagagcccgtaaaataacatctgaatcattcctgttttttttatgaagcttatgatatgacactgataacactacagaagtagttcacacatttgctaacaagtatgaagagaacagatcagacagtttgaagaatttttgtgccaagatgaacgaacttacttagaactgatagtttcatcgtcttgacctatgtttttcaaaggctcttcatgttcttgtgtatttgctgcaaaacctgacttcaataacctcttctttttcccacttctgttaaaagcagaacaaatttacttagccaaatgtgtgggacagaagaaaagcaagaatttatagaatcagtaaggtttaacaattggcataagaagatttatatggtcattttattgatgagtgtaaagctgtatgagctcacctatgcatagagtctatgatctcatcaccagaataagtgtcttgcagggcttcttgtttttgagatatttccggtgaataattactggtgtttgtactgtctggtgactcctgatgtttctctatattcattgcattgtccggcgtcaacagcctcttcttttttccacttctgttaaaggaaggacttacatgatttagtttagttaaacatattattattaggaaataaagatggtaacacacagaattaatgagggataacacttcctttgtgtaaaaagcggaaggagctcacctgagcatagatcctatggtctcatcatcagaatccgggtctgccaaaccatcttgatgctgtgatgtactaggtgagaaacccacaagtggtaccttcttattttttgttctgcgaggaaaacactcaaaatatcaacatataaaggataacaaaaattaatttcatcttagtagtccatgacattttgatgcccagtacttgaagagggaaatgtaacctagattagttgcatactaagtattaatcatcatattctctgataactcaaggagacaaacttggcatacaggctatatcctgaatataaaggctgtacagcacatagtttgactacaaaattgattgatctgcaggaccatataaaaattactattgcatcactctgttttgcagaaacatttggtattttcagtgcaaattacccaaacagaaataaaatatacttctacctcacgatttaaatgtagcggcaatatttcagatcacattcatactttctgaaatacaggcttcttaacagtaaaatgatttcagattcatttatctcgtcaacaaagttacttcgttgaaagcaacttacagggtaactcacctgcttttaattgcttgtaatgtttcttcatcagatgattttccatcggtagtgttgtcctcatagctagcatgcgacacattttgccttttccttctgcgcctaaaaatgcaggttatgtttagtaacaagtaccaatgaagtgaaatgtgaaaccaagaaagcatgcatattatgtttgatagaaacgcttgtccagtaaaagaataagggtcagttgcacttatccatacaattggtaagcacaaaattgattatcgagcattttttagaaggaaccacacattaggaattaggctgacttgaacttgtataataatgtcaacagagttcatttgcttgtgcataactgtctactaaacatgtcaatagaagtcagataccattacaaagtgaatgtcacagctgatcatttataataggggcaattgcagatttaccactattttgaatcgttattgtaaaactgccactagaaaattgaaaaaataccactagaactatcattcgagtggcatccttacaaaattgaaaaaaaacgatggcaaatttgcaaatgcccctttataatactcaccgggtcgtttctggcttgggatcacagttgtgttcacctagcatctggtccgtctgtgtagccaattcttgagctgaaagaggtgcctctggaacttttgtcctcctcttcatggcattcctcaggcctagctgtgtgagctttcgataaacttgaacagaagaaatctttccactggggtctaaagcttcagcaatgagatgagtgcatttgcggtcatctttgtatctgcaatacgaaggaaataaaccccacatgatccctacctaaatgactaagccttacatactaatgaatacaaaattgtcctttttggggagggggtgttggtgcttcctcacacagattatgtggctacactagagactaagttttgttcaattgtatgattctatcattttttttgcttgatacaaattgaatacttacttttcataaagatctctcataagcttctcttgctcttcactaaaaatggaacgacctcgccttttgggggcttcagaattctgagaacctcttgatacagtgttcctatttttttcaatttgaattgaactgaggattaaagaagcaatcacaaattcaaatgtagaaccatgtataaagcaaacctatcattatcgtcagcttcactgtctgaaaatgacaatatcctgttacttttatttgtggcacccatgcttctcttagaaacatcttcatgttcgccagacgatgaatcatcatccctgcttgtatgcacataaatcatatcgtcactcatgtgtttcctagttgccgctatattaatggacataaacagaacaaacttacttatcagcattatatggttcatgtggtataaccaagtccacttcgtcatcaccaagagaatctgctatgtttattgaacctctccatcccttacttgaaccaatttcgccacccttgtttgtagcatcttttgtgatatcactcagaagagcatcagcatcaatgcaatggcactccttgcgtgttttccaaaagagtacatcaacaaatagcaatggttgtttcttcattaccctcagcatctttcttacaattttagaaagaaaatttacaatgttcgtatactcctttgaatttgatgatttctcgtcagctaatatatcatagaaggtagttagaagggacagctgcaaaagacagcacaatgttagatcccaaggaaatatagctccttacataaatatatatcagcgtatttttacctgatagagcattggtgccaattccaggtcttcgcaaaatctccgcagcatgcatattatgtagtgatttgttcgaaaggagttactcttgtaatgcttcaacaaccaacatatattttggacaacagaattgttcgcaagagtagatattagtcgggatacattgaaatcaacttcactagtagcagggggttgatcatcaagtgaagagtctgaagtcccatcctcttcatcaattagatttcctttcagttcaccattgtctgcacgagatggctcgccttcacaatgcgaggtgctatccagattaactgatgtgccagcaagttcatctggtgcatccatgccgttggagacaactttttcttgctctgtgagaggaggctctgctacagaatccacatttttcaaatctggaagtgattcaagtgcagatttagtcccatctgttgaatcaacattgctctgttccattttctctgcattgagatttgtgttctcaattttgttctttgaagccttcttttttcttccttttcttgtcctttttgcaacctatagcggtgatcaatagtcagctcatagagaaaagggaggggcaaaaaatctcagcataaaatttctcatcttcacttgaacaaataaaaattgatagaaaccatagttgcttaaaaggagatgcagacagatcatagtgtaacttggtggccaagaaagcaaggcatacccttaatgcaccacgtgcttgaagcttctccatgagctgtagcatgatatggattgttcctagtaaatctgcaagatcactgataaaacaatagatatgttcatcaactatttgtaaaaatgtattattagattgctatatagttgattaaaggaaaaaaaaaaagactcgtatgattgtctagaaaccaagtgcaacccaaaccatgcaatgccctttcacaagaacaagtgtttgcagaatgtagcagcttgcacacagtatcccatagtaattttggaccttttcctaatataaatatccaaaaagaatcacttgtacaaacctttttggttgcttatgagtatcaaatgatctgaataagttcagcagaaattgagtgagcccttgttctgtctgatcataaaacagcttatacagtaaaacacgagctgtttgagattctcttgaatcatcaggaagtactttaagcaccaaatataccatgtcaatctgcaaggtaaggttcttcagcacgtagattttgaatgtacataaagtcataactggacaagccattaagacagtagaactaactgaactaggcaggttcaagcctttctttctaaagtatataagattctctttttcaagttaataataaact

SEQ ID NO: 94142 - DNA, 3356 bp, Oryza sativa
  unsure (1)..(3356): unsure at all n locations
aaataaaaaagcttatgctccttgacttgatgcacattcagaggggctttttcttgagagaattttccatttcataatattaggcacaatattattgaagatcttcccatttcattgtttccatgtgcaccatgctgcaaaaccacaatccagaccatggaccaatgaagtcataggacagcaggtatgttagattttatagcaaactttaacaattaatagagtattacatttttgcaggtgtttctgttgttcatttcatggcacctttaaatcagcaatgctctgatatcgccccatttgtggatgcactgtgtaccagatatccatctgttaatttcctcaaggtaactagcatcttctaatgaattatgtgcttctgatttcttattatgatctctgtcaacgtgcttctttgattttgacataggtggatataactgagaaccccacagtgacacaattagaaaatgtcaagacagttccaaccttcaaaatttacaaggatgggacacgagtgatggagatgatctgccccagccatcagctgctggagtcctcactgagacaatacgaggtctagaccatgacttcaattatttaatattacctgcaagttcaacatccccaaaattgacacatgatagccacagctaagaaggcaatatttgtttgccctctgcgaaggcgagtgaatataagcgagtgatgtgaaaatttaccccatttcggccaaccacattcttctgtgcatttttaccatccccattgttatttatgtatcttatttattctttccatatataatgtatatgcttgcactgttcttctaaaacataaacaatgtcttacattcttgtatagaataggtgtaaattcttgttttcattaaactcgtatatttaagttactcagtttatattctgtgtatccacaaacctttagctgcgtctgtaagcttttgttgcagttcttttatacagatctgtatgtaaattatatgtaaccatattgcccataacctgatttgctcaatgaaagcataccaactttacgtttagggttcaacattttattgtcttgtgatttggcagatcagttttatcataatagatatagtttttagccgatgagtgggtggactgtcaatgatgctgacacgccaacatctggctggctggtactgtgtcatgttaagaccgacgattttggcccgtcctatcgtccaggtcggcgtgcattgttatcttgtcactgtccatccgtggagctatcactggatagtggtctggttttggattcgagtgcttgttagctgttgctttcttcccccacagtgggcaaataatgtgatgtgtacatgcgttgttatcatgtaactttccaggactctcaatgggcagccgactgggttttggatttttcatactatgttttctttcttttcagtgcaaataacatgaagttttcatgcaagtttatgtgccgtgttggtttgcttatacattatcttaaaaaacgtgtggtttgctcacaatgtggatggtaagcctgcttttctggtgagatttcatgctcctttggacagtcattgatgtcaagaacggcaagttatatgcattttcagaagcaaggtaggttgatgtcgaaggggctagctctagtgaatttcacatgggacagtccaattaccccaagatacagttttctgcctgacaagaaacagaggtcgagtcctgtaactctacaggaagatgatttgatgacacagtggctgttctttctgtttaatgttaactacagcaaagagttagtttgctctgttttatcttgatgctaactgctaatcatgtgaccttgcattaagggcaggtacaaccacgtttccttctttatgctggaactgctggtagtggccctcctaactgctgaaggtgaccaatcaacctgaaacctgcatgtgtatataccttttccctttacatttagaacgcaacatgacgtgggctcaattggacttataaacactggattaaaaacaggttagtgtaggccttctgttaccccattttatcagtaattcttttcttttttatatttttagattaaacaccagttttattaatctggaataggatccgacacaagtgcctgttcaatgaacgagtaagtagttcttgtttgatgacatgggggcatatccggagctgcaaattgctgctaatagcaggctggagctaacctgtccatgaactcatggttgtcatgggttcagtgcttgagctacaactacctgaaattacattaacaaaaaaaaaatgtctcgctctctctcaaaacacattctcaaaagacaaatgcttcattgttagattggcattcctacatacataacaacccaatatatccatctcagttagaattcagagcatatatccatctcaattggaattcagctccaaactaaccactactcatcgtcgtcatcttcctcaacgtcaatgccagtgaaatctatcttggcccattgctcatcaaacaatgcccgggacgcagctctttggacgaagaagtccattccaacctcgtaataccccttctccacctctttgcggacctgtttctggaactcctcgaacgagtcatccgctttcttcaagagatttgccgtctttatcacggacttgctgttcttctcgacccattcctccgagaggccatccaccttgacggggttgttggtcctcaggagagggtagtcctcggggctctcgtagtatgcctccctcttctgggcgagcacccagtcgacgtactcctgcggcatctgaatcatccgtggtggacgctcgccgccgtcgtctccatctgtcgccgccgcagcagcagcacacgcctgctctgcccccttgcctgcttcggaggtggccatcgccagagaaatcgatgctggccgtgtcgctcccccgcaacctaaatacacttgtgcgaaccctcgaagcagtcggactcggggttagaagaggcctcggacacggtcaaccttgtttcatgctggatgggcctagcccaacctgtgcaacaggattatgagcagttttttttttcttctcttattagaatgaggaataagttctcctgaggtacctcaacttaacaacgtgatttttttaaggtcccttagccacaaaaccataaatgtgtactcctaaactcacacaaaccgtgcaatcaaggttctataacagtatatatgggtggtttcgctaacgtggcatcctagttagcaatctgggaccacatgtaagtgttattatgtntgntgcgtaccgagctggtctaccntnggacgcaca

SEQ ID NO: 94143 - DNA, 1399 bp, Oryza sativa
  unsure (1)..(1399): unsure at all n locations
cggagtagaattagagagagaaagcgaagtattcnncgatgaagaaagtgtcacaggcgaagcagagaaggggtgaatttgtttgnagtacacctgatgaaaggagggatcatatattaatttagattaccctgaaagaacactcatatgataagacgggctagccaacaatggatagaggggataggacaacaaaggggacttatagaagaggaatatacagagcgacaagaccatcacttaagataaatgaagggggaagaacaaaagtagaaaaggatgtcagggtctgattagaaaaggagcagcacagaagcgggggaatttttaataggagggcagagtgagagtatttaaaagcacgcacccccccgggcgtccccaggtgcacgatccatcctttaccctgaacacaacaaagacaaaaacactttcggcgccaaatagcctcttgggctaaaccactataccaactaagcttgagcaaagctcaaacttagcaacaggaacatgctttgtcatcatatcaacaggattatcatgagtacttatcttgcataccttcagcttaccttgcgcgactacatcgcgaacataatggtacttgatatcaatgtgctttgtcctctcatgaaacatctgatctttagtaaggcatatagcactttgactgtcacaaaacaagttaatgcaagaataaactccacaaagctcagcaaacaatcctttcaaccaaactgattctttacatgcttcagcaatagccatgtattctgcttcagtggtagactgggcaacaacatgccgcaatgttgccttccaactcacagcacaactaccaatggtaaacacataacctgtgagtgaccttctcttatctaaatctgcagcaaaatcagaatccacatatccaataagccccttattagtcctgccaaacttcaagcaagcattagctgtgtctctgaggtacctgaaaatccactgaatagctttccagtgttctttaccaggattagccatgtatctactaaccaaactcatagcatgagataaatctagacgggagcaaaccatggcatacatcaaagaaccaacaacactagaatatggaactctagacatgtattctacatcctcatcagtactagcacattgtaaagctgataatttaaaatgaggtgcaatatgagtactaacaggctttgtatcatgcatgttaaaacgctgaagaaccttcttaatgtagctttgctgactaagaaataaccaaccggaatttctgtctctagtgatttccatacctagaattttcttagcagcatcaagatccttcatatcaaactcactactcaactgtttcttcaatgtagtgatttgttccttgctcttggcagca

SEQ ID NO: 94144 - DNA, 2045 bp, Oryza sativa
  unsure (1)..(2045): unsure at all n locations
ccgctgcccattgttattccgactcgctactctactattttccattntcatgtaaagcttgggataacacagtgcttgccagtcctcatgcagtctgtctgtgatgatatcgtaaaggagcatcattctatccagaaatctgacatcactacattcttcaaagttgctcgctttgtcttagcttttcaacacgagaaggcatcaaatgctcaggtattgaattaaactcatgggccatttgtgctgcatttttatggtcagtgactcactggttttgacctgtggtactgtattgtctatcggtgttaaaagaacagttctggaaataacatgacttgctctatgagctggtatttattcatgtctcagcgtaaaaaaaagggtaaaacactatcctaattattttatagtattttcaacttcaaacaacacgtaatcatgaatattacctagagcaagcaataaaggcccaaaacaatcacgtatgactggtgtggaccatggacagcacctgtggcgctgtagcagcaagagggaggaaggctttacttttcctgacaagattatatatttttctgaataattagctgacttgccagaaggatttgttgtttagtaattacctactagttactaaatttgttatcagttcaattaagaaaagaaagagaaaaactaaatctactgcacccatctgttctctatattattggttaaagagtcttgttgcatgaccggagaagagccctgctgtgcaagatctgcccatggtcctcggacctgtataaaatcatgttttcacattacttttataaaaccatgtgtaattgcatttacttatatcggccagctgtttcatattcctatcacacaaggaattttttcccggtataatctgttggagcagcaatctgaaattgtcaagagttccatccgtttttcctagtgcaacctaagttgtagattagtgatgtcttcattgcctcgccttgtttgcattgaatactatacttgcaaaatttgtaactagtgctgatatgtatcatctttttttccatgatgttttatgacattgctaacctctttttgtcagaaatctaatgctgcggtccaactgcctgaggcttctcctagcgatcatcttgatgataatctgccgtttcttggtgacatatgcggacctgttgcagccacattgaatgaaggtatgtttaacttggtcatctccaggtggcgtgaggcctatgatagcctgaaggaaacacatgattacaagactctttcagcagctgggtctctaatgaagaacatggtaagaaaatatgtatactaacatttcaggctagtaactctgctcaactttatactagtctagtactctgatgaatctcatcaactcctttgttatctgagaattagagtttattattaacttgaaaaagagaatcttatatactttagaaagaaaggcttgaacctgcctagttcagttagttctactgtcttaatggcttgtccagttatgactttatgtacattcaaaatctacgtgctgaagaaccttaccttgcagattgacatggtatatttggtgcttaaagtacttcctgatgattcaagagaatctcaaacagctcgtgttttactgtataagctgttttatgatcagacagaacaagggctcactcaatttctgctgaacttattcagatcatttgatactcataagcaaccaaaaaggtttgtacaagtgattctttttggatatttatattaggaaaaggtccaaaattactatgggatactgtgtgcaagctgctacattctgcaaacacttgttcttgtgaaagggcattgcatggtttgggttgcacttggtttctagacaatcatacgagtctttttttttttcctttaatcanctatatagcaatctaataatacatttttacaaatagttgatgaacatatctattgttttatcagtgatcttgcagatttctaggnnncnatccgggtgcccaatgatattcaaatggcacgct

SEQ ID NO: 94145 - DNA, 639 bp, Oryza sativa
caataaaaatataatattaagcgattcaacttcgattagaactaatcgatttaggcagttatgcgttggcacaggagataaactgtttccaccgacaatgcaacacgaagaattgccagcacgcaacatgaaagcaactttcacggtacagtgatcaccttatttgcagcgacgcgaggcgctggtgcgcgcggccgtaggacggatcgagccggatggcctcctcgcactcctcgacggcctcgccgaggcgggtgagcccgatgagcgccgcggcgcggttggcacggcacgcggcgctgtcggggcacagcgcgagcgcgcggtcgtacagccgcagcgcctcctcgaagcacccgttcttgtactgctcgttcccggcgcgcctaacctcctccgcctcggcgctcgccgccgcggacattctgaccgcccgacgcgtggtccttggaggaggagactggagcggcacatcgcgcgcggacgacgcttccgtggccgtagttgccggtgccggagccaagcacgtcgcggcgggcggcacggggaggccgaaccggcggcgtggtggggaggcggccggaagggcaaatgttccccgcggggaacgcgccggcggcgagcgccgaggtggccgtg

SEQ ID NO: 94146 - DNA, 502 bp, Oryza sativa
  unsure (1)..(502): unsure at all n locations
atggtgtannttttgaatagcactcggtaccgtataatatctgcagagagatgagatgtgacccaattaattgtgcactgtttgcttaattaggccgaagtgtgtgtttgtatttgtgtgtgggttaattaatatttgttcatggggtttacttaattagagtttggttgtgatttggagagggtgattttaagcctgatgatgtatttagttggggatcgaatcaaactgatccaagtgaataatgaagctcaaacaagggcttttccattttagtttcacaagttgttatgggctggctctcaatgaggtcctgaggggctttcgtttgcgtggccttgcaactgcaattccggcccctctagtcggaactttacgggccaaattttgtaacccttttgtagtagtagagccagaaatgctaaaaagaatttggtcgaaaggagccactataacactattgttagttttctttttcaaaatttcctgaatctatagtaaa

SEQ ID NO: 94147 - DNA, 3592 bp, Oryza sativa
  unsure (1)..(3592): unsure at all n locations
gcacatatccgcgcccaggcgaagaagcggacttgcacgcggtacagcgaagggacgatgagtctcttcgctcgtacattcagcggttctgtcaagtccgcaacaccataccgtgcatccccgcacacgcggtgatctacgcgttcagggggggcgtgcggcacaaccgcatgctcgagaagatcgcctccaaggagccccagaccaccgcgcagctttttgagctcgcggaccgtgtggctcgcaaggaggaggcctggacctggaactcctccggttctggtgtggcagcttcggccgcccccgggtccgccgctcggtcagggcggcgggacaggaggaggaagaaggggtcggcccgtttcgacgacgagggtcatgtcctcgccgtcgagggcgcttcgcgggccccccgaaaggggaggcctgcgagcgacaaaaagaaggaggccggcgcttccagcagggagcgcccgaccggcaagtggtgtaccgtgcacaacaccttcctccacgacctcgcggactgccgcgcggtcaaaagtttggctgagcggacgaggaagtgggaggaggagaagaggcaggagcgccgtgagggcaagaccctggcggctcccgccggcaaccggcgaggtgaggccaagcagaaggccatcgccgaggacatcgacgatggcgacgatgacctggggttccaggagcctgaggccaccgtcgccaccgtcgatgggggagcgtgcgctcacgcttctcgccggagcctcaaggccatgaagtgagagcttctggccgcggcccctaccatgaggcgacgcggcgggcgcggtggtcggaggttgcccttaccttcgaccagaccgaccacccgccgtgcgttgtccggtgaggacagatcgcgatggtggtttcccccaccgtttgcaatgtgaagttggggcgtgtcctcatagacgggggtgcaggccttaacatcctttcccccgcggcctttgacgccatcaaggtcccggggatggtgctccggccgtcccagccgatcatcggtgtgacgccggggcacacctggccgctgggtcatattgacctcccggtcaccttcggtggttccgccaacttccgcacggagcgggtggacttcgatgtggcggacctcagtctgccctacaacgcggttctggggaggcccgcgttggtaaagttcatggcggcggtccactacgcctatctccagatgaagatgccgggccccagtggccccatcaccgtccatggcgacctcaaagtcgcgcttgcttgtatggagcaacgcgcggaccaccttgccgcggcgtccaagcccgcgggcggcgacgagaggctcagcacctccgtcccggccgccccaaggcggcggatggtcacgtgcgacgaggtcccggtcaaggaggttgtcctaggcgacggcccgtccaagaccacacgaatcggtggtcttctggacgataaataggaagacgcgctcgtctccttcctgcgggcaaacgccgacgtcttcgcctggagaccggcggacatgcccggggtccccagggaggtgattgagcaccgtcttgccgtgcagccgggcgcaaggccggtccggcagaaagtgcggcggcaggccccggaacgtcaagccttcatccgcgaggaggtggcgcgacttctggaggccggattcatccgtgaggtcatccatccggagtgactggcgaacccggtcgtcgttcccaaggcgaacggcaagcttcggatgtgcatcgactacaccgaccttaacaaggcatgtcttaaggacccttaccccctgccacgcatagatcagattgtcgactccaccgcggggtgcgaccttttgtgttttctagatgcatactctggttatcatcagattcgcatggctagggaggatgagaaaananctgcattcattacccccataggaacttattgttatacgacaatgcctttcgggttaaagaatgcaggtcctacttttcaacgtactactcgaatttctttgggtagccagataggacgcaatgttgaggcctatgttgatgacttggttgtgaagacgcgcaaccaagagaccttactctcggatctagcggaaactttcaaaagtctccgctccgcccgcataaagctgaaccccgataagtgcctgttcggcgtgcctgcgagcaagcttctcgggttcttggtctctgcccgaggcatcgaggccaaccccgagaagatacgagctatagagcggatgcgcccccccagcaagcttagggatgtgcagtgcgtcaccggctgcatggccgccctaagtcggttcatatcgaggctgggagagaaggcactacccctatttaagctcctcaaacgctccgggccgtttacctggacggaggaggctgagcggaccttcactcagttgaaagcgtacctcagttctcccccagtcctggtcgccccggagccagatgagccgttgctattctacctggcggcaaccccgcaggtggttagcgcggcgttggttgtggagcgcgacgaggacaaccctcaccccgtgcatccccaccctgtgtcgactcgacccgggagagagcagggaggagaggcccccgagccgaacggcggcccgaggcccccgacggccggagctggccctccgcctgcttgtccgacggtgccaggcgcccccgacccccaggatggccccggggccactgcgggaaggccgcgcctatcgccctctgaccccgaggtcgtcagcacagaagccgagtgcggggccgcgaggcctctcggacgaagagcgccctggagatgcggcccctggcgaagaggatcggccccgccgaaaggtgcagcggcccatctacttcgttagcgaggccctccgggacgccaagacccgataccctcaggcccagaagatgctttacgctattctgatggcttcgaggaagctgcgccattacttccaggcgcatcgggtcacggtggttacgtcttaccccctcggccaaattcttgcataaacgagagggtactggacgggtggtgagatggccaatcgaactctctgaattcgatttgcgctttgaaccacgccacacgatcaagagccaggccctcgccgactttgtggcggagtggaccccagctcccgagcccgtctccgcccacgagaccagctcgggccccccgcagctgcctcacaccgcctactgggtgatgcagttcgacggctccatgtctctttagggcgccggtgcaggggtcacgttgacctcgccaagcggatatgtcctcagatatctggtccgcctatactttcgggcgaccaacaatatggtggagtacaagggactccttgcggggcttagagtggcagctggactggggatccaccgcctcctggtgttaggcgactcccagttagtcgttaaccaggtctgtaaggagtaccggtgctttgacccgtagatgaacgcttacgtgtgccaggtacggtgtatggagcgccatttcgacggaatagagcttcggcatgtgcccagacgggata

SEQ ID NO: 94148 - DNA, 2281 bp, Oryza sativa
ttccatatatttgtaaaaatatgtgcaaagctatgttcagtaagtactctgtaaatgttagaatatcaagggaaatgtaaaagaatcacagtaacagacctagacaagggagggggagtggccgtttcacatgttcagtactattttttgctatgttggctaaaatttggcttagagagttggatggagagtctcttggtgatgctctaactgcgggttgggtgggttttttgtgtggatttttcgctgtgatttccacaatttgagtatgtcacatgtggacagtcagtgatgatatgactgtacaaaccaattattcatacccagtcaaagagctgccaggaaaaatatatatagctgaatttttcccatgaaacctaacaagggattcattaggtgaggtttgtacgaatgaggtttgtctaaggaagacatcagattgggggatccctcatgtatgatttatcaaaaaattacaacaatccttattcatgtggtcccttgagagtcaataccacttaaatctagtatatccaactcctagaaaaaattagtccatccaattccaagaaatagtaaagtaattatttctactttttgaaattagtacctgaatcctgaaaaatccggagacgaatatgtgctaagaaatctagcaatgttgtctgccaaaagtggaagataaacagcattgtatccaatagattgaagacatgtattgtgcaaaactgggctcttgctctgttttactgggttggctataacaccgagaacctttgtatcaggtcctatgcgccttatatcataaatgtctatcagctcttcgacggttggctgcccaggtgctgatacctttgtagcatcaagactcccaaaggttagatatcccccaaacttgggggataacacccttgacattaaacctttttcgcccataactagtccaatcataggcacctgtcatttccatttctactggtcagtcaaatggaagttaatccacaatggtcaaatttagaaaaagaagagcataaaagtccaatttagacatactacaacattatccatactgttgtctacctcctactccctccggcacaaaacatagctacttatgcctttttttgaagggattaaggttgaggtgggaaatggttgtggttggttaagataaaaaagtagttgaagaaatttaatgaggagtggttgtgattggttaagatggggaagtaggttgagatgagacaaatttgaatgatagaagtagccatattttgagaccgagggagtaataaataacaccaaacatgatgacataagaataagctaacaaacgagcacagctttgccaatgagcttagttttcttcttaaaattctcctaaacacataaagttttaaaagcttaattggtccgatatttcaatttgcatcctctctgcaagcgaccaattttatcactattcacatcctctgtgcaagcaaccaattttatcacaatggtaagtaatgattttctattaaaaattaatgatattatttgctttcactggtaaatagggagatttgaatatggaaagtacagtataacagaagggactgaaaaaaaagtttaatactacaggttagattggtgaaattctcatacagcttaactgaagtacaatatgtgaaatgcaatttcctaaaagccaatatgctaaaattaaattgcaagtcctaatgttttcattaaaaaaaatgacttccaaaccataggagctaggaagcatttcatacaaagtttgaggaatgtttactggcctgagctagggatcattagacagaacgatttccgtgtgaagtaatttaaaaacagcatgaatctaaaaggaatgcagtagtggtatcaagatgtacaggatgattatacaggataggtgacgcaagtttccagatggaagagtgaaaatgtatcttggattttatacaatgacacttacttggcagtgcaccatcacttggaacattcgtgacacatcagcaatgtcactagcagttgttgcgattttcactatgtcagatccaactgcttgtattctagccacaagatctgcaagctcctcgcaggacggagtactttcataattgtgtgatgagacaataagtttacacttctctggcttactgccagaaataaagctgataaatttgtcagcaacctacaaaaaaaaggaaagttggttacaattgtgtgcatgtattccaaatcgtgaactcaaataaatgaggcatatgggtgt

SEQ ID NO: 94149 - DNA, 1717 bp, Oryza sativa
gctaccgaactcagcataggaaagacttagatattgtagtttcattccatatatagagtattacaccatacttatattaatatattccatagcacaatacgaatagattccaatagaaccatcaacacaatccataattttaatatatgacaaaaacattgaaattataaaataagcatagttgcaaacattgcttgctgctcatttattcctcaacaagttctctagctaattggtccaacacatcttcatgtctcttcagttttgcttcattgaaggttgatgtatccttctccatcaatttttaaatacatttggtatttttctacccttgcctcctctcttttagcacttgcgttctcttttatttttgcttctgctccaatcagtgttgcttctgcggcctttagcaatgttgctgctttagttgtaatagcttcatgaaagagaaccatattttgacttggcttgtcccccaaagttgatggagcaccttttccttttttcctctgttttgctgccttttgcctctcaaggcacttctctttgcgctctgttttctcctctatttcttggttcgatgatgaagtatatgctcctgattcagaaatcttgttcctcttattatggctactctcttcaaggactctacaccatttaggttgttctttaagatctttccacatataatccaaggtgaaagtattttggttgttctaacttttgtgccattcacgggctttctctattatcatatgatcagaatacccattagtgaaagtacttctagctttacaataaaatccacagaacttagtgacatctctcttgacattatcccaatgtgttctgcattgcttggggttccttttgtgcccattgctaggcaatactggtgttgaactctcaagctatagccttccaatactaatattattttttgtcattgcctttgatgggatcaactgagttgttcaaccaagagctcattagttgtatattgtcatcttcagtccaattgatgcgtgtccctcttcttccttcttcactgctttcacttgcctcttcaatctcaactacttgtttctccttatatcttgtatggtatggaaaagctcatccatgtgaagaagtgttggctgcagccccaattgaagtactatagtgcataccaaattgtgatctattggctgcaaatccaaatgcttggatagatgactacactagattttcttgaagttgaaaacctttaaagcttcctagagtagtttgcgcataataatcttgttggtgagcaccttaaaagattgaagggtgtccatatagttggtagttgcttagaggaccaaaaggatggaaattttggagaaaactaggtctcaagttttagggataacttgtgggaaattgggtagaatggggagttttggacatcactatttgttgcttacttgtttggcttaacaaaaggctccacttagtatctagggaactgaatggatcaatatgttgttcatctcacttgtgcctcctttcgtaggtagcacaagaatgttgtaagaagccaatggctaggaaagcaaatgagcaactcaaatgaaagagcaccaacggctagtagaagtagttactatctgtagtaactgacatgtatattttattggtgtgaacagaaaaacattacaagtattatattttgtagctttgtggccacacc

SEQ ID NO: 94150 - DNA, 608 bp, Oryza sativa
ctcgtcactggcgctccaatcgcctcgatgggcttctcctccagatacagctgcagatcctgggcgggcacaccgttgagcgtcacctcgtagtgcagattgcactcgttgtcaatggacatccaggccatgccgacggcatgtggattctgtgcatccgtgtgctcctgtcgcttcagcagaatgggttccgccgagtcccgagcatcggccactggacggggcactaggcggccacggatcaggctcgtctcatgctcggtggccacattaacgcccagttcgccggcatacagcgactcgaggaccttgggacccaacttctccacactaccaatggcctggttgaagttgaagctcggcgtcagatcctccagcttggccttccgcttgccctgctcctcaatcaaactgatgttgggcctatcccgggtgttcacgtgctccgtttcgatgttgtaggccagagatccatcggtgttcaagtagacccacgccaaaccgctgctcttggtcgaggattcggcactgtgcggcgccagcagggtctggaagatttcgcagctggctcgggtcacgatgtgtccctggatgcgcagatgtgggta

SEQ ID NO: 94151 - DNA, 4794 bp, Oryza sativa
ccgcgacagcggcatcgtcactcgagttaggatctggctccgcgacagggagcaccacggtgttcgccgtcgccgactcgatgggcatctcggccaccatctacatctcggccgcctcgtccccaccgccaccgccaccgccgccgtcactccccgccgccatcgtccccatgtcagtcgcggataagagagagataagggagagagagggggaggaagaaggggaggagagggaggatgacatgtgggtcccacattactttttttttattctagcgccacgtaagtgccacgttggacaaagactcggtcaagaccgccacgtaggcgtcacgtcagccaaaaccacctctaaaaccacctagggacattgtttgcaccggttttgatagttggaggagtcgatacccggttttgtggttggaggagatgaatcatactcaggcgatagttgagggagtcaaaatactttttccaaaacaaatactgggggaattccaatactaggatcgacaacttaattatcaaaagaggtccccaaaattcatatgagttagcaacttatagataccctaagccaaagcaaaacaaatcgtcagataattacagctgaatctatccctttttctcttttcttttacagcggcatgtattattttcatatgcagttgcctccttgtatggcagagcgaaacgggcgattcgcagtgctctggtcaaagcgctattgtggttgtgtgcgcgcttgctctcgtgttaatgcatttaagcgaccatgcccggtttgcccgtatataaggggcaagtagatgttcatatttttacataaagactactgatactctagaaaattgcgaagaaatcctcctatcaccaatacctcgttgtgcttttttatggtaaaacattttgaccttgagtgaaatataatgcgaagaaacggaagttccgtttctaattatatcgcactaaatcttaaaagtatcaggacattctcataaaaatacatcaaaatccaacatcaatcctatcccacctcttgtttagcgcctaccgtacccatccctacacccaacacctccctgccttcctcccatacaccatccgcctatgcctcccctagctgaccagccattgttgctctctcaaccccttaagctcacgccctcctcgtcctggcatccatgctgccttttccccttcttgatccagccatggctattctaaggggaggagtctagcggtggacttgctgacaagggagacgatgggtgtaagcattaccgctgagccaccctcaccccacgctggcgcgggattatcctacaccggtgctcccagatcctcgcctcccgccacccactcttcctcggtcacgcctcctaccaccgtccccgcctcctgcaaatcgaggaaggtggacggtagacctcagcaaggaggcgtggaggtggacgtcagcgtcgcggaggacctcgtggccctcgagtcggcatggggacaatgtggagtttgtcggtgatgacgagcaaggccatcggaggggagcaggaacagtggatgcaccatgcgtgggctctggcgccgccactcgtcctccctccagcaccttcgtctcctcttctcctcttccactttctagcggaggcaactgctttggatggcgtggctagagacgataacaatacctcagacctcaatggggcggctcacaaggacgagcttgaaggcaacatccttttctccaccgctatcctcctctagctcgacatgaggcgctctcctctatccctcccatccgctggcgagccgcacccttcaccgttgtgtgaccatgtacttctttcctatcattgggtggggtgagaacctcagtggtagtgcgcgggaattggggagcaactcggcggcctgtttccatcaagctcagcggcgagtgtggcgactgcaaacccttttgacctccccactcctcagcggcgacaacaacgacgacccagtgcagctggagctgctggccaaggcggctttcgtgggtgcggctgtgtgctgggccatttggttaactcgcggaattattggctctttaaaaatgttttgaataaatcctaggtggtgtacagtatagtgctttctccttgatgcaaaggtgcaaagggttatttctattttgaagaaccttaccttatcttcgttgatataaaagttagtcgatatagcggaacgacgactaaccttcctgatcgcttcagtcattgatcacccaagacatgccagatgacgacacaagaacacacaatatttgttaacgaggttcagccgaagcctacatcctcggggctctgattatgggcgctcctccccaaccaatatagctcctagccgctacgagtccatggcctcaccgccatcctctccctacgtgtctacactgcattgtagtcgccatggttacattgtgggtgcccccttctctatttaagagagttgccgggttacagagtttgactctaattccacccctaacacctatatcacaattccaagtcgaactgtaaccaaatagaactagtatatttgacgtctattctaacaaactccacctagaagtagtagaatcaccatgccgacccacctgtcttctagacttgagttgtttccttttcgtagcttcatcacaagccacccgacaagtctgcaccagactcactgccatcaagagactccgctatccctgcaacttcttcctctggacttcacctataacagtgctccaccttctctcttatcatcacagtcgtcttaccaagcgaaattgaactcctccttagctttcttatcatagactccttgaagaccatgttcacctcatcttccatctttgattttatttaatctaatccatggtttataacccgcgtcatcaccaaatagataaatcaaactcactagactaatgaagaaaccatttcttcattgtagtcttatgaaccgagctaataaatccaacatccacgcttttcgcatcctttgactgcgctccatgataacctaagaaaattcaccgtacgcctgaatcacttgaagaattatcatgacagccttcgctcttcctcttcagtgacgcagatttcatatatccccatcatgcaaacccgcaaatcctagatatatcctgtattgccaaacaacctgtttatgtcctcaacgattttcacccactgtttcccgagacttttcttcagttatggactaactccatatatcccaacctcttgtcaagtcccagatatatcatgttcctgccagataattctatatgcgacctaactagcctgcactccaacattcgcatatatatctagtaatttttcttatgggtttggatgtagccgaactgtcttggagaactgcaacaccctagtgtaccatgtgtgatgcggttgttttcctctttcttttttttaaattccttcacagcagggggtttccctagcatgcacatatcaaaccatgttatattgggcgtatgaacaagtacgcgctcgaacttaaggatggatgtgacgagatcgatggaccctatccaaacaaaccagatatgcatgaacatatgggaaacatgaggggatcaggtggcccagcatgctatagctagaagtcacatgtttactgtagcgtcacatagcctcacatatttactatagcatcacataggctagtcatggattaattaggctcaatagattcgtctcccgaattagtccagggttatggaatgggttttgtcaatagtctacgtttaatacttctaattagtgtccaaacattcaatgtggcagggactaaaaagttttagtccaccttgcctatcgtgtaaaacgtatatctgccgatgccgtacccttgccatgaggtcacaaggctacttgggccagttgccagcctatttaatgttttttcctcgatcgtttcaccgaacggtagatctttttccttcaaccattcaggaaatttgtgcttctgttccttcgagacccaagatgccggtcttcttgggttgcaagctctgatctcgttcatgtgttcctcaatgtacggctcgaggatggcgcgctgttgcagcatgctgctatgtgcttccgctacaactttataggcctcatcatagaaccatttcttgcttacggtccccttcccagctaaccggccctcgtgtacaggagggggcataccaatgagtgtggcgtccttcatataatctatacagcattcaaccacctcctcagttatgtacccgtctatcattgatccccccagatgagcttggttacagacataccatttcagaactgacatgtacctctcatacgcccacatatgatgtagatataggggaccaatttcgataatctgagggacgatgtggacaatcagatgctctatcatattgaagtaagatggagggaaaaacatctcaagctggcaagctgtctcgattgcgaatttatgaagggggcctaactcttcaggatcaaaaaccttatgtgatactcgattgaaaaaatagcacaactttgttatcaccaacttagtgtgaactggcttgaccgctcttatagcaataggtaggaagacagttaacatcttgtgacagtcgtgagcattgtacccagagatggtcaaatctttcatagatacaagttttctaatgttcgatgagaaaccagtcgagactttcaaactacgcaagcatgtacagaaagcttttttctcttttggtgtcagtgagta

SEQ ID NO: 94152 - DNA, 673 bp, Oryza sativa
gttggtagaagttatgctatgattgccccatatgacgtagatggtaaccgtattacgtacccttctcttgggggacgaaactacaactctactacccctgttaaatttacaaaactagcaaaaccacttaaagtcggggatacagaggtttttgtagaagatgttagtctatggaacggacaggcaccgcaagactaccaacgtagtattatcatgtggggttataaaaactcgttcggctatacttatcccgatggaacgtatagtcagctaatgcagatgaggacatatgatattggtgcagttgacaccacagctaacaagattacgttaaacaagccatgggcagttgcaaacccaaatagttcagatgggattttcccagtagggcatacacttagcccaacttctgacggctccacatatttgtatttgaatggtcacgtaaatatacaagtacctactacgtacaccaagtacagccatttgattagtggctcttctgagtttgctaatacaacgattatcccagtagaaacaggttttattcaacttggattcttgttgaaccgtgatacaacaggtgaaaaatcttggctaaatggtttacgtctacgtgactatacagatacgtataaactaaacgatgacgttagagaaacacaagaaaacg

SEQ ID NO: 94153 - DNA, 4597 bp, Oryza sativa
tgggcacgtgccgaagctctatcccgtcgaaatggcgctccatatgccgcacctggcgcacgtaagcgtccatctgcgggtcagagcactggtactccttacagacctggttaacgactaactgggagtcgcctaacaccaggaggcggcggatccccagtccagctgccactctgagccccgcaaggagtccctcgtactctgccatattgttggtcgcccgaaaatcgaggcggaccaggtatctgaggacgtctccgctcggcgaggtcaacgtgacccccgcaccggcgccctgaagagacagggaaccgtcgaactgtatcacccagtaggcggtgtgaggcagctgcgaggggcccgagctggcctcgggggcggagacgggctcgggagctggggtccactccgccacaaagtcggcgagggcctagctcttgatcgcgtggcgtggttcaaagcgcaaatcgaattcagagagttcgattgcccatctcaccacccgtccagtaccttctcggttatgcaagatttggccgaggaggtaagacgtaaccaccgtgacccgatgggcctggaaataatggcgcaacttcctcgaagccatcagaatagcgtaaagcatcttctgggcctgagggtatcgggtcttggcgtcccggagggcctcgctaacgaagtatacggcccgctgcacctttcggcggggccaatcctcttcgccaggggccgcatctccagggcgctcttcgtccgagaggccacgcggggcgcactcggcttctgtgccgatgacctcggggtcagagggcgacaggcgcagccttcccgcagtggccccggggccatcctgggggtcgggggcgcctggcaccgtcggacaagcaggcggagggccagctccgaccgtcgggggccttggccgccgttcggctcgggggcctctcctccctgctctctcccgggtcgagtcgacacagggtggggatgcgcggagtgagggttgtcctcgtcgcgctccacgaccaacgccgcgctgaccacctgcggggttgccgccaggtagagtagcaacggctcatctggctccggggcgaccaggactgggggagaactgaggtacgccttcaactgagtgaaggcctgctcagcctcctccgtccaggtaaacggcccggagcgtttgaggagcttaaataggggtagcgccttctctcccagcctcgatatgaaccgacttagggcggccatgcagccggtgacgcactgcacatccctaagcttgctgggggggcgcatccgctctatagctcgtatcttctcggggttggcctcgatgcctcgggcagagaccaagaacccgagaagcttgcccgcaggcacgccgaacacgcacttatcggggttcagctttatgcgggtggagcggagacttccgaaagtttccgctagatccgagagtaaggtctcttggttgcgcgtcttcacaaccaagtcatcaacataggcctcaacattgcttcctatctggctacccaaagaaattcgagtagtacgctgaaaagtaggacctgcattctttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttggccttgggaacaacgaccgggttcgccagccactccagatggatgacctcacggatgaatccggcctccagaagtcgcgccacctcctcgcggatgaaggcttgacgttccggggcctgccgccgcactttctgccggaccggccttgcgcccggccgcacggcgagacggtgctcaatcacctccctggggacccctggcatgtctgccggtcttcaggcgaagacgtcggcgtttgcccgcaggaaggagacgagcgcgtcttcctatttgtcgtccagaagaccaccgattcgtgtggtcttggacgagccgtcgcccagggcaacctccttgaccgggacctcgtcgcacgtgaccatccgctgccttggggcggccgggacggaggtgctgagcctctcgtcgccacccgcgggcttggacgccgcggcgaggtggtccgcgcgctgctccatacaagcaagcgcgactttgaggtcgccatggacggtgatggggccaccggggcccggcatcttcatctggagataggcgtagtggaccgccgccatgaacttcaccaacgcgggcctccctaggaccgcgttgtagggtagactgaggtccgccacatcgaagtccacccgctccgtgcggaagttggcggaaccaccgaaggtgaccgggaggtcgatatgacccagcggccaggtgtgccccggcgtcacaccgatgatcggctgggacggccggagcaccatccccggggccttgatggcgtcaaaggctgcgggggaaaggatgttgagggctgcacccccgtctatgaggacacgccccaacttcacattgcaaacggtgggggaaaccaccatcgcgatctgtcctccccgggcaacgcacggcgggtggtcggtctggtcgaaggtgagggcaacctccgaccaccgcgcccgccgcgtcgcctcatgggtaggggccgcggccagaagctctcgcttcatgtccttgaggctccggcgagaagcgtgagcgcacgctcccccatcgacggtggcgacggtggcctcaggctcctggaaccccaggtcatcgtcgccatcgtcgatgtcctcggcggtggccttctgcttggcctcacctcgccggttgccggtgggagccgccggggttttgccctcacagcgctcctgcttcttctcctcctcccacttcctcgtccgctcagccaaacttttgaccgcgcggcagtccgcgaggtcgtggaggaaggtgttgtgcacggtacaccacttgccggtcgggcgctccctgctgggagcgccggcctccttctttttgtcgctcacaggcctcccctttcggggggcccgcgaagcgccctcgacggcgaggacgtgaccctcgtcgtcggaacgggccgaccccttcttcctcttcctgtcccgccgccctgaccgagcggcggacccgggggcggccgaagctgccacaccagaatcggaggagttccaggtccaggcctcctccttttgagccacacggtccgcgagctcaaaaagctgcgcggtggtctggggctccttggaggcgatcttctcgagcatgcggttgcgccgtacgccccccctgaacgcgtagatcaccccgtgtgcggggatgcacggtatggtgttgcggacttgacagaaccgctgaatgtacgagtgaagagactcatcgtcccttcgctgtaccgcatgcaagtccgcttcttcgcctgggcgcggatatatgccctggaagttcatggtgaactgctggcacaaatccttccaagagtggaccgacgcgggtggcaagttcattagccaaccccacgcctgacccttcagggccatggggaagaaattcgccatgaccctgtcgtcacccccggcggcctcgatcccggtcgtgtagatctggagaaactcggcggggttgacgcttccgtcgtatttttcggtgatggtggggccggaaccttggggccaacggacgttccgaaggctcgccacaaaggctcgacagccggcaccgccaaccggggacacggggggccggcccccgtgcccggaccgaagtggcgctccggacgaggaagcgccctccgttgcgtgggcggcgcgcgtcgcgccgccgctcgatatcgaggcgggcatccggccccccacgcacatcttcttgggtcggaggcgttgacgagggaatggcggacgaacggcgggtaacggccgccgctcgccgcgccctccgcctcgacgacatggagccggcggcggcagcgccagaggcctcggtggcggaggaccgcccgccggcgcctaggcgctgctgcgccgccatgaccaagtcggccacgtcatccagccaacgtcgggctggagtctctggatcggggacgacgggcgggtgacgcaggagcgcgcccgcagcctggagcgcgccctggggcgtgccgccatcgccgtagacgaggcggcgacacgccccgtctcgccgtcctcccccgtcgcccgcgggcggtgaagtcgcggttccttcgaacctccccgagcgcctccccccgcccaagatttcagtgagagggggacggtggggtgcgagcccgacggcgcgggttctgctccccgtcgtcaccgctagcgttcggagagaggctgtgcgccactgcccgttcggccattaggctgagcgggagaagcttggtgcacacgaaagaggacgagggcttaaaaagacacgcgcgccccctacctggcgcgccagatg

SEQ ID NO: 94154 - DNA, 700 bp, Oryza sativa
gtccttggcccaatccttaggcttgccacaacatagcattctcctttaccttttacgttgtctttattcttaaaattgatttgaagctttgggtttgacgtcaggtttgactttctgttctggttgtggaatgcgtaagggtttttcttctgtaacaaattagcgctagaccctccctcgttcttttggtcccggttgtcctttcccctggttttctcctcatcacccaaagagccaatgagatcagtaacgctgacctcttgcgtcttgtgttttagagaagtaccaaagtctgcccaagaaggtggcagtttggcaataatgccacccgccccaatcttgtccggcaactcgcagttgttgttctcaagttcctttgccagcatctgaatttcatgagcatgttcctctacagaacggtcatcgcccatgttgtagtcatagaactgctccatgacatacagctccctgtcggcgtggaaaaccccgaacttgtcctcaagagaatcccacatgtccttccctgaaggcatgtgcatatcatcgtccacaatactgtcggggtgcactctgatcaatgctccacggaacaagcaatccgcagcctcgagtttagcctcctcttcagccacaccccccggttcactcggtttgcctcgtaaagcaaagaaacgttgcttcgcggtcaaccacaaaagtg

SEQ ID NO: 94155 - DNA, 572 bp, Oryza sativa
cgcagtgaatttaagccatgatttatgaatgactacttcaaaagaacattgccatggcagcaagttcacatttacaatgttgtgctactgaaaaaccattttcatatattcaactatgattgtatgatgcagtgaaatgaaattcttatgcagtgccattcacgaggtaatgaacaaaccttgctctttgcatccgcagcaaacttatcagctactacaatatcagttggaagcaatagggagactccctttgacttggctttttcaataagcgaggtagccaattcgagcttgtcttcctccacaagagattttccaacagcgtatccctgagccttgtaaaatgtatagatcataccaccacccagtatgaggatgtcaacctttgccaaaagactctcaatcaccccaatctttgttgacaccttggatccaccaacaatggcagcaaatggttttttggggttggcaacagctccaacaagatagtcaagttcctagattggtgaggacagttactacaaaattttaaaaggattacatatttcaaaaaatctcaaggaaaaacagct

SEQ ID NO: 94156 - DNA, 867 bp, Oryza sativa
tttaaaacattttaaaaacaaaatgagggaaatcaaataacatttgagaatggtgagctcattttacctctttttcgctgcccgagtggatcgcaagttgtattgcgtgggttgcgtcccctgagacgcgtcgggaagctgcgacatgtctatctcctcagcgtctggggcgacgtagtcctcatcctcctcctcctcgtcgtcatcgtcgtcgctaggtggagtcggcgccttcccctttcccctcccttgcggaatgcgtgacgacgacgagccaccaacttcttcacgctcttctatcctgatggagtgtcgagcggtacttggacgcacggagtgaggtagtggtggtggtagtctccgcggttggtacacgtcgtccaattcaaccgacttgcaacctaatcttgctgcaagtttccggcacctttgacgaactttctgcagttcaaaaaaaaaagaagtttgttaggcataactcaagtaatgcaaagtgctaaataaattttacctccaaaacattgcggagtgtgttctccgtgtcctcaccacccctcggagcttggagggcatgccccatttcattcacactcctgaggagctctctcgactgaaagcgtgagaagatatatgttagggtctagggtgcaaatggaaataactttgacaaatgcaagaaaacttacgactctgtctctaagtggggcgtgctccatttgatatccaactctagtccggacatcatagggattccgtccctcatcggagtcgcggtcatcctctatgtcggcttccgtccaagtagggcggaggaacagtctatatgtcctatgcagccaacgaagatactctgagaaaagatgattt

SEQ ID NO: 94157 - DNA, 1130 bp, Oryza sativa
ctagggcacgggcgctgcggcgggcgcggctagagaagggagatgacaggtgggtcccacccgtcagcgagagtgcgggcgggcccgcctgtcagcggcgcgcgcgcgcgcgggaaaccgatggtccgcgggagaagagagagagagagggagggaatgggccgagccggcccaagagggaaagggggggggggaaaagaacttcttttaggatttttctttttataaaaccttttcaactttgtttatttcttttcaattattatttgtgctctgaaaattccactaaaatttatttaagcattttaggcttttaggaaatatacaaaaatcctccaagcctcatttgacttttatctttgcacattttaattgttggaggctttcacaataaatttttaattattcttttgcacaattttgaggatgaattttagagtcgatttgggacgcgacaatgaggccgtagctggcgtgaggcataggccaccacataaccttcctgcatgagcacgcaccccaatccttggcgcgaagcgtcacagtacaccatgaagtccttgcgagtatccggcaagattaacactggcgaggaaaccagcttttctttgagagttttgaacgccttctcgcattgcgggctccacacaaatttctcttctttcttcaacaactgtgtcatgggtcgagcgattttggagaagttctcgatgaacctccggtagtatcctgccaaacctaagaaactgcgaatttgagtgactgtcttgggttgcttccaatcggtgacggcggtcactgtttcggggtccacagcaactcctttagcagatatcacgtgccctaagaatttgacttcggacaaccatgtcacgtcctgataaattcatcccgaaattaaaaatcattttctaaaaggaataatagaattaattaaaattcaaaaagaaattggcaaacactaaaatacgtacaagaaaaatccaaatgtggcccggggaatttttgttaaattctccttggtctaaaaggagccctcaaattttagtggaattttcagagcacaaattataattattaagaaataaacaaagttaaaatgggtttataaaaagaaaaatcctaaaaag

SEQ ID NO: 94158 - DNA, 905 bp, Oryza sativa
tgacggccgggccccacttggcagccgcggggcgcgcccgaagtcgtcctcgccggcacggccgacgggggacggcgctcccgcgccccgatggtcaccgccggcgaccaccggcgcggcggatcggcgcccgagagagcggagaggagaggaaagagaaaggggcggtccccggctcacccggggacgacgaggacggcgaaaacgacggccggagcgaaggaaagcggcggcgcggttcgggacggcgaggacgacggtgctccggcggtcggcgggcgaaacggaggagcggacggggtcgacgacgacacggcgaagccgatgggggtgacgccgagatgggaggaagtccggggcgacggcggcggcgaaccggagctcggcggcgacggcggagagagaggacgacggcgcgagcacgaatccgacggaaagagcgagcggcgagcggcggaaacggaggagggaggcacggggagcgattatatagggttgggagggggagaaagcggccgggcgagggggaaacggccgcgaaagatgcggccgccattgatgccggcgaggtttaggggaaagattccgagcgaatccaagggagagagagcgggaaaagtggggggaaatgtcgagggaatcacggggagtaattccccccacttcaatgcgcgcggggacggcgggatgcggcggattcggcggcggcggcggcgctagggcacgggcgggcggcgggagcggcgggaggacagggatgacaggtgggccccacccgtcagcgagggtggcgggcgggcccgcctgtcaacggcgcgcgcgcggggaggaggccgatgggccgcgggggagaggggagagagggagggagctgggccgagccggcccagtaggggaaggggggg

SEQ ID NO: 94159 - DNA, 3647 bp, Oryza sativa
ggagggaagctgggccgagccggcccagtaggggaagggggggaaagaagactttttaggatttttctttttataaaaccattttaactttgtttatttcttaataattattatttgtgctctgaaaattccactaaaatttgagggctccttttagaccaaggagaatttaacaaaaattccccgggccacatttggatttttcttgtacgtattttagtgtttgccaatttcttttcgaattttaattaattctattattccttttagaaaatgatttttaatttcgggatgaatttatcaggacgtgacaaatccaccccccttacaagaatctcgtccccgagattcgaggaggctagcaggaagataggtcggacggtcttctcttcttgtctgacttcttccgtcgcgtcttctataacgaacttgcctagccaaacttctccactctggactgcttggctcgatctcctgttgcggatggaaccttctcttcacctgacttgaaccagggtgcaccttttagctgactcagactaggttgcggtagtttaatgatgcttccgttccagaacttctcatgattcatatcttcggagtcaacctcatacaagttaccacttcatgtcatgcgtcaacactagcttgtcattactaggataccatgtttgtcatcatgagaataccatgcttgtcatttacttctagcttgccaccaactgcctcatattagctttcctggtctccgggtgctaactacttctgctattcgatgcaagggtcaaccactctaactacaagttatgcttcccaagagaaccaatttatcccacttgacatgctttgacgtcttcccgaatgactttgctgccggacttgttattgcctgatcgtgatcctgccagacctgaagcttcgttgctagaggtgattttaatctgacctctgtagactatcttcgaacatatcacttggttcataactgggaatagctcccacgaacaagcagctcggattcactttctttacattccgtttacttcccattattatcttcaggttgtcctcagttagcattcaacgtattcctttacacctttaaccttgatgtgttctttcccattgggtcatctcccaagacatggcatttcctggtaaccggtgcttgcactttttactccgtgtagcatctgatactgagttgaggatttcactccttgccttcatagaaacacttttacctaggtcatcttgcttacttaatgacaaggtgactgttgcggggcaattactatcaggggtcttccttgagcgatgcagagcatgtttctgtttatcaatcacctttcggcctactttttttcatgctggagaacatctttgccaatctcttttatcgatcatctttcggcttatctctaacaggtggtattctttaatgtggattgcggacgcttctggggacgatgaggtccttcggcttgctgcctttcagtgaaaccttgatgtggttcgtcaaaaagctgcactgactaccttcagggaaatacattgcttgctatctgtatctatgccactagggtttaattgccgatggtcatctttagtgcttcctcgagatggggagcatccaaattgttcttctgccatatcacctttgacccttttctgataccagataaacgaattaccaaccatcgactactacgttctcaaatattgatgtctcctgggtcttcttaactgtttgcaggtatatccgaacttattaatgtagagccatggtgggtaccctcatgggtttcatccaacaatccttatcttgatctgtaaaaggcgtatccaaactcctatccccaactactgtctcattggctttttaacccaacacagtttaattggttttcttttccatcaacaggttggttattaactcgaggttagaacatagttcctctgaaatgagaccctaggtctcctttgacagtaaacaattatacacctaatcccatatcagcatcttctgaaagagtcctcatagaacttgtttttattacacatttctcccatattacaagaatacgaggcactgccttaatcaaaaagggaaggtgcttaacatcggtacattgcatcctcaacatgaatcatccataagcatagcaagctcactgtttatagacatgaatatatttatttattacaggattgctgcaaactttcgattacggtgataagtagcgaactgaaaatcacaaacatggctactcattctgattctgaagaggtatagctggcattgttctagtgactgcatcatccttgattggttctgtgatgatgtgataggactgcatattgctatcattcacaggagaagcttccttctgattgctggttgaagcgaataacggtcttctgcttggtatcgccctcctgaggttgattgccctttgctcggcctggagtaggtcggggagagacacaacttcttccatcgacgacaattctttgctgaggctgtcggtgcagagaatggttggtgctgaagatattattgccatgatttattgcagagttaggtggagcaggaggagcattggtgctgtggatgatatcgtcgaggttgctgttggagctgactagctgatgagacaatcgtagggttgttcgttggatttctgcggtcttggtcaacaacacactgagttggcaatccttgggcacatggtttgtaccttcgcacagaaaacatgtgaccttgcgagtgggacactcccctggtgaatggtcttcttcatagtgagtgcagagtgtgagacacatgctagcaacgtgtccagtttctccacaacgggtgcatgcctttgatccgaagaagacacatctgaaactcttagtccaaacaaatgtctctttggttgatcacttgattttcttcgccatcaagcgctaggttatttgattcataacagattatgagcttacggaaatgagaccctaggtctccctaatcaacaacaaaatatacacaactcacagcacttgcaatcttaacatggatccttcataaacttatcaaactccttcataatctcatgtttctctgttattacatgattgacggggaacaactataaaacataagtatttgaacactgatataagagtattatggttgcttctgactagcgctaggcttaacaggtactgcatttgctccagtgaccacttggcgattggcatgtctgcttccttaacaggtactacagttgtaacagacaataactttcttacgctcgggttcttcatcttgtacttgatttcttggctgctgtgctggaacatccaaagatacaatgccgatactggcctctgtcttgtcaactgatggctggggctgaaattgagcattgacaccttgtggtaatgcactcgctggagttggagctgttgcaacgcgggctataagactgcttcgggatgcatggatgacaattcgctgaggagcaagcttctgattgcagggagttgcgtggactgacgtgctggcaactatgtttctcggttttgggcacttgtcggcgaaatggcccattccttgacaattgaagcaacagatatcttcccggactcggcatttt

SEQ ID NO: 94160 - DNA, 1325 bp, Oryza sativa
gcacaaggccttggggtcgcccaagccccgcttggcgaatttccacattcaccgggaggctaaccaaaggatccgctacccgaatccctttccagaaggatcgtcctcgcagcagcaacagcagcagcaacctcgctccgcgccccgacttcatttcgtggtgcgcgtcccgcagccgcagcacaagcagagccagcaagggacccgtgcgccccgtcctcttacgccagccgcgcagtctggtcaaggccgcagggacgttcaaggtccgcagcgtttgtgcttcacctgcttcgagcctgggcactttgcggataaatgcccaaagcagaggcgccagcaaggccaagcgcctccccgctccaacaatggtggtaaggatgtcattcggggtcgtgtgaaccacgtgacggccgaggacgtgctgacaactccagacgtcatcgttggtacgttcctcattcattccatccctgctaccattttgttcgactctggagcttcccactcgtttatatctgtgccattcgtggggagaaatcagttgggggtagaaaggcttaggaaccctctcctcatcaccacccctggaggggttatgacagcaaagtattatagccctgctgttcctatagaaattcagggaattccttttccctcggatctgtgtcacgcccggaatttctatccaaaattccaaacgcttacatgtgtgttaaaccctcgtccaggaatcaaccgaggcacacaatgacaatattgataatagagtacaaataattattaaatattcgcaaaataaaattattacagaggtagatagttcctctcaaacaaaaacaacattctacgcagcggaaaacaaaactaaaacaaactacggaacagcgacggcaactccactccacaggcaacttaaccagaacaagcctattcctccagatcatcaccttcactgaagtactcctcctctgatgaatgaatattgcaagaatgagcatatgacatactcaacaagccacacagcaaatatgcaagtgcacaggatagcaaaggatggcataatatagctcatttgcagaaaacagcatttaacaaatatttaagagagaagtaaaacagttgaataattaatcaatattaaataaacaccatacaacacacccgtgttgcataggcccaaccacatttgatcaaccaaccccagttgaacaaattaaccctccataccaggaattaaccattccaaaccaggaaataaattaattactacattattaccattaatgagaagtgtgagactaatcacgaaaaacattgctcaa

SEQ ID NO: 94161 - DNA, 1334 bp, Oryza sativa
aatgtttcaggacaaatcctctctatcctagcctatcctttgcttggtgtccttggatgaaccggaggaagaattaatcacacacgttcccttggattcgatacccttggaatactccgtagaggaaatgttacatcggtatatccgtgcgcttgcggattctatctgtgatcataagaaatatcaacagggccctgtaccacttggctccactgccgcacgtgtttgttcccatggattttcacaagtgctgccgcaacctcccagagctccatcgagcactcctcccacatgagagggtgtagagagagagagagaggggaagatggaggaaaaaagtgtggtatgggtcccaacgtattttttttgactagaatgcggaatgccatgttagcgaaaaccaccacgatactacgaggggcttgatttacaccgataatgatagttaggggatactctataccgagtgttgcggttgatgggcatgaatgaaactcgaccaatagttgagggatgataagtggactttttttttgcggggaggagcaagagatatattactcaaccaacagatccttactgatatgctgagaaataaagctacaagaatcgcctaaccaaaaacttgagggctggtcagtgcgagctttatgagccaacatatgattaatttggttttgggatctctgtatcttctttataacaatttccctctcaccaagtatcaggcatttgatctccccgaagatatgcaatctttcctttgtcgtatacgcctccgtcaagaacaatatcattagagcaatgtgatgagcacccaacaacgagtaccctaatttatccccctctttcacggtaccaaataaaacagctatcaaattaattcagaaaatatgatgacgatataccaaagcactcagaatctaatccacccgtgctttcacacacgaatagaagaggaggcacacacatgtaccaagcaacaaaaccaggtaagacttcctgatcttgtttcttctccaaccaatcagttatcaggcggcaaaatattcagatagaagctgatgggatcgccaccagctagttcggcagggaccaaaccctaaacatgaactttaggaaaaccaatctgcctcctgttgctaatacctaacatatatgtatacgtgcatgcaagcactagtactggacccaacacaggctcgcaggcccagaccaacaccgactgcaactcaataaacaaattaatatagtgactaaataggcctttacaaaccaggtccaacatatattaaaataatgtggccatgacccctcatgaccttggctaatta

SEQ ID NO: 94162 - DNA, 1355 bp, Oryza sativa
gaatataacgtggtggagaaagctttcgtgtagacaaggataaagcatacaccaagtctaaactgatagcattagtgaaactaccaccatcaattattaatttgcaaaccttctcttgaattttgcactctgactgaaaaatattacagcgctgcccctttgcatcaacattagagccatctcgctgaactgcatatgcaagcatagataaaccattattcttttcagcaccatcatccatagatgaatcatcaatatctcgatagcccgtagtaagagtatgatcaagttgtacaccttctgaattttctaatatactctcagaaacatagccttctttagtcatcaacgccttcttctgattaggacaatctctcatataatgtcctctccctccacaagtataacactgtacacttcgtgatttagaactagatgtagcagtagattcaactttagatttggatttactcaccgaactagcagcaggtttagacccatctctagaaggagtagtcagcttgaaagacatcgacttactagcggcacttccatcaccatctcgctgaaaagaacatgaacggctagtgtggcgacttgttagttgctgctccaccctttgagcaatgtgcaccatattttgtatatcataataatatgatatctcaacacgttctttcacatcatcgttgagaccagtaagaaatctagcgatagtagcttcatcattctctgttacccctgtatggctcattaacaattccatctccttataataagcatccacactaagatcaccttgtttgagttgctgcaagcgtgtatacaaggatctagtataatgttcaggaacaaaacggcgagccataacctctttcatatatatattgccaagtatgtggacgaccaacatgtaccaattgattccaccaagataaagcataaccagtgaattcaatagatgcaagacgtgccttcttatcctctaaatagttgtgactattaaagatctgatcacaacgcatctcccactgcaaataatcctccggatctccagaacataaaaaagcaggcatggaaatttttatcttaccaagcccttcatccaacggaacacgagcagcacgacgattccgattgtcacggtgaatatcatcaacaaccctatccataaaagcaggacctcggcgaggaggatgtcgaggacgacgatgatgatcaccttcatcagaacacaagcctagactctcatcctccgcatcatactcatgatgttcaggtagtggacgtcgaccctgtctagcatgttcctgacgtggcagtggtagacgatcgactaacatagaaatactcct

SEQ ID NO: 94163 - DNA, 1489 bp, Oryza sativa
gtcacgagctatgagctttttggtatatttttgttatagtttttagggttaattggatccatgccactgtaaatgtggcaaattagaaaaataccactactatttgttttattggctaggtgccactacaaatttttaaaattgaaaccatgccactccgtcactatttctgtcgttctctctcacgtcgtcatcctctaatctcacgtaggcacggcgagggcaagaagacgaggcggccgccggcgaggacgtcgcgagcgcggggagcggctgcggccacggccggcgaggatggagacggacgccgagtggttgaacagcagcttgccgacgtcgcggacggcagagccaacaggtcgaggaggcggagtggcggagttgccggccggcgtcatggccgccatgccgccgtgctaaccgtgcagaggctgcatccacgccaccatgccgccatgacacgcaccgcgtgcttgacgcatacgaacatggacctggcattgacagccatgacgcggtcgtactcgtcgatgtcgagcacgccgagcgagtccggagcctgtgctcctatgatccggcgttgctgtagaggacgtcgaggcggccgtggcgcgtaatggcgaggtcaacggtcgcggcaacatccgccttgacagtgacatcgctgtgcgtgtacaacgcgcgtcagcgccgagcttggcagcgacggcacggcgttcgcccgctgctgctctcgctccccatgccatcgccaccgccggagtgccgccgcggggttccgttgctgctgctcctgctcccgctcccggagcgcgccggagtgccgcccgcgacccgccgcgtcgccccgaatcgtcaactgccgcgccgtcgttgggggcgggctgcgccgcggcggccttgtgctgctgctgttgtgtgtaccgtcgctaccgtaagtggtggtcgccgggggagccgaggcggcgagccaccagactagctcgtcggcggggctctccctgaccaagccactatgcacgcagtccatggaggacgagagctgctcgtggaggacatggagatgcacggcgaggatgagctcctcttcctcaacggcgtccgacgagaaaggtggtaatgcatagcggcaaccgcgcgaggaacgaggcccgcagctgcggcaaccggcattgtgaaaatcaacgatgggaacggcgccggaggtgaagaagatgaaggccgatctccccgttccccgtgtctccggctgaggttcttgaggcttcttgaagaggacgtcgaggcgacgacggtggcgccatggcttgctccggcgtgctccggtttgacggcgacaaagacgatgtcccggtgatggcgtctagtcccggcagcccccacggcggcacggaccatagagttaggaaattaacgggggaacgacggaaaaggcgacgggatggcatggattcaatttcccaaaattccagcggcacctagccaatat

SEQ ID NO: 94164 - DNA, 1601 bp, Oryza sativa
gaggctattgagttctgtgtcaattacatgtccgatgctgatcctatcggagttcctgcgtctcgtcacgagggaaggttgtcacgtgttggcacaattggaaggaaaagaatcaggcctgatcaagcatcgtacgcgtaggctcattacgctgtgctccaacatatggcagaagttggcccatactttgaggagcacttagcgaaaatctgagatgagaacttggggcgatctgatgcatggattaacagagaacataattctcggttcaacgaatggttcaagaatcgtgtgataatgtccacagatgtcccaaatgagacagtacagttgttggggatgggaccgtcttggaccgtagacacatggcaaggatacgatataaatggatattttacaccgtcaaacaagatgacaaaagcacagtgcaaaacaacggcgtccgtatagatgcgttccaggatcaagttgggtcaaacacatactacggccgcattgaggagatctgcgagctaaactacgtcaagttcaaggttcgtttgttccgctgccattgggtgaatctaagcactggtgtcaaagccgacaaggaaggtttcactttagtagatctatctaaggtgggatacgtcgatgaaccatttgtacttgcgaaacaggtcgagcagatattctacataaaagacccttcaaacaggaagatgcacatcgtgagggatggaaagcgccgaattgtaggagttgacaacgtcgtcgatgaagaagaatacaaccataatcttcatgtaagacctcacattgaccttgacgatgatccccaagagcctgtggcatatgctcgttcagatcatacggaagtcataaccttgtgacatgcatttgtacttatctattgtaatgaatgaagtattttgttttattacaaatgaccaaaataaaagttgtagatcctgatgagaggatcaactttgtttttgaccatatttcaatttgaaatcatgtagtatttacaaatgctgttaattagatttgttatattgtcaaaatcaatttcaagttgttgggaaaaaaattatatagaaaaatgaccaaaataaaactagtagatcttgaaaggctctacaactttgttgttgaccatatttccatttgaaatcatttactatccaaaaatgtattatgactaataaaatgaattattacacagcagctatatattttgcacccacaacaaataaaagatggaaaatgagtcatcgtgacgggccttagtttatggccgatagagattaatctatctcaatcgggctttatcttagggcctgtcacagatgactcatccgtgacgggcctaaatgtcatctcaatcgggcattattatggagcccgtcaccgatgagtcatgtgtgacgggccctacggcaaagcccgattgagatgactcatcactcttttgtaactagggtttctcaaatcggattgaaaaattttctaagacctgctatagttcccgcctccttagaaccctagcgccgccgccaactcctactttaccgccactgccaccgagaccgtaaccggctggcaccgagcccgccgcc

SEQ ID NO: 94165 - DNA, 7044 bp, Oryza sativa
atttacaaatgctgtttagatttgtcatattgtcaaaatcaatttcaagctgttggaaacaaaggtatatagacaaatgaccaaaataaaagttgtagctcttgataacctctacaattttattgttcaccatatttcgatttgaaatcatttactatccgaaaatgtattatgactaataaaatgaattattacacagcagctatatattttgtactcacaaatgtaaggacttatctggaaaaatagaaaaatagtcattggtgacgggccttagttcaagcccgatagagattaatctatctctatcgggcattatcttagggcccgtcacagatgagtcatccgtgacgggcctaaatgtcatctcaatcgggcattattatggagcccgtcaccgatgagtcatgtgtgacgggccctacggcaaagcccgattgagatgactcatcactcttttgtaactagggtttctcagatcggattgaaaaattttctaagtcctgctatagtttcccgcctccttagaaccctagcgccgccgccaactcctacttcaccgccaccgccaccgagaccgtcaccgccgccaccgagcccgccgccgcctccaccgagcccgtcgcctccaccgaccggcgacgccctccaccgaacctggcgccaccgccaccgagcccgccaccaccgccctcgccaagcctgccgccgtcgccaccgacgctgagcccgcggctgccgccaccgagcctccttggcccttcattcggaccaccgccacctcctcactgacgacccccaccgagcccgcgccgccgccaccgagcctctacaccgactggaccggtgtcggccttcctcgtcgtcgccgcccgcgtcctcaccgacgcacgttgccaaccccccaccgagcccgacgccgcccgcccggcgccgacctacccgaccggcatctccactgaccggcgccgccctccaccgagcccagcgccgacccccaggtgagtcctccattgcgcatgaatgatgaatagatgaatgtggttcgattgatgaatgtgatgaataaatgattagatgaatgtatttgaatagttaaatgtgtatggatatatgaatgtggatgaatagatgattagagatgaatgtggatgaatagatgaatagatgaaatatttaatttatttatatgtgatattcaattcattttacatgtggatgaatagatgattagatgaatgtgtttgaatagatgaatgtttatgcatagatgaatgtggatgaataaatgattatagatgaatgtggatgaatagatgaatagatgaaatgtttaatttatttatatgtgatattcaattcagtttattagatttgtgagatgtgcaatttagtttatttatgtgaataagtgattttagaactttggattctaagccattgaagcactgaattgtgtattttcgttattttgaaaaaaagtagacgatgtctcagcaaggtgaaccaatgtcgacgacaactagtgggtcctcaagggcacgtactcctaggacagggaacaaaatccctaaggaacggttccgcataacagtggtggacgccgtagggttgccgacatctccaaggaaaatattgagccgatttaggtctatctgtggggtcatagggaggcagaaattcagtattctgcaagatgacatcaagctcatgccggccgcagagaaggacattgcttggctaatgttcaaggagagctttgattatcctgtggagcatgaggaccgtctcaggcgggctgctttcaaggttatgggcaatgcttggaagaacttcaagactaagctagtcggcgagttcgtctacaacccggcgaatctagatccaagagagaaatttccttggatcacggaacaggtctgggaggaattacatgcgaagaagtcgacccccgagtccagagctagaagcgaggcatatctcttgctccagaccaggaaccagcatccgcaccggctgggcaccgccggatatgccagtaaggaagaggaatggcaacgtgaggatgaagaagcggaggaatcatgcacaccgctcgtgtttggcgatatcccacaccctcgggctaggaactgggccagggccaggtaccagaagaatgatgatggcacaatcttcatgccaaatgcagaagatcaacgagtgtacgaagctatagtaagtgtctagtcaaactagatgttcgcattgtttcccatcgtgcagtttatttaaccccactaaattgtaatgcagatggagttggttgccgagcaacaagcctcgcaagaggcctgctctcaaagacgtgaggacgacctcctcacgaaagcgttgggcaacaaggaacaccgtggacggacacggggcgttgggtcttctgttccctggaagtatggatttccagactacgcgtggcagtacaagaagcggacttccaacaaggcggagaaagatgcacgccttgaagccaagatctgggcgtcgataagagctgagctgacatctgaattcgatgaaaagctcgagtcgatgagggccaagattaggcaagagatccgagaagagcaatagaacccccaggccgccgttgcttctgcgcacgaagagttaggaagtcccacccaaaaacgcagcagttgcgcatcaactgagttggcggaaaatccaacatcggtcgacagcgccgctgaccatataacggtaaccatgaacttactcaatacatgaaagacttaccgaatccatatgatatataatattctaaaaaaattgattaatctatcgcaggaaccaacgagctgcaccctcatagttagggtgatgccgaccttcacggttccagcagccgagggacttgcgtacaagccgaccccatagacaaaagtgcatggagcgcaactcagggccgactgtgcaaaagttcaagtcgactcggtgaagcccgaatacgagctgttccctctgaagtatctaccaaacgacgaggtcctctcactaggaaatgctcgtggtaccttcatccaatggcccaaggacctcattgagatcagggttacagtgaggctaaccacttgcaccaggctgtcgttcagcaaagagacccgcctctgctccttcagcccctcctgctcaagattgtcatgcacaatcttacgatgtgcagttgcagtacgacacggattttggggaggaccgaacggaggccgacagcaaggcgattcatgaacccccactgatgaagaagagcaggaaggcacactcttccccttagagaattactctcaataaacccgaagcaaaggggagaggaaggggaggaaaggtgcaggcctcgcttctagctccaaggaagctagatctgggcaagggccaggaagagactaagggcaaagaggtcaagaagaaatacgttgctccacaggagttcaaactaggcatgccattggttggagatgacgtgcttgccacaatgggcaccgcttggaaggaccttcacttatactacatggagaaatctaacgccaggaagccgagtaaagctaccgatatccttggagagcacgatggaaagccattccttggtccaacaaattatgtcgtggtcgacttcaaggatcttttcgacctctacaggctccgaacggtggacacaagcctccttaagtgctactccttgtaagtattgtcgcccaactcattctggtaataacaatcggtttaacttgcttacaagatcgtttatcctgtgtgtaggttaagttggcaatggtgtcagaagcatgcaccggaagttgccttccttgatccacaagtggtcactgtcacaaatctccagaatgaccgtcaaggaatggtcaactacatctacgacaccttgtggtcctgccgagacaaggagtacattatgtgcgcctataatcaatagtaagtgtgttaactaaatatacacaacaaaatgacacacattccttgagtacttaattaactttcactatattaatgccgcagtgcccattggatccttctggtcataacacctaagtggagtacatgtcactacctgaactccagaattgataagaacgcatataattggaccccaattcaactagcaatagatgaagcgtgggcccaatatgtgcaaagaggagacctcaggaagacaggacatgacaccctcatccacaaaaaagacttcccggtgaagcaacaaataggtgaccagtgcagattccatgtgtgccacaacatgcgccttctgtatagagaaaaggtgaagactttggctgagtttgaggtcggtggtctcaattgtgatagactaaatatattttagtacttatatatgatcgatcaattaatctggaattatgacaatgtagggcataataaccaagtctgcctaccagctttgaggaggttcgcgaggagatagccagcttcatcctgtgcgaaataattaaccccaaaggaatgtttaggcttaaactaaaatgatgaacaatgttgaacttttatgtttaggcaatgatgaacacttattatgcaattgtgatgatgtaactctgatgtttatatttatgtatatatttcatatgtttatgttaaaacttgctaaataaatatttgatccaattaactcggttttgcaggtgaaatatgataaatatttgaatggatgtgaaatatgtgaatggatgtgaaatatgagatggctgtgaatgtgtggttgtgtgaaatatgttgatgtgtgtgtatgtgaatgcatatatatatgaatgggtgatgctggggagctggggatattggatatctgtgtttgtttctgttatttttgcagcgggcatggctagcaaaggcctgaggctagccaaaaaacaaatttttttgtgaattatagccatctgtgacgggccataactaaatgcccgattgagatgaggtgtcacgcccagaaattcccgaatagaattccaagcagaatgtgcattaaaacccccgtccaggaccggtcggggtacacaaacgacaaatttgacatacagatccacgtcttacaaacattataaaagtattacataaatgcagcggaaaataaaaagataactggagctaagccttgacttgcaccgcagcgggaacaccactccacaagtatcctcgacggcacggacgaagcctactcctcggagaagccaccatctgacgcatactcaaactctggggtttggggaaaatatagcaagactgagtactacccactgtactcagcaagtcataccggaataggggtatgatgcagggaattatcaagggatagctataatggttcctttgcataaagcgagcatttataaatagtagttgaaagtagtaaaaccgttgtaataattaatcaatattaatcatccactgtccaatgctataccacgttgcaacaggcccaaccatccacctatactattcaattccattagactagtctagggtgaatctaatcacggtgaatctggttgaccgcccataaccgcgggcacggctattcgaatagttttactctaatcaaaggtgtacaactgtacccacaagacacagccccacgacatgtttccatgtgccgacatgccaccacgacataccggaaagaggccgtgacaggacccttcgcataaccccctctagccaagcacaccacacctcaagtttcacccccgtccccagcgggcaacgggcagtcccctctcgtgcctaggtgaatccaaaagcgacagaggccgtcgcagggcccgccccgctccatcacgcccacccttgcctggatgtgtcagctagaggaaagctacactacaagcctagccattgcccacgctggcttgtggtaagtacgaggaattcttccagggtttcccacgaaccagtccttaagtgccatgggcgcgactagcaaaaccatgcacccacagcccaccataggattcattttaattagcaacaccaggacggtggtactaatccaacatcaacactagaacctgaagtctatatattatatgatttcccccattgtgtgctagttgaactaagcatggctaagcaatccctagtccaatatctagtcatgtcatatcccaagctaacaaaggagcatggtacaaaaatagcatggctataacagtaggtaaacatcccatagtattattgtaaaacaatgcaatatttgaacaaaaacagtaaaacatttgcaatataggatcaacatgttcaagtgacaagcatgacttgccttgctctgctgctggaggaacctcggcgactatttcaaagtacaccggagcgttgggagagccggaatctaagcgacatacaaagcaaacaatacaaacaggctataagactactgaaacagagaacaaaaccatttttaatggaatctatgcatttttattgatttactgagacttgaatgggcttaaacggagctcggatgaattagatatgaattttggaatattcactgtgtttttactataaacagaaaaatccttaattgatttattgcgcaataattaaaatcctggggagagagagagcggcgccaacatgcgggccccacaagagagagagtggtgcacacgtggcgccgacgcggcgcacacgcggcggccacgcggcagccatgcggcagccgaaccgacggcctcgatctactgcccggtagatcggacggcggatgcggctcgcggccggcgcgcgcgggcacggctcaagccggcccggcggccatggcgcgcggcagcgcggcgcgcacgcagcggcgacgcgaggtggcgaccggcggcgatagcggcggctaagcagctaggcggcggcgcggtggctaagcggcgcgggagagagggagaaaggggaggagaggcctcaccgacgacgatcgacgacggcgagcgacggagggcgatggcgacggtgagacgagcttcggaacctcctaacgaacaaaag

SEQ ID NO: 94166 - DNA, 9975 bp, Oryza sativa
tgagagaagatacatggttttttaaagtcactggtggcaccgagtcctctcccctcccccatccgtatcctcttctccatctccccatctcctctcctctccaagtcgcctctcctctcctctgctcccgtccttggatacctctccagtgcgggtggcagatgccactccctccaccgttgagcctcctcctctcctctaccacagccgcaatcggttctattggcccacgacgcctcctcctctccactaatgcagctgcagtcgccgacggtcccctttgcccatgacagctcttcctctcgctgctgcagccaccgacagccctcctcacccgcatcgtctccaccactctcgagggtggccggatctaccaccatgagcacggggacgggtggatccggcaacgcgaccacaggatggcctgttcaacaatggtagcagcggtgacagtggtattctctgtgtgttcttcttagttgattttgattctctctctatttactttggggatggtgtcatatgttgattttgtttttgaatgtcgattctgtggttgtgttcttgggtgatgggagtgatgatgatctcagtggtgatggggagctattcaatgcatcagcttgattcgtggcgatgcattgagctggcatttttttttcattcctgaaacctcaaaggtaccgctgcagggtaccggtcaaaaaatccaacacctatgtccgattcctaacaagtataatcatccttttttatagtgttaggactttgtgtaataaaatgtatttctttattgttattgagaaagtaaaatactttatagcaaaacttacaatatctttgggctttggctaagtgcgatgattagttttgtgttctcttttaattttgcaaacttcggtatggtgtactctcttcgtcccaaaaaaaactcaacctaggagaagatgtgacccctcttaggataatggatctggacagaccctctatccagattcattattttaggagaggtcaaatctcctcctaattaagtttctttgggacggagagagtaacagttttggtttttgctgaccagaaatattcatgcccaagctggcaaggcccatccatcgcttgccagtttcccacagccaattaagagcaagtttaatagtatagctaactactagctccaaatcatttatagccaatgtaatagccaattcatactatagttgtttactacactattaatatctggtcccacctgtcatatacacattacgtcttgaagtccgtgctgtagctggctacagatcagtaacaccactgctcttctctcttattttattctttaaaatatatttatagattatagtctgtattccagctctaattaatgctaaaagtttagtagtggcttctatggtctcgtgccctttgacctcgatggtttcgatcgtctcgttccctttgaccttagattgcctcgccgccagtcatcggcctcccctccttcgttctctgacaaaatttgccaaatgacaaaagtttatgcaatttactgactggtatcataaaagcatgtcatgaataattacggaacatattctgcccaattgaatagagaaattataaaaaacaaaaaacaaaaatacccataaagccacaagcctggctacatgactagttttcctgtcatggcccatccaaaagttatagtgtcttcttgctgaaacgtagagacttgctcccttctttccaaaataaatgaactcctaaaatttaactttgtcacaaatctaatcaatttatacttttttacctatattctaatccatagttcaattgataagttttatccctacagtactcttcacttatcaatatatctattctattatatactaaaagtccattaaatttcctacaaacgtttctaagccaccaagtgacgctcctaaaaacactcctagattgccacgtggcagtttataatctcaccatcaattttcatttaaattagtgggcccattattttaggccattagattagatctattgcttactcttaatattctgtagatatgggtgaaaccgtttacaccagaaaaacatacgtacgtactatggaaagaaacgatcaaacgattaacgaacccttcagcatacatacgcacgtacgataaatagctatattaaaaaaagataaaagaaagatactgttcacttgaaaaaaaaattacttatataagcacgagtaaaaataataaaagctataagacctaaaatatatataagacataaaaaatatatttacatcggtataagaaaatagacgttttttaaaataagattttctatactataaaaacaaaatttattactctacaaataagatgatttagcgtttctacaattactcttaaatcgccacatgcatggctctctaacattttgctatcaattttcatttaaaatgacggaccattattttagatcattagattagcccatttcctcttaatttcctgggtatacaaccgaatgctctattgaaaaaatacaaagacatatacatttatatgataataaagcccaaaaaaactagaaaataaaataaacctttacatattgttccctagaaaaagtacgtacggatacacgagtaaaaataaaagccataagaccctaaaaatatatatacgtcggtaggaaaaaatagacggtcttttaaaaatacgattttctatactataaaaataaaattcattactccacaaatatgatcatgtagcgtttctgcaagcactcttagaatgctacgtggcactctataatttcgttgtcaattttcattcaaaatgatggatccattattttagataattaaattagcccgcttactattaatctcctatgtatacgagaaaccatttactggatgtttgattgaaaaacaaatacaaagaaccatacgtacatacgataataaagttataaagcctaaaaaatatttatcagagtacgtactacgattaaaaaagctataaaacaaaataaacaattagatatactgttcccttaaaaaaagtaagtaatagatggtctttttaaaataggatttgccatactataaaaatataatttatcactccacaaatatggccatgtggcatttcagcaagcactcttagaatgctacgtggtactctataattttgttgtcaattttcattcaaaatgatggatatattatttttggattatttgattagcccgcttccttttaatctcatgcatacgagagaaaccatttagcgatgttcgattgaagcaagttaaactagataaatataaaaaacaaattaaatgtgtttacacgcaaagttttttagattatttttaaattttatagtcaacttataatcaggtgtattcaaatgttgataacatatcatagttatattataactaaatacattatagcacctggagctgacatataataagtaatgtcatgataatcttcaaaataatttcacatcataatttatggtcaaatatcacttaacaattatataacactaactgaaatatacatgcatgaaaaatgaaacaacattatattttttaattatatctgatttaattttagtttgtgtgagattgagattctcaaagtttttttttaatttttcataactattggattggtatgctcaggcaatgatcttgctataatacgaccccttaatccatcacaagaactatggtcatatacattttttctttgccaaataggtttgataacaaatgaacaatcctataacatgagcatgaaactattcatgatatattctcttatagtagaggaattataatataatggtcataagtgataattgatgaatgtaatgacataaaccatagtggcataactacaagtgcacctcaacaaattagttattataaataattttgggaaataaatacaattttagaattagtaaaggtgtctcatgcaattatggacaataggtgatgaaaacaaacaagatgctaaaatatagatctttgtcaaaatataaaaaatgatataatactctgaacattgtcacggtcacgtgtttgtttagctatatatatttttagtgatcaacttcactcatttctaaagatgacattgtatttgtaccataaaaattaagtagttttgattaacaccataaacaaaattgtgtctaaacaaaacataaagaaactatattttatgggaagaaccgaataactatttgcatcatatccatcttctctttgtttccctagagggcaacgagcatagataccacaactatagcatggggcacacatatggttgacttgatgcaggctcaatggaggccacattgataatagtgctcaacttcctacttactggtgcaatcgtctttaagggtgtcgacagtgaactaggattaattaaaattgtgctccacaatggtcatgagactgtgagaggcacgactatatcgacctatgcttgaaggaatcttgatggttcccccattagaggggcatgtctattttttaacggtgctatcctaataactaataaccaatagaagcgttagttttagaatacttatccgtagatttagaaataagtgttcgcataaacatttaggtacatagttgaaataaagttttatgtattaatgatgtattagacttattttggtggtttagatggagttccatttattaaaatcatatctatcttttaagaacaatgataataagtaatggtgataataggagagtttacacttacctggacaaaagtgaattttgattaaatctaagagacattcttatcatttatattaaagtctacggtctatttcacaacataattttttattactacgaggcaaaatctataatttgttatatgtatatggtgagatataacttaattctcttagcattatttatataaacaataaataaaatgcccgtgcatctgcgcgggcttcttttcttgttatttataaattgtggatatttttccttacaatctaaactctctcgagttgatttatttcgagacggagggacttaagcagtattggcttaaatagatgtgatgaagatcttggtaggttcaaatgtactttgtacatgggtagggctgtcaaaaagctcaaggttcacaagcagctcgagttcggctcgttataagttcgattcaagctcggctcgtctgataatcaaatcgagctcgagcttacctttgaactcgcgagcctactcagccgagctcgaatagctcgacgagctccaccttctctttgtttctctcctttatccatcccctctatctccctcctcattgaattcttccatcaacaaaacaatacggtactgtcaaatccatcagagagtatagcatttgtttgacttcttatcttactttccaaagtagtactagtagtactacttttctccatcaaatcatcacagttctacttttctcttgaatggagcaagctcgtggctgagtttccaatagcaagctcgagaaaaggctcgaggctcgaacgaaccgagcccaagcttaattccaagctcgatgtcaaattaggctcgagtctgttccgagctcaagcctacatagggaagttcgctcaagcttggctcgttgacagccctatacatgcggactgaacacccaatttagttacttcaattaggttatttgatatttcctttgaaaaccaccatcttacagcattctacttgcaagctacttgcacatatactaattaggtgagattgagaagataagtatatctcagctttgctgccaataaatatcgtcggctgcatgccccattacactggacaccactccggctagtcaattaaccatcctgcagctgcaggcacaccaaacacacgcatgcacaataatccacacaagatggccaccggcgtagcctcgatctcctacggctgccgtcgccgtcgccgccatggcctgcgtcgtgctggttgtcctctcctcctccgccgtcgcgccggcggcggcgaagatgttctgctggcagctgcgacgagacatgcgcccattcgtgcgagtacaccgacaccgtcgccacggcgtgcgccccgcagtgcgacggcggctgctcgcctgaggcttgccagaactgcgtgctggcgatgagccaaggatgcttgatcatctgcggcgacgactgccgcacacactgcacttaattaattagcgtacgtaaagatcgagtaaaccatgattgtctccggtttccattatttttaacgttgtctagatcagcgcgtactacgtgtgcatgtaagtcaaattttatcaagtatcgttcaggacttgctgtaataaatgggtgtattttcattgttattgagaaaatgcaataggaggtagcacaacttgcaatgtctttggacttggaagacactattgctacctgttggaaatttggtcataattcaatatattttaatccaaaatattaagacaataaacataacatttgcaatttgaatagatctagtgatagtgctagatatgtacaacattagcatgtttaatataaaataagcatcagaatagataaggcaacgtaacaacattgcgactgatagtagtaggaaatgaagaacgaatggtaatagtaaatcgttatatccccgagaacggtcctccgttggagtttgaagcagtattgcctccgttggtgttgacgggagcctccttctccttgtctccaatgttactgttgtcgccggtgttcgacatgttggcgcagacgatgcagaggaagacgaacaaaagcagtcgcgtgtagcgctccccaaaaacttcgcctgtctacccatgcaggttctcaagcggacggagtttcggaggcacctactcgttccgatcacccgtgtgcgcgggatgaacagaaccggggaaacagagagatagcgcaggaactgaaggagagtatcacgtaggaacagcagcaggaggaagattcgatctttgagagcctctgccttgcgttatatatagagagatctccattaccacacaaataaatctctcatttgttgtgaaggttaccacacattgaatctattatttgttgtggagattacaacaaataaatctctcatttgttgtggatgttacaacacaatgaatgtctcattcgttgtggaggttacaacacaatgaatttcatttgttaatggtgactttattctcgtctattacaaaacggaagagcagcaggcaggctcggctcagtcggccgccccgcctcgccacgcccattgccgaggccaactcggcgcacgcgcgcgtgtgtagcagtccaaccatcacctcaaccggtcaatagggaatctccaatatcaccctatttaagttgaggttcttctacctaaattttcaaggcagtattattgtctctaacattacttgtgggctcttgagattttagttgaattaaattgggcctagcctatttattccaacaatccccaccaaatttcatggctcacaacaaatgttctcaaaactgaacctgttagttataccagtgttttgatggagactgttaagttgaacttccacctaggaaaagagctacaccatatcacaactgaacaatggactatgcattgaattgtcagtcttgtgcgattcaggtttcactcaaacccttaactggtactgggctgccgtttgcatcccctctgtttggatcatataagtcatactcctggacttttcatgagtatctagagattacccagatctcatagactataactagcaattggactcatataggtgtgttccttctaagatattctgtaggatgacatctctgctttatgaaaagccactcggatcacattaaggtgtataccatcgtaccatacagaatagaagagaagtacatcatgaagataaactcattttgagggtctcttctctcagttacccaatagtttgttttgccatccaaattcacgggatctccgatcataatggacaggttaccaccattgtgcatctctaagtgggtctcaagcctatctccctcgatgcacagtctatcacattatgtggtagccccttgataaactgatctgccagatttttagccgtcagggtatagtcaaatgctatcactccggagtttttcctctttctaacatacttcagtcttcttttaacatgcctggatgacttcatattgtccttcgaactgttcactttaataatcactgtttaattatcacagttcatcaggattactggtactgaaatttttaaccaccggcaagtccatcaggagctcacgaagccattcggcctcaactgtggcaatatctaaagttgtgagttctgattccattgtctcattaagatggtctgcttgcaagtcttccaggaaacagcgccccctccaagtgtgaacacatacccacttgtggcctttatctcatcagcatcagatatccagtttgaatcactatagccctccagtacttttgggtacccagcgtagtgaattccatagctcattgtcctttttagatagcgcattactctttcaagagcatgccaatgatcatctcccggatttaaaacaaaccggctcaacttgctcacagcaaatgagatgtcaggcctcgttgcactagctaagtacatcaatgaaccaatgatctgggagtatctcaattgataccttgctattcttcaattttttcttaatagcacactagaattatgaggagtaagagctaccttgcagtcactataaccaaagcgactcaggaccttgtccacataatgagattgcacaagtgtaatcccaccctcatctcctctcagtagtttaatgttaagaataacatcagtcactcccaaatccttcatttcaaagcttttggacagaaagtccttgacctcctcaatcacaatgaggctggtcccaaagatcaatatgacatcgacatataaacacaagatcactccctctcccccaccatagcgatagtacacacatttgccaacttcattcacaccaaagccaagcggatataagtgtatcgtcaaacttctcatgccattgattaggcgcttgtttgagactatacaatgacttcaacagcttgcacaccattccctcttgaccttctagtacatacccatctggttgatccatatagatctcctcctccaactctccattgaggaaagttgtcttaacatccatctgatggatgactagaccatgagaggctgccagagtgagtagtactcgaatcatagtcaagcgagcaaccgatgaataagtgtcgaaaaagtcctcgccttctttttgggtataacccttggccacaagtcttgcgttgtactttttaattgtaccatcaggcctaagttttttcttgaaaacccatttgcatcctacatgcttgcacccatatggacgctcgatgactacccaagtaccataagacataattgagtccatctccctgcgtaccacttccttccaattgtcacttaatcatcgtctacataagaatatgcctcttcaatggtacttggagtatcatccacaagatatgcaatgtagtcatctccaaaagactatgcagtcctttctctcttattctttccagtggctacaatgatatcctactcacgattatcctcaagcgtttgatcaatgtgttctatcggcacaaagtgttcaggggataaaatatgttcttggctagaagtgctaggtgcatttttcataggaaattcattctcaaaaaatgtggcatctatggactcagtaattgtaccaacacgcatgtcgggtactccagaattttctattaagaacctatatcacacactgtggatagcataaccaaggaaca

SEQ ID NO: 94167 - DNA, 5272 bp, Oryza sativa
aatgactggtggggtccattggttaatagagagtataatgcggagagtctgttggaatagaatgcaaatttgactctctaaacttttgttaggttggccaaataggtatttggagagctaaaaatgaccactctattaaagatgctcttcgatttgaacttctttcatgggggatacataccgtcttatagcagcttaatttagaacacgatggcgaagaggacactccattagagtagcaaaagagtgcatggttgaattcaagcatgaggcaagcaataagaatcaaataataaaaaaagccagatttggtggagaaacgtcccccaaacatttttttcaaaattttttgctataagatattatgacttcatggacactctgtaaacgtcagagccgtcctaacaattttggggccagtgaaaaatataaatgagaccttattttctaaaaagtaattgattaatacataagggttatatatttggaacggatattcacagccactgtttttttaccactgtttgttctttgatatgcactgtctgacaagcacgtcaggaaaggtagcatcgacctaatactcttttttaagactgtttttagatcgaggggcaaaaaaaatttttaaggtgtcacattgaatatacggatatacatttgaactattaaacatagtctaataacaaaacaaattatagatttcgcatgtaaactgcgagacgaatttattaagcctaattaatttatcattagtaaatgtttactgtagcaccacattatcaaattatggagcaactaggcttaaaagattcgtctcgcaatttacacgtaatctgtataattagtttttttttctatatttaataccttatacatgtgtccaaatatttagtatgatagggtgaaaaaacttgctaggggatctaaataagcccttagatatattctgctattaaacaagtaggaattgtttgcaatcaatgacaactaatggtatatcaaataagctcattcacctgtatattataatggcgatctggttaagtaaaatatcgttgcaataattcattttttcttactaaatagaaaaatataatctaagaacgcatgttcacatccccgtcatgaaactttacgattaccatcgaacacttgtcggaattgagaaaaaaaaacagcttgttctagtggtggagcaggaagagtgaaattcaaaaagcataatctaaagatcataaacatgtcagaacatcaatttcaattgaaacatatggttattaagcctctgcaggcccggtaaatgtaaaaattagcttatgaacacgtcattattataatattcatttctagttgaataaaagaaaaaaaacacataaaaaattttgaaatacatctggatccacatgtaaggtatctatctcaacctctatctccaattgcccttcatcctcagcctaaggccggcgatcacctcgtgatgtggttgttcaacgcattcgaaaggtccaacgttctacagtaaccaaacagaaacatcgaatttagataatcttggactaacctagccatcagaatgtaaagtaatagtggcatatatcctatccatatgagagtaaagttaccctgtttctcaaaaaaaaaaaaaaaaagaaagagcaaagtaccctttaaagtacggataatttttcggacgtcggatggagatccatcgtctcacagccctccccttcctctctaccctctaccgagtcgagcgtcgcgtccgccgccgccggcgccgccgccccccgcctcttctcccacccgcgcgccaccgctctccgccggcgagccgtaacactaacccgctcctccccccgcccacaccactccattttcttcctcatctccggtctgcaaaacggtagttaaacaacggggatatgttcgccgcgaaatcaaaccggggaagaatgtacatggcgacgaggagcgccgccgccaggctgctctcctcctcctccgccgccgccgccgcctctcccctttggtccagacgccggcgccgccatccattcctccatccgccctcccgctccaagaccacctcctcctcctccagcagcagcaagcctcctcgccgcccaccgcctcgcaaggacggcggcgggccgcgcccgtgcctcttccaagaactctccggtctcgtcgccccatccgccagcgatgaccccgcgtttcagcctcggcgagatgggcaggagcggtgtggcctcctcggccatgacactgcgcagtgcgcggaaggtgctcgacgaattacccctgagggagcggctgcggcttctggttctttcaccggtagcgttccgaacaatgacgctcttgggttccttcctgatggtgggattgggcctcgtagcactgcaacaggcggtgctccggacagtgagcaatctatccaggaggtgggcgatggaaatgctggagatgttgagaatatcagtgaggttgtgcatagggtaacagaagttttgcgggcagaggtgcctggattgtctgtggaacagaggctggagaacctgggagttacatatacaccgaggcttgtgagcttggtgctcaacaggtgcttcaagaagaggcatttggggttcaaattctttgactgggttaggcaagttcctggattccagcacaccacggagacgtacaacgcaatgctgtacattgcgggtgaggagaggaactttggggccatggagaagttgatggatgagatggataaggagatgtgtttgaaggacatcaagacatggacaatcgtcatatccagttatgggaaggcaaggcagattggcaagatgctatctacctttcaggctatggggaaatcgagacatgtggcagcagatagtaaagtttataggacgatacttcatgctttatgcaattctgcaaagtccgagcttgctcttgagttctacaaagatatggcaaggaacacggaggttggatctgacatttttcgacttctattgtgttgtctcgcaggatcagataatgctgaaggtgttttttatgtcagagatgatatgattaagagcatgaagtatccagaggagtattgttatctggaagctctacggagcttctgtgtttcaggaaaaatagaagaggctcagaaaatcttccagcagatgatgaacaagtccattgctagctcatctgcatttgaaatcctattgaggggcctttgcaaagatggaaggatggataaagctcttcaagttatggagtacatgaaaagcaactcatctgcgagcagtgccacctttggttctctcattgatggctacctgaggaaaggagagcgtatgaaggcacttgaggtgcttcaggaaatgagggaatatggatgtgttccattggcatcatcttatactcagctcatgcaacacctctttgcatttgatcaacatgaagcagcatgtagattgtatgaggaaatgcaggaaaatggtattgaaccagatgttgtggcaatcacagcactgataggtgggcatgttcgtaatggacatatatctgaagcatgggatgcatttaggaatatcaatgagaatggtcagaaacccacattgaaagcttatacagtgttcatccaagagctctgtaaggcctccaggccccttgaagcactaaaacttctgaaggaaatgctggaatcagatttcaggccttccgagcaaactttcagcaggattatttccactctgtatgacaatcactatttggaagaagctagcaatattgagaggatgcgagcatcttttaattgttgtagccctatagaagagctgcaacgcagaacattggatcaagttgactacactgataaatttgaaaaatcatctggatctggtccggaagagaaggaaaggacagtggagtttgttggtcatccttcgtataaagactgtgaggtctcagggagctttccttgtgatgacacacaggatttagaacaagcaaaggattacaacaatgaagacgttgaacaaatatgtcggattctgtcatcttctgattgctggagctcaatagaacaggctttagagatgacatcaatatcttttactccagatcttgttgatgccattatgaagcgttgtaaggcaaacagtcgtgctgctttacaatttttttcttgggtaggcaaacgatcttactacatgcagacaacaaagacatataacacagccataaaactcgctggctctgcaaaagattttaagcacatgaggcatctttacagagagatgatatgggcagagtgttgcccaacagtggatacatggaatgtcatgatttgtcagtatggaaatgctggtctaactgaaatggcccttgaaacattctaccagatgaagcagggtggctttcagcctgacaaaactacttacagtcacctaataatgtacctcagccgcagaaaagggaggaaagtagatgctgcagtcaagattttccatgaaatgtgtcgtgcaggctatatacctgacaatggaatggtttgcacatatctttctgtgttatgtgagtgtgggatgatagatcgtgctgaaagctcagtagtactattatgtaaacatggattttctattcaggctggctactccatactcattagatcattgtgcaggtctgatagaatggccgaagctctcagtttgttcgataatattaagaattatggatgttcaagaagtgcatacatgtatgggagtctcattcacgcgttgttgaggagggatcgctttgaagatgcttcagctaagcttgcagaaatgaagaatttaggtatagctcaaagcacacatatgtatacctcattcatgatctattacttggggaaaagggatgtttccaaagcgatggatgtacttaaggagatgacagaaaatggatgtgagcctactgttgtcacttactctgcattgatccgtggtcacatggcaatgggtatggtttcagaggcttgggatgtcttccaacgcatgaaactgaagggacctgtgccagactttgagacctactcaatgttcatgtcatgcctttgtaaggcaggtagatcagaggatgggttgcagcttattcatgacatgctgaatagtggtatcatccccagtgcagtgaacttcagaactgttgtccatggtctgaatatggagggcaagtacaagctagctgattctgttctccagtcaaaatggcaattgcggaatcg

SEQ ID NO: 94168 - DNA, 1689 bp, Oryza sativa
ctactataggcgaattcgagctcggtacccacattatatgagagattgtcctaatcagaagaaggtgttgatgactaaagaaggctttgtttctgaaaatatattaaaaaattcaaaagggggtccacttggtcatactcttactacgggctatcgagatattgatgattcatctatggatgatggtgctgaaaagaataatggtttatctatgcttgcatatgcagttcagcgagatggctctaatgttgatgcaaaggggcagcgctgtaatatttttcagtcagagtgcaaaattcaagagaaggtttgcaaattaataattgatggtggtagtttcactaatgctatcagtttagacttggtgtatgctttatccttgtctacacgaaggctttctccaccacgttatattcaatggatgaatcaagcgggcacacagaaaattactcataaagtgatagctatcttgataaagtggattgtgatgtggtgccaatgaatgcttgtcagttgttgttggggaggccatggcagtttgatcgtaatgctacccatgagggcagatccaactgttattcttgggtaaattggaaccatgccattataatttgcaaagtttaagatatgccattggtatctcaatgacatgtagaacccatatgagtcaatgacatgtgggtcaggatggcatatctcaaattttgcaaaattacaatggcatggttccaattttccgtattcttttatgcatcgtggtgttaatgaagtgttgaatccggaaccatgccattttaattttgcaaagtttaagatatgccatcggtatctcaatgacatgtagaacccacatgagtcaatgacatgtgggtcaggatggcgtaaaattataatgccatggttccaattttccgtattcttttatgcatcatggtgttaatctagtgttgaatcctatgcttgatattgacatcaaagcagagatatttcccaccgtcaagaagaagaaagaagtggctgaaattaatattaagccgaggatggctttgttacaagaggggaaggataatatgttctagactactcaagtaatatcagtcggtgatttgcatatttttataaagtctggagaaggccaaacaatatttcaagatccatgcagtgtaccagtgccaacagatggaattaaaatcgatgatatcaatcatcatggtgagggttaattagacctagataattagccaaggtcattaggcatcatggccacattattttaatatatgttggacctggtttgtaaaggcctatttagtcactatattaatttgtttattgagttgcagtcggtgttggtctgggcctgcgagcctgtgttgggtccagtactagtgcttgcatgcacgtatacatatatgttaggtattagcaacaggaggcagattggttttcctaaagttcatgtttagggtttggtccctgccgaactagctggtggcgatcccatcagcttctatctgaatattttgccgcctgataactgattggttggagaagaaacaagatcaggaagtcttacctggttttgttgcttggtacatgtgtgtgcctcctcttctattcgtgtgtgaaagcacgggtggattagattctgagtgctttggtatatcgtcatcatattttctgaattaa

SEQ ID NO: 94169 - DNA, 1518 bp, Oryza sativa
gcacttgtgaaaatccatgggaacaaacacgtgcggcagtggagccaagtggtacagggccctgttgatatttcttatgatcacagatagaatccgcaagcgcacggatataccgatgtaacatttcctctacggagtattccaagggtatcgaatccaagggaacgtgtgtgattaattcttcctccggttcatccaaggacaccaagcaaaggataggctaggatagagaggatttgtcctgaaacattgactacggatgaaggagcttcttttatgcctaaggaagtgaagacttttgctgaatcttatggtattaagttattgagttcttctccttactacgctcaggctaatggacaagccgagtctagtaataagacattgttaaagttagtcaaaaagaagattgaggaagacccaaataagtggcatgaagtgctttctgaagcattgtgggcacataggatatctaaacatggtaccactaaagtcactccttctgagctagtgtatggtcaagaagccgttttaccggttgaggtaaatcttggctctcttcgggatatcaagcaagatgatttgtcaagtgaagattagaagacattgacgggataaaatcttgatgaagtcatcgacaagcgtttgaaggctttggaagagatagagaaagagaagaagagggtggccaaagcatacaacaaaagagtgaaagcaaagttgtttcaagtgggagacttggttcggaagacaattttgcctttgggtactcgatccagggagttcggtaagtggtctcctagttgggagggtctttatcgagtatgcggaattgttcgagggaacgcgtattttttggaaacacattttggaaccatggttttgtgatatagtatgagatataggcgaacctttggtttctatcccgagatggacgtggaagagagcttgtagagggcaagaccaacccctatataagggacaaggtcggttcattgtgaaaagacaatcaataatcaatcaatcgaatcgtttttcatattgcttttattttttgcttagtttgtccatcattgtcgatttgcgccgtaaatcgtccgccgttactgcgagagtgcgacacctctttctaggtttatcctgaaaaccttccgttttatctacgagacaggtagttatctatagttctatctagatcggctctgctagccggtttagtttatcaaaacccatcttgatatagtgcttgctagattagggtggttggcgactctactatcactgcaaagctttaggtgttgcgatcgtgcttgtcgacttgtcaaaaaagttaccaacagtatgcattgctgcaaactgcccaacatcatttggtatggttagttgttctgtctaaataaggtgtatacaagtttcaaaactgataaataatccaaccttaccatttcacttttttttttacttcctactctggaatactgatacgtgttttcgtttagtgtgcaggcttcttggatc

SEQ ID NO: 94170 - DNA, 1462 bp, Oryza sativa
tcacgatatcgattaggctcaaggctagatatgtgccatcctctaatagctcaatcattcacttgaacctgttgatagattatataacttgtgattgactactcaatcacctttggcatggtcatgcacttccataatctacaacatcgaggggcccagagatatctctctataggaggggcaaatcccatcttgattattcatatcccactacatgtttcatagcatactcaaaaactacttttataactacccaattacggagtagcgtttagctgtccctaagtaagctactacacatgttgggaaccatgataatatcaggtctatggattcaacaccaacactaaatgagatcactgatgacacaacacatatggctcttgcagtgtctcatgttgggtctattcaacaacatgttcactaacatgtgtccacattattaatttggtatctctataccatgatccatgagacatgatcatcaattaatacatgtgttgatcatctaaacatatttgttccatatatgatatttgatcagggatcctttagaaatagcaacatataacataaagagtctcatgaaagaatcacatattcattaaccaataatgagtttatctatttcaaggaacaaagtcagataaatatgtaaacatagtgtgtgatacaatcatctctataatagcctctagggcatatcactaacagtctcccacttgcactagagtcaatcatgaacgtatcttatacccattgccctagtgtgtgcctcatgtttaggctgagggagtggctttgtcaatagatctgcaacattcaaatccgtatgtattttgcatatcttcacatctcctctacccactatctcgtgaatgaggtgataccgccgtaaaatgtgtttggacttttgatgcgatctatgctccttggcttgcacaatggcaccactattatcgcaatagaggttcatagggctagaagcactagtcatcacacctagttgagaaacaaatttctttatccaaacctttgctgcttcagaagcggcaatgtattcggcttctgttgtagaatcagacactgtatcttacttttccaactcacagcgcgtccattcaggcagaacacaaatccagactgcaatctaaaatcatctttgtcggtttgaaagcttgcgtcaatgtaaccatttaccacgagctcttcctgtcctccatagactaggaacatatccttagttcttctcaagtacttaaggatattctttacagctatccagtgactctcacctggatctgattggtatcggcttgttgcactaagtgcatatgaaacatctatacgtgtacatagcatagcatacataatggatccgattgcccaggcatatggaatcacactcatcttgtttcgctcatcagtcgtttgaggacactgattcttgccatgattaatg

SEQ ID NO: 94171 - DNA, 710 bp, Oryza sativa
gggtcttactgaaactagaatgtttaacattgctttgttggctaaatggttggttaaggttgaatctcctgatggtagtctctgttttgagctattaagaaagaaatacttgtgttctgggggagtctttcagtgctctactgaaggtgcttctcagttttggtctgggattcttaatacaagaaaatgaatgatgcttggttctgaattgaatagaagattggtgatggttcccatatttggttctggctagatgtttggtatgggtcttgccctctgaaaacaagttttcatgagatttttgagatatgcaaccaacaatcaatcacaattctgagctgaaacagataggtataggtggtttatcttttaggagaacttttggccctctggaacttgaccaatggcagcaggttaggacaatcctagaagagctagagttgactgactctcctgatattttgaaatggggtttgacagctagtaagagatttactaccaactctttatacagagctatggcttttagatgggtgaaagatgagatgctacaactaatctggaaatctccctgtcccataaaaattaaacatttcctttggttggcaagtagagataggatccaatcttgtgaacaattgaaaaagaaaggttgggatggttcagaactttgtatgctatgcaatactattgaatctaccaatcacatt

SEQ ID NO: 94172 - DNA, 1004 bp, Oryza sativa
aagcactagtcatcacacctagttgagaaacaaatttctttatccaaacctttgctgcttcagaagcggcaatgtattcggcttctgttgtagaatcagacactgtatcttacttttccaactcacagcgcgtccattcaggcagaacacaaatccagactgcaatctaaaatcatctttgtcggtttgaaagcttgcgtcaatgtaaccatttaccacgagctcttcctgtcctccatagactaggaacatatccttagttcttctcaagtacttaaggatattctttacagctatccagtgactctcacctggatctgattggtatcggcttgttgcactaagtgcatatgaaacatctatacgtgtacatagcatagcatacataatggatccgattgcccaggcatatggaatcacactcatcttgtttcgctcatcagtcgtttgaggacactgattcttgccatgattaatgccatgtgacatcggtaagaagcctttcttagaatcttgcatgttgaacctcttcaacaccttgtcaatgtatgtactctggcttaatccaattagcctctttgatctatctctatagatccttatgcccataatatatgctgcttctcctaagtccttcattgaaaaactatttttcaacgatgtcttaacggattcaagcataggaatatcgttcccaatcaataatatgtcatctacatataggattagaaacaccagtgcgctcccactaatcttcttgtatacacaaggctcttcttcatttttgacaaagcccaacgccttgactacttcgtcaaaacgaatattccaactccgagatgcttgcttcaacccataaatggatttctgcaatttgcatatctttttagctgattgtggatcaacaaatcccttgggttatgtcatgtacacatcctcatcgagatttccgctgaggaaagctgttttgacatccatttgccatatctcatagtcgaaatagg

SEQ ID NO: 94173 - DNA, 729 bp, Oryza sativa
actacggatcaattgatatgaggtgcaccaatcgaaaaggcgaaagtgaaatacatgtacgaactcgataaaccgcttatcaagcctgagcagctgcagttcctacccactcaaatgtacaagttccatcaactgtacatggagatgagcgccaccggtagagagatgatcagagcgaggatcagggacacggacttcttgcaaggagatgacattctctggatcaatttcaagggtatctacgaactataccagctggacgccctcgacgtttctattatgagttgctgcattttgtaagtatcgttcagttagatttcttattacgtttcctttaaataattaggtccttgtatataagtagactatatataatatatacttccttttatcgttgtagaatggagattcaaagggcccgacggtggggggttttcgatactggattcatcgaccctcggaaagtaaacgtcacagtgctcgaccggtatctgcaagacacagaggacaatctcgtccatctcctgaaggcgcagcattacaagacgttcatactgttgccgtacaacacagagttagtttaattttactgtcttcctataccaaatttcattcccgtacaaacatgctaagtgtttcatatataatgcatcccacgcacattgcagattccactgggtgcttttactcttcgacctggaggcctgcaccgtcaacgtatatgactca

SEQ ID NO: 94174 - DNA, 2832 bp, Oryza sativa
ttttgcgttatccacttaatgattgcggatgcctcgacaagcatctctactaccatgcgaacattgtacccagcccacaaaaggtcaatattctaactgcattacgtgcccaatgctactgactatatgctacctgatctgggctctgctttgctctacctccaccatgactgcgagaaatgcattgtgcatggagacatcaagcctgcaaatgtaatgcttgatgtgtcacacaatgctaagcttggtgacttcgggttagcaaggcttgttgagcatgggggagagccacaaacaacacaagttgtcgcagggacccctggatacattgacccagaattcatcaacaaccgctggcctcgcaccgaattggatgtgtacagcttcggtattgtcctcttagagatagcttgtggcaagcggccggcatcgaggcagctgccaaatggagcttcatcactgctagcctgggtgcgtgatttgtatgaccagggcaagattcttgacgcagcagatcagagactgaacggcgagttcaatcagcagcaaatggagcgtgtgatcgtcatgggtctctgctgttcacatcaagacccgatccagcgaccgtctatcgtgcaagctatggatgttctgtgatctgcagacgcagagttgccggtacctcccgcagcacatgatacaggacacatccggtccatgcaagaacaggcttatgccgacctgccagttgaggatcattctgtgcatactgtcacccgaagtacgtattttacttccaaggattcagtttatctacttgctgaaggataacgaattctctcttttgaatagcaatattagttatgtttacatgcgcctgtttagattgttttgtcaacaagattgctgataggcacacatctattttgttcatagttttgtgctatctatctatctattatccatctacacatgtagtataaatgatagtttcatatgaaccagctctattgttagcattaatcctgacttacatattttaaatatctgcagtagttagtcgtgtatgtgtgtcatgcacgtagtggagtattgcatatatgatgcatgcatataggagattagatctgtcacagccatgtacttggtgattagttgaccgagtaattagcttgtgtagttagttgagtgcggcaagttagcagatagttagttgcatgcatggttagttggacgagtgggtctcgtaatgcatggagttagtggctcatgtattcaggtagtgcgtgcgtgcgcatgaagaccggcaacagttcgtgcatgtaaggctatttaagccgtgctctgatccattttcagttaagtgtgtgagtcacagataaacagagaaaagggcatttgttgccgcaaagcttgcttgtgttccctgtgttcatctgagccatcgcgtgtgttgtgtgctcgcgtgagtttacgccgaaggtagttcgttgctccccggcagtttgatccctgggcgaaagtcaacatctattgttgcagcattttttttctcataaatttaagacgacgtgattcaagtaattttactttacaatttttaacaatctgtgctctagaataacgcagcctagcccatccaatcggcacgtccacttataaatatcacctcacatacatccttagtatacaagaaaaaaaatactccatccatcccaatataagcattcttagaatagtggcaaatcaaacttttaaattttgactattaatagcaaacgaacaaaaacagatcaatcatgtaaatttgatgttactagatttgttattaagcaaattatcataatgtgtaactttttttatttaaaacatcttacttttatagatattgttgatcaatgtagcatctcgaagacattgtcgaagtccaacaatgcttatattttgggacggagagagtattacttaaaattttaaattagagaaaatccataaaatgccatcgtacaagtctttttcttccagaaatgccatcgccatcaacgcaccattgattccacaccattacaaccataaatttgaccaaattaccctccgttcaaaattcctcctcatcgtcggcgaagcagatcttgactcccagcctgatgcagtaatcctgaaaatcggcactgatgaactgggagccgttgtccgttatgatacggtggggcaatccgaatctgcagaatatccctttgatgaatttgatggcgttgtcggccttgatttccctcgtgggtgtcgcttcaatccacttagtgaatttgtcgatcgccacgaataggaacctgcagccgccctatcctcgtgggaatagcccgagaatatctagcccccagcacgagaacggccaagtgagagggatagtctgaagtgcttgcgctggtagccttgtgtgtttactgtagaattgataggcttcacaccgctgaatcatgtcgcaggcgtctttaagggcggttggccagaagaacccttgtcgaaaagcttttccgactaatgtccgaccggcggcatgtgatccacggattccttcatgtatgtcaaggaggaggtgtctgtcgtcgtcggacgagacgcattttagaagtaccccgtttggtgccttcttgtatagatcgttgccgatcatacagtagacttttgctttacgggatattttcttggcttctgtgtcgtcctcgggcaactcttcactgcctatgaatttaatgagtggggtgtgccagtcatctgtgctctcgatatcggcaacggcgcgctctgcctctgtagcccccgagctgatgttaggggtgaccgggctat

SEQ ID NO: 94175 - DNA, 1323 bp, Oryza sativa
caatttggttgtctgacctgttatcaggcatagtccaatcggctacgaagtcggcaagtacctgggacttgatggctgttcgtggcacaaagcggatgtcaaattggcttagctcgactacccatttcacaatgcggccgagaacgtctttgtttctcactacttcaccgagagggcaggaggatacaactgtaaccctgtgggcttggaagtagtggcgtagctttcttgatgtcatgattaccgcgtagagcaatttttggatctgtggatatcttgtctttgtgtcgtggagagcgtcgctaacgtagtagactggttgttgcaccttctctctctcgacaacaatgacagtgctaacggaatatggcgtggcggcaatatagagaaataattcttcattaggttggggggcaacaagtatagggggatttgataggtagcgcttgagtgcaatgaatgcctctttggcttcctgtgtccatacaaatttgtcttgcttctttagcagagcgaagaaaggttgtcctcgctctcccatcctagcgacgaacctgcttaatgccgccatatatccggttaacttctgtacttccttgagtcttgtaggcgacttcatgttcttgattgccttgatcttctcgggatttgcttatattcctctgccagagacgaggaaaccgagtagcttgcccgatggtactccaaacatgcacttctctgaattgagcatgaggcgatatcgtcggaggctgtcgaacgtttcatgtaatttgagagaaacattcctttgatcttctactcttgagtatggagttagcaaaacaaagaaagatcaaaacaattgagtatggagttaccaaaacaaagaaagatcaaaacaatttagaagtttagttgcactaccgtcgtagccgccgacataattcacggctaagctgaatgccttgtagtaatgatggccttgtcaattctagttggatctgacaaggtagtgccccattacctagtggcgattgcttcattagtgtttgatactagttgaaaaccaaaatgctgaatgagggaggttgtctgaataggtggaaacattgatgacatatgagaaagcatgtggtacattttttttactacagtttaggtcttatcaaatctaattggatatgacaagggagtcgctgctcaccattacctagtgtccgtttctaattgttgaaagtcaaaatgctggaagagggtggttttttggaataggtgcaaacagtggtgacatatgagaagcatgctttttttttaaccaacagtagagcttaatccagtttc

SEQ ID NO: 94176 - DNA, 662 bp, Oryza sativa
catatctagtactaatcagaaaatctatcgtatggtattccgtggagacggaatagtactactgccttatctcctgttcccctcttccagtctcttcccctccactcactctctctctctctcttttcccctccactcgatccctctctctgtaactaccacccatgagcacggaggcggcgacgacggtgacgacgacggcagcaacgacgacgacagcgacggcggcaacgacggcgacgatggcggcggcaacgacggcgacgacaacgacggcggcgccgtcaccaccagcccccgcgaacgacctagacgacagccagcggagctcccgaccaccacgggcgacggccgccatcgagaagcctccccatcaagctcctcaaggcgctcctcctcttcgtcggtcttgtcggtagcttccttgccgctgccgcctcctcctccttggcggcgctggcgcctcctacggtcggagagcggtggacgcggccaccgggggcgagcgcttggcacaacatgagcgacgaggagctgctctaggcggtgtcgatggagccacgggttccgcggtttggagcgaggcacgacgaccagcgacggaatggcacaaggtaggcaccagatctatcgcttcttcttctttttctccgccgccgccc

SEQ ID NO: 94177 - DNA, 657 bp, Oryza sativa
cttcccttatgcaaggccaatcgtctgccacctgtccggcgacgttcgagtttctccggcgacctcctcggttaccctgaccatgccattgcagcaaggggaggcagcggcgcggcgcatcaggccatatgcacgccgggacgacttcctgctacctcttgtcagagaagtggccatcacatcagctgcaagtgaaggcgatgctcccagctgcaatgtcagccatggcgtccccgcggtcatcttctccatcggcggctacaccggcaacttcttccatgacatggcagacgtgctggtgcctctgtacctcaccaccttccatttcaaagggaaggtacagctgttcgttgcaaactacaagcaatggtggattcagaagtacaagccggtgctccggcggctttcgcatcgagccgtcgtcgatttcgactccgacggcgatgtccattgcttcgatcatgtgatcgtgggcttggtgagagacagggacctgatccttgggcagcatccgacgaggaaccccaaggggtacaccatggtcgacttcacgaggttcttgcgccacgcgtacgggctgaggagggacaagcccatggtgctcggcgagacgagcggcaagaagccgaggatgctgatcatatcgcggcggcggac

SEQ ID NO: 94178 - DNA, 2160 bp, Oryza sativa
gactctagaggatccccgtcgatctcaacggtgtttgtgggacattgccgtgctaaccaccgcttcgaccgtggcttgctgctgttgcattgacattttcgtcgctgccctgcttgctggtttgtgaggagaatccggcaaagagattcccatttgccgcggtattagttcaggacaaggcatttgaatttggataatatggttttcttctttttcatttgtttctgtttatttattggtgttcaggtttgtcatctgaacgatccgtgatgaaatgttcctctttttcatccagaaaaattgaactgcattttctattgttggtgatattgttaataaaagatatttttttcattctttatctaagattgtacagatagctttccagatgcatacatcaaataattggagtgcatttctacgtaatcttgaagatacagactggaagtagtatcgacagttacagaaattatacgcacagttcatgatgttaatctgtaaactgatcctaatgtgtgtcggccacaagctactagccttgcagatttcatcagcaatgacagaagaatttgtttggtagagatataattaaggacggaaaaaatcatttgaaaaaacaatcagatagtaggttaatatatatcataggatattctcctagctactactactacatatatgtgttcatcatgcatatagtatatgattgggctcacatatcataagcaaataaatgatcatgcggtgcaagtgcaatataggacgtttaaacgaacgcacggaagcagagagatgcattaacaaatcccaaatgtctgacccgttgaggatcgatttgcccacgatatatatagagaatgtaaccaacaacgacatgccatccaactctgtgatctcaactgccaaactaatacatactacagcttgatttcccattgatgcatctacattttcagagcttgattaattcaatcaaactcttgcaacaggatagttgtgtaactatggtgatactatgatttagcctcttcaaaggtatcgactctagtcttgtcagacaatgaggtatcaactgtagatagtagttcaaatcatgtataaccattcagtttccagaattaatcatattgcaacttgtaagtagaagtcaatcactggctagcctgtacccatgtgccacactgctaggatatgattcagagaggaagctatcagagattagtcgccgtgcagaaatgagcaaatagtactgacaaatatttcaagctgtagccactacctggtaagctttctttcacaacttgacttatatcaaaggactagcagtacacaagaacagacaatctcctctctcaatttttgtattcgcccattaaaattctatcttaattacagtgtaatagtatatagttgcaagtgtgtgcattcaatatatataatcttcgagagatggaaaagaagagggtaaaagaatgtgaatgtgatgagatgaactaggaacaaaatgtaatcataatctacttggtggcaaggttgtcgagagcttgctgcaacactggcctgaatcgggtgacgtcaatggtgatgtcctggccgtccatgagcgtctgcttcatgaaggcgaaccctctcttgtgcagacccgtcgggttggtgaagatctcgtcgccggcggggtacttgtccttgagcgagctctcggcgacggcgatctcgtactggatgtagttgagccccatcgccgccgccggctcgccgtagtccatgcgcgcgatccactggaggccgccccatggcaccacctgcaccatcgtcgctcccggcggcaggaacatcatgttcgtcaggccggcgccatggacgccgagcagcgcgtcgcacgagttgatcagcttccccacctgctcgatggagttccccacgtccgactcgttcaccaccacctcgaacccgacctcctccgccgcgcggaccacggcgtcgaggttcaagagcagcctggtgcgcccccgggagatgaccaggaggcgcggccgccgcccggtgccgtcgccgagccgcgtcggcgcgtcgcgcggcaacgacagcgcgcggcggaggaaccgcgtgaagtccggcgtcgccagcccgtccaggctgcgctcccgctcgatgatgagc

SEQ ID NO: 94179 - DNA, 2025 bp, Oryza sativa
gccctccctcgctctacccgcgccgagcccacgcgccgccgctctctggcgaactccagccgcgccgcgccgccgctcccgtccaccccgcactgcgccgtcgccctccccggcaccgcagtcgtcgtgcacaccccgtccaccgctcctcttccccaatccaccaccgcaacgccgcttccacctccaccccgagccaccttcgccattagccgcctccatccgctccccgccggcgagcgccgcctcgcccggccgtgcttttgcctccaacggcttcgccacgtcacaccgtaccccggcatccactccgtcctccccttccacccccgcagcaccattcccaccatgcaagccgaaaccaccgccattcaccgcctccagccgcccgctactgcagccctatgggtcgccgcgccgtgccgtttgtgtcgtcggcatcgctgtgccgagctctacccctgcccctactccatctcccctctccgcctccggaacatcgccgcctcgcgcaccacttttctcgcgccgccgccatctcgcctccctccgtcggccgcctctctccggcgtcgccccgtggtgagcaccccggtttcctcctcctctccctcctagcgccgtgcgctgccgcttccgtgcatgcgtcgccgccccgcgtcgccgccgctcgccgctgatggtcctcaggccggtgcgtcgccgccgcgccgtgtgctcgaccggccggctgccgctgccctgctcgcccgggccgatcggtcccctttgccgcgcctccctcgcgtgcaccgccgctccccgcgccgtcgccgccggtggtcacattgccgcgcgccattgctcggtcgggccggcataagccgtgcccgtgcccagccgcgccaccccatggccgcccgatcggctttgggtcgatccgggccgtcggttcccgtggaccgacggtggaccgcctcggtggtctcggtccacggtggaccggcgcccttgtgccgctgaccggtggggcccgcttgccggcgctgcccctcccccttgatgacgtcagcaaccccgttttcctttggaaaaataattaacaattgcatcataaatcatatttaattctagaaattcatttaaatggctcaaaacttctaaaattcatatctaattcattcgaactccgaatggagccattcaacttgcaaaattcatctaaaattgagctctacatgtttgtttagtttttatgtactatttccttggtttttattagagtttttcctcgttttgcgtgcaagcgtgtagtttccgccgtttcggaagatcgcggtcgtgaggataagagtttggaagatcaaagtgaagaagcaaggcaagtcacacattccccttgagcatgttgatcccaatttactaatgttttaccgtttgcaaataaatatgcatgttttgctaattacatgggatccggttattacctatctgctcgcttgtaccatgtttacttgatatctgtcatttgtcaaccttgggcgataaatcgactagctcatgttacttatgtgacctagctagaactatatgcttagccatgcttaattaccactagctcagttgatgggataattgcagtattagacctttttagtatctgaatgagctgcgtgctcgagacatctggccatgcttcatggtcgtaattatccaactaaaatgcgactgaatggtgggctgtgggtgcatggttttgctagtcgcacccatggcaattaaggaccggttcgcgggaaaccctgcaagaattcctcgtacttaccacaagccagcgtgggctgtgggtgcatggtttacgctttatttacgtttggaactgtatattacttatcgttttgtgtatcctggctggtcctggacagggatttaatacacaaaatagtctggaaatttagggctaaatttctgggcgtgacatatattttgtatacatacatatataaacttttatatacgtcgcatacaaactttgtatatgacgta

SEQ ID NO: 94180 - DNA, 2351 bp, Oryza sativa
ggattgattgtgtgaaatatgtttgccagttggtgaattgtagtttgcacatgaagtgatttggttcagccccaacaaagtggtactagagttgtaactgcagtaactcaagctgacaaaccaccactcaaatccggtgctctactcaaccaatcctcacacaaactgatcagattgaagtgctcaaagtgaggaacaaactcaccaagtttggtgccaatccaaccacgtttgagccttcaatcgctgacttgatgaagattgggtaagagcccccccaacttgaacaaactgcaactctttttctccactctcatctccctcttttgctggttctttcacctctctcaatggcttctgctctcacctctctcaatggaggctagggtttttctttccatgaccaaggatacgccaagctctaccggtgacccacacgtgtacccatgcctggaagccgctgggccgtcgcgctgggatcgcctgagagcaaaggctcaatgactttcggaaggtagtgaggtgcttcatgatgtcgggagggggagtttgttgggccaaatttccctccttatggagcctttgttctcagtccattgtagcctaaaagtccaacaaatgtgagccatgattcatgtgttgatcaatgatggagattgtctcatcctttatgatgggaagaaaaaccctagcctacattgagatgtgagagcagcatccattgagaaagtgaatgaaccagcaaaacacaagagagggagaggagagtggagaagaaggccccgtttggcacagctctagcttccaactccaacttacctggaaccggaactgtgccaaacggttcagatcctccatttttgggagtggagttagcagagctactcctaaaaaatgaactacgagggtggagttgggtttttgctgctccacagctccactccaacctaatagacccactaccatctaattttttaacatatttacacaaaaataccactgaaccacaccaaactcacctcctcacccctctctctctctccctcctgtaaccctcacctctcccacgacaggcgcacaggcggcggggtcgacagctcacggcttggaggcgcacggctgacggcgcgtgcggggacaacacggcgacggtgggtggcgcgtgggggacggtgcgcggcccgcgaccggcgacgcacacgggacggcaacctagggattcacgagagataagggattgttttttttccatttttttttaatttcagatctggagctgaatactagccaaacacttttcaactggtctccaatcccacaggagccagctcccattggagtgggagtttagagctaggagttgtagtttggagctagcagttggtagaatgtcagtttgagggatcaaatggtgtccgattgggctgttttttggataactttgaagggactcagaccatcatttctgtcaagttttgtgcaatttgcatctgtggtttggaagatctcagctgagaaccgaacaagacagaatcttctatttctctgcttgtttgttgatatacctcttgttaactttgatggttgatgttgatgatgccaagtgtgtaacttgatgttatagttgatgttgtgatgtgtctctagatgtagaagactccatttgtaccaattgttgattatagtggaagcttggagtgaaccgttggtcctgtggttttttcctcctcacaccgaggaggtttttcaacgtaaatcaccgtgtcttgtatgcatgtgtttattgttgtttcgttgctgatttgctagttgaaactatactcaaagtttatggcaagatgaggggttgattgtgtgaaatatgtttgccggtcgatgaattgtagtttgcacatgaagtgatttggttcagccccaacaaagtggcaactgggctgctaaagcataaagattctattatcatggcaagtaacgaagagagcttactgcagcatcaaagcgctggactgcggtcactgggaagtactgtcctttctccagccgaccctgcaaagacattttcagttctttcagtttcaccaccaactaagcaaccaagcacgattttttccattttctttcagaaacaccaaaatggctgctcctctcgcgagcaatgaggcgcatgttggtgaccttagcagtgaagatgagcatccatgtcctgcccggggactgtgtcccaccgagggtctcgaagaaggtggatgtgtcgagctttgccttcttgatcttggccaatgccgcgagcaactccggcgacggcaccttcctcgtcttggccgcctccttcagcaccttcacgctctccg

SEQ ID NO: 94181 - DNA, 531 bp, Oryza sativa
tctccatgtccttcctagaaatttatacacaccttcaattccaccaatgctccatgtttttaaatctctatatacatcacatattctatcaactttctaaaataactagaacttcatctataatataaatacatacctcattaatcccataaacatttcatataaacaagataaaatcaacaccatattctaaaaccacctcatctaaattaataacatttcctcaacttttactcattttataaacactaacatttaaacctatatttacatcatccttcagtacataatgatctccaacttttatgacctttaaaaacatacaataaataaaaaaaatcaaactaaaaaacttttatcatgccaattaaataaaattataaatataccaaaacccaccttatcttcaaatacttttttttaatagcaatcaatcaaacttaaattagaatcttcaaaaacccatctgcctttaatatctctatattcaatatattcaacctattataatattaccttgtaaaaacacat

SEQ ID NO: 94182 - DNA, 3841 bp, Oryza sativa
cctcccaccaacccacctcctctccccccaagggcccaaaacccacctcccacctcagtcaaaggccagtcaaaggtcccccacgtcggtcaattctaggtcaaacccgtcggtgactttccccacgaccctctctcttcttagctctcgtctcggaatgacgtagtaacgtgttggtcatcgtatagtaacacaatgttttacttgcagtaacaaaattaaaatttactcataatatacttatgatggatctacttttggtaagcaccttttttttaacatcatggtgcaaacggtttttaaaaatagtacatgatgtgagagatattacccttcaaagatttgtttttgaggatttaactctccacaagtaataatattgtagtaattacaagtggtaacgtgtaattgtcgtgcggtaacacttttacttttgtgcagtaacaagtgtatgattagcatctgagacttttatcgcatatatttttgtttcaattcctgaattactgcaattcaccacaatattacggtcaaaagtgcaataacgtcatatacatgcagtaacgctatattggagggaggaaaccaattttcttgagaagagggaggaaaaacggttcttgaggaggggagtacgtagatgcattttgaagtttaatcctccacatgcagtaacacgataacatcatggtggaaacggttttaaaaaataatacatatcttgtgagatattgcttttcaaagattgacattttgaactttagccctccacatgcagtaacagaatgtgtaatttacagtaacaggggtatatacatgcagtaacatggttttactaaatgtataaaattattcaaaacactcctacatcaatcagaccttgctcaaagctacctacaaactttacctatggcccacctattcgaacttcatctcgtaaaaatgacatagtaacactgcatttatcatgcagtaacatatctacttggaagtggtaacatgcacctattatgtagtaacgcttctacttttgtgtagtaacaagtatacggttagcatgtgaggctttaacccatatatttttgtttcaattcctagtttatgtagtaataatattcaagaaatgcaagacactttgttactgcaaagcttattgtctttactagactcttatagtaacgttgtgatagaactgtagtaacgtacagtagtaacaagtaatgctattgtattactacttgtggagagtcaaattccaaaaagaaaagcttttaagaacaatatctctgatgtcatgtatggttttttaaaaattgtttgcaccatgatgctagaaaaaaaatgcttatcaaaagtagatccatcgtgactatatttcaactatatttgagcgttgttactgcacgtaaaacatagtttactacacggtgaccgtcgcgttactgcacagtttcgcgagacgagagctgagaagaggtgggtggtgaggggagttagtaggtggttttgactgagctttgaccggcgggagggggctttgaccagcgtttgaccgaggtgagaggtggtttttaggccttggaaaggagggggaggtgggtgtggcccttgagagggaggggggtatagaatagttattctataccccgggtgtagaattgtcttaccctatatatattacatatatattacgcacatatatatatggaatacatatatatatatatatatatatatatatatatatatatatatatatatatatatatatatatatatatgcatatgtataaatacatatattacacatgtataatttaaagcacttaacattttatgtgcatatatattaccaaaatatatatttacactaaagtaaatgtgtacatctataaacatatacatgcatgtatagtacaattcatttgctcactatttagctacgacttcgacgcgggcgttatgtcaaaagaagaaggaccgacgttatgaattgtcgatccgtcgtagtagaattcacccttgggattaaggacttgaacagccgtgataaaatccttgtgtgagagattgtccctcatgtgaatacgctatcattcgaaaaataatgacatatgaatatatgaaattaataaacaacaaatcgatacgcaatgaaattttgaatggtttatatatacgtacatcgagctctcgtgtggtgtagatttgggttgataggcagtgggcatactcgtatacgtagtagccgcacaagttagttccctggtcccgctttgcacactacataagaaaggacaagagatttaatatacacttatattaactgtaattagagattcaattcaatataatttcggagcatgcatgtactgattggaaaattaaagctccgtccaagtttttctttccaagtcccgcggaacaattgacggaaccgatcccaagccctacatgcagttgcaagctatgattatttattatccgagatccgcataatagcaataggaaaaatccatgcggctttggaatagatggcattatattacctatctataagttggaaaaccttgtcaaaagtcttctctttattcattgagtcatacacattgactctgcatgcatccaagtcgaaaagtaacaggacccagtggaatctgcaacatgcgtgagatgatatatgaaaatgtacatgttatatgtatgggaacgaagtttgttcgaacgatagtaaaaactcactctgtgttgtacggcagtactatgaacgtcttgaaatgctgctgcgtcaggagatggacgagattgtcctctgtgtctttctcgtacttgtcgatcatttcgacgttgattttctgagggtcgatgaacccagtatcgcaaaccccccgccgtcgggtcttttgaatcttcattctacaacgataaaaggaaattattattgtttacatatatgcaaggagctaattattgaacgaaacaaatcgaactcaacgatacttacaaaatccatgcgctcagaagagagacgttcagggcgttcagatggtatagttcgaagacatccttgaaatggatccagagaacattttctccttgcaagaagtcggagtttcttatcctcgctccgaacatctctctacccttggcgttcatttccatgtaccattcatggaatttgtacatctgtgtcggtagggactgcagctgctcaggcgtgacaagcggtttaccgagttcaaacttgtatgccacttccgtcttcgggattggtgcgcctctaatcaactgttccacagttagaccggtgtcagaaatgaattatgttatgccaatttctttgccgacaccaacggctcgacctcttggttaggttgttctccaagctgaggaactggtttggacttcttgtaataggctttcttaagtgttcggtcatagtccgatagctttaaggcctccttgtttgttgtggacattttcttgaagaagttcttcacgctcgggtcaataggtatcttcttttcaagactccgaggcttgaattgcctcttcacttttgctgccacataagcgtcaagctcctcttgactgcaattgtacagcggctccttgtttttggtggcgtcaacttttgccttcttcgttgcccttgtgcgggcaggcggtggagcttgacgagaccttgtcttgggaggtgcaggcggacatggtggaggtggaggaggcggaggagccggaggagccggaggagatggtacaggaggaggtgacggaggagccagaggagatggtgcaggaggaggtagcggaggagatggcggagccggaggagatggtg

SEQ ID NO: 94183 - DNA, 810 bp, Oryza sativa
atagccactacgcaagtcaatctttgtgaaaattatagagccacacaactcatcaagcatgtcatctaacctaggaataggatgccgatatcagatagtaatattattaatggctctacaattaacacacattcgccaagaaccatctttcttaggaaccaaaattacaggaactgcacagggactaagtctttgacgtacatacccgtggtctaaaaggtcttgaacttgccgctgaatttccttagtctcctctaggttagttcgataagcagcacggtttggcaatcctgggggtatctcggctggaaagacatcctcatactcctgtaaaaggttagtaacaacaagatgtatcgaactagcaatatcatctaaagaaaccaaggcttgtttgcatatcaagaaatagcacatatcatcatctgaattttcagcaatgtcacatttcgttgcaagcataacaccacccttcgacttaattcccttagccttagaactaggtgaaagattatcctttttaggtggaaaaacagttttagccacttgctgattttcagattcatcaagtttcaaactagcagctcgctctttatcagcttctacaatttcagcaggggtcaaaggtagcaaagtaatttgcgtcccattatgcacaaaagcgtatttattactcctaccatggtgtgaagcatcattatcatgttcccaaggacggcccaacaaaagtgaacaagcttgcataggaaccacatcgcaatcaacagaatctgcatatgagccaatggaaaacgaaatcctacaaacttg

SEQ ID NO: 94184 - DNA, 663 bp, Oryza sativa
tttcggagccctcagttcgcgccggcaggccgtcattcgccggcgagaatgcgtgcccaagccgccgccggtggtgacgtcgtcgctgacgtcatcgtcatcatccctcgtggtctagccgtggacgaatggatctcggccgtccattttggatggatcgatctcggccgtccgtttcgtgaaccgccgccgtgcacccggtcaaccgtaaacccgacccgctgatgcaataattcccttttccttttcaaaaataattaattattgcgtcataattcaattaaaatctacataaatgatttaaatcgatttaatctttgaaaattcataactaattcatcttagctcggatttagttggttcaagtctctaaatttttctaaaattgagatctacatgttaaaaatatccacatgtactgttcatgcgtgtttatgtgctgttttggtgattttgttcttttctctttagattcagacgttccgggagagtctgattttgcaggagaagactttgaggatttccaaggccagcaaggcaagtcacacagattcctaacaaccctttgagcatgttgatcctgtttaaagctattgtttctattcaactattgcatttattttcgaatgtcattgggtggaattaacctattatttgttatgg

SEQ ID NO: 94185 - DNA, 648 bp, Oryza sativa
tttaaatacagaacatatggacatacttctctctttgctgccctgtgtttgtagatggttcaactatcaacataggatgctcctcagcataaaagctaataaagcaaaaaaattcagtagttgcatctccatgccatacaaaggaaatcctactatttaatcaactttatccggttgtacacataagaagggatttcactatcagtatatttgaagagcataaataaatatgtaaggtgaaaagatggtgggcataaagcagtaaccatgctgacatccaaaagattccatagaggcatagaagattaactttgttgctgattctaaagaaactatgttaaagatagagtttggttcatcccaaacttccccagaaacaagttaggcacgttcggccttttgcggcaacgggcaagtgtttggccaaccacataagcagtgtgccaaacctggttactccagtgcctctcatgtcatagatttatttttcagacaagttttgccacaagtgtggccagctttttgggcgtgcacttttggcacaaaattactcagatctgcatcaaatagataaagcaactcacctgaaagcatgattccatatattgtcaacaatatcccaatcaataaatgttccatctttcattg

SEQ ID NO: 94186 - DNA, 686 bp, Oryza sativa
ttgctacctttattttacctggagacaatttatatttggcctgtgataatactctattgtagtgtatgtactaaaaggtgtttttattctatttaggagggatcatatggaggttagtttatcaacattctaaaatatcaatattgatgctcatgattttgttaactattgtttatcactgattttcttccatgcccaataggtgatttcaccaatgaaagatggaacatttattgattgggatattgttgacaatatatggaatcatgctttcaggtgagttgctttatctatttgatgcagatctgagtaattttgtgccaaaagtgcacgcccaaaaagctggccacacttgtggcaaaacttgtctgaaaaataaatctatgacatgagaggcactggagtaaccaggtttggcacactgcttatgtggttggccaaacacttgcccgttgccgcaaaaggccgaacgtgcctaacttgtttctggggaagtttgggatgaaccaaactctatctttaacatagtttctttagaatcagcaacaaagttaatcttctatgcctctatggaatcttttggatgtcagcatggttactgctttatgcccaccatcttttcaccttacatatttatttatgctcttcaaatatactgatagtgaaatcccttcttatgtgtacaa

SEQ ID NO: 94187 - DNA, 589 bp, Oryza sativa
  unsure (1)..(589): unsure at all n locations
atttgacgatcaccacggcggcttttcccgagcgacgacgacgaccgaaagaacgncggcgcacggctgaacgaacggcggcgacgcgggcgctagactacacgacgctagggctctaccggcgacaagagacttaggcgagggtggcgccgggtagaggagacaccgggggtccttttatagcggctagggggtggcggcgaaggtccccagcgaccggcggcagcgatgaaaagtctagggttcggggagagagacgaatccgatttgagttcgaatccatggatttccgaacgattttagccgatgattccaaaagagaaaaggtagaggggatctcggggatcatttcccctctatcaatttcaccggatcgggaaagacacgatcgaatttggaagggcagcggcgcggctcggctagggttcggccgggcgacggcgcgaggaagacgacgagtctgacaggtgggtcccacctatcagcgggcgagggcgcgcgcgcagacggtgctcggctgcgggccgacctaggccgggagagagagaggggtttgggccgactttcggcccaaagccaaaagaggatt

SEQ ID NO: 94188 - DNA, 1575 bp, Oryza sativa
atctgaaatgttaaacgtgggactaaccccaaactcaggaggcaactcaagtttatatgcattatcattaatcttctcaacaattttaaaagggccatcaacacgaggcatcaacttagactttctcaattctggaaatctatccttccgcaagtgcaaccatactaaatcacccggttcaaacttaacctcttgcctacctttacttccagcaattctatacttttcagtcatcttttcaatattgaacttggttgactcatgcattttcaaaataaattcagcgcgtgccttagcatcattatgaatcctctcactagtaggtaaaggcaaaatatcaattggagcacgagggttgaaaccatacactacctgaaaaggacttaccttggtagtagaatgtgttgcccgattgtatgcaaactccacatgaggcaaacattcttcccacatcttcaaatttttcttcaaaatagccctcaacatggtatccaaagtgcggttgactatcttcgtttgtccatctgtttgtgggtgacatgttgtagaaaacaatagctttgtacccaacttgttccatagtgtgcaccagaaatgacttaagaattttgcatcaccatctgaaacaatagtacaaggcataccatgcaagcgaacaatctcatggaaaaatagatcagcaatatgaacagcatcatcacttttatgacatggtatgaaatgtgccatcttagaaaaacgatccaccaccacgaaaatactatccctccccctcttagttctaggcaatcccaaaacaaagtccatagaaatatctgcccaaggaatagaaggtacaggaagaggcatatacaaaccatgtggattcaaacgagacttagctttctgacaagtggtgcaacgtgccacgaacctctcaacatcctttctcatccttggccaaaagaaatgcatggccaaaacatcttccgtcttcttagctccaaaatgtcccatcaaccctcctccatgcgcttcctgtatcaacaaaagacgaacggaaccaactggaatgcatagacggttagctctataaacaaatccaccattgagcacaaatttgttccaagtacgtccctctttgcaatttatcatcacttcattaaaatcaggatcaagcgcatattgttctttaattaattcaaggccaaaaatccgacaatcaagttgggacaagaaagtatagcgcctagacaaagcatctgcaatcgcattatctttccctttcttgtgtttgataacataaggaaaagattcaatgaattcaacccattttgcatgtctacgattcaaattattttgagagcgaagatatttaagcgattcgtgatcggagtgaataacaatttttttaggccacaaataatgacgccacgtctctaaggaacgtacaagagcatacaattccttatcatacgtggaataattcaaaacatgtcggatcccaaaactaatgatttggaaaccgacatgtttaactgtatcaagccctggatcagtagattgatataggttcaacaatctggatcttcattg

SEQ ID NO: 94189 - DNA, 1584 bp, Oryza sativa
attttatcttgcacaaaatattttagagaattaggatgacctttgtttgtatatgtattcccacttcataattgcatttaatattattatagggattacattaaattttcttttagactgagaagatgatatttgagtttaatattaagtccacatgttatcacccaagattaactataggtttgtttggtgaaataattcttttagattatgctcatgggacctattatggaatgcaagaccaaaactccaaatgcacaaagaactcgagcctaggcatgcattatgtacatgtatgcttggtgacatttctagtctaatgttgggaatgaaaagattttattttgttctcaaattataatcatgcaatggtttaagttgatcttcacctaaattaaaacggaaatttttggctctctcaaaattggagaagttaacctctaactattttgacaagaaattttaagtcctaaaatttcgggtatgttacactaagaatacaaggaatgtgatagcagccgagaaattgaccatgtttcctcccccctccctttgctttcctagtaggattcggaatactctttggcatgacaatcttaattatctcccatagtctaaaactcacaaaaacatcagaaatacgctaagaataaattaagtaaagaacatgcacacacaaataataataatcatgttgcattaaattgctaaggtcagagaccaacagatgacacattggatagtgctatggccttattaaaagtagcaagagaaattaaatatgcttgtgagcgcacatatgcacgacatacaaatagttgggaccaacagatggatcgactatagatcgctccatatggtcaacaatttattggagataaacattaacataacttggccataacttgaagcaaaacaacatattcttatgaaaggcattaagactggtagcaatgcgagtaggttgttttaggcttgtccttccatcttagcaagaactcccatttcgtccatcttagcaacaactgtgaaattaaaatatggaaatcacattagcgcattagttaattaattttgtagtggaagtagagcataaattgtcttcatgttgcaagatatatgcctgaagttgtcagatgggaagtgaagtcaacaaactatattgatgaaaatgcatggaaggccacacatatgtattagtccacgatatgctacaaagtctgtatctacatataagaagtgcatttaaaagagtgacttcagtgaatttaccagaatcggccagaatacatgggaaacaacaagtgttcttgcagattgagtcggagccaccagcagcaatacaaccaaaacaacatgcttttgcccgagaggatatgcagcagccgcactgtgccgcggtggcggagtcgacagtgaggctcaagatgaccaggcacatgatcaccatcgaagtggtagtcctctttccctccattgcctcctgctgctgatgctaccttccctggttacctagctatgtttcttagttgtgtgttgagaggtgattcttgaatgtaaggtgctgctgctatttataggcag

SEQ ID NO: 94190 - DNA, 2841 bp, Oryza sativa
cctcgtgttgatggcccttttaaaattgttgagaagattaatgataatgcatataaacttgagttgcctcctgagtttggggttagtcccacgtttaacatttcagatttgaagccatacttgggagaaaaggatgagcttgagtcaaggacgacttcaattcaagagggggaggatgatgcggacatcactacctcggatacacacagcaatccttcaacggtcattcaaggaccgataacaagagctcgtgcgcgacaattgaatttagaggtgagctcgttcctatgttcttctttgtatgaattcgagaatagattgctacctaatgattatattgtgattaggaacaatggaggggacaaggagacacttggagaaggacttagagccatggaggatcatcggggaagtccaagtcaaggtggaggcccaaaccaagtcgacgtcccgtgcaattcggagtccaggaccagtctgcactaaaacgggcacccaggtcgcatacgtactcggattggggctttctttatatggatggaaagctaagaagataacctttccaatggttttggtcccacgtctaaattctttccgggtcaatgggaattgaccgaacaagttgatatccagaatctgtcccggttctgcgtcaccgtatttgggcctttggcccgtgtatcgtgttggaacccattagggttgcgtcgagaggggtttgcatgaccctaaactctatatatcagtacccgccgccatctttaggtttttgggttttgcttagattaatctgtcgataacagtttcgccgctagatcggttagtaagaccccaactcgtgagcttaatcattcatctgcaattttggttgtttttctatctcattcttgtttgtgttctttgattggcaaacagggaatagccttctcagcgaggtcatccgcgtttcgacacgggtgataaccagaggagacgtggtgctgcgattgcggggctcaagagcgtgcgcgttcaagaagccggatcgatttgtgtcgcgactccgtccaaatcattgtttatcagaacctttcggaagatcgggaaccctagtgcacatcacctacacaacatgtttcctttcgagaggtacatgggcgttctgaagaagtatgtttgtaaccgtgctcgtccagaggcaagcattagcatggggtatggaatagaggaggtcattgaattctgcgtagaatttatcgaagacctttgcccaatcagggtgcctgaatcacgccatggagactacggggaaaggggactctcagaaggaacgcagcaattacggtagacaataatttattccgtaaagcccatttcacggttctgcaacaatcttcattggtggctccctacatcaaggagcacttggctctagttcgcgccagaaacatcggtaaatccgatgcatggattacacggcatcacattgatactttctccgcgtggctgcgacaacatctcatgggtaacgagacgattaaccaacaactggccttcctggcgaggggaccatctggctcgatcgcaacattctagggatatgaaatcaatgggtacacattctacacgagagcccaagacatgaagagcacgaaccagaacggtgctgttcgtatcgatgccatgggacacgatggtacaactggcacctattacggtgccatcgaggacatatgggaacttgactatggacctctcaaggtacctctgttccggtgccaatgggttaggttgactggtggaggcgtaacgattgatgacagtgggatgacaacggttaaccttaacaaggttggatactcggacgaaccgtttgtccctgtcaatgatgtaacggaagttttttgcgtcaacgacatatctagtaaaggaaaaaagggcaaagggcctgacgagccgaagcgccacatggttctcccaagaaaaagaaaaatcatcggagtagaggacatggtttgatgggcaaccccctttcacagtgacgattgaccctagcatctatcacaccctaaaaatccctaaatatataaattgttgtttaattggaattattagaaatgattttaaaagcctagaagaaaagatctaattttaaataataaattccaatataaaagtgggctagataaaattttattaaatacttcacttgattctatagttcctaggtttttctgggatttatttgagccatggaagttattttaataaatggaattgcatttcatgaataatttaaattgaaaaaaggttttaaaagtcttcttttggctgcccaaaaccctctctcaccctctcctcggcctagccggcccaagtcagctcgcagccgcccgctcgcgcgctctctctcccgctgacaggtggggcccacctgtcggggtcgtcgtcttcctcccgccgccaagccgcgccctagccgccgccgccgcccttccaattcggttgcccctttccttctccggccaaatcgattgaggggaaatgatccccgggatcccctctaccttttctcttttggaatcatcggctaaaatcatttggaaatcggtggattcgatctcgaatcgaattcatttctcgcccccgaaccctaactttccatcgccgtcgccggccgccgtgggcctccgtcgccgccctctagcccctatataagaacccccaggacctcctctttccgtcgccaccctcgctttagctcgccgccgcctgtagcgccgcctccgcgagaacttgtgcgccgccgtcgccgccgcttgtccagccgtgcgccgccgccgctccggtcgtcgtcgtcgc

SEQ ID NO: 94191 - DNA, 1541 bp, Oryza sativa
ataaacttaatcaaacctaaagatttttaactaagaaaaagttatttgacttataatataaacggatggagtaacagttttgccaaattggcatgccacgtgtgcattgtgccgcctaaaccgctcgaaataatgctcggggattatttgcccaatttaaatagctgggagtgcaaaacgatactcaagttcaaaggtaattcagtcaacctcaatgctttaggggtaatgtagactattctgtatttcttagctattctcactttcatatatatactcctgtgtaggcactgaatcttatgttgttacttttcccctctaataatacatatcttcatgctggacatctataaaattgagggtcaaaaagatatatacaaagtttttcatatttattccctacagaattgagtgcgttttggtgccactaagaggtccgcgaccatttatcagtcaaaagggttgggctaaaagtggcgttctgcttcattcatcattgggcccaaaatggactatgaagtatttacccaccgacttacaacccatcaatgcacacgtgtttccatagaggaaaaagtgcaccgaaggtccctcaacttgtcatcgagttacaaaatcgtccttgaaccacaaaaccagatataatacatccctcaacttataaaaccagtataatcctgaacggttttgactccggttttgtctgatgtgacagctgactcagagtgggacccacgtgggtcccacatgtcagccacttcttcccctcccctctccacggcggctgcagagagcagatgggcgttgcgggcgcgggcagcggccggcgagggaggagctgccaccggcggcggcggcggcggctctccgccggccgacctccagctgttgcatctgctcatcaccagtccgcggcgagacgacgacgccgcccgacgcactatggtcccggagcaaacacccgcacgcggagcccgacgccgctgacatgccgccgcccacgaccgcaaaccgcccgcagcagcgcggccctccgcccctcgtctgcctctttcgctggcgccggcggcgctctgcgtcttgcagagcctctcggcgatggtgtgccccatgtgcattgacaggtgacgagcagcctcgtcgcggcgacgtcgagcgcttccgttcgggagctccacgatggagtggccccggtggttctccctgacgaccgagaccacggcggcgagcgaattggtgtgcgcggtgagcgcgacaggacacggatgatgctgaggttgagcttgtcaggaatgaagcacttgagcatgtggatgaagtcgtagatggattacttggacgtgaggacgtggccttctttgttcaccacggtggtatccggatcaatgctagactcgacgacgttggcgaggacggcggcggccatggccttgtaagggagcgcctcgtcgtctacctttcggatgtagagctcctccaccatgaccgggacgacctcgacgagcgtcttgctgttggggcggtgtgagaaaagttcgatg

SEQ ID NO: 94192 - DNA, 626 bp, Oryza sativa
agccgaccccagtcagcccctccccgtgcgtgcgttccaccgcgaaccgtgaggctgcgcgtgggcccgccgcatccacgtccaccgcgaaccgcgcgcgtgcaccgcgtccctcccccgcccgcgcgcgtgcgccgcgtgctcgctccgcacggtgaaccgtgtcaccgacaagcgggtcccaccaaggaccacgcaaggtgagcccggtccaccggctctctctctccttgcctcccgcgcgcgtgtgccttggaccgccttgggccggctggcccatttagctcgaccgagccgccccttttctctcgggccgcgccctagccgcccgaggaaagtctattttccctccctcttttcttttctttttttttcttttccaaaaaggatttaattaaatccttttcctttagaccaaaaatccaataatcttagaaattcaatatcttcccaaccataaatccgtttgactccgttcaacttccaaaattcctcaaatctcgagatctatctaatggcacgcttagaggtcattaatagggctttattttcgccgtttgttgagttttcccgtttcgcgtgtagtttcggagcccgaagacccgcagtgcgaggatttcgaggat

SEQ ID NO: 94193 - DNA, 3186 bp, Oryza sativa
ccagttccaccaagaggcggttatctgccccacgaccgaggccgttgccccaggcccatccatgtctgcttgacgaccatctccatcatcagcactccatggaatgtatgaatgtatctatgtgagcttgtgcgtgctgtaaatcttaattttaatttaggttaaaatatatttgttctatcaggcaagagtgaagctgggttcaatcttgaacatctggaagtttgatttagagaatgccatgtaatgtgacatcgaggaaagagtgaagcaatttagcttaggtaaattaggtcatccagtgcataagagatttacacagctaagtagtacagtagtggtagcttgacatgcatgaatgcttggtccattgattgaattcacagctaagtagtacagtagtggtagcttgacatgcatgaatgcttggtccccgatccaaattttatattatctccttccattgcatgtaataattttagaaggttatactaatgtaacagcattaggccaaacgtacatgttgccgatttggtggtaacttccgacaaatcaatcttcccttaatttgactcattttgtcctacattccaatcaatgcatattatctatgaagaaataatatacattcagtttcaggtaaaacacaaagaaagctgctcctcatttgggtcaaagctataaagtaattccctggttgtgattgtgatccagcaccaattcagcagttccctatcctggctaacatgaatgttttactctttagttatgtatatgttgatataatgcgcgctgattaaaattaagtcaaacctacccccaatcatttattttgcttcccttattccttactttggttgacgaaatggacctgaatgtgtcagatttattcttcttaaaatttatttgcgatgaaatggatggagtaccaatggctgttgcaacagggtaatttattcaataaacaatatatttgccctcaatcctgtgtactatcttttcacagtaaaccatgtacttttcaaactagaatcatgtctaattatttctttatatctatgaatcatttttccttaaagacacagaaccacaaggagatgtttacactgatgtaccatgttatcatgggggatgatccagacctgaagactggcaagccatctcctgatttatttctagcttgctgctatgaggaggtttgaggtgtttccgtatgtgttatttcctttagaatgttcttaatttggactaaaatacagtactataatttcatcttatgcaagtgcactgcatgttgttcagggcaatgtataaccaggtaattgccttctatttcaagatgctggaatgttggtacatgtatttgttgtagcagcagtaaaaaaatgctggaatacaagtgccttgttacatgtgtgtgaagtgtgaacaatcatgacaacaagaaaacacttcttccactataaaaaaggtaaagggaaattcagccaatgtccaggtatgtaggaacaaatgggcacgtgctttttttaaattgagaaacaccatttcttgtgaacagagttttacatgatcagactctccagtgccaccctcttatttgggtacaagattattttggaacagaaaaaaaaatatatttacttattactattttttgcacttcttgcgtaggaatatatctaagcaatcaacgtgaggaatagagtttgtgaagactggagacatacaaaaacctttattggcactgatgttgtacatcctgttgattgaaaattttcataccactgcaatgttttagctctttttccatcagttcagttgttataaaacatagaaaattgtaagcctttatttatgacctgttatctactaggttgttttatgaaatagccttcccattgtgaactgaagtaggcttataaaagttcattattagtttatttgacataccacagtgactctgtatcatcaattgagtttactaaaacttcttttttgatggagtcattaagatgatcattgcaatttgcttgctagcttgaagagtgtcgtattcaaattcttctatctccatttaatgtagaggcttaccttgcctatttgctcgatgaccagggagcatgaccagactatcgtattttgtttagatggtctataagattgctagactatatatgttcaatgatctttgtaggatacataggcagtgttcgttcggggagattggagatagattgcacatcgttttccgcgtgcatgttttccaaactattaaacggtgcgttttttgcaaaaaaaattctataggaaagatgctttaaaaaatcatattagttcatttttgaaatttaaaataattaatactcaattaattatgcactaatagctcacctcgttttgcgtatcttcccaatcttctctatctcccctttctcaaacacagcctatagtgtattgatgcagattcgggattccgcacttggttttgtcttgacaaacaatagatgagctgtcacttgtaggagaagctttgtttaaattgctgtgtttatcttagataatataaaataaatgagctgccactatttcaatagagattttgtgttcttatttgcatgatacatgggtttgaaatgtatgtatagttcctttgtttttgtttcatgtgatgaaaatttcattcacatacaattgtcattgttgtattacaaatagtgtgtgttgggattatatattaattggtggagacgtgcgttgcacgtgcatgcacaattactagtagaccacaaacgcacaggttagccacgtctggccgcaccactcggtcagtcactccgtgacttaatcacccactaatcacgtctctatgcatgcaggtcatatctccttgcgtgtagagcactaacacacacatgcaacagagctaactgatccactatccacgccactactgcagctacttgacatgcaagcaccttcatgcaggtcatggactttcttgatcaagctaactcatgcacacactaatcacaactcacactaaagtaaaggtgaatagctaatatggtatttgaagtttcgcttcgggctcagtttaaatcgaccaaacaagtcatccaaattaatcatttgggttaatatagtccttagacccacaaaaagtgccacgtaagcatgccaagt

SEQ ID NO: 94194 - DNA, 10871 bp, Oryza sativa
ttttttttattaatttaatttagaaattatgaattactaagtatcaacagagagtcttaactatattttgtttcaccatttaatattttttttgagaattacacggtacaacacagatactcacaatgcacgcacactcacccctatgaaagtacgcacgtaaaccctacccctataagcatctttgaagactgggccggcaatctatcctgaagattgacgaagtcaccataggtgcatcgctgtcgacgggtacgtctcctaccatttaataattttgaattcaacaacaaatcagtagtgagaatagtgagttgtgtttgataattggcatggagtcacaagtaattatagctttttatataatctaataaataaaatcgacgataaaaatttcttattgatggctttgggcacatatttgcatgtgttatcaatatatgttcatataattttttttaatatctatatactttttcatcacatagaacatgcaaatgcacaaacgcagtcacgcacacaacacttacacattcaaggtgtgccctaactcatgattaagggcatgtttagtagagctccaattcctaaattcagctacaggagttggtttggagtggagttgtggagctgcctaaacccaactccacctctattttaggtggagctgaaactgtttggctgagctccagctccaaaagagatggagctgaagttaaagctgtgccaaagaggcgctaaagagtcttaatttctgacataactaaaattttattaaaagcgtaggtgtgtatataatcaaataaaaatatattaaaatactactggatagagatgtgatcaaacttgatttgctaacctcaatgcattgacccttccatgaatccataatcaccttgtcattaagttctgcttatctacacaaacagggatgatggtacgttctcattgagaacatggaatttataaaatcattgtcatgattaatatttgtgatgaataattggctatacaaatgatttaattaaagaattggtttgagagtttatgtaaatgttggtgtgagtgcgtgtgactaatgtgggttagcttgtgatatctgtgtccagaaacggttgttttgtctgattgtgtgcaggtgacttgaggtcagccttggtcaatggtgagggccgggactatattcagggaggaacaaaggtctagtgcggtcgggataccatgtgagaaggtgactagagtccggattcttagaggtcaacttcggtcaacggtggggatcgggactaaactcatagaggagttgaggttcagacggttaaggataccgggtgacgaagttggatacgagatggcacatggtggatggacaccgtgtgggagagatcttcgcaacgggtttcacgaggtgtgcgtgcaagtgccagggttcgcgaaggagattggaagaaattagagagaagtatatggtgctacagtgcttcgagttactgtagcagtcgtgtatgcatatatgtgtgtatgctggtcgtagcatatgcatgtatgtatggtgattgatgcatgcatgttgtgccatgcatgtgtgatggctcggtgggcttcggtggcagctggctggaggccgagccggtccaggagcagcagcacgtcagcccacatgcgataggcccaagcaggagcaagcgcaggagatcgagtccgatgcggttggctgcggctgtgcgagttttggtaaattgtaaaaggtttggaaattgagagattgagtcctattgtgaataggagttttacacctactttgagtagggggttttttggtataaatagagagggagcgtgaggttttccggtatcgctttgagagcaattgagttgatagtttagttagggtttcgagtttagtcgagattttttgtaaggaatgctgtagttgcactttgtaaacacagagagaagcaataaagttgtcatctactttgagcgttctttgatttgtgtttcgtcgggttcaggcggcagcaaggtggttcaactggcagcgtgtgagcaatccgaccggcagcaacaggactacgtcgagatttccatcgatttgagggtaacttttatttccgctaaaagtttttgggtttttggttttccctaccattcaccctcctctggtaggcttgattgcttgtgttcgatcctacagaattaacgatggtaaaaacaggatccttaaatcagtaaaattagcagtaagttatgcaaagtgagatcagcatataaaaaaaagctacatatatacgtgtatttgtagatgagacgatacattaaatgtgcaacatttcttgtcaatcatcatgtcaacccctcaaggatgtgatgatggtgtcactactaaagaagaggatattgttgccggttgagaacccggtataggtgccggattttccaactgtcactacggaggtggtatagatgtgaaaccacataggtgccagcggtttagaaccggcacctataaagatgaatgagaaaaaaaaaagctggctcagctcgaatgaagccgaacacatcaagaacttcaagaacatgtcaagaacatcatgaacacatcacagaacacatctaagaacacattaacaacacagaacacttcgcgtcgcaggcggtcacatcaccctccgcgccggccttctccaccaccgccaatgtcgtcggatgttaacaaggaggagggcgtcgctgccttcagcaccaccgccgcctttacctccctttagaaatggcagagggaggacgtcgccaccgggtcgctaggctgccgccaccgcccttcccgtcgtcagatctggtggaggggagggcgtgccaccgggccgtcactgccaccactgggccgccaccacctccgtcgggccgctgagaaagtgagagagagagagaggtggggagggcgttgccgctgtgtcgtcgggctgccgccgtctcccctcccgctggatctggtggagggaagggtgcgccaccaggcccccgccgccacctccgccgggccgctgagagagagagagagaggtggggagggcaccgccgccagagcttgcgggtgggcagggctcgcgggtggggggagggagagagagaagcacgggtggataagggcgacgcagtcgtcgggataagcggtcagctcggctcgatttttttcgatgtcggttttttaaaaactgatatctattataaattaaaggtgctggtttttttactatgaaccgatacctttctctgacacaggttttagaaataaaaccagcacctatttagaaataaaggtgtcggttttttgtgatttcaacccacggaggtgggaaaatggtctataggtgccggttttagtatttttggaacctatcgtgccgatatctatttgatgttttatagtagtttgtatatgcatattctgatcggtgtcgtctctgaccgaaaatcaatgttgatcaacgaaaaatagttcaagtgagttgcagatggtggagtccatcttgttccgcttctggcctgatattcccatatgtcaattgtctggtctggttaattaatacggagtactctctaccctaggattagatagacgatcaataagtgtggcgattggagataagattaggtagcctaattgacgttgaccggattattagatcgatctgaagaaatctgtgcaagaaaaaaaaaagataattcccccggtgccggtgcatgcatggtctatatttaaagaaaattaaaaaaaaagaaaagataattattaacgtgacttgcgacttctccgggtgtatcatccatggatttcacaatcagcactcaattaggagttggacttgagcagtaccccctctgtcaaaaaaaaagacaacctagttataggatgtgacacatcctattacaatgaatttgagagatgtgtcacatcctagtacaaggttaattttttttgggacggagagagtacatgccgaactttttgattaatgtgagagctcctgaaaaatggccaattagtattggtatagatagatatgcatgattatcgactcaggttatggcatgagtgtacatatgtactactctctaaagaaatttagcataatgatacttacagaataaatgatgaatagtcccgttctttcttaaagaaatggatttattgtcaccattctaattcattcatactaaattatgcttagttagaattactcctttgaatccattccatataaaatcataattttaatccctaaaaaaataattttaaggggcatttttagtttttatataatcttgttactctcaacatgccaattagtgattagagctaagtacataggatgaaccgaaaattgaccactttaataaagattctatctaaatatgccatttcatcatttgaatgaacatgcataattgaagtgacaaagttgtgccaattaggttctaacttaccaacgcttttttaaaggaaacattaaatctggtaaggtaacggcagtaattcgtatttcaagcccttccaaggataggagtagccgattacgttaaagatgacgttttaaagtgattcaattttgtttccgaataatgataatagcccaatatactcaggcgtaaatgcaaagattatttaccattgttgttcttactgctttttggaaaaaggcaaaagctttctcacttttgtattaatagagaggagtacattcataacgcggaaatacatacagggtctatcacaagagagctattctccagggtgaatgatctctgtgattcgtgtggctaccgccttgatccacgctcacgcctccttttgatcttagcgataattgtagccggtatggtagctatgtgcctaaagattctgacattttgctcacaccaaagctcccagaacacaaggatgatgttaatgtcaaaatttggtaagccccgaagtcatcatcggcctagagtcagtatcggcatcagagttcaggaccggccgatgggcattatcagttgccagtagcccgattcttgatgggttcagctagggaaattaattacttaaaagaagcttatccagaagagaccgagttcgaggaggatgtggcttggcagtttatctattaattaggaatctgttcaataaggacttaatgtttttccttttatttctttaggaaagtttgtatcgtgtccaataaggataaggactagtatctacccatgggtataaatatatacaccggagtccttataaaccatctccacaaatcaatacaactacttttggcacattgccaccctcttgttcgaggttttacttatcaaccggcagaacttggcacctgatgcggggctgcatcggcttttgatctcctacgaaggggtgttgttcaaggctgtatcgcttcgacctcttggatctctcttgttcggttgatatatttgcatacctattttttatatatcttagttaatctatgtcgatgattcaatttatctgtatcggccgaattttttcagggtttagccggtatcgactaaattgttttgtcgatctagattggctaaggtatctatcacctaaaaattagtcaaatggttggtgtttagaatttatgcttcttttcataattagttctgcatcaattgggtttgacctactaagtcgtgcttagaatcataaaagctaacctatctttgattgccaataagtgtttcatcgtggtttcagccgataagttatctggacgttgcatcggctttacatataagttagttttagctaatcgcaataaatgtttcattgattatctaatcatttggatttatgaacatcgtatctccagctgatgtatgctttaatcaatagttattttatcgtatcgttattggccgattggtttctattggattatatttttttatatagtattatcagtcgattgtgtttatatcattatttactcaagtattagagtctatattggatatatagccgatttctcgaaaccctatcgacatcggttagtatcgacattgactggaattactatattggcttgctggccgatcggctctttgatgttcaatttatatatcttgttagttgcaggatccaactgactagcatgcccacatctcatcaatattttgtacctgcactggaattaagcagatctcctaggccttcgtgtgtttgtcgacacggttcgcgtcaatgcagatttgacaccattggtcggacgcagaattttttttttgttcgcactttttttttttggattttggctcctctgggcacgtttcactttttttttgccgtttctttccgattttttttcaatatttcgcatacctcttgacaaatgtagaattgaaagtttttaattttgacttgaagtttttaaatcttgacttgaaagttttcaaattttgtgttgaaagttttaaaattttgagttgaaagtttttaaatttgagttgaaagttttcaaatctaggttgaaaattttcaaatttgggttgaaagtttcaaatttgggattaaagtttttcaaatttgagatgaaaagttgaaatttttcaaaatttgacttcaaaaaaaattcaaatttcgagttgaaatttttcaaatttgagttaaaaacttttcaaaatctgacttggaagttttcaaaatctgacttgaatgttttcaaattgacataaaaatttaaattgtagttgaaagtttttaaaattcaagttgataggtttcaaatctttagtaaaaaaggaaaacaatgttatgtgaaaaaagaaagtataacttgattgaccgtaattatcagatctaattacctaacagttctgctaatcacgtttttatcccggttcttgtgcacgtgcggcagctttgtgacacgaaaaagaaaaaggaagaccattgccacgtgcgaggttagaggctaaaaaaaaaaggaaaaagtaaactgatgggctgcgcgtgagggcgtgggccgcatgcggagcaatgggccaaaatgcgcgacttaagttgatggcacgtacgcgctaattagcaattctgggcgcaagaagcactctctagctatcccgggccctctgctcagcatcttcgaggcacacatacgagtccgagtgacagtaatcattacattttggctaatgtgatagggggacaaggacaagactaagcatagtaccttccttccctaggaaagagcggccactatggactccccatagatataaaaggaggacccgtgccacttagaaaggggttggaagaaaaaagctggagtagaacctagttcacatcactctaagcaagaaatcacatacaaaccacatagtcccaaacacaggagtagggttttacgcatctgtgcggcctatacctatataaaccatcgtgttcatctccttgttaagaggagctcgggctcaactcaccctctagccgaatcatcttcaaaagagggagtgttcactttaccgttgtcggggtaccaaactctgacacttgtatatatgtatattagcttgatgataatgacatgtacatattttcatcaaaatactcaaagtactaaccactacatgcatatccttagttctatagtttacaaaatgtcaaaagaaaaagggcaaattgcaaaaccaccttaaatatcactatgaatttgagattccccctataatacggtttgttgcaaatacctctctcataattcacctttgtttgaaaatccccccaatagtcgttgcctgcccattcttgtgcccacaaaccccatatgcactcatcacatgaatacaagcaagtgaggagccgtggtggtcactcatgttggtcatgctctatatgatatgacaatgacattcctagtgatggctccaagcatgtcattggacaatggcagtcacaaatcttcgcacttggctcctgaggttcggtgcaggctggtttttattcagtagatttaagatgagaacgatgagctcggtgcaacactctgtcgctgagaaagaagatgtgtgctcggtgtgacaccatgtcactgagatagaatatgcgtttgcgaacatgtagatgaggagatacgctaagttgtataacacatgcagaaagagaaaaaaaatatgtgaacaacctaggtgaattaaaggggggtatttgcaataaaccgtcttataggggggtgaaatcaaaacctaggtgaattagaagggggtattttggggtgttttttttgcaattttcccaaagaaaaaacatgaaaatagatatgaaaatcgatgcttatgcacctggttctgatgaagcaacacttggaatacagaactaccattaattattgcaattatactttgcttattttagctagtagtggagcggaatacattaagctatatcaaaagcatggtagattgacatgttcttccaatggaaacaaacgaggagctcctaattcgcacatgcgccccctgaagcgtgcggcgcccctgctagcttcccccttcctctctcattgccctccccttgttctctctccaccaacaccggacaccaacggtgagcgagcaagcaatggccctttgtcgagctcctccgatggaagaacctgagcatgcagcggtgcagcaagaaacaaagcgcctcgctcaatccctccggcggaatccttctaccctcttccgacgatgccatagccaggtcagctccaatccctctcctcttttgcgtcggtgcctctcttcttttgcgtccaccggcgccgcccggcctcgccggtgtggacttgcctggtcggcctacccctctccttcacctagctttgtcctcatcacaaacaccggcccatcaccttctgcccactccgcgggttcgacaatgctgccgccacctcaccgccctcccttgtccaccacccaccaccgggtagccacctcccaggcaatccctctaagctaatcccaatttccccctcccagtgccacctttcctcacccatcccgaatcccaaaccctaaccctatcccgagcttgttgtcacgcggtcggaaactgcacgcgctcccccccccccccccggcccccgccacgcgtgcatggattaggattcctgaacaaacgagtactacaagaacaagataaatgcaatctaaatattatgaatggggaattaaacacaagataaattgttgaatagagaatgggtacatggtcgaatatatttagattacatcaacccagataatcaaacaaacaaactattgggatatatgaatgattagtcttcaactaagccattgagaactaaagacaagatgaaccgtacatgtcaaattattaactaaataaaacacaacttacgatggaaaatataaaaaaatgaagtgctttgattcatggaggtggcacacttgaggtggaagtcatagacctaatcctttacaagatcgatggcctaagtttaactcgatttcagcacaataccagcttattttgacaatttcacgtgaaccttttatccacacatacactctatgaaaataacaaaaatatagtcacaactacaaatcatagaggaccttgtattcaacagaagaaccgagctctgtaatttgtgggcacgcgagtggagcttgtgtgtatgaaccccgtagcaggccaattgcaatggccttaaacacagcttctgatggatgatagtcatcccatgacccatacagttgagggtcatcgcaccccttgtattcaccatgtccacatcttgcagtttcagatacaccataaggtcctcctccaccacagcaagctgccaaaggattctcaattcctgaaacacaatcagaaaatttttatttaagctatcaacgacaacaaaaaccgtgatttgtcaatgcagaaattagcatgggagtgcatgacatgggtgctgaaaaataaagtagccaacttgataataaatttgtggagcagaaatcctatttagctgttgtggctaagataaaagcatagataaagatttgctttggtttgagaagcactagggaaatcaaatttagatgcctattgcttttcagctcttgaatatcatgacatcttttcctattgcttttcagctcatctcctctagacactttgctgtctactacgaatagttgaagcaagaacaaatatagtatttgtcatcaagcgattcattatcaacatagaaagtagagtaggggtcccttacatgacatgatgaaaataaactagtggacctggcaaataaatgaagggggagaaatcgtatttagctattgtgactatgaaacgagcatacaaaaagatttgcttcgatttgtttgagaagccgtaaggaaatcgaatttaagcgaacacatatatagagtatttttgtgtaaaataaatactaaaattaatagtgttaagctttacaaaagaaatcagagtagcactggtggagaaaccatctttgatcggtcaacccaaatctacaatagtcccggttctattaaaaaccgggactaaaaacgattttttgtcccggtttataagaagaacatgactagatgatctttattcccggtttgtgttaccaactgggactaaaaatcatctttagtcccagttggtaatatgtcagaccgtgtcaggcgcctaggatctttagtcccggtttgtaacaccaaccgggactaaagatctaactttagtcccagttgttgttactaaccgggaataaaaatcaacgcgtactatataatccctattacttatcctcttctctcgtccacacaacaaactctatctctttctttct

SEQ ID NO: 94195 - DNA, 3766 bp, Oryza sativa
ctcgcctcgttcaagaaagtgctcggtcggatagctcctggagtcggtaaacaatcaatcacgcgaacacgttgttaatttgatcgattaacgtgcatgcgtgcagtgcatggaagagcgtgttcagatcatgtcggatatatatataaatctttgtctctgtttcagatgccaccaagagcctgctaggcgagtcgctgatcgtgatgggcgagatcggcggcaacgactacaacttctggttcaccgcgcggcagccacgcgagacggcgaggcagtacctccccgacgtcatcggccgcatcggcgccgccgtccaggaggtgatcaacctcggcgcgaagaccgtgctggtcccgggcaacttcccgttcgggtgcgccccggagtacctccagggcttccagagcagcaacacctccgactacgacgccaccgggtgcatcgcgtggttcaacgacttctcaaggcagcacaaccaggcgctggtgcaggaggtcgcccgcctcaggtcgcagaaccccggcgtgaggctcatctacgccgactactacggcgccgccttggagttcttcaagaaccccaagaactacggtgagcacgccataaatcctatatattgtgttcgatatatatgatgcttcattgctttgtttgactaataatgttttatcgatccgttcttggttttggaaggtatcggtgaccctctgctggagtgctgcggcggcgacggcccgtaccacaccggcatgacgtgcaacaagacagccaaggtttgggggtccccggccaacttcgccagctgggacggcgtccacatgacggagaaggcctacagcatcatcgccgacggggtgttgagcaagcgttacgccgacgctccgttgctctgctagaggatttagctggaattcgtgcgtggctttaattctgggatagagattcttgggaactcttacgcatatatatttgtatcaaccagtgaactagtaatgcaaataacaataatctgattacgcaacgcacgcattccttcctccggagtccggagtataacatttggtaagcgtaaacccgtagcaagatatactgcttatgtaagatatgaccacacatttatttttctaaatgtcgtctatctcattcggtttggtctttgacccaaatagtttcaaacctacatccatcctatagtgtttcacatatgttcgggacgggagtttggcttttgtgtttatctaaagttttgagacctttactcctaatatgagctgttgctatatgttgatcggtatggttatgtaggaatggtgtagcttttaaagattgattctcctttgcagggtaatctggcttcgtttttgggctacttcataagccaagtttacggaatttaattgcttttactacatgttagcaattggaaagtggccaagaagttttttacctacgagcgtgggtggcgacttaatctacgaattgataacccttaattcttcatgtttaattctttcaaaacaagtgtgggtatggtgtgcgtttaggttatgtgctgagtatctgtttaggctatgtgcattttaggtatgtagaggctacgaatgtttttagcatggttgtatcatcttgaataaaaacttatgttatctaaaagaaaaatcattaatattttaattgatcaagtcaaggagagtaggaccgacgagtaatgtagatgaggctagctatcgagctcttgagtttgtgagtgacaaaatgctcggttccttacatggtagaccggggcccatataagaatacctacttgttgaatttcccgcgcaattgcatgggactaatcgaattttccccataattgcaggagggatattgaaatagaattatatttgctaaataaatcttctcattttccgagttaacgcttaatatttaggtcttagctaggagagtgttaagaattagggtaaccaatagtttcaaaggtaccaaccctatgatggaaaattttcttcttttggtagaactctaaggccccctttgaatcacaggaatgaaaaaacgggggaatgggaaaaacataggattctgataggaatacaagtgtaaaacagaggattgcaaaacacaggaaaaacatagaaatgaccgtttgattgagccgcaggaaaaacacaggaatttgaggagagagaaagactcgaaggattcttaacatgaggtagaacctcatgttaaatttccttcaaaatttgcatgggaagaggcattccataggaattttataggattccataggattcattcctttgattcaaagggctatataggaaaaattcctatagaaattaaatcctttaaaattcctatgaatttcctttgaatcaaagggggcctaaaaagaataaagatttttaaacacacgggcataggaaaaaaatgtaggattcaaacgcctcgacatctcaaatcctatggattgggaagcacagaaaaactaaatgaatgattatttggataaaacgtaggaaaaacacaggaattaaaacagagatatagacatacaaaggtttttttttccaggagattgatcctcatgtaggaaatcctccaaaatttccatgattgagacaatcctaaggaatttcaaaagatttgaaagagccattcccttgttctaaatgaccatataggatagatgtctttccataggaattcaatccttgaaaattcctccagaattgctttgatttaaaggcccaaatttagatatggttttatacaattatatttgtaaaactagaagaaagagttgtatctcaaatacaattatgagaaaagaaaattatcttgaatcaacatttatacgatccattgatgctacagctacaatgtggcgtcactatgggtatacacatatctttagaatactatatctacacggcttcccatcaatctgcatttgaccacagggaaggaactgtccaaaatactttaagaagcactttaatagtattcggatgtattgcatatgttgtgatatggtaccataataataccataattggactacatctccatttataacaggggattcgaatgagccatttaaaatgcaggcgataaattgaagccaacaacattgtgtccattgtcttcgatccctctgtcgatctctgctgttccagcctagaggcagagcagcagcagccgttgtcagatatgggaagtttcagtcaccagaaacattccatttccgtatacctcgtcctcgtgtccgccgtcctgctgctgaactcaaccctgggtttgtgtggctgctacaagcgcatctttagcttcggcgactccatcatcgacagcggcaacttcgtccacatcgccggcgaccatccgtgtccgttcaaggaaccaccgtttggcatgacctacttcaagcaccccagcggccgcatctctgatggccgtgtcgttattgatttctacggtgagttcataggcccatcaactcctccctgactgttccaaaatttattttcccatgtatggtcaaaattgatttttcttttgtttacagtcagggcggatcacacagctaggatagccaatattttcgtaattcaacaacattgaaaatcatttgtccatgtttttgtccaggtttttgaaaatttctagatccgttattgtttacatagatagtaccctctttaatcatgaaaatatatcattttgattttttttaattatcaaactacatgcataa

SEQ ID NO: 94196 - DNA, 4087 bp, Oryza sativa
aaccctgggtttgtgtggctgctacaagcgcatctttagtttcggggactccatcatcgacagcggcaacttcgtccacatcgccggcgaccatccgtgtccgttcaaggaaccaccgtttggcatgacctacttcaagcaccccagcggccgcatctctgatggccgtgtcgttattgatttctacggtgagttcataggcccatcaactcctccctgactgttccaaaatttattttcccatgtatggtcaaaattgatttttcttttgtttacagtcagggcggatcacacagctaggatagccaatattttcgtaattcaacaacattgaaaatcatttgtccatgtttttgtccaggtttttgaaaatttctagatccgttattgtttacatagatagtaccctctttaatcatgaaaatatatcattttgattttttttaattatcaaacctacatgcataatttgtatattttcaataaaagattatttgatggaaaaaattaaaagcttgactttatgtttagtaactgaagagaatatacagtagagcaccattaattcgagtagtagtgcacatacccaatacagtagtacattttttagatgatgatactgtgtgtagtacatgttttttttttttttgacatgcccaccatgtgcttgcgtatatatgttgcagcgcaagcactccagcttccgtttgtaccaccgagtttgcccgagaaggacagggggcagttcccgcacggcgccaacttcgccgtgttggcctccacggcgctgccgccggagtacttcagaaggcggaaccacaccgtgccgatgcccttctccctcgccacgcagctggagtggttcaagcaaacgctgcagcggatcgctcccggggacggtaagtagtacgtggtacttgtaaaattaacaaccaaaaaaaaaaaaaaccgtgtgcacgggcaacagtgcacactgcacatacacagctgatcaatttgtccgtttcaagtttctaaaatgttgctcctgagtcctgattttaaatttcagctgctaggagagcactgctcggtgagtctcttatcttgatgggtgagatcggcggcaacgactacaacttttggttcttagatcataaacctcgcgaggttgcttaccagttcatcccggatgtcgtcgccagcatcagctccactgtccaggtcggcacaaaccatcatatcctgatcgaaccattgcatatgtacatgaaaaacatgaaccatcccactgacgtagcatgcaccatgtacatatacaatcgcatacacgcaggagctcatcggtctgggcgcgaggacgatcatgatcccggggaacttcccgaccgggtgcgtgccggcgtacctgagcgcctaccggagcggcaacccggcggactacgacgagttccgttgcctccggtggttcaacgccttctccgccgcgcacaaccaggcgctgctcaacgaggtcagccggctcaaggcgcagcacccgggcgtcaggctcatctacgccgactacttcggcgccgccctgcaactcttccgtaatccacgcagattcggtgagctgccgcttgtttcgatcgcatcgcatcgttaaaaaccgcaagatgcgtacgcacgccacaccacagtactgatatatggaatatcgatctgtttgcgattggcgtgcgtgcaggtatcaatgatcctctgctcgcgtgctgcggcggccatggcccgtaccacaccggcgcgacgtgcgacaggacggcgacagtctggggtgatccgggcagtttcgccaactgggacggtgtccatatgacggagaaggcgtaccatgtcatcgccgacggggtgctcaacgggccgttcgcggatcctccgttgctgcatagttgctagaattgtgctatggctgttccagaatccagctgactactgtagctgagatctccggagatcttttgctggttttattgatgaatttgaaatggaggaaattatttcagtttacttagatgatttcgaggagaaataagttcaagtaatgtcatgctcgatgctattatcgctttttttttaaagaaaaatagtacaaacgtaagcgctcacaatgcgtgcacattcaccatgacgaatacaaacgcacagccctaaccctataagcatctccgaaaaattggaccgacatgtattgagaatgacgaagtcaactcaggcatctgctttgaaagactaggatgacatatcttgagaatgactaagtcgttataggtgtatcactgatgacaggtacttctcctaccaccaaaagaaaaaagctgtaaatacgaacacccatgtcaaatctagaatttgaatccgagtatggtggttctaccgtaagaaacctaaccaccagttgagctattctcactttggtattatctcttgatttcaagcgttgatgctgcactttacacacaaaatgacaaagaaatggtgatctaaggtcccgtttaagttgttaactatgaacacgcaaaatgagaaaactattaatgcatgattaattaatttttaattattttaaacttttaaagaatttgtatatgatattttaaagaaacttctataaaaatagttttacacgaaatacaatgtctaaaaagcgtgttaaaaaaccaagatagaattggtatcttcatcaccaaaataatggggcgtacagattgatcagacccttcaattaagcccacaatgggcctactccttcgaagagcccattatgggcctacacaactaagcccattaaaattaagcagggccgagacccatcgtacacgcaaaaccgaacgagaaagctttgaaaccgtgcgaccctgaagcccgcggccacgatgcccccgccgtggccgccggccgcgccgccgccggcctgcgcgcgctcgctcgctgacctcctcgtcgcgctctccgccgcccgcgcgctccccaaggggcagcagctccacgggcatctcctcaaggcaggccacttctctgccacggcctcttcccacgcgcccatcgcccaccacctcctcaccttctacgcccggtgcgcgctccccggagactccttttgcgcattcctcgacctccccgcgccgccatccccggccgagtggtcctccctcatatcctccttctcacagaacggcctccccgccgccgcgttagacgccttccgccgcatgctcgcggctggcgtccccgccaccgaccgcaacattccctccgccgccaaggcggtcgcagccgcggaagactcctcgaaaaagcatcttgccccgcacgcgctccatggactctccgccaagacaccgttcgccggaaacgtgtttgtcgggtcgtcggtgcttgacatgtatgccaagtgcgggcaccttgccgacgcccgccggctattcgatgaaatgccgaagcggaatgtcgtctcctggtctgctctcatatgtgggtacgctgatgctgggatgcattccgcggcgatggagatcttccgcttagcacttgaggaggcagtgccggttaatgacttcacagtttcgtgcattcttcgcgtgtgtgctgcagcaacactctttgagcttggtgctcaggtgcacgcccgatctataaagacagctctaaatgcatcaccgtttgtgggtagctcgcttgtttctctttactcaaaatgtggccttgtggagtgtgcataccaggtgtttggtgaagcacctgagagaaaccttggaatttggaatgcggggctcaatgcatctgctcagcatggtcatactactgcagcatttcaacggtttatggatatgcaaaatgctggatttcgtcccaactccatcacgttcctgtctttgatcactgcttgtagccatgctggtcttgttgatgagggaaagagatatttttccctcatgaaagagtacagaattgagccgcaggctgagcattatgctgcaatggttgacctacttggccgtgtaggacgtataagtgaagcactaggccttattgagtcaaggggatcctctagagtcgacctgcaggc

SEQ ID NO: 94197 - DNA, 2564 bp, Oryza sativa
ttttagtgaggctgacaaagaacctttgtatgagcttctgaaggtatataatattattatttttattcctttatgtaatatctttgacttctctggagtgatcttgcaaatactaacatctgaattctatcttttgcagatgaaattcaacttagatctatctgaacctcatgttaaaggctgtctggagctactattttcgtcaagctataaaacatttcaccatagatgctatactcattatctcaagtctggtggtggggacagtgctcgtaacagtccatatgaaccccttcgtgacagacctggttattggacttggctttgtgatcatttcgaaacagaagaatttcaggtatatgattctttgcatgctttatcttatatctgaatgcatgcctcttaacaactagctaaatttatttcttcttcatattaactaaggcattttctatgtgttcctttggctattcttgccatatgcagaaaaaatcagttatagggaaagctaatcggatgaaactggcatatgttcataaaaagggaaccaaaccatttgtggcacttcagcatgaattagtaagctaaatttcatctattttccttatgatttatttttcgtaagcatctgtttaagtaaatattatgtcttggcagagttgtgatcaaatctcattgtacaaggaatgctattgtagtgacaaaggatgggcgtcaagagatgctagacagaactatgtaagtatcattctaacgagtcattttcactatagttaagtgtcttcttgtgctaacaaaaacttttgatttttttctatataaaggaaacaatgttacagatgcagcatgaaaatgagcaagaaggtgcaatccagctgacagagcaacaaatttgtgagaaggtgcttgggaaggcatatggatatattagagggagaggtcatggtccgaaacctaatagaagagcttcatcaacttcagcaaacacctatcaacaaatggaagaagaattggcttctacagaacaaactgtggcagttcaacaaaaccagcttgcagtataacaaaatcagcttgaatctcaacaaaagcaacttgattggttgcgcagtgtcgtgtccaaacttgctggtattccacctcctgctatggatgataatgatgcctcaggaccatcccacacaaccacaacttcaattgatggatccggtatgcaacatttttttttcttctaaaagaaaagaagaatatagtgttataatacatagaaatgacaattaacttttgttaaatttatttgataggttcactggtttcggatggaatgtcaaggagatcatgattttgaagatctttgattaggaggtattactactagaaattgattgcccaaaccatatggaaacttgagcatgcatgtagtactgcttctataaattcatgtttgaattgaatctctaatgtatacgctagaattctataaattttccaatcgactttttatgtcctgtttctattaaaactccactgtagtcatagcactgttttgaatttttttcaattaaattttagcaatatttcccatactccatgcatcttaaagttgcaactaaattgaaacttcgttcctatgaaataagttcatcattaacaattttgaagaagacaggattagaggatcgaccagatcagcatagtagtgaatacgaacattttatatatgtgatccagtccatgacattttctaatttccctgagattagctttttttcaggaacaccgcaacgtaatctcctaggctattacatcatcttgacaatactcatcatggtgtttcaaaacaagcatcaggttgcgatgctccaagagacttgtataaactcaaccatagtactacagaaattttgtttactttgtggtatagtgattcgtagttctgttcagatagaagtgattcatatttttcttcaaatagattactcatttagaagttgacttttgggtataatgatttccttgtaagactgcacatcagttttaatgtgttaccgtgtcaagcatgtactctaaggtgaagcttgagatgagtttattgtagcactattctgcagttgatgctatggtaacctagttgattcatatatgaattgcacatcaaattgccatagtactgtagtttctattaattgctctgtctgaattgaattatgcagtgggtgaacaaacctttagtcaccaaggtaattaatgttctaggtggcaggatgtatgtacttaccaaggagggttggacacaacatacttttagttgccaattacttggtggcaaattataaatagtcaccaagcaaccttggttattagatatttttagttaccaagtaccacttggttctaaaaaatatatagttaccaacattttcttggtgactattgcttttacatattgttaccaactatggttggtaagtaattatattatgtttagcaaccgaggagatcacacgttggttacaaaatacatttagcaaccgggttgtagccaccaagatgcgcccacggtt

SEQ ID NO: 94198 - DNA, 714 bp, Oryza sativa
ttatgttcggatgaaattccaaggaaacggtccttaggtacaagagcgggaaaccgtacacccagtacattccccggtccgcggttttggaaattcatttagttcgcaagcaccgacccaggtgtcgggttttccaagtcttttgtaaaacccaagttttacccaagaagttactcagattttaagtttgaaggcgaccgtcggtactcgcacagagtgcacgaatatcgaggcgcaactagatggttacaagggaacatggtataacaattaacaatggaaggatcaaatgcaacaagttaggtaggtctgccaatctgccttgcagacggaacaacagattaagtgcaatcctatcaatgcataatattttgcaagcaatataattagatttcaaatataggctcaagatgttcaaaggtggcttgccttgctcgagatctggagcttgatcctcgaaatcctcgcactgcgggtcttcggactccgaaactacacgcaaaacgggacaactcaacaaacggtgaaaataaagccctattaatgacctctaagcgtgccattagatagatctcgagatttgagaaattttggaatttgaacggagtcaaacggatttacggttgggaagatattgaatttctaagattattggatttttggtctaaaggaaaaggatttaattaaatcctttttggaaaagaaaagaaaaga

SEQ ID NO: 94199 - DNA, 3056 bp, Oryza sativa
atatgatggagcatttgatcgttcacatcgtccctcagattattgaacttggtccattatacttacatcagatgtgggcctatgagcgttacatgtcgatcctcaaaggctatgtacgcaatcgcgctcacccggaaggatcaatgatagagggatacacaactgaagaggcagtcgagtgttgtatggactacataaaggatgctaatgccattggcattcctgttcatcgacatgaaggtagattgtctggaaggggtactgttggtaggaagcagttcttcgataatgattacaaaaaggtgtccgcggcacacaacagcgttcttcaacagctcgctatcgttgagccattcattgagcgacacctagaagaaatcaaagcctgcttcccagggcggtccaatgattggatatcaagagagcacaagcgtcgctttcctctgtggttgaaagatctaaacctgccagttggtgattctgtggaggaacttactttacaaagattggcatgtgggccttcaagtattgtcaattcatggcaaggttacgacatcaatggatttaccttgagtacgactacgaaggacatgaaaagcacctcacaaaacagtgggatccgtgtcgaagcgattgacacgagtggagaaaagaggtcgtattatgggaccattcaagaaatatgggaactggactatggcctaaacatccagatccctgtgctccgttgtgaatgggttaaagacacaataggggtttccgttgatgactacgggctaacgatagtcgatcacagtaaaacaggccacaaggatgatccatgggttttagcagaacgtgtggctcaggtgttttatgtgaaggacccttcagatgaaagaaaaactattgtcatatccggaaagcaacagatcgtcggcatcgacaacatcgaagaccccaatgattacaaccagttcgacgatgtaccattgtttactgatcttcctatgcgaattaagaaggttgagagaacaatcgatgaagcaaatatgtcgtacgttcgagcagatggtgttgccaaggttattaagtcatagttatttcgtaacctttagttctcattgtattccaaatgtacgtgcatgaatttaggtcccccttatgttgtaatcattagcaaatgtacgtgcatgaatttaggtcccccttatgttgtaatcattagcatgtaacatttgattacgagttttgagcaattttcatgagttttcttagtgccaaaaacatttggaatgtataattgtggcgaaatattgggaaaaaaatatatatggacagtttacttatagaggaaaaaaaatatgagtttttttggtaaaaagatctttctatgcggctggcttaacagcccgcatggaaagatctttttcgcatgcggccggcttaacagcccgcatggaaagatctttttcgcatgcggccggcttaacagcccgcatggaaagatctttttcgcatgcggccggattatgtcgaccgcatggaaagatatttttccatgcggacccttaagccgtccgcatgcgatgatctgcgcctatatatagggagcgcggggagccaaaatttctaagtcccggctcccgcgaaaccctagccgccaggctgccaaaatttcccaagtcgccatcgccgtcgtccccgccaccgccggctcctccccaaagtcgccccgccccacgccgccgccgccgccgccgtcaggacctctcccccctcgccgttgccgtcgccgtcgccaggacctctcccccctcgccgttgccgtcgctgccgccaggacctctcccccctcgccgtcgccgtcgccgccggcaggtcgccgtcgccaccgcacggaactctcccccctcgccgttgccatcgccgccgccaggtcgtccccgccgccaagtcgtccccgccgtcgctcggtaacatttacttttaaaaaaagaaatgtgaaatgtgcaattgtggattgtggattgtttaattgtgcatcgtggattgtgatatgtgcaattgtggattgtttaattttgagaatgtttaattgtggattgttaaatggagatttatgtttaaattgggacttatgtttaaattgggacttatgttaaattgggatttatgtataattgggactttgttaaattgagatttatgtataattgggacttttgttaaattggcagctatgttaaaatgtgacttatgtttaagttgagacttatgttatattgggatttatgtataattgtgatttttgttaaactgagatttatgtataattgtgacttatgttaaattggcacctatgtcaaatggagatttctgtttaattgtgacttatgctaaattgggacctatgttaatttgagatttatgtataattgggacttatgttaaattgagatttatgtataattcggacttatgttaaattgggacttatgtcaaattgagacttatgtgaaattgcgttaaattgggacttacgtaaaattgggacttatgtcaaatttttttacgtcaagttggaagatgtcgaacgaaaaggttccatcgaacgcaccaatagcgcctcaagaaggtaacgctcctcaaaattccggtagcaataagcatccaggcgcttctagtgaagaaacgtggcgcacaccaagtgacccgtttccaatggaaataacacaagtcgccccccgcgatgatgatccggactacatacctatcgaacaggccgtaagtgatgaaaatcgttagccatgtattattccctaactatgatgtgacatgaacctaatggtgtatagagttacctattctgtgcagatggtagtccgacgccgctcaaaacgtaaagccgggaggaacaggacagagcaagaagttgagatggacaccgctacgtctgcacctgaacgtacggagacatctacaagtgcaggcgggagtgggaaaaaaagacgtggtgagagaagcaagaataaattacccaacgaaacttacaacgtgattgctctcgatcagga

SEQ ID NO: 94200 - DNA, 1463 bp, Oryza sativa
acgtacggatacatctacaagtgcaggcgggagtgggaaaaaaagacgtggtgagataagcaagaataatttacccaaggaaacttacaacgtgattgctctcgatcaggatgggaagcccatcgagccaccgatagtgcggtccaagttcagcaacgcctgtggcactctagtcaggacgcgttgtcccattaatgtcaagttgtgggaaacagtggacgacaacatcaagacacttctctggaatgagttgcagaagtattttgtgttccctcctggatcagaggtcagggggagagattacgcacttaaaaagatgggagatcgatggcgacagtggaagtccgatctaaatcgggattatgttcagaagaatctcccaccgtttacggattatggacatatatcgcaggctgactgggacacgtttgttgcggatcgtacaacagctgaagcattggctttgaggaaaaaaatgtccgagctcgcgaagaagaacaaatatccccatagattggggtcgagcggatacgctggtcacgtcgatcaatggcgggagatcgagcaaagatttgccgcggccggtaagcccctgctggtagaccccatggttgaacgtagcaagaactgggtttgggcgcgcagcacaggtcaagtctcggatgagggagacatactattcgagactccagacatagaagaagtgactactaatttgcagcagatagtcgagaaagaaagatcaggacagttcgtcccacggagggagagagatcagcttactgcggcgttggggacggctgaacactctggacgtgtaaggggtttgtcctcaaagacaagttggaaggtcgggtttccacaagacgcaccaagttataagaagagagacaaatacaaagaacaactatcggacaagatctatgcgcaagtgaaggaacacttctactcgttggcagctgaaaacccgacagcatttccaaggttattccctgatagccagcaacccacacaatccgcacagcaaacaactaatgtacccagcagtgtaggctcagtgcagacaagtaccttccctgtggatagtataactggaccaactccgtgcagtctcgtcgtaccaatcggccgcgctggaaagactaaggaggttgcaacgggtttagcgatacccggacgtcaattccacaacacggcaatccctgaggattacgcaagggtacaggtcgccaaggtccatagcgaccacgtttccttggaactagacatacctgcacctgaggggattgaacttctcggtgatgcagtgaatcagtttatcttgtggcaccgcagagacataatcctgagcgcggccgttcttgcagcaggatcttcaaccccatcctcatcgcaggcaatgactgctgccgctcctgcaccaccgtcgcctcttgaaccaccgtcacctcgacatccgccgt

SEQ ID NO: 94201 - DNA, 1964 bp, Oryza sativa
ctgccgctcctgcaccaccgtcgcctcctgaaccaccgtcacctcgacatccgccgtcaccaccaccgcttaggtcaccgcctcgccaacctacaccaccaccctccccttctcaacaaccgcctctcccgaccccgcaaccagttcaagcctctcccacctccccaactaaacagcatgctcccccggctccgccctcagttcaaacctctccacctacaccccaatctgctttggtagaagaagtgcacataccagatggtactacatccgactctagaggatccccactttggaacctcgtcgtataattccaaagttgatatcgacatacgacccaaaggagattgacaaggacaaggagaagttcatgttttcagctttcaggaattctgagaagagaaaagaacttgctcacgtcttgtcagactcccagaagtcagtactagcggcccaagatgaagtgcaatcctggttatctgccgatgtgcctgaaacttatgagtatggcaagccattcttgccaacttatcttatgaacaagctaccatgggaaatgagggtaatgcacgaatggtatatgaaggcatctaggaaaggtctcggtttcataagcgtcgccgtcccggaaggcactttcatgagtggtcctaatgggatattttttatctctttccaagacctttacgccctctacaagctagataaaatggacgttaatctcgttgcggctttctgtctgtaagtctaaactctttattacatgttgcacgtttcattcgaaacaaataaaccaaatctcatttcttctttattcattgtacagtatgcaattccacgaagctgatagaactggagcaaaggttggatacgtcgatccaacaagaatatgcaaaacacaacacaccgtagagctgagacaggactgcgagcaattggttggcaagaccccggaagaaaaggaagaatatgtgaagacattgcacaagaggaagaagctagaagtagcaacatacttggcaatagcaatgttggcgcacgccgacaaagatgtcttaatggtcccctaccagttcacgtaagctctctcttctttttgtttaattaatttatcttcttcggaattttctgtctccaataagcctatcttatatgtagagaccactacatattattccttgtatatccgaaagaccaattgatcatatcattggaccccgcacactatgacaaggagacatttatggaattcctcactattttgaatttgtaagtgataaacatttcattactataaattgtttaggtcgatcaccagtcttctaactactaataaaacaattgtttccttcaaacagagcacacaagtactaccgcaaaagaggtggaccagtacatattccatcccagaagaagttatccgtcaggactggctggccggtactatcaaatttataccaatacaactaattatcgaatagtacatatatactaaatatatctactgagatcggtccccataattatatcgcagtgctacaaacaaccaccaggaaccaacttgtgtggttattacgtgtgcgagatgctcagagtaaatgggaggtacaaaacaaccagtaaccgagtaggtcatcgaactcttctctacaaagaaacccatctcgcacacacttctcactgagtaccgttttattttcctttctgtgtgcagatccccgaaatcccatatattgcacaacgattcaaccacactactatcttgaacgtggccgctgacctctgccgattcatccgtcgcgatgtctgcaacgcaagaggtctcttctacgacaaccagagtgaactcgcaatggacgacaaatttaaacctctcagagagtgggagaaagaacatatgcaataacatgtacactacttatacatatgatgaaaaaactgtgccacttgtattatatatttgt

SEQ ID NO: 94202 - DNA, 957 bp, Oryza sativa
cagttcacttggtaacagtcatgatgtgtataatagtactacagttctataatgagaacaataccacagtccttacatattttaattgcatatattgtgtataataataacaaaatataattacagaactacatgtcatagatgaccttgcgttcagcagaagaaccgaggccaatgatctgtagacaagaatcggtgatgctagcgattggaggttgagtgtatgggccctgtagcaggccaattgcaatgcccttgtatgcagcttctgatggatgaaagccatcccacgatgcatactttgatgggtcatcacacactttgtattcaccatatccacagcctgcagatgcagatacaccataaggtcctcctccaccacagcaagcgaccaaaggatcctcaattcctgaatcgcagtttgggagtgttaaacaagctaccaacaagaaaaaatgttctttatcaatgtagaaagtagttgaggagtgcattccatgacatgatgaaaatagaatagccaacctggtaaatatatggagggagagaaaccctaattagatgttatgattgtggtacaagcatatttacagaaagatttcctttgttcaagaaatgctatggaagtcgaatttaacaggtcaacagaaagctagtattttatttcttgtagtaacctacaaactagaattaattaatagtataaagcttacaaacagtaatgaactagctgcactcaccaaattgttcaggggaaagaaaaatttccatggcagctccatagtaatcagtatagatgatggccacatcggggtgaagcttgcgcaagttttccaattcatctataagaagtttgttgtggtattgcgagaactcattcatccacctaagacaacctatctctggctcataatcttccttcttatcacgggtaccgagctcgaattcgccctatag

SEQ ID NO: 94203 - DNA, 670 bp, Oryza sativa
tcacccaggggatttgacacttgcaagccacattgaattgttccccgacgggttgccgctcaccgagaatattccatcgctggaaatctcctatctaaatttgctttcaacttgagtagatgaacaattattccaagtgggaaccacgaatcgcatatactagtctccacatttgatggctggtgagtggtgtgacttgttaacagcaatagtctctcttttcactcgtcaaattcaaatgagtagtttgtatttccagaaattatagttttaaaactggctaaagcagaacattaggccagtgtcaacaaatgctaaggcaaaaggtgcataatccaatgtttgtccaatgtaacaactcaaaacttgacacaaatagttcctctcgtacaagttttgttctgtttggcattaggccgccggattcttattgtaaagctcaaatcctcggtatcccaacacaaggggtagaaaaaagcataaatcaaatcaagagaagcctcatctacaggtatgagttgctagtctgcaaaatggcctaactacgcatttgcaaatttgatacccttctcaattgaagccttgagctcgcccttaagattctccagtccttccttctcaaagtctgacagctggcccaacccaagaacttcctcaactccattcttcc

SEQ ID NO: 94204 - DNA, 682 bp, Oryza sativa
agctcggtaccctgttgcatctgatccttcctttgttaattgttataccatgttcccttgtaaccatctagttgcgcctcgatattcgtgcactctgtgcgagtaccgacggtcgccttcaaacttaaaatctgagtaacttcttgggtaaaacttgggttttacaaaagacttggaaaacccgacacctgggtcggtgcttgcgaactaaatgaatttccaaaaccgcggaccggggaatgtactgggtgtacggtttcccgctcttgtacctaaggaccgtttccttggaatttcatccgaacataagacaagtacgaccacatgggtggaatgggacacccctggctgagtaactagcttatcaggggagccttgatgccgagagacatgtggattcgtcggggtggtgtcggggaggacccctgggcttcctggcacagtatggtctgggacctaacctgttgtcggtctgggacccctctcgtcggcatatggtaaacctgtgtcggctttggaaatgccttgtcatgaaagcttggaggtctcccgacgtggctgatccccacgggctgggtgatccgggttagtaatgtcgtgtgggtaaagtgtaccccctctgtagaggttaacaaactgttcgaacagccgtgcccacggtcatgggcggatgtgaggtgat

SEQ ID NO: 94205 - DNA, 1692 bp, Oryza sativa
gaacgtttaactaccatataaagcatcaattttgatacttaaaggcccttttcaacaatactacatatttacatgctaattctaaccatgtttatatcacagattgcaacgacatgatgaatcaatctctgttcttagtcggagaaattggtggcaacgattacaaccatcctcttatctgtggggtatccattagaaagattcgcagcttcactccgagtgtcattgccgaaatttcttccacaatcactgtaagtaatatgcctatggacatacatacatacatatatataaggtgcctgggcctcaaggtttgaaatacactaattggctcaattttgttgaatgttttcaacttatggtttttatatacctagatgcaagaatttgattcatacccattactagcaataacacaactcaattcaaggatgggagacaacctttttttttacatgggaaaaaaacatcttgttatttatactttattgatgtcttattctatattttatggaattcctcttttgtagctgtgacacaacttcttatttactccctccatcccaaaaaaagccaacctaggaggggttgtgacccctcgtagtacaaggagtctagacaaccctctgttcagattctttgtactaggaggggttggttttttccgggacggagggagtatgtgtgagaactataaatgtcttgatcatatttgttgtaatatttgtaaatggatcagaatggtccaaagataagactttttggattgttagagatggactcacttcactcgtttgtataactagtcctttttcaccataacaagctaatgtatcacaacacggaacaagtgtatatggctataatgcaatagagttgagtttgtaggaattgatcaggcttggagccaagacgttagttgttcctggtaatctcccaattggatgaattccatactatctcatgatattcaagagtggtaagaaggaagattatgagccagagacaggttgcctcaggtggatgaacgggttctcgcaataccacaacaaactatccccggatgaactggaaaatttacggaagcttcatcctgatgtggccatcatctatgccgattactatggagctgctatgggaatcttcttttcccctgaacaatttggtgagttctgttaattcattactgtatctacactggtggagaagtgctttttggtcccggtttataacccccctttagtcccggttgtccaaccgggactacgaatccgggactaaagatcactatctttagtcccgggtgaaataaccgggactaaagatcgatccttagtctcggttggtaacaccaaccgggactaaagagggaataacagcagtacaggtggtcctctttccttttttttttcttttttattttctctcaaatcaagtgggatgcatatccccaaatcccaaatcaaagtaacatcccaaatctacatcacaaatctttaagttacttatacacataaatcaaatacatcgcaaatcctaaaaaaaattacacaaatcaaattacatcacaagttctacaaaattcatcgcaaatacatcacaagttcacatcgcacataaatcaaatacatcacagaatcatgcaataaatcacaaattctaaaaaaaaaagggtaccgagctcgaattcgc

SEQ ID NO: 94206 - DNA, 3056 bp, Oryza sativa
actatagggcgaattcgagctcggtacccttatgaattgtggttacttagtttatggcacaacaataaattgtgcttccaaagaggagaactgcaccaacaaaaatatggaaagcaatttatcattaccaagaaatagtggaatttatttatgaattgatgattggtggcttctgattgcactaaggaagactgtccatttcaacatccagggggaatattcgaagataacccgtgaaaactggacataagcattttttaatagagataagtataagcatgaaatacattcccaccaaatctactgtttaatgtaaaatttgtcttttggttcccccacatgaagttgagtttggacatgaatatatttcatgtttatacatatctctagtatttttttcattaatttagaaaacttataggttcggttttcacgggttttcatttatttgatggttttcattggatatcccccccccccccaaaatcccccacacccaaacatccataccatgatatatcaattaatcatcatgatacacgataactgatagtgtattttgttaaaattaaattcaataaagaaacattttcagacattttgcttatctcttcattttgcactacaaatccgaatgcattagtttataaatagacatactcatgggatgaaatcagaaattattaaaattatttgataagcacacatcatgccactgctaaatatttggtcagcatgatgtgattgtcatgcgagaaatggttacactcctcgaaggcctacaaaaaaaatctgaaaacaattaatatgcgagtggaaagattatgttgctacaaatctggtttgtaatatgcttaaaaaatgaatatgcagatattgatgaatgtttaactaccatataaagcatcaattttgatacttaaaggcccttttcaacaatactacatatttacatgctaattctaaccatgtttatttcacagattgcaacgacatgatgaatcaatctctcttcttagtcggagaaattggtggcaatgattacaaccatcctcttatgggcggggtatccattagaaagattcgcagcttcactccgagtatcattgccaaaatttcttccacaatcactgtgagtaatatgcctatggacatacatacatatatataaggtgtctgggcttcaaggtttgaaatacacgaattggctccaatttttgaaaattttcaacttcttgtttttatatacctagatgcaagaatttgattcaacccataattagcagtaaaacaactcaaattcatggatgggagagaacctttttaattttgacatggggaaaacatcttgttagtctataatttattgatgtcttattctatattttatggaattcgttctttgtagctgtgacacatcttcttatttatgtgagagctataaatgtcttgatcatatttgctgtaatatttgtaaatggctcagaatggtctaaagataagaatttttggattgttagagatggactcacttcactcgtttgtataactagtcctttttcaccatcacaagctcatgtatcacaacatggaacaagtgtatatggctagtaatccaatagagttgagtttgtaggaattgatcgggctcggagccaagacgttagttgttcctggtaatctcccaattggatgtattccacattatctcatgatattcaagagtggtaagaaggaagattatgagccagagacaggttgcctcaggtggatgaactagttctcgcaataccacaacagacttcttatggatgaactagaaaatttacggaagcttcatcctgatgtggccatcatctatgccgattactatgaagctgctatggaaatcttcctttcccctgaacaatttggtgattttcgttaattcattactgtatctactctgatttcttttgtaaagcttaacatattaattttagtttttagtttacaagaaaaatactctatatgtgtgttctcttaaatttgatttccttatgttgacaatgaatcgcttgatgacaaacactctatatttgttcttgcttcaactatttgtagtagacaacaaagtatctagaggagaggagctgaaaagcaatatataggcatctaaatttgatttccttagcacttctcaaaccaaagcaaatctttatctatatatgcctgtatcttagtcacagcagctaaataggatttctgctccacaaatttattaccaagttggctagtttatttttcagcacctcatggcatgcgctcctatgctaatttttgcattgacaaatcacagttttttattctcgttgatagcttgaataaaaattctctgattgtgtttcagaaattgagaatcctttggtagcttcctgtggtggaggaggaccttatggtgtatctgaaactgcaagatgtggaaatggtgaatacaaggtgtgcgatgacccacaactgtatgggtcatgggatggctttcatccatcagaagcagtctataaggccattgcaactggcctgatatggggttcatacacacaacctccaatcgctaccaccaccatttcgtgcttgcaaattacagagctcagttcttctgttgaatacaaggtcctctatgatttgtaattgtgtgactatattttgttattttcatagaatgtatgtgcggataaaaggttcatgtggaatcgtcgaaataagctggtattgtgctgaaatcgagttaaacttatgccatcgggtcttctaacggattagttctatgacttccatctcaagtgtgccacctcccacctccatgaatcaaagcacttaattttttttctattttccttcataagttgtgttttgtttagttaaattttttccatgtactgttcatcttgtctttagttcttgatggcttagtcaaagactaatcatttatatatctcagtagttcatttgtttgattatctaggttgatataatctaaatatattcgaccatgtatccattatgtatttaacaat

SEQ ID NO: 94207 - DNA, 605 bp, Oryza sativa
ttattaaatggtaggagacgtacccgtcgacagcgatgcacctatggtgacttcgtcaatcttcaggatagattgccggcccagtcttcaaagatgcttataggggtagggtttacgtgcgtactttcataggggtgagtgtgcgtgcattgtgagtatctgtgttgtaccgtgtaattctcaaaaaaaatattaaatggtgaaacaaaatatagttaagactctctgttgatacttagtaattcataatttctaaattaaattaataaaaaaaactccaaaaagtactataataaggctttggcgtgaattagaattagaataaaagaaaaacataatacttgtaaaattagtaacaatagcccatgcaacgcatgggttgttggctagtatttgttaatttcgaatagagattttataacagacttgaataaacgtgttttctccttaagcgtggggtggctataattagtaatgtcgctatccgctccatcgcatcccccacccttgaccgcctcactccaccacgtgcaccttcactccctcctccagtcctccgctctctcctccctcccctccccttccctcccattccatccccaccc

SEQ ID NO: 94208 - DNA, 610 bp, Oryza sativa
tgtgtttagtgtttgatcaggacttgtcattttccttttatttttaggaaagtgtgtttagtgttcgatcaggactgttaacagcctataggtataaatatgtacacccaaggtccctataaattatctctcgatcaatacaacttcggcgcatcgccaccctttttatttttcatctttctcgacgagctcttgtttcgagttgggctgcttcagcttcgatcaccgatgaggggtaaggcttgttatggctatttgtatcggcgaggctagggtctcgacactctaatcttgtcgttgtaatacatatttatcatatatctcagttaatcaaagtcgttgtctaggccataccatttctagggttttgttggtatcagttaaattgcttcatcgatctagattagctaaggtatctaccaccctgaaaatcacacaaaggcttgatttgttagactttatgcttcttttcatatttagtgttgcatcaatgggtttgacctactaagctgtgcttataatcataaactaacctgcctttgattgccattaaggtttcatcggggttttagccgataaggttatttagacgttgcatcggcttacaagg

SEQ ID NO: 94209 - DNA, 1019 bp, Oryza sativa
cttgatttaaccattagtatatcaacgaaaaagccaatatttattgtcttatcttctgaagcaaacgttgtcaatttttgtccaagttataccttagtatatttaagtatctaaagtagagtatagtagatcgatagttacgcttgaaggataggagttgtttcatttgaagtgaaggaaagaaaaggatgtataccagatagcttatgctatggatcagggtattgcttatttgcttatacttcactgaaataacatagtacacgtgcaaatgttgtagaatcgctgtgcttgttatttatatgccctgctgttgcacatagttgtatggtaaatgttggtgcaacataaaactaatgaaaagcaataaaactgatttaagaagcaacacttgatataatctttcctgtttccctattatccattgtagagaaccaacgtaaggactccttttttcaccaatcggccatcatgtatctctgttccaccttactgcactaatgaagcatcatgatggtttcaagtgggagattattccgttatgattctcccaaagcttaatccacataaagacaatcatcgcacaacactagtgcattgcaagggaaggaagcttggattactgggtctatgatattaatgattactagatgttaaatagcattgtctgtgcatggaaaggaattttgatcgatcaaactaacatatttgtatcaggtcttgaatgagatcaaacggctccaggatatgtacgagcatgaggagactagcatcaccataacaggccacagccttggggctgcacttgccaccatcaatgccactgacattgtctccaatggttacaacaagagctggccagtgtctgccttcgtcttcggtagcccaagagtgggcaaccctgattttcagaaagcgttcgacagtgctccaaatttgagattgctccgcattccaaactttcctgagggggttcaaactggccaaaactaggatacagcgatgctggcacagagctg

SEQ ID NO: 94210 - DNA, 2331 bp, Oryza sativa
cccccgtcaccgccgtggtgttcggcagcccgcgcacgggcgaccgcggcttccgcgacgccttccacaggctccgggacctccggatgctcagcgtccgcaaccggccggaccgcatcccgcactacccgccggtgggctacgccgacgtcggcgtggagctgctgatcgacacgcggctgtcgccgttcctcaggcgccacggcagcgagtcgcagtcgcacgacctcgagtgccacctgcacggcgtcgccgggtggcacggcgaccaccgcgggttcgagctggtggtcgaccggaacgtggcgctggtgaacaagttcgacgactgcctggcggacgagtaccccgtgcccgtgcgatggaaggtgcaccacaacaagagcatggtgaagggtcccgacgggaggtgggtgttgcaagaccacgagcctgatgacgacgacgacgacgacgacgacgattgatcgtaggtttcgatatgtaccatcgccatggggcgtgacaacttttgtcttctctatcttgatttcttctgataatagtggttttggtggtttttgttagttgtgtcatagattaaacttccataagtacaatatattagctacaaatttaatctcacgattctttgtggctccaattcataagacactaacgcatcgtactcctaggaccttacaatcttacaacgtgtttatgccatgtgctaatgtgcaatattcgcaaaggctaaagactcagagcgtgcagagtttaggctgcattcggttgcatgggttcccaacccctctccctcatttttcacgcgcacgctttttaaactgctaaacggtgtgtttttataaaaaagtttctatatgaaagttgcttaaaaaatcatgctggtccattttttttaagaaaaatagttaaaacttaattaatcatgtgttaagcgctgatttgttttgcgtgccggaacaaatacagcctagtgcaggcacaaaagcttgctatggttatcgtcgtcttgtgggtcacatttatctggggcttttaactatttgccactcttacgagtggtgcttaacgatttgccactaggcccacatgccatggacacatgagggcccacatgtcattgacagggtgtgacaaatcgttaattgtcatgtcatatgagtggcaaatagttaaatttccccatttatctctatcaacgattggaaagagaaatatatattgttccctccgttcaaaaattagttttgtattactttggacttctcaaagtcaataagacataactctgaccactttgcccataaatatttggcgttaaaaataggatttaatcaaaccttggaaactttggccatcaatttttacaagaataagtttataaaatctaagttcaggctattatgacattatttttcaaggcaaatctatacataacatttttttaagaaaaaaaagacattttagaaattatggatggtcaattttcacaaatttgaccaaataatcaaatattatcataaatgtttatgtctggacagaataattcttttgcatgaatgcgatactacgaaagtttttgttataacaaagttggccatgtcattttcatatgcctaaaacctatattccaaacgataatcatagttgaaattaaattatgttacaaattctaaaacatcacttgctgtaattggagtaagcatttaatacaataattaagcaccaaactctataaatagtgtgagctatatatatatatgaagaaaaagatccttaactcttcttctaccctaattaattgtacgttttacgcggatctagaagaagaaagaactaccaataaatcccttatattatattacatgtagccttatatgtactatcttaaatgatattagtggtggtggtgattttgccaccctcacctatctaacaagtgggggccaccacctgtaatgtgggtccatcgttgttgaccaacatctatttggtttatatatactatagatttagttctaatcaattcatctaatataattagagcctactataacacacgggtattttgctaatctactgaaaaatagtcaactttggaggattccaccctccaatgaagaggccctttgagtaacactagccttgttgatcatgttgaccctattcatgaatgtgtggtttcttttaaagacatgtgagattccgaggagcattagcttttccttttttgtgtgatagggaattttaaatcgattgggtaattgttatctctcgaggggatatctccttgtttcttacttcctttatttcaggttataagatgtt

SEQ ID NO: 94211 - DNA, 1181 bp, Oryza sativa
gcgaattcgagctcggtaccctggtgaaaaaaggagtccttacgttggttctctacaatggataatagggaaacaggaaagattatatcaagtgttgcttcttaaatcagttttattgcttttcattagttttatgttgcaccaacatttaccatacaactatgtgcaacagcagggcatataaataacaagcacagcgattctacaacatttgcacgtgtactatgttatttcagtgaagtataagcaaataagcaataccctgatccatagcataagctatctggtatacatccttttctttccttcacttcaaatgaaacaactcctatccttcaagcgtaactatcgatctactatactctactttagatacttaaatatactaaggtataacttggacaaaaattgacaacgtttgcttcagaagataagacaataaatattggctttttcgttgatatactaatggttaaatcaagaatgacatgaattacctgatatcttgcactctgcttattgtactgagattctggatcggcactcgtgtacacagacagccaccccccatgcacacaagggtcatcagcactgcctggccgtactatttctgaagcaggtaccaaggaaatatcaaggtcatccatccattctaccatccgtattgttccacgccatgccaccaccacatcccgtctcccaagcacttctttaccttcatctgtggccaccgcaacaaaccccatccaatttgactgcttgctccatgcagccttcgaccatgactttatcatgaatgcatcaggcaaactgacagtacacattgcatatatgaactttgtaatgacatacagatttgggtttgatacatccaccctgctgaggaagtccttgcgactgaagaggcaagacccagcgtaccttgatcttctctctctgtttaaccccgtgtaggctgcctgagaaagctcaccatagttgatgatgttattgcggagatcaacgtcaagaggatcaagtaaccccttccagtaactcacaccattgagctctctccatcttctggcgatatttccaagccctcttagggagctcatctttgccgtatatggttggtctgtgatgcttggtacttacaagccacaaaagcttgcaacttcatattccactgggcgtctggg

SEQ ID NO: 94212 - DNA, 1850 bp, Oryza sativa
ctagctggtcaaggtcctacgtgcaacaaggtaaagccacaaataaagctcagatctctacctatcacttccaaagtacaatattttaatacatttagcagctacctttaagtcttggcctaacaaatttcaacagatgtaccagtgcctgaaaaataaagctaatgctactttcagttcacattgcattgtttagctaatatccaaacagggccacaataatttttcattttgatctaaactgagttttgctgttctatttaagatatagaagtttatctttctcaaagtagatgacttagtaccaaagaaataatacaattataattgataatactatagaatgacagacattataaaagaaaagttatgacttagtaccaaagaaataatacaattataattgataatactatagaatgacagacattataaaagaaaagtttatatgattatagtgtaacggactgaactgtaccatgctgatgtattatggtgactctcaaactggtgtatggaaacttgtatgtagcttctcctgatacatcaatcattcttctatgcacaacgaagcatcagaacagtctcaactatcgtgcagtgaaactgttattcagattattaaactgagcctaacatatcatgaccgatgtcctgttttatttatagaaccatggctgagtccagctgtttcagcttgaaggttatggcatgtttttttctgtgccaaaacagcatggcaatagatttgtgtttcataccagccactgaacctgtaaagatctatttcctgaagaaatataatctaaaatgcctgaccagaaaaacatgatgaatgagaatgaggtacatcagaagatatatcaccagaaatccccacaagagcataccccatcctcaaaccggtgaaaccgacggttatccctgagaattacaatccttcctgtacacttactgagatacttaactgcattgtggcaatcatcacaaactcgtaggttcttcataactcgtattggtacaccttctggaacaatcagaagccccaaacctattgctagcctttcactatgatacctcattgttgcctgcttctcatccttgtccacatccttaaccactgcacttgtatctgctacataaccagctgcctccatcttctcaccaactttctccagcacattgtaaatttcgttgcttcttggatgtctcctgcaatttgacacaaaggtatgtacctcccctgcagcttccagccagcttagtccagtctctttacgtacacctgcatcacgcattgctttcctcgcaagtgctgcatccatatgccttcctgcagctgcatacgtgcttgacaagacatatgtgcaccagagcttcgtgaccctgtctcaaacaacctctttgcagcaattgctgcagcgtcagcatccttaaacatgcgacatgccataaggagtgcaccccagacatactcaggtggctccatgggcattgactcaataaggcctagtgcttcacttatacgtcctacacggccaagtaggtcaaccattgcagcataatgctcagcctgcggctcaattctgtactctttcatgagggaaaaatatctctttccctcatcaacaagaccagcatggctacaagcagtgatcaaagacaggaacgtgatggagttgggacgaaatccagcattttgcatatccataaaccgttgaaatgctgcagtagtatgaccatgctgagcagatgcattgagccccgcattccaaattccaaggtttctctcaggtgcttcaccaaacacctggtatgcacactccacaaggccacattttgagtaaaga

SEQ ID NO: 94213 - DNA, 922 bp, Oryza sativa
gcgaattcgagctcggtaccctttcttgtagtaacctacaaactagaattaattaatagtataaagcttacaaacagtaatgaactagctgcactcaccaaattgttcaggggaaagaaaaatttccatggcagctccatagtaatcagtatagatgatggccacatcggggtgaagcttgcgcaagttttccaattcatctataagaagtttgttgtggtattgcgagaactcattcatccacctaagacaacctatctctggctcataatcttccttcttatcactctcaaattgcatgaggtatgttggaatacatccaattgggaggttaccaggaacaactagtgtcttggctccaagtccgatcaattcctgcgaactcaactttattgcattacaagctatataatattatattgcttcgtgaaacaggagctcaaggtatataaaaagatgcaggcacattactcacggtgattgtagaagaaattttggcaataacactaggagtgaagctgcgaatcttttcaatgggcacgccgctcataagaggatagttgtaatcattgcctccgatttctccgaccaaaaagagagattgattcatcatgcccttgcaacctgtgccataaacatcgtttagtaatagctgaaagggaactttaactatcaaaattgctgctttatatggtagttaaactaaactatcttcacctactacttctagcatgttcgtttattatcctattataaactagacagatttgtagcaaacccacaatcattgacctggcatatttattttttttattttattctatgcaaccaattcaagggttaagcaattattcacgtggaaatcatatcatgttgaccaaatatttggcagtggcatggtggggtaccgagctcgaattcg

SEQ ID NO: 94214 - DNA, 611 bp, Oryza sativa
atacatccactgtggggtacaatgtatagtgccgtaggtcagtagcaacctttggcatacagattccatttaagtttggtaacatgtaaatcatctaacttcatgcatccagtagccttagaacaacaggaagaccaaacttaggctgaagagttaacaggtctacaggtgcatgaacatagttaggggaaagtgtgaatgagaacttttttaggatcatagccataactgacttggcttccaacatcgcaaaattctgaccgatgcaagaccttggccctattgagaatgccagtagggcatgtggaactttggctgctcttgtgaccccgttctgaaatcttaatggattgaattcatctgtatcgtcaccccaaatctccttgtcccggtgcataattgctgaaggtatgataattgcatggtctttgggtatttttgtttctcctactgtaatatctgttagaggttttctttgaaggaaaagagcaggaccatagagccttagggtctcaaggaataccattgacatctgcaatatatatatatatatatatgttatgttgtagttagccatacatgaaccattattattagaatgatacacatgg

SEQ ID NO: 94215 - DNA, 715 bp, Oryza sativa
cagctaaatgacagaaagcaatatatggttggtacctccctttgatatgctatttgttgtagcccatctgtgcatactcatgtaaaagtttcttatgaactgtacagatcaaagagttgaattcctatgtcaccttgaggaagacgtaagtcagcaagttctcttgatgaataaatatgtttcacagaacctctagtttagtctctgttgtattatatataaccaattccattgggaggaaacccagtttcttaaactgaaaaaaaatgctcttgtttataacatccgtacctcctgcaatattcttctgtaatgtcttttgttacttctagtaatgctaacacaaactatctgttgcagatatcaaagtagcctaggtaataataataagagggttgagctctttgatatgggcgctggaagtagtgaacctgctgccgaggacaacatccaaatagcatcaggtgaaaataatcatgtgaatctttttcaaatgtggttaatgccatgctaataatcttcttaaatgtaataattgccttatgattgctgagcataagatgcagagcttgcaatcatgttgagagtatatgaaattacaaagtattgtgatggatcgatttcttaacttttgatactataatgacaagtagactatattatagattttcttttgaacaacaaagtagagaaaacaattagtttcgaacatggt

SEQ ID NO: 94216 - DNA, 984 bp, Oryza sativa
cggcgcgtcgcaggggtggctggtcaccgtcgacgaggcgcccaacctccatctcgttctcgtcaaccccatcaccggcgccacggcggcgctcccgcccatcaccaccctccacaacgtcgagaggttcacgagcaaaaagggcaagacaagatacagggtgtacgacgacatgggatacagcgaggcgtcccttgagtactcgccggcgcatgcgagggaatgggtgtaccaccaggtggtcctctcgcgcagccccgccgaggggagcgcatgcgtcgcgctcctcctgcaccggccggacggctatgtctcgttcgcgcggctcggcgacgagcggtggacgccagtcgcgtacccgggacaggactgctccaccggctgtcgccacgccatctacgatgacgccgatggcctcttctacacgttgcggtacgacggctccgtctacgcgatcgacgtccctcgcgccgcggccgcgttgtcgccgccggcgacgagagaggtcatgcggagtgtgacgaacgcggacaacggcagcaagtacctcgtcagggtgccatgttccggcgatctcctgcaggtctggaggttcgtcgactacgacgacggcgacgaagtcgaagaggatgaagacgctgaagattaaccactcggcaccaagcacctgcagatcttcaaggtcgacggcggcgagcagaagctcgtggaggcgtcggcggcgagcttggaggatcatgtcctcttcctcggtcacgggttctcggcgtgcttcccggccgagcacttcccggcgttgaagcccggctgcgcctacctcgccgatgaccacgaactcgtcagcgtgagtaagcattgccggcgagacattggcagatgggacatgaaacacaggtcagatggaaaggctctccggaaaaaaaaacgtggcggcgccgtctcagccttggctcaactggccatctcctgtctggatcacgccaa

SEQ ID NO: 94217 - DNA, 621 bp, Oryza sativa
ttttttttcaaatacacccctggtttggattgctgtcattggaagcgacttggaatttctcaaaattgctcgaatgaggcgcagattcagggttggattttagtgaactctacaaaattcatacaacaaagtttgaacgaacggaaaagggagtgtccaattctttcaaagtgaatttacagaaggattttgatggccgccatgggtgctcgatccatcggtgcttcgccagctgtgcgaggaagaagacgacgacgaagactagtaggacatggatgcatcggctacgtgtcgagctcgaggggatcaggggacgatgaggcagaggccgtcttcttggtcgccgtcgtcttcctccggaacggccggcacgccttgacgctgaggtcgacggcggcggcgagcgccacgaacatggcggcgtcctccatgcacgtgacgtggcgcatggcgagctgcacgagcggcctgctgctccgggactccccctccacgcggcagctcatcacgaacccgccgccggcgcacgcctcgcccaggctcgccgcgcagtgctccgccccggcggccagcgccggcgcctgcctgtccatgtcgatggcgaactccccgcccctgtcg

SEQ ID NO: 94218 - DNA, 2500 bp, Oryza sativa
tatgacgggaactaattggtctacattggaaattctgcttatcttgtacggataccatgggaagccaaaggagctaaagatgacatgggatcttatgcaaggtctccctcatattcgacccaaaagctttatactagcaattgaagcatttggaaaggttggctccatcgatcaagcagaagagatatggggaaagtttgaatcaacaagaaagccgaagctgacagaacagttcaattccattttatcagtatattgtaggcatggtcttgtggataaagcatcggctgtgtttaaagaaatgagagcaaatggttgtcagccgaatgctatcacataccgccacttgacgttaggctgcttgaaagcaggtattgttaaagaagctctgaagacgatggatatagcaaagaaagaagttgtcaccaagaaggtgaaaagttcaacaccatggttggagacaactcatatgatacttgaaagctttgcagaaaatggcgacttggtaaatgcaaagagagtttttgacgaactgaatgaatcaaagtactgtaggaattcatttgtgtataatacccttcttaaagctcatgtaaaggcaaaagtttatgagccagatttgttaagagcgatgattttgagaggagcgatgccagatgctgaaacatacagcctactgggattgatagagcagttcaagacataatgaacctgtacacaaactagctattgtagctgtgaaggagtttgaaatgatatatactgaactgagccatacaacaaccggtggtaacatgtgaacattttggcacataatcattcaatattccaattgtcatactgatggtatcgctggtattcatggtgcatgatcagtgtctgaagatgagcacaaatcattgctgaagtgcaggcctcgcagctacctttgttatcctgaacatctagcacaaggtaaaaacattaattattccaatatcttaaatatgttgttgcccaaggtaaaaacattaattatttcaatatttgaaacctgtttttctactatgtaagaagcatataagatgctaaactaggtcagctgaatcctaagaaccagatgttgtaatctaacatttttttccccacaaacccccacacctaaacattgcaggtgatgtacactgcattttcaaagtaggggaatagtgcaaaggaaaaattgcatcagatggaggacaaacacttccaagcaaacaaaggtagtcaggatattacaatgaccactgcttagtggttacacaacatgttgcaggtttcattgtgctacttcaaccatcttcacacctcggccccctgaaacacacatcgacctggtgtttttaatgtgcaaatgacggaacgagatataaaggaaggcaagataaccattataaagcttaaggaaacagtgctacgctgcccaaatgctggatacacaaggagtaccaacctccatttgaatggcagcaaatctagcagcatgcaagtctaacccaagcagcttgtgctctgagcatctgactctggagcaataattttaagataaatgcctgataccgagacatgtatgttgtagctagttgcatagcaccaatctgacattgttcttgtacaaaaagaatccatgcaaagaagttacaataaacagtggccatatgttccatatggtatcgagtcagtggatagattattagcagagactgatttcgtcaagtaatttcatttgcatcctgtccgggcataatcaatgtgcatcctgttgcagaggctggtacattgacaaggtgaccttcaaagagtaattcgcaaacaatattattatggagccatggggaatatatatgttttttttttgccaaaacaaatgttcagatgtacctgaaatgtaaatgattattgacaagtatacaattggtttatatgtttttgatagcttttacatttgcaacaaaatgttagttcatgacacacaggaactgattatgccccatgagaggttcagatcaaggagtctataatctgtcaggcctcaacataacatgatcttgtatgctacagtattcatttatggaatgtcactgcaaaatagacataaaaatacatcttaaaatggttaacaataacatgctgacacaaacttgaccacctgaatactgcaagttttgctctcattcaaaatggagctgcaatcagaggaaaacaaaggaagagacttgtacctgactctgagtaccagtgattttctgaactctagttaacttgtaatagtcatagtgtcaaatttaaattgaaaagcataatgcattggttcctatcttcgatctcaacagtacaaatctagctgaataaaaggatacacatgacttggctccacaagttttgtgagtttcagtaccaggaatcacaatagcataaaggtacatggtgcaaccagaatatctgaaactcattatcagaaacagatatcatgtcagaaaat

SEQ ID NO: 94219 - DNA, 4027 bp, Oryza sativa
tattttctttcagataatccagtcactacttttaacctatcaaatcctacatggtcctgactgtggattggattggattgtttggatataacacatggacattggaacttgtcatttcataaagggatagaaggtccaagtttagtatggaataaagggtgagttgagttagacatttcacatgaacttgactcataatttattttaattttattttttcttgtgcactggtaaacatctactactgctattacctgtactgctagtcctctgaaaatgggagtagaaaggttcttcaggacagacaacacacaattggcatgaagggcaggtgtaacagaaacagatgcttctgttgctgctgatgctgcatctgaatgattgtgttctatcaaccacggctataaatctctctctacctgaacccaactgcttcacagtttacatctagctcttcagattaggtactagcttcagtgttggatatgctgtgcttgttcaggcactggaagtgagaattggaggaaaacaaactgattgctggttgttgtttgcaacagtgtggcaaacaatgttcagcttgtttttcttcaatatctcaccttcaggttgattgcttgatggaatactttagttgagcagcacatgaacagattggcagctagtgttgggttttagcagctaggaccatatttatatgtgccatttgaaatgaggattaaagggaactgaaccattttgatgaatatcagaaggttcagtttcctctaatatctcgccttgaatggcccatccggaaaatagctatacccatcatatatgcactaaaatgtaggaatagaagagaaccagtttgtggccctcccaaattcttccttttattgaattctttgatttttgctgaaggcgcatatcaacctctcttttctcaaacttacagaattttatccaccaactcttttttgaatatcgtgtggaaaagcctactctttgccaccaagctcatttgaaatggtaaacataggttgagtttagaaaagtattttatttaacatgatgataagttttgaacaaaattcagtgccaattacaaggattaattcattaaacgttcagaagtttcaatgagttcggttataccatacttcaaacttgtgaagattttggagttacaccaactctaatatcatctaacatgataagaaatttttttgccagccttgtcagttttaagcatcttatttatatgtaaatagaaagaatacatatttagaacacggtaaaaaatggctcagaacttttaagtgttgctctattgatcaagctaaatcatacttacatatatattacagaataattgtaaaccttgaaggaaaaacatcatctctctgtttcctgattgccttggtcataacacaggcatagagattttgatcatgcatctccctaatgtcacaaaatgtacacgtataattactttcatgtgagtggcagtacgccttttgaaggatgtaccctatgttttctgagtatatacaaccgctgtgtttgtggatctgactcaaacaaaaagcccctcaactcaataatcctcaagcaatgcctccaaatttttcctcctcgcagcatgcttcagcttctccattgcgatgagtcctacttgcctcaccctctcccttgacaacccgaatctgaggatcatttttcaaggccaaatattataaactaataaatataccaagaaactattatgaatagtttgataataatggaaaagttttagatttttttttatggcgagcaaacttgactaggcagttgaacatgtacaggaccttggtccataagagctgaagaaataatacttactgtctgctaatatcctcccatgtatggcattgttttcctatgccatgatataaccggataatgtccctctcacgctcgttgagagttgagtttaaaagcttgttgacttcttcctggtattagtagaatgtttatagttaaagcacattcaatgattctctaaggacataaggtaatgaggtctggtcatccatataccagtaccaactcagagctataatatgtttgtggagtcaacttttaaaaacaaaatgcttggagtcataatgatcttttgtcttgtggatggattatttccaaaaataaaagaaagaacaggattatggactagtagcaattagtgcaattatcttctggaacaaatatctctgtggttaccttgagataccactcctcaaatccatgccatggatcatttgcgacattttgatcctctatgtactgagaacaaggaaagggcgaaaaaggtttaatctcgtggcacatttcaaaattgaaaatgtataatggtgtttcaaagtagctatatagctgcttacactgtgcagtgtctctccaggtaagccgtttaaggatggaaatgcttgttgatccaacgaaagaaccttgttcacagcctgtatttttcaaccagtaaaaatgtctgtgacaatgccagaaatatcaaaggaatttaacaaaagaagttccaccgagcaagatgaagatatattacctctgtagcattgagtactttcttttctgatatgttgagtgaccctgctatgttctgagaataaccaccaaaaggttatagcaaaccatcagagacgcgacattcaaattatataatctttttcaaagaaaaacaaaagtagcatggttaaaaatacaatagcagcaactagaagtactttgcagttcacagaactgaaaaccatcataaaggttggcaaactgtcatacctgcgtttttaattttaattttaaaaataaaaagaaacaatgattaaaatacacaaagaaaactgcaattgtcaatattttgtaattcatggaaacagaacttgccaaatttttattttgatagtgcagtatgccttacttctattgttggagcaattccttgaacttccaactcatactttgcaccacgaatcgcaatcatccgctcgtgcagataatttggaagcctgtatgtttttgaagttttaactaatactctagaaacaccctggtatcgatcgaaacagtgaaataaggacaatgtatcaggtatcgattgagttaatctctgactgtaattctgaacttccatacatttgcctgagcacaggatagcagagaactcttacctggcgtatccaccagtatacataagtggaaattctaaagcccctggatgcatcaaatttttcgatcccacggagtaaccctatcagaccaccctgcaaaatgtgattggatcgcaacacgttactacatgtctcaagcacacaaaatcctcctagtgtgtccaacagatgattggactgaacagactctgttagaattgcaaaggcagctgaattaactgattccattacctgaatgaggtcagccaactcaacaccaaggttatcatacttctgggcaatggaaatgaccaaacggaggttgctcattgttagcatctcccttgcaagaaacgactcgtgcatccttgatcgtagctcgggcggtgatatcttcagcgaatgcgccagctgtttgtatgagggctcatttcccagcttctctttcagcctggttcaacaatggaggaacaaaccatcaggatcaagaaagctaaaaaaaattatgaagaaatggcatacaaatgcaaggtcactgagtgcaatgcagaatagcaatttgaatggccattactgaaaaatcatacgaatcaaatcacttaaatcatttgaagtattttggtgaatttcatacaccgatcaatcgatcttcactccgaagcttaagctgacgatgaaatgtaaacaatatacttgaacagtttcaatggttttgagaggaaatgataattcaaatgaaggattgatcatttcatatttgcagtgtgtggcaatggaggcatactttgatctttgctgctgcagccagatgccatccttgatcttgtgggagaggtggacgacct

SEQ ID NO: 94220 - DNA, 1782 bp, Oryza sativa
tttttttctcaaacgcgcaaaaggattgcatgtcaatatattactccatcccaaaatgtttgatgccgttgactttttaaatatgtttgaccgttcgtcttattcaaaaaaatttaagtaattattaattctttttctatcatttgattcattgttaaatatacttttatgtatacatatagttttacatatttcataaagttattgaataagataaacggtcaaacatgtttaaaaaagtcaacggcgtcaaacatttagggatgaagggagtagaagaaaagaatatttgttacacaacacaattagtcagaccaactgatgccaagagaggaggtaaacaaaagaccaaggaaaaaaatacgacttgggtactatgactccaaaaggcgggaagggggcagagcccaccatggtggtcaagtcgtaaagttgagtcgaggtacccttggaccgacttgtcgacttggtcgactagtccacgacttgtccatgactagtccatgacttggtcatgcaaaaacaggggatacaatatataatttttactactattatactgggctaagaaatgtatatagtataaactataaactatggagtagcaaagcaagacaattagtcaacaataaaataaactaaagtactaaacacaataagccaattatcatggtgaattggtaatttgctacgactaattacgactaatttacgaccgattttacgactaatgtacgactaaccacgactaaccatgactatcacacgacttgctatttggtcgagtcgtggttctttagtcgactagcttgaccgactttacgactaatcacgattagtcgggtgacttgataacattggagcccactactctcccaaaaaaacccccaaaattagcaatgccagctaacgaccatagatggccctctgagaggatggactgcaggacctccgagactgaagataatgcagagtcgaaaaccatggagttccattccttccacagttgctaggagaccaagaggatcagagaatcgaagtcaggacggagatgctcaggcatgcatgccctaaacgaaggccaccaatcctggaggcagctaccacgggagggagaaatggcaacccaaccaagaggtgacaacactcggagccatacttgtcaagcgaacacgcaatcaggaggatgtggttcgccgtcttaagctcttgagcgcaaaaggggaagaccgagtgaccgtcaatgtcgtgcttctggaagagatcggtcgtccaacagtgtcactgaaatgcaaaccagaggaagaacttacatttagcaggatccctcgcatgccagagaagatcagcacaagcaaatgactgctggccataaaagaacgtctggtacgtcgaacgcgctgagtagcgctagtcacttgtccaacaccaaacaagacgatctccgacacccgacgagagctggaagtgagacactgcatcccaaatacgaagaaactaggagatgaccgggacaattagggtgccacggatgtcggaaacccaagaattgttcgtcaggccagaagcgaccgtgtacggacctcagatgcactggggcacgacgaagaggagatcaggagccaaggaagccattgagcggccatcaatccattggtcagtctagaagagcaccgattcaccatccccggcatgaagaaggtggacgcatcgaacatgtcggaaacagtccgctcgacgagggccttcaaaccatcacaataaggatgcccagagcgctga

SEQ ID NO: 94221 - DNA, 843 bp, Oryza sativa
cacacttggccgttaggtcatatcgacctcccggtcaccttcggtggatccgccaacttccgcacggagcgggtgaacttcgatgtggcggacctcagtctgccctacaacgcggtcctggggaggcccgcgttggtgaagttcatggcggcggtccactacgcctatctccagatgaagatgccgggccccggtggccccatcaccgtccatggcgagctcaaagtcgcgcttgcttgcatggagcagcgcgcggaccacctcgccgcggcatcaaagcccgagggtggcgacgagaggttcagcgcctccgtcccagccgccccgaggcagcgaatgatcacatgcgacgaggtcccgatcaagcaggtagccctgggcgacggcccgtccaagaccacacgaatcggtggtcttctggacggcaaataggaagacgcgctcgtctccttcctgcgggcaaacgctgacgtcttcgcatggagaccagcggacatgcccggggtccccagggaggtgattgagcactgtctcgccgtgcggccgggcgcaaggccagtccggcagaaagtgcggcggcaggccccggaacgtcaagccttcatccgcgaggaggtggcgcgacttctggaggccggattcatccgtgaggtcatccatccggagtggctggcgaatccggtcgtcgttcccaaggcgaacggcaagcttcggatgtgcatcgactacaccgaccttaacaaggcatgtgctaaggacccttaccccctgccacgcatagatcagattgtcaactccaccgcggggtgcgaacctttgtgttttttagatgcatactctggt

SEQ ID NO: 94222 - DNA, 690 bp, Oryza sativa
cgccaggtgcgacgtatgaaacgccatttcgacgggatagagcttcggcacgtgcccagacgggataacgcggtcgccgatggactctcaaggctcgcttcctcgcgagcccagaccccaccgggcgcctttgaagaaaggcttgcccagccgtcggcgcgacccgaccccctaggggagacggatgcacctgaacggcccccgaggcccgtcggagtccaggcctcgggacccgaggggagcgctcccagctcccctagattgattgcttggatcactgagatccaggtgtacctcgcagataagactctacccgaggaccgcgaagggagtgaacgcgtccagtgtatctccaagcgctacgtgctggtggaagggaccctctatcggcgcgcggctaacggagtcctcctgaagtgcattcctcgggaacaaggcgtcgagcttcttgccgatatccatgaaggcgagtgcggagcccactccgcctcacgcaccttggtcggaaaggcctttcgccagggtttctattggccgacggcactcaacgatgcggtcgacctggtccggcggtgcaaggcgtgccagttccacgccaggcaaccccatcagctggcccaggccctgcagaccatacctctttcatggccgtttgctgtctgggggctcgatatcctgggtccgtttagg

SEQ ID NO: 94223 - DNA, 1053 bp, Oryza sativa
aacatggtgtatatgttctattacagtaacaactctaagttacctactgatgcctcctccttgtcctccttgcaggggtggattcagaaactcttgacctcctaccctgtgctggccctcccgctataacacccacggtgctagaagtcgacgcttgctccacagatgatgactgttggggagcgacagcagcagccggtgcagcaccattagcatcaggaggtggcaaaggagcctgattgccactcccagcatcagcattgaccacctgctgctgtgttgctggtgcagaaggcgcatcttgtcttgcctgccttcgacccctaccccttggccggggtgcagatgaagccgcctggcctaccactatatcttggttttgcatcaaccgcctcaccatgtttgcaatgcctcctcttgtgtctggcctttgcagctgctgcctcaagctctcggtcctctgcgcactcggcctgggagggatttggatatcatttctggaggagttctcctcgccacctcctcttccataaatcggtgtgacgtttacttcgagcacctcgcccttgcagacagggcaatcagagtgctctgaatgtccatgaagccactggtatatgcaaggccagcagaagaggtggccacaaggggtaaccacaggatctttagctgattcaaagcagatattgcattcgaagctgccgttgcatccgcaaccgtcatccttcttggtggcatcactgccatcaccatcaagcatctgcctccttgatgcctcaagagaattatgagacctctggatggcccgcgccagattatcggcttccgggctattcgcccgtcggctgcggctcactggcccagtccccgccctcccattcccgacgccgtgttgatcgctcacctggatcaacctccgcagccgattctccggcgtcatagggcggcttgcagcagcaatctctgctccccttataagaccagtaggtgggattgctccaccggtctgcacaagcatttccaacgcagcacaagcaaaaatctgtggcagcg

SEQ ID NO: 94224 - DNA, 1132 bp, Oryza sativa
ccgaccagtctgcaacggcggtttcttcctccatggcgacggatctgccggaggcggccgggagccctactggaaacggatgaattggtttttttcttcctctgctttgcgattgcgattgcgatttgctcggatggttcggtcgcgctagcgcatgcacatcgacctatttaaaaggataaaacggccgagtccgagatcgaactgttcaggccatcaccgagtcagagactgaggccctgtttagatgagactgaacttttaagtccctatcacatcggatgtttggacgctaattataaatattaaacgtagactattaataaaacccaaccataatcttggactaattcgcgagacgaatcttttgagcataattaatccatgattagcctatgtgatgctatagtaaacattctctaattatagattaattaggcttaaaaaatttgtctcgcgaattagctttcatttatgtaattagttttgtaagtagtctatatttaatactctaaattagtgtctaaatatagggactaaagttaagtcctggatccaaacaccacctgaataatactggatcccggcctattccctggccggccagcccgggcagtaaaattccacgggccaattttccggaccatttggaagcccatcagctgggaaattcccggcccgatccacgtggaaaatctcgtcgcgtcgctcgcgtgccgcagcgacgattcccctctcgcgaacgaaggtcgccgccgccgccagtccttcccctccagcgagatgcagcgccaagcctccctcctccaagatctgggttgagctgctcttcacatcctctcctttttctaggttttctataggtgatgcacgggtttgtggttgagtcccatctctgctcccgatgctccaatcctcctctcctcctggattctgccgaggcggcagtggcatttgaaggcgtcgcgagaagacgcaggtcactctctgacacgtgtgtcccacagtcaactgtcgtcaaccgtactcaatgacgggtgggcccgagaacagggagtgcggcagatttcatggtacaggattttgtcaaatgaagcggcgcaggttaatcaggattgggtttgagtggact

SEQ ID NO: 94225 - DNA, 848 bp, Oryza sativa
ctctctcccatctcttgttgcgattcttggtgtttgtcgcgtgtcctctatgcgattctgcaacttgtttgcgtcatcattcgttctgctacaatctgtgatgctgatttggtgggggattaatcttgatttcttgcaagaacaaaccgtgaactgatcaaattccttgtgctaccgttgctgatttttgtgcaggccgacttggtcgggcgcctcgtcaaggcgtgcttcctcccgctgcagcgggagatccagttcgtggaggccgacgacgacggcaacatcggcgagggacaagaagtctgggattcgtttcagtaccaggggaggtcggtgcagctcctgagaaacgagctcgaggaccgtgtgggctacgccatcacggtgtgcgtccgcgccggccgccatgggcagcacagccctctgctcatcaacctgcctcacagccgggagaccctgcacatcgtcgttctcaggcgcaacagcgaaggttcgatctcgatatgcatgcatgcttctgaatttttctgaacatagtttatgctgttctgaaattgttggcaatgctgtgggcgatgtttctgaatggcatgcatatctttttcttgtcctttttgttagttcaacactgtagatctttccagttttcagtaagttttgtggaatttgtggaaaattcagtcatgtttttacttgttgagttaggacttgtctgaacaacattgtagtagaacggcagaagtgaacattgcagtaggaattgtttttacttgctgacaaatgtgaggaattttctgttgatggaatgctagtcaggcatcacaagaaaattgtttgcaattgatagg

SEQ ID NO: 94226 - DNA, 1382 bp, Oryza sativa
gggggcggtggagctcgtactggcaagctatcaggccagggaccccgacttctccccgtgggcagcgctggacgagttccctccaggaccgagtaccacgcgcgcgcgcaggtccgggactccgccgaccacatcgtccatagcttccagggtacggcccctcggctcgcgttcgccctcgactccgacgagtaggatggtgcggacgacgaggctagcgacccgggcgcgtcggagtgagcccccgggcccccgccaatcttgatagccctttttttttcgaggccttcgggcctccttcttgtatagactaacttaatctgcaatcaaataaagagaaaatttctgtgtcaattctatttgttgtgtgtatgaggcaaggatggtctgtgccgcggtccttctgagtcttggcttgaacaagggctcgtgcccaggtcccagcctcaaacggcgcgggtcggggctagtgcctggggagatccacatgtcgagactggccaggccgggagcgtggtgaccgagggttatggatgacccgattgtgggcctttgccgattcccccccggagttcaccacaccccggggcacggctcggttctgggccccttttggcgattttagccggcccgggccaccgagggcaggatcgagcacgagcgtgctaattcaagtcaagattcttcaaaaggaaacaatggcacagatacagtccttaggaaatcgaaaatgcttttattgaaatacggaagagaaaaaagataagtatatgcatgtggtagcccccggccaaccctgcacgcccgggggggtgcggggttggcccgagcccgagacctgatacccaacccccactaggggtagaaacgacgaaggtgttcgatgttccacgggttaggcagctccgtgccgtcgcccgtggccagccgaacggagcccggccgggggacaccgatcactcgatacggaccctcccacattggtgagagcttgctcagtccagcacgcgtttgaacgcggcgtaggacgaggtcgtcgacgcagagtgatcgggcccgaacgtggcgctgatggtagcgccgcaagctctgctgatagcgcgcggctcggaaggccgcgcgccgtcttcgctcttccaagtagtcgaggtcgtctctgcaaagctgatcttgatcagcctcgcaatacatggtggcccgaggggacctcagggtgagctcagatgggaggaccgcctccacgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggctct

SEQ ID NO: 94227 - DNA, 676 bp, Oryza sativa
ggccatggctggctagctgcgtactactccctcctttccaaattgatcatcatataataagatttaaaatttttcaaattgaacatcatataaccgcatggacacggatttcatcaaaatacaattaatgtagcatgggagaatgtgtgcatgctaatgtgtaattggcatagtgttttaatcgatgcatatattgtgggagaatgtgtgcatggtgtcttgattgatgtgatttaaattattcttgatcttggtgcataaacatatatgatgatcaatttgggaaggaggaagtactagctagggtttacatcacccttcaggatggttattgcatctactgttgacggagcttggggctcctcaccgggagaccgcgcaggcccccctttgctggttcggccgggggcgctcagtgaggttctttgccctcggtctggggaaagttcgcgagagagagaatgcacaagacacgggcgatgtagacaggttcgggccgctgagaagcgtaataccctactcctgtgttctggtggatctgtgtatggagaagttacaaagagctggggagcaagagagttcaggctctagaacccctctattccctccctggctctcgatctgatcccatccccttcttcggtgggtaaggtcttccttttatatctcaagggga

SEQ ID NO: 94228 - DNA, 6324 bp, Oryza sativa
  unsure (1)..(6324): unsure at all n locations
agggcgaattcgagctcggtaccctattttgctatatatgagatgaggatgatctgtgccgtggtctttttgcgtcttagcttgaaataagggcccgtgcccaagtcccagtcctcgaaaagcgcgggtcgaggctaatgcctggggagatccgcatgtcgagactggccagaccgggaacgtggtgaccgagggttatgggtgacccgattgtgggtttttgccgattcccccccggagttcaccacgccccggggcacggctcggttctgggccccgtttggcgattttagctgaccgaaccgaacccccgagggcaaggttgagcacgagtgacattatttcaagtcaagattcttcaaaaggaaaaaacggcacagacacaacctttagaaaattgaaactgcttttattgaaatgctgaaataaaggaaaaagggatatatgtgcatgtgtggtagcccccggccaatcctgcacacccgaggggggtgcggggttggcccgagccaaaacctgacacccgaccccccccccctttcaggggtagaagcgacgaaggtgttcgatgttccacgggtttggcagctccgtgccgtcgcccgtggccagccgtaccgagcccggccgggggacaccgatcacccgatacggaccctcccacattggtgagagcttgctcaatccagcacgcgtttggacgcggcgtaggacgaggtcgtcgacgcagagtgatcgggcccggacgtggtgctgatggtagcgccgcaggctctgctggtagcgcgcagctcggagggccgcgcgccgccttcgttcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatgttgaaggtcttggttttgaggcctttaaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatggatttgcttggcgtgaaactaacacgctctgcatcgccggaccagatcgactgcgtcattgagagctgtcggccaataaaatccttgacgaaaggccttgccaaccagggtacgcgaggcggaatgggctccgcactcgccctcatggatatcagcaagaagctcaacgccttgttcctgaggaatgcacttcaggaggattccgttagccgcgcgccgatagagggtcccttctaccaacacgtagcgtttggaaatgcgttgtacgcgttcactcccttcgcggtcctcaggtagagtcttatctgcgaggtatgtttggatctcagagatccaagcaatcaatctaaaggagcttggagcgctcccttcgggtcccgaggcctggactccgacgggcctcgggggccggtcaggcgcatccgtctcccctaaggggtcgggtcgcgccgacggctgagtaagcctttcttcaaaggcgcccggtggggtctgggctcgcgaggacgcgagccttgagagttcatcggcaatcatattatcccgtctgggcacatgccgaagctctatcccgtcaaaatggcgctccatacgccgtacttggcgcacgtaggcgtccatctgcggatcagagcaccggtattccttacagacttggttaacaaccagctgagagtcacctaacaccagaaggcggcggatccccagcccggccgccactctgagtccggcaaggagtccctcgtactctgccatattattggtcgctcgaaagtcgagacggaccatgtatctgaggacgtctccgttcggagaggtcagcgtgacccctgcaccggcgccctggagagacaaagaaccgtcgaactgcatcacccagtgggcggtgtgtggcagctgagaggggttcgtgctggcctcgggtattgagacagtctctggagccggggtccactctgccacaaaatcggcaagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgtgggtatcgggtcttggcgtcccggagggcctcactaacaaagtagacaggccgctgcacctttcggcggggccgatcctcttcgctagggtccgtacccccggggcgttcttcgtccgagtggcccctcggggcgcactcgtcttctgtgccgatgacctcggggtcggaggacgacaggagcggctttcccacagtggcctcggggccgtcctgggggtcgggggctcctggcgtcatcggacaagcgggcaaagggccaactccggtcgtcaggggccttaggccaccgttcggctcgggggcctcttctccctgctctctcccgggtcgaatcggtacagggttagcctcggggtcagagggcgataggtgcggcctccccgcagtggcctcggggccttcctgagggtcgggggcgcccagcaccgtctgacgagcggggagagggtcgactccggtcgtcaggggccttaggccaccgttcggctcgggggcctctcctccctgcttgctcccgggccaagtcagcacagggtgggggtgcgcggaatgaggattgtcttcatcgcgctccacagccaacgctgcactaactacttggggggtcgccgctaagtaaagtagcaggggctcatttggctccagggcgactagaaccgggggagagctgagatatgcctttaactgagtaagggcatgttcagcttcctccgtccaaacgaacggccccgagcgcttgaggagcttaaacaagggaagcgccttctctcccagccttgatatgaaacgacttagggcggccatgcaaccagtgacgcactgcacatccctaagtttgctgggggggcggatccgctctatagctcgtatcttctcggggttggcctcaatgcctcgggcagagaccaaaaacccgagaagcttgcccgcaggtacaccaaacacgcacttatcggggttcagttttatgcgggcggagcggaggttctcaaaagtttccgctagatctgagagtaaggtctcttggttgcgcgtttttacaaccaagtcatcgacatacgcctcaacattacgtcctatttggctacccaaagaaattcgagtagtacgctgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccggtttcgccaaccactccggatggatgacctcacggatgaacccggcctccaaaagtctagccacctcctcgcggatgaaggcttgacgttccggggcttgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggccatccgctgcctcggggcggtgggggcagaggggccaagcctctcgtcaccaccctcgggcttggacgcagcagcgaggcggtccgcgcgctgctccatgcaagcaagcgcgactttaaggtcgccacggacagagatggggccaccggggcccggcatcttcatctggaggtaggcgtagtggaccgccgccatgaacttcaccaacgcgggtctccctaggaccgcgttgtagggcagactgaggtccgccacatcgaagctcacccgctccgtgcggaagttggcgggtccaccgaaggtgaccggtaggtcgatgtgacctaatggccacgtgtgccccggcgtcacaccgatgatcggttgagacggctggagcaccatccccgaggccttgatagcatcaaaggccgcgggggaaaggatgttgagagccgctcctccatctatgaggacacgacccaacttcacgttgcagatggtgggggaaaccaccatcgcaacctgccctccccgggcaatgcacggtgggtggtcggtctggtcgaaagtgagagcaacctccgaccaccgcgcccgacgcatcgcctcatgggtaggggccatggccagaagctctcgcttcatagccttgaagctccggcgagagacgtgagcacatgctcctccatcgacggtggcaatggtggccccaggttcttggaaacctaggtcatcatcaccatcatcaatgtcaacagcgggggccttctgcttggcctcacttcgccgtttgccagaaggaaccgccggggacttgccctcacggcgttcctgcctcctgtcctcctcccatttcctcgttcgctcggccaggtttttgaccgcacgacagtccgcgagatcgtggagggaggtgttgtggacagagcaccacctgccggcgaggcgctccttgctgggtgtaccagcctcgttctttttgtcgctcgcaggcctcccctttcgagtggcccgcggagcgccctcgactgcgaggacatgaccctcgtcgccggaacggtccggcctcttcttcctcctcctgtcacgccgccctgtctgagcggcggatccgggggcggccgaagctgccactccggaaccggaggagttccaggtccaggcctcctccttacgagccactcggtccgcgagctgaaaaagctctgcggtagtctggggctctttgcaggcaatcttttcgagcatgcggttgtgccgcacaccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcttcacgtccgtgtcgaggtgacactctggacgaggaggcgccctccggtgcacggggagtacgccggctattacgccggcgctcgacgttgaggcgggcatacggctccccatgctgatccctccgagtcgacggtgtcgacgagggagtggcagccgaatgacgtgcagncgccgccgttcgccgggcccttcggcttgatgacacggagcccgtggtagcggcgcccgaggtctttgtggtggctgaccg

SEQ ID NO: 94229 - DNA, 1451 bp, Oryza sativa
aaaactaattaatatttgttacaattgtgaaactccttacttgataatataatatttataatgtaaatgcgtgtggtgatttaaatgctatatggctcaacgtaaagtgatgctatcatatccttgattgtatgtgaaaaggtgaatgaatctgcttgcttgtatatataatccccagttcgtgcaaaatcaataactgttcttgccacgatttttggctgaaggtttgttggtgcaaggtattctttcatcatatccttccacgaatcttctatcaactcctttatcccaatgcatgcttcatgtattgttgtaccatgctgcagcatgtaacactgaattgtggaagcatagtggtcccctgcttgttcacgctgaaacattccatagcatcatgttttagttatttataattgaagttgaagattaatatttataaaacataaatgaatatataggtgtaaagatagagagatattaaattacctttgttgaagcaatatcatttgagagccgtacacatgttgtgtaagacttaataagttttggataagtcaaaagataatcgagagtatcctctgttataaaatcacccatcccaactaaagaagcacatgctagttgaaaggcaccaacagtcattctggaaagttccaggtgttcctctattgtttttggaatgtaatgatcatcacgccattttatctcttcagagtatcctttaattaatatcttgaactacattaaagatgtaaaagtgtgaattcagtctgtatattggcataattttgaagaaatatctttttacccaaaaaaaagatgattaagtcattagaagatcgtaaaataaagtggttaccatagttccctctaagggcatccacaatgtggtgcaaaagtagtccataagcattataatatttcattcagccacctattacctttgtgcaactagtccgtatagaaaaaataacaaaaggtacccatatgcaaatagattacccatatggcggaataaataatattatctatctctactcctctctctttttctaatgataccttgtgtctatatatattgtgggattgctatagttaaagttcatttatatgtgtcccatctatatggatcattttgtcatatacatagttgatgccctagctaaggataaaataatcagttctctcctctaaaatacatatattctattaagcatatatataatcatatcaagatttatatgtaggatatgaccaacaatgaagtttctatacgatttgtaacaaaagttatattgtaatcaaggataaataactatatcattaaatttcagtctatttaataatccccccaactcccctccccctccttgttcccaaaatataaagcgactaagagttttacatggtcaccaaatattgtactttgacgggtaccgagctcgaattcg

SEQ ID NO: 94230 - DNA, 740 bp, Oryza sativa
atggtgggccggaaccttgggggccaacggacattccgaagactcgccacaaaggctctacagccaacaccaccggccgggggcacggagggctgatcttcacgtccgtgtcgaggtgacactctggacgaggaggcgccctccgttgcacggggagtacgccggctattacgccggcgctcgacgttgaggcgggcatccggctccccatgctgatcctcccgagtcgacggtgtcgacgagggagtggcagccgaatgacgtgcagccgccgccgctcgccgcgccctccgccttgatgacacggagccggtggtagcggcgccggaggtcttggtggtggctgaccgtccaccagcacccaggcgctgctgtgccgtcatgaccaagttggccacgtcttccagccatcgttgggctggagactccgggtcatggacgacaggcgggtgtcgtaggagcgcgccagcagcctgaagcgcaccctgaggcgtgctgccgtcgccgtagacgaggaggcgacgctccccatctcgccgttctcctgcatcacctgcgactggtgatgccacggatttgtcgaccctctgaagcgcctccccctgcttagggctttggcgcggaggaggtggaggagtacgagctcgacggcgtggattcggctccccgtcgtcgccgctcacactcggagagaggtcgtgcgcttttccttgctcggccattaggctgaacaagaaaaa

SEQ ID NO: 94231 - DNA, 796 bp, Oryza sativa
aataatgcttcaatcaaacaatcaggtggaacccagacgccattgtatttaactcctggcaacaatacggaactcctagttactggatgcagactcttttccgtgaatctagcggtgctatgtttcatccaattacaatcacttccagctactctggttctctggcagcatctgcaattacttggcaggattctgaaaatagcttcttaagagtaaaggcaagaaattttgttataaacctactctacatctgtaggagaattgcgtacctcatggattgatcttgaaatctcctgtgcagattataaactttgggtctgatccagtgagcctcacgatctctgcaactgggcttcaggcccgtgttaacgcactgggatcaactgccactgttatcacatccagcaatgtgatggatgagaactcttttagtaacccgaataaggtaagcaaacatttctgatttcttactggatgtaatgcacatatcaatgtctagtagagtttgtggttttggtcatctgaagccaaagctttgctcatgataaccaatgcaggttgttcctgtcaaaagccagctttccaatgcagcagagcagatgcaagtcacgcttgctcctcactctttctcctcattcgatcttgcgcttgcccagtccaaactcgtggcagagatgtgaagcaggaacacaaggttagcgacagaaacacaagaaatacacgagatgtgatatgcgaataccagaatgcagtccatatatgtgcatgtatcttgaagcactactgtatagtgtaa

SEQ ID NO: 94232 - DNA, 897 bp, Oryza sativa
tattagatatagcactacacgggtcgggtcacacaacacctagtatccatcgtttacggctaggactactggggtcaccaatcccattttctcccctagcttttgtttctgagtgtcaatgttggcctagtagagtgatttcgccattggtgtcctttccgatctcaatgctcaaaccatgctaccatgcattaacacagttgtagataagggtcccttgagaatacgcctcctcaacgatcaatggttaatggcggttaggctagaatagttaatagtgatatcatcattttagaaaatgatgtgaaactgggcttaacaacggtgacataatattttttttgtacccatcaactacgtacatgatgatcagaacatctaaccatttattcatcagaatatttgaacaattttgccatgagatctattccaattacctaaaatatatatatagttggaaacataacaagatcatatgagcaattagtatatatcttattactggaggggagaacattgcacataatattgtgacaacaagataaggaaaaacaattctttaaccatggaaactttctaatgaagcttaactaacgatggtttcatgatcagcagccaccatcacattattgaaaactaattaatatttgttacaattgtgaaactccttacttgataatataatatttataatgtaaatgcgtgtggtgatttaaatgctatatggctcaacgtaaagtgatgctatcatatccttgattgtatgtgaaaaggtgaatgaatctgcttgcttgtatatataatccccagttcgtgcaaaatcaataactgttcttgccacgatttttggcttaaggtttggtggtgcaaggtattctttcatcatatccttccacg

SEQ ID NO: 94233 - DNA, 603 bp, Oryza sativa
cctcagatacatggtccgtctcgactttcgagcgaccaataatatggcagagtacgagggactccttgccggactcagagtggcggccgggctggggatccgccgcctcctggtgttaggtgactctcagctggttgttaaccaagtctgtaaggaataccggtgctctgatccgcagatggacgcctacgtgcgccaagtacggcgtatggagcgccattttgacgggatagagcttcggcatgtgcccagacgggataatatgattgccgatgaactctcaaggctcgcgtcctcgcgagcccagaccccaccgggcgcctttgaagaaaggcttactcagccgtcggcgcgacccgaccccttaggggagacggatgcgcctgaccggcccccgaggcccgtcggagtccaggcctcgggacccgaagggagcgctccaagctcctttagattgattgcttggatctctgagatccaaacatacctcgcagataagactctacctgaggaccgcgaagggagtgaacgcgtacaacgcatttccaaacgctacgtgttggtagaagggaccctctatcggcgcgcggctaacggaatcct

SEQ ID NO: 94234 - DNA, 2006 bp, Oryza sativa
ttcagcatttcaataaaagcagtttcaattttctaaaggttgtgtctgtgccgttttttccttttgaagaatcttgacttgaaataatgtcactcgtgctcaaccttgccctcgggggttcggttcggtcagctaaaatcgccaaacggggcccagaaccgagccgtgccccggggcgtggtgaactccgggggggaatcggcaaaaacccacaatcgggtcacccataaccctcggtcaccacgttcccggtctggccagtctcgacatgcggatctccccaggcattagcctcgacccgcgcttttcgaggactgggacttgggcacgggcccttatttcaagctaagacgcaaaaagaccacggcacagatcatcctcatctcatatatagcaaaataaagctaacacaaaaattttttcatcatttctcattgcagattaagttaaattgtacaaaaaagaggcatgaaggccttagaagaaagaacaagaaaaaagttaagattggcgggggcctgggggctcattcaaatgcgcccgggtcgccggcctcgtcgccaccgtcgtcctcgccgctggcgtcgccctcctcgtcggagctgggggcgaacgcgagccgaggggccgagccctcgaagccgttgacgatgtggtcagcagcatccccgacgcgcgcgcgcgcgtcgtcctcggtcccgggagggaactcctccagcgccatccagggagagaaattggggtcccgggcctggtaactcgctagcacgagttcaaccgccccccgggcgaggtccctcgaggatgacttgatggtcttctcgagctcctcggggagtcgttcgaggacccaggccatcctgttgaggtgcggagcgaggccttccagattggtggggggcaccgtcgtctggcctctccagaggcctgcttgccgaccggcgcgcttcatgcgggagaccgcatcccaaagcatgtcgggcccaatctcgcccgccaagcgaagggcctcggcctccccggtggaggagtccagcgctcgctgcatttccgcgacggtgtgttcggcagctgcgaggcgggcggctaagtcgttttcgcccgcggcccccccgccgataggcgccctagcgtccagctccttttcccgcgcctcgaggtcagcagcccgctgctccagtgcggctctctcggcgcggacgcattcgagattgcggcgcgcctgctcctcctgtgccgcctcgcgaagggacaggctgtccgccagccgtttggtcgtggcctcagcctcctcgagagctcgctcccgctcagcgagtgcgtcctcgcggaggcggagcgcgcactcctcctcggcgcaggcggcctcatgtgccgccagcgtcgcctctcggagaccagcggcggcctcgcggtccgtcaagcccctctccacggcgccggcgtgttcttccagcgccatggcacgggcctcaagggcctcctcgcgccgccgaaacgccgcttcagtctccgttacccgccgctctcgggcagcggcggagtcaaggaccccttgggcggcgtcgagctttttcttcagctccgcctcccagcttgcgtgctgaaggcggagagtgtcttgcgcctcgatcatcgcggtggtagagatgagggcggccgcccgctcctcctccacctcacgggcgatctccgccagcgccgctttccgggcttcaagctccgagacatgacggcggtgagccttacggcccacctccaccatggcgtccaccgagcgccgcccctcctcaacacgcgcccatgcggcctcgagctccgctcgttctgcacgcagggcctccacttgggtgttgaacccatccagcactgcggtgtttgcagcggccagggcctgcagaaggggctcggcgctcagcggggcgacacaagatgaggagaagagccgccttggagaaaaggcgacgcggcttggccccccggaggatgcgctgggctcggggatg

SEQ ID NO: 94235 - DNA, 847 bp, Oryza sativa
cctcgcaggttgtgagcacggttctagttgtcaagcgtgaagaggaaggccatgttcaaaaagtccaacaaccaatttatttcgttagcgaggttttagccgactccaagacaagatagatatcctcaggttcaaaagttattatatggtgtcttaattaccgtcaggaaattatctcactactttcaaagtcactcggtcacggtggtcacatcgtttccactcggggatatacttcataaccgcgaagcaaacggacggattgcgaagtgggccttagaattgatgtctttggacatatcgttcaagccacgaacttcgatcaagtcacaagctttagctgatttccttgccgagtggaccgagtgccaagaagacatgccagaggaaaagatggaatattggactatgcattttgatgggtcaaagaggcttataggcactggagctggggttgttttaatttccccgactggagaaagattgagctacgtattgtggatacatttttctgcgtcccataacgtggcagaatacgaggcgctactccatggattaaggattgctatctctctaggcattcgccgattaatcgtccgtggagactctcagttggttgttaatcaagtcatgaaagagtggtcctgtttagatgataatatgaccgcttatcgacaagaggtacgcaagttggaagataaattcgatggacttgagctcacccatgtcctctgacataacaatgaggcagccgacagactggccaattttggttcaaaacgagaagcagccccttctgatgtgttcgtcgaacatctttacgaaccaaccgtacccagaaaagaaa

SEQ ID NO: 94236 - DNA, 824 bp, Oryza sativa
  unsure (1)..(824): unsure at all n locations
cacatgacagagtcgcgaatgccacacattagactcatcattctcgctaatatggttcacagcattatgattattacacatgtcattcaaagaaaagcggaacaagccttcgctgtcataacattttccaacaaaagtcccatatttagatacgacacatttattggactcaaacacaagtctaaaaccttctctacacaatagagagccgctaactagattcttctttattaaagggacatgctgcacgttcttcagctgcacggtctttcccgaagtaaacttcagatcgaccgtaccaacaccatgaacagccgcaagcgacccgtttcccatcaacaaggaggaacctcttcccgacctgataagaagaaaacagagaaatgtcagcacatatatgaatattagcaccagtgtccacccaccaatcaggtgaatgataaacagagagaactgtaggtaacattttaccgtaccccgatgttcctccgccctcgctaatgaccatgttggcagacttcctatctttgcgctcaggacagtccttggcccaatgcccagacttgccacacacaaagcaggctccctttgcctttcccttgcctttcttcttaaaattggntgcagccttgggtttgacatcaggcttgactttcttgttgttgggggatgcatgagggttcttcttctgtaccatattggcactagaaatttcctcaacctttttgccccggacgtcctttgccctcgctttctcctcaacacccaaagagccaatgagatcaggaacactgaactcttgtctcttgtgctttagagaagtg

SEQ ID NO: 94237 - DNA, 729 bp, Oryza sativa
gttattgtgtgcctcggctgattcctggacgagggttcacacacatgtaagcgtttggaattttggatagaaattccgggcgtgacaaagggtaaggttttggcactccattgcattatcttgaacccttgcaagagctctcacacccttgtgcacttagtttatctagtgaggtgttagagagtgagttaagccaatccaagtgcattgcttcattgttttagctagtgtggcacttgatcatcctcggcaagcatcctagacttgttactcttggaggttgccgcctcctagacggcttgtataggtgttgcccggtgacctctccgagaagattgtggaggaggcccggcaccgtttgtgagtggtttggagttcaccaccttcggagtgaaggaagaactaccccgagtgatcgaggcttggatagtcctctccgtgggtcggctcccgccttgcccaccccttgacgaagggggcgtgcggtggcttcgtgattgagcggtggagttgggctcgcctcaacggggattaggaaaccggcgagtttccgaacctcggtgaaaaatttcttgtctcttgtctcatttatttgttgtatttacatttgtgctatttacattcatagagacatatttgagcctataacacataggtttgcaaaacttaacttagttgcttagttaaccttgtaccttaccttgcctagcaacttaggttagttttgtt

SEQ ID NO: 94238 - DNA, 791 bp, Oryza sativa
ggctttttctactgcttccaacatttcttttacacattcagggacatggttttcgcacagaactaatatctatgatgttggacttaaaaccacgattcttgagattccctggtatgagctatattttccaattgaaaatcaagttcttgatatctgcacatatatgtcagacgtgtctgggataattgacttgatttccattcaaacaattgtaggaggttgcttcgtggagggtgaatggttaagaaacgcattcaggtggagggaatctattggtccatgggaagagaggcctggacactttggggatgtttggcattactggactgatgatggccttggatattatgagtttcttcaggtaccagtttagttgacattatttccgcccttcattttcttatcactccctaatcatatattggctttgaattctatttttttttctaatgaaaaatttgaactctacatcaaagctttctgaggacctgggcgcttgcccaatctgggtgtttaacaatggtaataattgccatattttttatatctttatcgccacagctgacctccttaattgctactaaactcttttatatatcaggaatcagccataatgatgaagttgatactgctgcaattgctccttttgtaaaagtatgttctgaactccctggtttattttctgttaagtcagatgcaccttgattcgctaaattgtttccactttaaaatttacctgcaacatcctagctatgactgggcattactatggatatggaatgtgagaaaat

SEQ ID NO: 94239 - DNA, 1127 bp, Oryza sativa
taatttagtcacataaaatctccatagaaaacccttacaaggtgacatttgtttcttacactatttcaattagtatataatattaatttttttatgtcatatgttctttttcctcttttatactcacagtaatatacgttgttattttttatcgttgcaaataaagtaggattagtaatacataaaaacaagtcctggaagcaaaaactactaaaatgtggttattttcattattttttaaaaaaattggatgcaatttttttatgtttgatcataatccccaatggtactgcacaagttttacttgaactgtgtggagagcaactgttgagttctccttttaggtatatgcatgatgttctcttatccgttatacaggtaattacctcaagttttataatgctataagggaggcctatccggacattcaaatgatttcaaattgtgatgcttcatcaagaccacttgaccatcctgctgatttatatgacttccatgtaaactactcatcctctggagttctgttatgcagtacttctcattctgtcaccaatgtcaaggtttttcccatttattaaattctaataattcctttttctctaggtctatactgattctaagactttgttttcgatgaagagtgcatttgatagatcatctcgtaatgggcccaaggtatgttgtatacctggactttcattgctgtgtgaaccttttcatttatggagatgcttgtaaaacagcactgtgaatctcccatctttcatttatattttacattaataatccaggacttctcttggtatattcgtaggatgaccttggccatctatgttttaacaacaattcagtaacatccacagttcatctatgtcacgtgtgatgattttttccatgttttggataattttggaatctcattgcttctcttgcttattcacttctatctttacagatgtgctgcctatttatctcttctcatccctattggccattaaatatatttcttcatatatgttttggttgcaggcttttgtcagtgaatatgctgtttggagaagtgatgcaggtagaggaagtctacttgcttcattggcagaagctgctttccttactggactggagaa

SEQ ID NO: 94240 - DNA, 758 bp, Oryza sativa
aattatgataaataagttagtacttacatttatgtacaatacagatggtggaaagagcttaacgttgaatccaacttaagcttcattcgggatagaatagtggaaatgcatttttggatgacaggagcatgctcggagccccattattctcttttacgaattatacttacaaagatgacagcatttatcaccattctagatgatatatttgatacatatgctacaaccgaggagagcatgatgcttgccaaagcgatatatatgtaagccttcattataatatgtggtaatattaattgcatctttattttgtagtagctagtttatactaagtgtgaaatttctagttgtatgtggaatcaatttcacaatagactaaacacataaaaagtaaattataacaaaatcatagtataaaggagccaaataactctatgaaattatatatatgcaatgcacatgtatatccgtacatgttctgatacttgtaatctattcaccatgttgtattaatatattaatcccatgtatgcctcattaattgagaaaaagagtaagcatattaaattttctcctatatataattaccaaagatcaaggaaaacaattttctcttagaaaaagaaatgcaaacatttaacctatctgggcattaattgtaacggttacttaaaacctcattgtaatattaacagttggtcatttgctgccatgcatgttttatgcaatatgaagttgatacataagttaaatcataa

SEQ ID NO: 94241 - DNA, 1252 bp, Oryza sativa
gggtgcgccagcctcacacacgcaaggacgtggcacgccccggtgtagatcccgttagacgtctcctctccgatcctggctggatacttggaggggatctcctccatcgccgtcaccagctccgcaagagaagacatcagcgagaactcatcgggattcgccgggatggtagacttgataccgcactccccggcgagctggtgcagaccagtatatgtgacccacaacgagccacggatttccgacaagttgttctcaagctccgaaatgcggtgctcgagcccctgctgttgtcgctcattgccggccaccagttccctcatcttctggaggtcctcgcgaacctccgctagatcacgcgccagccgattggcgcgctcattcgccgacgacgcagccgccgccctcgccttcgcgatctcgtggctaacaccgtgaccaccagcctcgaggaggcgccccatctcaacctagagctcctcccaggtgaggacggcatccggcgaaccacgaccagccacgagatcgctggctgggccgctaggtgtcgcctcatggctcctgggcacgaccacgacatccgtcgaggccacggcaggagatgcgctggaggtccctccagacccatcttacgccgccttcgcccgcgccgccctgggaaaggctgcgattgagacagagtttgacgaaatcacgaaacctcaaatttattcacttacttctcgctgagcgtcacaagccgctgtcgtcgcggaggcgggggagacgcgtccgaggcctggagtacaatcgatatgatgtgaggtggaagttttccgactacgtgatcaaataacgggtgaacttactgagggagtgggtatcttccgacgatgtccgactatagaggagaatttcctcccctttttcggaacgtcgccgccactcgtcgtggtagtggcaacagcagcgtcagacccctccttggcgaccttctctttcagcgacgccgccacctgatggtccacgagcgacccgatgatatcagtcagagggagagccaacgtttcatgaagtcataatgtgatcccggaagaaagatgcaaaaggacagctaagtacacttatattgatggcagcgtcgcgctcggctacccctttctcgcaaaggaggacggggacgttgctcgccgttgtcgggccgctgattatcagttggcggacgcggcgctccacggttgcgctattcaagcctgtagattgagaacagaat

SEQ ID NO: 94242 - DNA, 772 bp, Oryza sativa
tatcgtcggaggttgtcgaacgtttcccgcagatcgtcaatcaaggagtcgcttgccttggtcttgacaacaatgtcatcgacgtaggcctcgacattgtttctgagctagtcactaagtgcaccttagaccgtgcgctggaaagtgtttcctgcggttattagtccgaacggcatcttaacatagcagaataccccgaacggcgtgatgaatgctgtcttctcctcatcctcttttgccatgcttatttggtggtaaccggagtaagcgtcgaggaaactcaacaactcgcaaccggctattgagtccaccagttggtctattcgaggaagaggaaagtgatccttgggacacgccttgttgaggtcggtgaaatcgacacacattctccacttcccgttggccttccgtaccatgactgggttggctagccactctggatggagtacctctctgatgaaaccggctttgagaagcttgtcgagctcttctcgtatggcttgttttcgatctggtgaaaatctccgcagtttttatattactggcttggcatcgggtcgcaccatgagtttgtgctcaatcacctccctgggtaccccaggcatgtcggacggctgccaagcgaacacgtcagcattgtcgcgggagaaggtgatgagcgcgagttcctatttctcgcctagtgaagccccgatcttgatggtcttgtcggggttggcactggatagtggaacgatcttgattgcgccgtctggtttcggcgtcttgtttg

SEQ ID NO: 94243 - DNA, 1025 bp, Oryza sativa
ccatgaacgtgcaaagcctttaaatgcgggtggcaagtaattcactaacgcgttgtcgtccgctccggcagcgcagaataccgtggagtaaacctaaaggaactcttctgggtcggcgctcccatcgtatttctctattgctccaggtcagaatcttttaggccatcggacattccgaagtgaacaaccgaaagctctacacccaacgctgggggcggtgggttgttggcgatcatgcgtccttcgtggatgtctatccgatgatgaagatgacgaggatgatgacgatgacgatgggtcgtctagttccggcgtacgattacggggacgtcggccgggttctcgagaatcctgtcgtcgtctcccgctgttatctcggtgccgatctccatcatcaccgtcattattgcgacgtcctcgaccagtatcgcccagtacccgccgttcgcgatcgttgtgatcgtggcggttgtggcggttatcatggtctcggtcttcgcttgaatgacctcctcgatcttcgttatcgtgacgccgtgaagagatatgacgccgggaacggttctcgttgtctcgtgtgcgtcgtgcctctcggcggccattcaggtgatcgcggagatcgccggtgccgcgaggtggaggggttgctcgatgaggtgattccgccgttcagggtcttcaccatttgcatcgcaagttggtggctgtttcgggtgcgctgcagcagcggcctcttcgaacgcgttgctgaggttggtcactaattgcgttgacggctctgatgtgttgggccggagtagtcacttgattctccgcttccgcattggtgcgtgctgacgtgccgacatcgtcgatagccaatacctcacgaggcgtactcgttgtcgatgatccatagtcttcgagtaggtgcaagactgatggttcatggggatcgatgtcgattaccccaacaaatcgatctgaaaccggcgtcgctccttgttccttgtcctcatccctgatggggatgcgtgactgctgga

SEQ ID NO: 94244 - DNA, 802 bp, Oryza sativa
ttattggtgaagacatataatgagaagagaatgaaggaaaatctggacattttcaactgggagctcacagatgaagagagggagaggatcagtcagctgccccaactgaggggcctgcctggattggaattcatctctgaccatgggccttacaaatcagttgaagatttgtgggatggtgacgtctagcaagctacttagatacagtggagtatatatctaaataatcatgatggatcatgatgtggatctatcttaattatgtgcggcaggcatgggcacggcaccattcccgtacacgttctgcgatcaattaatgtatggaccatacatgtatattaattgctgtatacctatccacttatttaaaacacgtcgacacgttcacgaaaaatggttactcccctggtatacatatataggtccatagatgatgcattgcaaatttaattagctacctagaaatttatttaggatgctaaatttaagatggtagatttagtttaaatgtatacgactcttgatctatttttgttggatttcactccacccgtggttgggaactattaattaattccctgggtctataatgattttggatgcattcccgacgagctaatttcatttcactatttttgttgtgattttagatacatgtttaaaattttgggtttatttttaaaccacctatctcctttacttgcagttatttatcattcaattagtgaagcataaactcattcgatattctgatattaatcaaaattaatattatttaatttcctttagaaagaaaacattt

SEQ ID NO: 94245 - DNA, 664 bp, Oryza sativa
cagataaataatttagaaaacagttgttcacagaatttaaggtaagagattaaatggtcataccatgttaattgagacttcaatatttaatttgcggtgcagatttgtttgaggtggatgtacgagcagggtgatgttttgttagtgaagacatacaatgaaaataggatgaaggagaatcttgatattttcgactgggagctcactgaggaagagagagacaaaatcagcaaactcccccagcagaggggtctgactggaatgcagttcgtctgtgacaatgggccttacaagtgcgtcgaagatttgtgggatggtgcttaacatgtcgcaggctggccctatgcaccaataatctggatggatcatgcttgctggggatctagcaaaataatttgtaattcaatattaatcttctgtcttctcgcaaaataattgtgtgaaatggagcgccagatgtgctcaattgttatctttcttctattcgtaatcgataaatatggtattttccaaaataatattgaaatttcgagatattgataccgaacatgaatacttttttatctagcatttcttaaaaagtcatcaatagatatcatcttggtcacagcctaagatggtcgtttcaggttgatgtatgagtattgctgcaacgattttacct

SEQ ID NO: 94246 - DNA, 559 bp, Oryza sativa
cgggatattttctcggcttctgcgtcgtcctcgggcaactcttcgctgcttatgaatttaatgagtggggtgcgccagtcgtcggtggtctcgatatcggcaacggcgcgctctgcccctgtagcccccgaggtggtgtcgggggcgaccgggctatcttcgccgcttgcctctttcactgatggcctcgtcaggacgtccagaaaggtgccaggttcaagtggttctcgtctggacgcacatcatgctagatcatccggttcgatgttgtctttacggtacacatgtcggacctcgatcccatcgaaccttttttctagcttcatgacttctgtgagatacttggataactcggggttagagcacttgtaatctttatgcacctggttcgtgactagtttggaatcccctttcacgattagtcgcttgactctgagtgcagctgcagctcttatcccggcgagtagtccttcgtattcggctgtgttattggttgccctgaagttgaggtgaattgcatgcttgaattgatctcccgaaggtgatgtcaagatgaatc

SEQ ID NO: 94247 - DNA, 4121 bp, Oryza sativa
aggcggcttacgccaccatcagcgaaaaccttttttctattagtgatgaaaacttatgcttgatttgtagtgtttttgcttgaattcaaaaagtagtctactcaaactttcctgaaattttctactcaaatgatcaagctttctactgtaataactttattgtctaaaagactaaaaccttttacttcgatgacaaaattttctattcttgtgacataagttcctacacaaatatttatcaagaaaagaacgcttgtgaagaagcatgtgggtacatgcgagattttttacggcataaaaaatcttaatatcgatgtctatttttttaaaaaaaaatgaggcagcagcttaaatgatgtaaactttcctttctatacaaattaatcggagcatcctcaaaattgatcaaaattatctgtaattaaacatgtgtttggctcttatatcaaacgcaagcgacatcggttgcctgcagcggccaccgtccactactactaggtggatgacactgccatcgtctggaaaatgggattaaattgatgggcaacgtcaaagcatgatgttcaaccaaaagctatatgcatggtactctggaaggaatctccttgtgccacacgtggtaaacacagctcatcctttttggcaacaaaagtacactacagcagtgacattttctcttgttactctttccttaatctgctggacttaaacatcattcaaatttgacttaaaaaggttttgagttgatctgtacggtacatagggggaaaacattagcacactaatttctagaaccgtcaaatcgtcaattaggaaaagatactgctgatgcgtttatctccttcgacatatagtttcaaccgtagtgtttgacaatgcactgactaactacgctgtcagtatgtgtatcttaagtcaattagaagcaatggcgtattaattgttttcttttttgcaccaaccgtcaaggaagtggaagaagacctcttcttaactgaacagttagactgaaaaatggtttccagcagaatcggctacgagaaaaaaaaatagccagggaaatttcagctcgtttatattgagaactttcaattgggaaaagttgcatcagcttaattggtaagtttccacttgaaagtaattaactaatgatgcataatgtgttggtccatgttaataagttcagaattgcaaatcttcaaaatttagcgaggatttctgtcgaattttggaccatctaaactcctccaagattcgggtcggcttccttttccatctcgggcgagtagtgacggttcttgcaatgtggccttgactagttagggttctgggttgggttggaattgaaggggctaagggaaaaggggaagacgtgctttccgggggcttagagggatgaccatgggtggtggaggacatagtggatggtgcactcggaccggcagcaaggtggaagtggtgcaacaggagtcgtactgatggaggagggtggtgggccggtgtcaatggcaggggcaaaacagaacgcatggttaggaggtagatctagtggtgaaaagccgccggagacaggaaagacggtaggagggggggcaccttgccgccgctggcttgacgaggaggctatccggggaggaaggggggtagactcgccgacgctgtttgtgccatccgcccaggtggcggcggccactactaaaaaaagatttttctggacgagcaccccaatagattacaaacggaccataagtatccgcgtctgcaaaaatcgaccctcttttttccatatggctccgtaacatatccatatgctaaaatccatttttccagatggcccgcttaacctatccacacacaaaaataagggtattttcgtatgcggggctcttaactcacccacatgcaaaatacctaaagattcccactcccattttttatatctccactcctctttctctctctctctcccataactctctcccccactcccccacttatccccatgccgtcggcggcggtggtggagggcaaaagaaggcgtgtgacggcgtggatctgatcgacgtgagcggatggacccggctgccccttgctccctacggtcccacgactacgaggacgcaaggaggctggtggtggcggcttctaggagttaagtttcgtgattttggggattttttttttttggatttttatttttatgtgcaggcaacataagcatccacacgcgaaaatcatatttttgcagaccatttagcacgtgcggctagccctaccgcacgtgaaaaccccttccgggccatttgcaaaaatcttttttagtagtgggcgagctcgcctcgtgctcggctgcatgctatggggagaaagcgaaggggtatgaaaatgaggatatggttactattgcacacaaatcctaaattaaatctagttgtccaaaatttgcttgatattaggtgggattttctgtcataaattggatagccactccctaaaaagtgcatagcttaaggtctaaggagtggcaaatagcaacggcactagttttctgcaccatcaaatggaggcagtggaagagaaagccatgcatgcatggcatcggtgaaaagaactaaaaattccttatgtgcacataagttcttgcgccccctacacgcccttgaatttttaatttattttgatctccactgttaatcactcccctctcgtatataagatctatcttttcatacaaacataataatgaagaacgaaggtgaaattttctgttataaaaaattgaaaaggacaaatgtgtttgatagaacaacatttaaaattttcaaataaattgcaatgacatttcaaaagggggaattgcaactatattttattcttcttctccttagaaacaaatttaaatatttttttaatacacatcaaacaaaattcaagatattttcatggaaagagagaaaggtgaaattgcctctaaaattttcatcaaacttcatttcaaattttatcttctcttttaacactggtggctagttcagttgattggtgcatgtgcgtgcctagtgttcgaatctccttcctggcaatgtttttctcttgataataaataaattgggttggcctgattgggacatggggtggagacattaaggagttttcccagaattatttcagaaattattgtaccaaaacagattccaataagggaatatcttaaaaacctacattattaaaaaaataatgtcttattaaaaactacattattagaaaattaagatttgtgctatactagatacatgtacatataggaaacatggtaattacagtatggttagtaattataactatattgtaaccatataaataattataactacataattaagtaattaactacttagagctcgaacctagactcgttgatagccctactccattgggtctttaacaatttctcaagcgtggatagaagatacatactgaaatgtatccatatatctctataatctctgtggaaagaaagaagagaagagagaagcagtcatttggattattttccgttcacaaactcacacagccacattgctttacgcggaaactagcttgcggaaactaattcgcaagacgacacaactttatactacgtcgctagtcttcatgcatcccatcaacacgcgtccacttctgatcatggaaaaaaatgggaatacggccacacggttgtccctttgcttttcttccatattaataataaattaaaaaactatgatttgaaaaaagcttcggatcggtcgactcagcaattagaatctcatgcaaccacgtgcttcctattacgcaaattttgctataggatatcgtaacttcacggttgttatagtataccgcacaaagtaacttttagagaagatattttataaacgtgataatttgtcaatagacaccataccgattaaaataataattcgcggttaaggaggaaagaaaaatcgtgtgaaatgtcagaaatacccatggtcccacctatcagggctctcatctctcttatttcgttctaccctccgacagtgccataggggtcatcgctgccgataggaagcagcacgcactgcacgggcaggata

SEQ ID NO: 94248 - DNA, 687 bp, Oryza sativa
ctgtggcctttctcctaggccttggcaaaatactccttggcccagtggtgtattgattgggcacaatttttggtattcgatgagtttgtgagcccaagactcaatgggtgaaattatccttcattttctatatgtatttcgtctcaactttggtagtttgtcacctgcatacacatatagaccaacactcgtggaaattgttagaattaaaccctaccactatgttgggtgtttcatattttctgatttatgcaagtattggcggaataaaattggcatttaccagccgccaattctccactccgcgtaaatgaactagataagtcacgcataacttatgcagactccacgccgctctactcaccggattgtttggcaccaatgagctattggcactagtacatactgatgtatgtggaccaatgagctcaactgccagaggtggttttaggtactttattacctttaccgatgactttagtagatatggttatgtctacttaatgaggcataagtctgaatactttgaaaagttcaaggaatttcataatgaggtacaaaatcatttggacaagacaatcaagtatctacgatctgatcgtggtggagaatacttgacccttgaatttggcaatcatctaaaggagggtggaattgttccacaactcactccgccaggaatgcctc

SEQ ID NO: 94249 - DNA, 789 bp, Oryza sativa
acaaggcagcgacacgaagaaagcatggtgccctatacacaagacggacagacattctctagaagattgcctcgtcttcaaaaagtcgctcgccaaacacatggcatcggaaaaaggcaagcgagtacgcgtggttgagaaggacgctaaggcgcctactcaggaatcagacttagcatacccagattacgatctccatgtctcacacatcttcggaggttccacggcatactcctcaaagcgagaatacaagaaagtggaacgtgaagtctgttcgacgtggcagggggccgcgcccaagatgaagtggtccgagcagtagatagaattctcagaagaggaccaccccaagactgctatcatcccagggcaatatccgatcatggtcgaacccactattcgtaatatcaaggtcgcccgagtactgatcgacggcggcagctcaatcaaccttctcttcgccagcaccttggacgcgatggggatcccacgaagcgagttgacacccaccgatcaacccttccatggaatcactcctcagtcatcgtccaaaccattgggcaaaattacgttgcctgtgactttcagccaagcaaacaacttccgaacggaacagatcacctttgatgtcgctgcattcgatacagcatacaatgccatcattgggagaactgcactcgtgaagctcatggccgcatctcactatgcgtatcaagtgctcaagatgccaggaccgaagggaacaatcactattcaagggaacgctaagctggcagtacaatgcgacaa

SEQ ID NO: 94250 - DNA, 552 bp, Oryza sativa
cggaccttcgtgaagccggtgcttccacaactagttcaacctgttgaacaacgtcttgctcaatttattgtgattgtgtggacgttgaagcgttttccggtgattcctgaatttcttcaagtcgcactatgctcccactatcctttcttgagataaactctttctccaagaaaacactgtcgggcgacaaacactttcgtttccttaggataccccacaaagaagcatttatcttatttaagtgtgagtttgaccgattgcaaacgttttacaaaagcctcacagccccaaatctttaggaaagacatactgggacggttccctgtccatatctcatatggtatcttatccacggattttgatggaaccctatttagtgtgaacacaactgtctctagagtgtaacaccagaagcttaacgggagatcagtttggctcatcattgatcgcaccatgtccaacaatgtacgattcctccgttcagacactccattccattgaggcattcctggcggagtgagttgtggaacaattccaccctcctttagatga

SEQ ID NO: 94251 - DNA, 5953 bp, Oryza sativa
caaaatatgtgacaaaatgagatgcatgttgaatatattaaaaaacatattagtttaaaagtaatttatttaaattatagaagtaacttccctatagcatgaaaagtaattacattctgactgagttaaaataagaaactatgtggagtaaattcataagcaaagtgtagagaagattttcaagtaaatacatttataaaagtaaattcaataaagtctaaaggtaatttacataaatcataaaagtaactttgcacaaaatggaagtaaattgttacaacattagaagtgaattccttgtatggagaaaaatatggtctatataataattaaatttaaagtccataaattatagaattgactaaaaccaataataaaaaataatcaacttacagcattatgaatgcataagaagtaatttaatcaaatctaaaagtaatttatatacggagtatatggtaaaagtaacttacatatataataaaagtaatttataaatataaatatttttttatcgtaatataatcatgtaagatcttgttgtgaagatttaattgcaacgaacacaatggtgtaatcagattgtaatggtgtaatcagattgtagatcggaaaagtaatttgaaagaaaactttacaagaaggggaaaaagatatgcatgtctaatagaaaaaggcatgcatgtgtagttggcttctccaccgttcccatgatcgaacggatatgacgcagcgtgcgtgattggacaaatctaagcagcgtcgtacgataagaatcgagaggcctcgtcgattagtttttgcgaaaaaattatgatgacttatgagtaagggctccttagtaaacacaacgaaattatgaatgcacttctaaatattatttttgctggcggccaaattaaaatatattttcgctggcggtcggcggtgcctccagtgaccaaaggccagtgaaaataatgcatattcactagcggctattcgaccgccaacgaaaatcgagtttcgcaagcagcatgctaaaacaaccactagcaaaaatactatcttcgttggttgtaagctaaagagaccaccagtgaaaacaatttttgggtaaaaaaaatgaaaatcggcaacgctggccgctacggccacatgcaccgccgggctccagccatcgctgacgtcgagagatctgtgacactgacgtcgccgaggccccgcagcctggcggtggcagatcagtgttccctatggcctagcggcgatggatctgtgctcctcaccatcgccttcccgacccgccgccaccttcccgagcaccgtcgctgagccgctgctgccactttcacactccccctctgccgtcgctgagctaacaccgccgagccccctccgctgctagcttcctgccgtccggtgatacttgaggaggggagtagaggagatggagagttgaggaggggagtagaggagagggagagagttgagggaggcagaggaggaaagaagactcaggatcgaaaggctaaggcaaagagagcgatgctctctagggatttaattatttaatttatatctcgattttatttgctcaggcggttctcctaagcattcgcaagtgaaaattgattttctctggtggttgtttaagtgggtcactagcgaaaatagctatattttttttgcgatctatgtaaccgaatcgccaccgaaaatcgattttcgccggtggttcatagccctccttgttacaatttcgctagcagttttcacgtatggccgctagagaaaaaaaataggttgatgtcatgaataatcgattttgtagtagtgacaatttttggaggatttaaatatcccaaaaatagaaatcctatcaggccattttggaacaaaggactaatccctaaaggttcctttgaaaatcatatgaaatgagcacctctttttgaaattttagaggaaaataaacatgggcgtgcacagctctacatgcagccagtgtcaactgccttgcccagtttttgcacaccgattgtcgaaacaaattttcggcaatatgaaaaggggtagcgcacgagacctaaaagtggatggatgcggagaaaaatgatttagacaggttcatgccctctcgatgagaggtaataccctactcctatttggggatttgaatccgccggggtgtagtattgatctgacgatcaggttgtctcatgccccctagagggcctcctgccccccttatataggatggggggcaagattacaagatagaaaccttaaccaatacggtatcggtttcctaaatctactttacaatcttatcaaaccagaactttaggccgttccataatatacagggaaacgtaatacccaagttatgatccgttacatatttcataaatataagtcatcccctatagctagtcggataaccatgccgtgtgggtatggggtacccataatctccacagtagcccctgagaccttcacagtcgaaaagataatcttctctcgaactagattactccaaagctgagtgcttcaatcatcttcgccatggtctccgaagtacttttaaatatgaagactgtggaaggctgaaaaataaagtcaggtgcatcgactagatgcacctaataggtgtagcccccgactatgtggttagctgaacaaactaagcatatagtcaaggaataaataatccaaccaaacgagtggttttgataattgtaatcaaccaagtgacttgatatcaatatatagcatatgcggtgtgaatctatgaataacatgatccgagtgatataccgactgttttgtaaaatatgatgagtgtaacctaaagttggctacatcattgaaaattcacatagcaaaacagctattaagaagcttgtatgttgtgaataaagaaattttcaaagtattgggcatacgccatgcgcacaatgctttaacagatgtgcttaagtccctagaagacacatggttccaccacacctggaaatatatggcatatgtgctataaaatccgagtaaataaactcataaaggatttaccaaccgcctagaaaatgaccaaaatatataatcagcctaagccataatattggtcaataaaagtgcacacttacgtggcaaaaagcaatgatattgtatccaatcaattgctttatgaacccaaacaacgccttgacttatataaaaaaagtcagcggggagctatataaagcattactgtttggcaccttttaaaatgcattgtaccaactcctaaaaagttgagtaactgcggtataaaaggattttatggtattgggcacataatcacgtgcacttttgcctaagcagaaagatgcctaagtcactaaaagaacgtgacaagccacacctgaaaatatgggctgcagacatattaagcctaggccaaaaaatatgccttcgacaccctttaaaggatgacgcatgtaacatgctcccgagtaataaatctttcgggtgatatagaccaagtgtagctcatatgaatagctcctgatctgagtgattatcctttatgggatgctccaaaatagatataacaattgaattctaacgggcgcaagtattcggttgataacccttacggggaataataaatagtccagtctttgagcatagaaaatagacccatgatcatcaaattcatgttgtatgtatccggaataagtccaaattgaaggtacggtacttgtgtttgagatagtaagcccctgagtatatagcttgtccttctgtcgtagtcacaattgtccattgatggtagctgacgcagttggcatagagacaagacgaccaatatagagataatattgcccaccagaggtggcaaaaatattggtagtagtgaagatagtgataccaatcaaaagtgatgaagttgcatagccgtggaggcgaagaaaccagtcggcaacagttaggtcagccagcaatgaatatgaaagtgcccagcgataaagttgtttagccatagcagcgaaataatcagtcggtgacagatgatgcagctggtgaagaagatgaagatgcccattagtggcgacataataatccatccatgaaggcgagcataccggtcggtggtgacgaaaacaagccgacggtgaagatgtagacacgcatcaaaggcgatgacgaaatccaccaatcatgaagatgaagaaaatagtcggcgacgacaaacgcaaccgacagtaatgatgataagcagcaatcatagatgatcgactatgatgacgaagttgcccatcaaacagcagtagaatagggctatgttgaagaggcttgacaggatattgatgaagatgatgatgtcggtgatccagtcaatagcagtgtagcaaccgatgataatgacgaagacgctcatcagcgtttgcaaagtaggtcaaccgtgagggtgaaataacaagtcggcaatgacggaagcaaccggaggagaagacgtagtcatccattaacaacagcagagatgtcagggccgatgaggtagaggtgctggtgatgaagtcaatgacaataatccatcaaactgttgagaagatatcgaagctcgaataattttcttgatacgagcgtgtgcataatgaagactgatgcaacgccccttgatttatgaagatggctgtagaacttagtgctatagctgttgcagatgcttcacttagaggaaagtatatgctgttggtcaactcattgaatctgatctgagttaattggttgatgactccaaactcccagacatgtaaattaaatctcaaacttgagaaatttggagtagattgtagcggcatgaagaagccaaaattgccggtgtaataattggagttgctgaaattaaatgtcggctctgaagcgaagacgaagataataactccccgagttgacttgttgattgattgattgcttcatcttgacataaagcttgtcgaattttgagagtcttgtatttgtgtagcccccgactcttggttagttgagaaacaactgaacatagagtcgagaactgtagcttcttgtcgttgagtagtcattgcttgagtgaatatacgcatagaagatgtccgagtagaaatcttgaatattggaacaccacttgttgtagtaaaataacatggcattatacttgttgacgtatgctaaggtgtcgaaactcttgtagtcgtcatggttggtgaagtagcaaagcttgcgaagtagaggcaatagagtttgccgatgccgaagataataaaaatgaaattgctccaccatggtgacaaagttgcatagccgtgatgaagtgaacatgagtcggcggcaatagaagcaaaccggtagtgaagatgcgcaattgtgaagataaaagcaccagtcggtggcggcataaccagttggcgacggaagacgatgatgtccatcagtagtggtagcagtcggcagcagacgtaggcagcttgtgttgaagatgctgacgcctattagcggtgacggcgatgtagccagccgtgaagaagatagcatcagttggcgtcataacaggccagccgtgcaggcggtgacaccagtcggcggcggatgaggcggccggtcggtgaagacgtatacgcccaacaacggcggcataataggtcagccgtgcaggcggaaacaacagttggcgtcggacgaggcggccggtcggtgaagacgtagacgcccaacaacggcggcataataggtcagccgtgcaggcggaaacaccagtcggcggcggacgaggcggctggtcagtgaagacgtagacgcccaacaatggcggcataataggccagccgtgcaggcggaaacaccagtcggtggcggacgaggcggccggtcggtgaagtgcaggtggaaacaacagtcggcggtggacgaggcggccggtcggtgaagacgtagacgcccaacaacggtggca

SEQ ID NO: 94252 - DNA, 802 bp, Oryza sativa
gcattcataaatgttcgcctatgatgacgaagttgcccatcaacaaccagtagaatagggctatgttaaaaaggcttgaaagaatattgataaagatgccaatgtcggtgatccagtcaataccagtgtaccacccgatgataatgacgaagacgctcatcagcgtttgcaaagtaggtcacccgtgagggtgaaataacaagtcggcaatgacgaaagcacccgaagaagaagacgtagtcatccattaacaacagcagagatgtcagggccgatgaggtagaggtgctggtgatgaagtcaatgacaataatccatcaaactgttgagaagatatcgaagctcgaataattttcttgatacgagcgtgtgcataatgaagactgatgcaacgccccttgatttatgaagatggctgtagaacttagtgctatagctgttgcagatgcttcacttagaggaaagtatatgctgttggtcaactcattgaatctgatctgagttaattggttgatgactccaaactcccagacatgtaaattaaatctcaaacttgagaaatttggagtagattgtagcggcatgaagaagccaaaattgccggtgtaataattggagttgctgaaattaaatgtcggctctgaagcgaagacgaagataataactccccgagttgacttgttgattgattgattgcttcatcttgacataaagcttgtcgaattttgagagtcttgtatttgtgtagcccccgactcttggttagttgagaaacaactgaacatagagtcgagaactgtag

SEQ ID NO: 94253 - DNA, 1574 bp, Oryza sativa
  unsure (1)..(1574): unsure at all n locations
cgaggagaaagtatgcggcctccgctatttatatagtctccgtttgcttttctgattcttgcataatgtggattcgctcgctggctgatgaccgtggcgttcgccatgcatgcaggaagaagcaaacgagaaaggaggtggtgcgcgtggcggcgagcgggccggcgccggacttgtgggcgtgccgaaagtacggncaaaatcggatcaaggggtccccgtacccgcgcggctactaccggtgcagcagcaacaagaactgcgccgcccggaagcaggtggagcgctgccgcttcgacccctccttcctcctcctcacctacaccggcgcccactccggccacgacgtccccctccaccgcaactccctcgccggcaccacgcgccacaagccgccgccgccgccgccgctcccgtccgccgccgacaagtctccggccaccgcggctgaggcggcgacggcgagccagagccccggcctgtcgccgaccacgccgctgcgcgcctcgtccatggagctccacggcgaggacgacgccgaggccgagctgcaggtggaggaggacgacatggccatcgacgacgaagacgacgacgacgtcgccgacgagaccatcagcaccgtgccgtggggcacgcccatctccgacgcgatcatcgcggcgagctacgagtggagatgaccaccaccacctcggcgacctcgccgtacattgccatacatagcaagcaattcagccgtcttagagagagaaattaagggaaagagacagaaattaaagagagagttgaagggagcatccgatccatgcagctagtatctccaacacccagtagcactagtgtttaattacttaattaattactacaagcacctagtagcgtctatttacagaactacctccgttccaaaataagtgcagtcgtgaatatccgtacccaacgtttgaccgtccgtcttatttgaaaaatttgtgaaaaatttgaaaatatttaatcacacataaagtactattcatgttttatcatctgatagcaacaaaaatactaatcataaaaatttttcaaataagacgagcggtcaaacattgaacgtgaatagtgtaaaactacacctattttggacggagggagtagtacttaattaattagctagtgagtgctggcctggatgcatgacaatcatataatcagacaataataatgtgtaattaatcaaaatctccaacagaaataaaattatcttcatttcctcatatagtttcctcagtttgtcctcctttcttggacatgtttgcgtcttttcttacagattctttatttcgttttgtgcaacattttctttttttttccatacataggagtatagatatgtagtacatacatatgtacataaatagatcgaagtagtaacagtatcagcaggtacccagatgatggaacagctaataattaaaagagttgaggaaaagaggggaaaaaaggggtggggtttgttggtgtgggttgtggtggctctttttggctcattccctttcactgtgcccatatttgggtgtgatatgtggctttca

SEQ ID NO: 94254 - DNA, 2866 bp, Oryza sativa
tatttatagatgcaatttaaaaggtatgccacttaggaaccgacacttaggcacatgcacctaggcttgatgggtaagtctggccaatttacatatggggaacataaattaatttaatcagttattccaatttattcttctttgtttctatgcattgcaatgccaatttgagtgcctatcttgtcatgctattcagcataatgtcttggcaggctctgcatatgttcatgcttatatatgcagcattcatataagtaaggattaattggatcgcttgctttgtctaatgcagcctcaccatttaatttgtggcgagcaccttaattccatcttgccattaccgagggagtatatcatatgcacctaattctgtatatagagtatttattgactagggtcttggaaatttttgaattgctgtcagatgtaagttcctcaggttgatgatttgattactttcacagctaataccattgatcacagctaaacaccacttatagaagtttaatggatttttatctaaaaagggaaaaaaggaaattaataactgaaactgcatagtagtactatgatctctgaacaaagaaatttgctgagtttcctagcagctgctgggtgcattttcctcttgttatgtgtgcctaaccttgcatccattaaatttcaaaagtgcaaatagagaattattgcatgcattcctttgatatcaaagattgggatgaaatttccagcttaatcctgacagccacaatgtgtcttgagcaaaaggaagcaaagctgcaactgaaacacggtgaatagtaaataaaaatctcgcttttaggaaaaaaaaaggtgagtcgtgcacaagtgctgtaatctggttttggcaaatttttatcgagatatacaactccgttgctttgtttacacaataaacctgaactctaggtgtagcagcttgaagcgttaaaaaagaagatggcagcaaacatatgtttgctttattggatttaatacttggatattccactgtgcttcccaaattgagctgaataaatagcttgacgaattgttctcttaacatgtctcagttgtcctttgtatcaaatgagcagcataagccattcatggattgttcttttccactgtgatacagatagttacttctaatgtttcatggaaaagtttgagcgacaaaaatttcttaagcaagcttacggattgtttctgatgagtttagcaactctatggaaacaagcataagtgcttctcatctaaccagttccaagagagaagtagccaagtaggtagaacaatcccaaaactgcaaacttattttactgtatatatatatatatatatattttcctttttagcattttctgtaaagtcccagttctgtattgcagttggcatggttgtgttcatcagaatattgaatgtcaaatcgaaaggaggcgccaacctatagctatcaacgacatggacaccatggttcagattcataaatttggggatcatggatgtctaggttcagaaatttttggattttagacaacaaattttgtagaattaccaatttagaaaaacacattttgcattttgttataatgtaataaaataccaatttatgtttatttgatgaattatcaaagcaacgcttacagtacttttatttttatcagtgcatatgagctacaatgtatcaatatatatcgctgtgcatcaacaatggatgtgttgttctccaatatacttcgcttagtatatatatcgacgtgccttgcacgtgcacgctcactagtgctaagtaaaagtgctgatgagtctttctattgggagtactgaggctaattagttatcaccaaccatacatccataattattgaggatagaaaaaaatgcacattgatcgattaactttatgtagctactgtcccaaccgagaaagagtaattcacggacaattgattgaatcggcaagttttgtcaatgagaacaacaataactaatttgaaattgagctaaacaatactgaaacttaatccgatggaattctatgaacttttgaggtctgactcaaactaaaaatatgggcgggcgaggagcatacatatacctcaacaaacatacaaatactgaaaagagcgaacctatttagttacacccaatcggtgcatacatatactcgaacaaacatacagtgtaaactgaaaagaaatgaacagatgttgttaaagttgtttgctgcaaaaagataattgagtaaataaaaaggaaaatacaattttattttgatcaagaaaaaagagaagcatatataccagggttactgtgggggggatctgctttgcatcttgtgctatgcaggttaaagctccagcagcatattggtgagagggagattaatcgaaaggaagtaaaattaagaggtaatatatagcaatgctcaccggatcagatcgatgccttgcacactactaccgaagtggtctttccatgcaggcgaaaacgatttacggtccgttcgcatgcacgaaatcgtctataaagatcacgatctttgtatacggccagggcaaccgcatgcgaacatcagatctttgcatgtgggcgcctaagccgaccgcatgcaaagagaaaaaatcacgaaaaaaaataaaattcaaaaaaaaggaaaccctagccggccggccgctcccaccgccgcccaccccccgccgccggccaccccagtcgccgaccacgtcgtcacccgcatctaggggcggatctagaaaaaaatagtagtagggctgaataaactatatcagcataaattgaaccttcagtccccacatcctatgatctatggaaaaaaaattagtgggggcttaagaggatc

SEQ ID NO: 94255 - DNA, 3008 bp, Oryza sativa
aggggaaagggtaaaaaaatagaggggagagagggaggagatgtgttagaaaaaaattgaagtggtgggagggaaaagagagtggagggagatgaaaaagttggggtagtatttttgcatgcagaccacttaagtagccgcatgcaaaaatagtcattaaaaattaatttaaaaatatgagaattttgaatcaaattttatgatattaaatgaactcatatgaaaaggttgtcaaaaacaaagttgtagactcgttgagatctaccaattttcttttggtcatttctccatccgagtttgattgaactatataaaatttaaattttataatgtaagaaattcaaataatttttcggatagtaaatgatttcaaatggaaaagttgtgaacaataaagttatataacttatcaaaatctacaacttttctattggtcatttttctatatgactttgtttgaacagtttgaatttgaatttcaaatgatgacaacttcaaataacattttcaaatactaaatgatttcaactgaacaagttatcaataacaaagtggtataactcatcaagatctataacttttattttggtcatttcttcatctgacaaaatgatttgtaagatttttcacaaaatgaacatatctcttatatagtttcataaactataagagagatatgtattttttgtgaaaatgttactatcactttatcggatgaagaaatgaccgaaataaaagttatagatcttgatgagttatacaactttgttgttgatgactttttcagctgaaatcatttactgcttcaaaatattaaaaagttttgaaattcaaaattttaattgataaacacaaagtcacaacaaaaagttcccaaaataatagtagtaagaacacaataacatgatagagcatgattttagaaacatttaggaaaaagaatcatccaatttggagttcatatgagtaaagatacactagttttaaatttttaaaatttttcaaattttattttcgcatacggctacttaagacacccgtatggaaaaatcgatttttctatgcgggcgcttaagtgagccgcatgcaaaagtgaccttatttttgcatgcggatctcttaagaggcccgtatggaaaaatcgattttttcatacgggcgtcttaagaagccgaatgcgaaaatggcgttcgatttgtacagacgccactaattatggtccgcatgttaaaatgatggggcctcgtacagaaaaatcaacttttcagtagtggcagttatcgaagtcgagaggtcagttgacagtttcgattggggaggcaggataggctgacaaatcaggcttcgctaccaattactactggttgataccccgcgcgttgctgctgacttttgtaaaatgcaataataactaaatttgaccatgaagttagaaagcgatatgctttagtgtgattaagcacggagtatgctttagtgtcaaaaagatgttatcaagattaataattactagcaaaagtgcctgtacgtcgctacgggaagtgtaaagactagaaaattgaggaaaagttgaaaaaaaattacattatgtaattaattgaaatacaaatttccttaaaaacttggaattttctaagttggtaggtgtataattaaatcaattaacaagtaaaataagtgtgaaaacaattatatggttggatttacttttaaaaaaattattcataattaattacaaacataattaattcttcatattttaaattttcagagcttaattgctaattttgataatacaaacataatttcagcatttattctttagcctgcgaattgaaatttcctgttcgtactcttcatggtaaccgaaggtgaagtgttatttgatgcgaactctagatgatttgttgtgtgttggacttgggatgtgtcagggttacggataaggcataccctctatcctacgacttatggaatataccgataaggtataccttcacatatacggatggtttccgtatacgccgttaggaatttgcctcaagttaaggaatatcccccacgaagttaaggaattgccgaagttctactcggaaaaggtaaaatctctaatatatcgtgtcggtttacatatctccaagtcttgcttgagagtcgaggtattccacagtataaaagggacccctagggagaggcaaagggcattgcatctcatcgccaacacacccaccaaagtttacgaagccggagtccacgaagccaactcgccgggagatctcgtcgaaaccctcgacaaagatctcatcagtatcccctatttcggttactctctttgtaatctattctcatcaacatcaatcccatataaactggactagggctattacctgataaggggcctgaaccagtataatccttgtcttttgtttgttttgatgtcgtactacgtagatccctgttccaacgtaccccaataccctattcttctggtccgcgagtatcactcgtcgacaggatgttgcggacaaaaataggtgaggacggacgaaaatttcaccggaagattaggtataggtatttaggtatatagaaagttagattagagatagagaacgtataaacgatgaatacgatagaaatcggacttttttgctgcactttttttccctttttacatacaatcggacttttttcgctcttttttttattttaggcggacaacggaaacgttttcaattatttaggtagtagagattagccattttcattttcaattatttagtttattaatatataattaattaagtattagcaaaacttaatttaaaaaatagattatatgttttttaaagcaactttcatatagataatttttgtgaaaaatgcgtcatttagtagtcttagaaggaaagaactcagccctaagggatcaaaattgaacttattctgtgcggagtgtacatgcggcccataatgcagccaattgtgtggtgagccacagccatctg

SEQ ID NO: 94256 - DNA, 992 bp, Oryza sativa
ttcgaaaaaaatgtgcgccgccaacgcacgcatgagctagcttttccgattataactagcgctgaggctcaacaccaacaaggttagtgttgaaacatttgaccccgacgccaaggactttggcattgagcttttcccccaatttgttcaataaatccctttaggggtctatatttggaatatctttcattttcaaatataaatacttctaattaaggatctagacatttacgttcaaatttataaaaataataagaaaaaaagtgtgacttaccccataaactattacggccgatcgattaccccctaaacttaaataccagacattacatatcctcaattattcaaacgagacaaataactcacctgcatcaatccgacgtggttttcatcctacgaggcagtctagtcagtattttttttcaaaaaagaatcatgggacccgtttgtcatattctctttactctctctttcccctcttccctccctctatctctcttagtccctggttgcgccggcggctacgagtctcctcgcgctcgtaccggcgaaggctaaggagggaccaagcactgtgcgccgatggaggccgaggagtcgtgtgccactgctggcagagactgagggaccaagcgttgcgcgttgacgaaggccaaggagttgcatgccgccgccagtgaagacggaggctgaggaggagttgcggccgccacgcgtgcgtttggtggaggccgaggatcaggagccacgcgtcgtgtgccggcgtagcccgaggaggagctgcagcgactatgactctcctcgtgcatgtgccggcgaaggccgaggaggaggtgcaccctagcagtgcccggatggtgatggaggtgtatttggagttggggaatgtgacagcaagcgcgccgtggtaggatcgaagaggagaggatacatttgcgttgctcggcttggtggggaaggctgtctcgcgaggagatgctgggacggccatt

SEQ ID NO: 94257 - DNA, 621 bp, Oryza sativa
acaccagtcggcggcggatgaggcggccggtcggtgaagacgtagacgcccaacatcggcggcataataggtcagccgtgcaggcggaaacaacagttggcgtcggacgaggcggccggtcggtgaaaacgtagacgcccaacaacggcggcataataggtcagccgtgcaggcggaaacaccagtcggcggcggacgaggcggctggtcagtgaagacgtagacgcccaacaatggcggcataataggccagccgtgcaggcggaaacaccagtcggtggcggacgaggcggccggtcggtgaagtgcaggtggaaacaacagtcggcggtggacgaggcggccggtcggtgaagacgtagacgcccaacaacggtggcataataggtcagccgtgcaggcggaaacaacagtcggcggtggacgaggcggccggtcggtgaagacgtagacgcccaacaacggcggcataataggtcagccgtgcaggcggaaacaacagtcggcggcggacaaggcggccggtcggtgaagacgtagacgcccaacaacggcggcataataggtcagccgtgcaggcggaaacaccagtccgcggcggacgaggcggccggtcggtga

SEQ ID NO: 94258 - DNA, 707 bp, Oryza sativa
ggctgctagggaaagtagcacacgaattgtggtcaatctagcaacaggtgagtaagtgcgaaagaaatcttcgccttctttctgagtgtagcccttagcaacaagccgagccttgtacttttcaatagtaccgtcaggcctaagcttcttcttcaacacccacttgcatctcacaggtttatacccatagggtcgctctgtcacctcccaagtcccgttagcgataatggaatccatttcactacggacagcctccttccagtagtctgcatcaggagatgcatatgcttctgaaattgatttaggagtgtcatccacgaggtacacagtgaaatcatcaccaaaggacttagccgtcctttgtctcttactccttcgaggagcttcactgtcatcctcctcagtgacatgttcatgtgtatgttcagtttgttctggtggtgtgattgaactgagaattatttcagatggttggctcgaactactatgtgtatccttcattgggaaaaagctctcaaagaaggtagcatcacgagactccataattgtaccaacatgtatgttaggtacctcagatttgactattaaaaatctataggccatgctgtgatgagcatatcccagaaagacacagtccacagtcttaggtcccagtttgcgcttcttcgttattggtacattgactttcgccaagcacccccatgtgc

SEQ ID NO: 94259 - DNA, 652 bp, Oryza sativa
acagaaaatttatgcatcagcttatacagcagcatctgcatcgtgctcagcaacagatgaaggcttatgctgataaaaatagaagcttccgggagtttcagccgggtgactgggtttacttgaagattcagccttatgttcaaacatcagtggctagaagagccaaccataagctatctttcaagtattttggtccttttgagattcagcataaagtgggtcaagtggcatacaagctggttcttcccaatacctgtttaatccatcctgtggtccatgtatctcaacttaaggctgccaagggtttccaacctgctctacagcatagcttgccatcttctttggggtccttggaaattcctgtgcagttcttggatcagcgagtggctaaaaaaggtaacgctgttgtaactcaattgctcacacactggtcaggtactgcagctgctgatgcgacttgggaggaccaagaagatctgaaggctcgctagctcattttccattcgcaccggcttgggggcaagccggctctcaaggaagggaggatgttaggaccagcaggagcaaccctgaaggagtacagtacggcggagatgacggcaacacggtggatggagaacaggacggaggcggtcgtaaagattgcgtcttc

SEQ ID NO: 94260 - DNA, 9132 bp, Oryza sativa
tcttttcgatgaagcagttcagagtgcgtcttcacactagcttaggcagttgtttgttactgttgtgcttttttgctctgttggtgatgttcgtgctttctttgaaaaatattggttgtccatgacagatgacatacaacataggttaaaaaaggcccttgataatccacgttgtattattccgcatgaacacttgcttactctattgatacatgaacttacttataacttaccccaaccaactttctctccacaagtgccctttggtaataggcttattgaagaagaactttcagctgatgcattaatgatgtcgatgcatgcagattccttggttgcacagattaatactgatcaaaaaacaatctttgacaccattgtaggccgagttgtagcagaacagccaggctttttctttgtatgtggtcatggtggtactgggaaaacatttatgtggaatgctttgattgcgaaaataagatctagaaataaaatagttcttgctgtagcttcgtctggtgtggcttctctactgttgccaaaaggaaggactgctcattcacgcttcaaaatacctattgaaattaatgaaaccagtctttgcaatgtaaagagaggaacgatgcttgctgaactacttgaaaacactttgctcatcatctgggatgaagctccaatgacacataggcgttgctttgaagcactagatcgcacactgcgtgatatcctttctgaaacatgcccttcaaatggtgttgttccctttggcggtaaaattgttgtgctaggtggcgactttcgacaaattctaccggttgtgcctaaaggttcacggtcaacaattattgacgcatctattacaaattcaaaactatggaaacatgttgttatgcttaggttgaatgtaaacatgagattgcttaacccttcacttccaaacacacaaaaagaagagcttaagcaatttagcgaatgggttttagccgttggtgatggcactttgcctaaaaaaaaagatggtgagagctatcccacatggatcacaatacctgatgatttgctgattatgacagatggtgacagatggtgagagctatcccacatggatcacaatacctgatgatttgctgattatgacagatggtgataaaatagatgctattgttagagaagtctatcatgatttcctgtcatgttacagagaccctgagtacctagcttcccgtgcgattgtctgtcctagcaattcaattgttgatgaaattaacaactatgttgtaggtttaattccaggagatggaaaagaatacctcagttgtgatacaatctcaaagtgttctgaccaaataccagattttcacatgttatatcccactgaactcctcaactcaattgatgcgaacaattttccaacacatagacttgtacttaaagaaggtgttgcagtcatgcttctttggaatctaaaccaatcaatgggcctttgcaacggaacaaggttattggtagtcgagcttggagagtgtatcttgagatgtatcatactaactggttctaacattggtgaaaccgtgtttatccctaaaatttcactaactactacgaaaatgaaatggccatttacattgcagagaagacaatttcctattcgaatttgctattccatgactatcaacaaaagccaaggccaaacactgcagagagttggtgtctatctaaaaaaacctgtttttacccatggccagttatatgttgccttctcaaggacgacttctcgaccaggcctacgaatattaattgagaatgactatggctcatgtgggatagaaacaaaaaacgtagtttatcatgagattcttgttgctacgttaccagcggtactgcagcctgcagctcttactgtgtacatgctactttagtgcttatgattggtctctcacaactaaacactaataaaatttcaggctgtgccgccacttccctgatacctaaataaatatgcatgcgcacgcagtgcacctttttggggtcttttttgagcattccgctggttatttggacgcagtgcaccgtgtgaagaatgcaaacaggagctacaagccagttgccaatgaactaatgatcactttcactaggtggacaactgttgaggagtgcattgaagttcctattgatttccctactgtggttttctccctgacacctttcgatgatgttgctaagtttgtggacaataatgatttttttattggtgagccatgttagtcttatatttctattggtcttatataatactttactgatcaagtgctaaaatcttcgtatttattcagatgttatgggtgtcattactgacatatctacacccacaatgcttcgtcctagatcaagggatgctgacagcttgaaaagaactattcagatacgcgatgcaaagtattctttatgcctcttattttgttccttgcttatttatttatcctgaccactaacaactaataaaactagcacaaacacagccaatagccactctaataaaatttattgatattcttaacatgtacaccacatttttcctgtttttttacacaaatagcaattctaccttgaatgtgtctctctgggctgaacaagcatctgcgtttgaggctgacgctatacacaaggctggtaagagtgaacctcagattattctgtttgttggaactcttgcgaagaactacccaggcataggtaaccaataaaactacaacataactcatatttgtatcatgcattctaaccaatcaatttaaaattgaaggattggcactatctggaggttctgcttgcaaatgggacattaacattgatgtacctgcgatagttgaattaaaggacaagctagcatagattatattatttcaatgtataactccatatgtcttctacatgtttcctgatatcaatggaatttacaggactgggacaaacttccagccaatcaattggattgaggctccagccagagcagctgttgatgaagtcgctgagaacaagactgtgcgtgaacttctagagatcaatcctcacaagtgcaaggtaaatgctaattgcgatagatcaaaacaacatgtttgtcttatgctatttagacctgctcttactctgctaattgctccatttgttacagaaggttcgatttcaagctcatgtaaccgttcgaaggatctgcaatgataagtgttggtggtatggttcatgtcaaagatgcttcaaggttgcaaaaccttatgggtccacctataaatgcactagctgttccaacatcgcagtggcagtaccaaggtaaaaaaaactgttaccatttatcttgacattgcaagtgctttccagatcttctcatgcttttctctacgcgaacataacttgcacgtacaggatagtagtcatagctggagatgactctgatgatgctatgtttgttctctttggatgaacagcccagcgcattgtgcgaaggccagttgaagctcttattgaggaagcaccagctgacagtgattttatccctgatgaaataacggctttagttgggaagtcgtttgtgtggaatgtcagcttcacagaaaatacgcttaagtttggggatatctcattccaggtcaacagcattgtctccattgatgctcctggtgaacctcttatgttgatgtccccaggtgcttcccagagttcttcagccatgatttcacctggaccaagtggctcattgatgtcaccatcaaggggaagtgaacttggcatagcttcacccggttcaactgcagccagctctccactgccaaggcgtgttattaccacggacaaaagccaagttgtgcacacaccaaccagcaagtgctctgtcagcatagatcaggatgacatttctgctgctttttctccaccaatgtcccaggtagtgactgataagttattattttgctacttctatagtctcctacacatttatggtcttgcttattgatcatgatagcaaactaataaaattctttgcagaaagtgcaagctccagctattcctgatgatgatacactactggctcatgcatctggctcaaagagcaagtctaggaagaggtagattgttttttttttttcatttgacatgtggttcttcattttttttttaaaaaaaattgctttcctaaaacatggtctgatgttaacagaggtcctccttctcaagcaccaccagcagttaagaaactattcaaggaaggtgacagcgatgagaaagaaaccactgttaggtatattcactggtttagcttggctgctatttgtgcatacagtatataattcattcttcttgcagcctgtcagctgacgcttgatccagtatacatgcatgcccactcaagcattttggccaccaagttgtagcatcttcgtctgcctgaaccgaagcgcatggaagaatgctgtctttgccatatgtctgaaccttttgctataaactgttgatctccagctattacttcttagtgactttcgaaattattgttcccatctcttttggaaccatctttagcaatgtttgtaagcttattatggttacattagctatagtccaaccacgtgctcaaagtccattacagttgccaatatgtcagtacggcaatggactttgaacagttggcattggcttagctccatgataccttctcaggtttcgcttagtaatgttagaccaatcttaagactcatccatgtttcttgagtccatctcctcatttcttattatgtcgcatgcatggcattggcattttaatttgttgcgataactaggttgtagcccgtgcgtttcctgtcatcataacttctctgcttttttatgttgtttgcctgatggtagggcgcgcaaagcgcgccttattacctagtataaattcacggcgcggtagttgagctcgagctatacctccacatggtaatggggaatttcttttgccattttcttctttatttctgtcaagtgcaaccagggtgcggaggccatttcaagcacatggcgttgaagctggtgccggcggagctcccgtgcaagcacggcactggcgagtggctcactttgtagtggtggttcttcctgcccatgagtggagagagaaagagaggagagagggggagctatagaggtagaagaaacagtccaaactaaaacaaccagtgaagataggtagtctaaagtgaacaagtttgttcacccctagtccaaattgcaacattggtaaaaaagagtggcccaagatgtaatttactcaaaaaaataattacagaatctactaatctcaagctggccattctgccagcattctattgcttcaaatggcactgtaatttaattatacgtggagcaacgagataaaagacatgctgtgcacagcgatctgatgtactgtctcgcaactcgcaagtatatctttctggatctctcaaaaaaatgcttctaatcgcccgtccggtgggaagccaaatatcggacgcatcgctgctgctgccggggctcacacgctgcctgttgtgccgcccacgtctctctcacgcgcgcagagtcctcatgctgccacgtatccccaccacatattccgttgcaataaatcacctacatattttggaaaaccctcttttaagggaatctgtttttttttccactaaaaatgttacacctagtgtactcacaatgtttcactatgtatagatctaatgttgcaatgaattgaaacattcttttgcaacaaatcacccatatattatggaaaccctttattaagggaactcgtttcattttttgttccacaaaaaatgtttcacctagtgtattgataatatttcactatgtatggatcaaatgttatagtgaattaaaacatcctttcgctattcgctgaaacattattttcatataaggtgaaacagtgtctgatgaaatattttcgatctagttagttaaacaattccgatatacttggtgcaacagcgtgtaacatttaaaaataattcaataataagctcaatttttttcattggattatatccatgtgtggtcttgttttaaagatttaattgcaatggatttaatagtgcaatcagatcatgatttggataaataatttaagagaaaaaatagtttaaagttcgcttagatgcatacatgcaggatgacatcatgatgacatgggtgcccgatttttctaaaaaaaatgggacttccgatttgtagctctctccggatctcttgcatatgcgcacccagccgcagtgcatgcatgtgcattaataattagaatttaacattaatatcatttaaaatctaagacaagatacatctcaaaagaaaaccaattatttaaatattaaataattaaattaaatatataaaaagagtagcaagtattgaaaacaattaaaaatgaaaaaaatgtgctaatccacaaattttactttttttaaggtaagtcagttgaaaaatgttccaataaatatgataagtgacattgtttaaattcaaaataggtaacttaaccaagttgatatcccatatctttaactattataaaaattcaacatgtttttatcaacaatttcgtacgtcgcccatacgattcgcacgcgtattttcctgtgttgtccgactcttgatcaaggcgcacgaatttttgctgtgaaaatctcttttctgtttgattcccttactagataacatccgtatttttcacacgtcaggatataggcctacgtagcttccattcaggcctaggcccactaatccaatttgtttgcaccaaaaacagatacaagcatgatctactgacgagaacccctttgagcggctaaaaaacatcttcgggaaaaattaactcctattatatatatatctatatacctaatttatatctatacctaataaaaaaaatgtaataacatctcccaggccgcgccgtgcctcggcccctcctcctccttcgtcggaagccgtcgggccgccgtccatgtcgcctccccgaggagcccgctgctgccaccacttgctgccgtgcccttttggccgccgcccctcgccagcgccccatggtgaggaccccctccctctcccatcccttccgctgctccgcgcgctgccactcaccgccggtgtcgccgctggtggccgtccggctacacgccgccgccgcctagtcgagttggccggcgagccaacccgcccctctgccacgcaccactaccgtggactcggtctacagtggaccaaatcctttgacccgctgatgtgtggggcccgccctttgtggacttggtccgcgcctctctccttgttgcggcagcaaatgccttttcctttgtaaaattaattaataattacgcaataaatcaataataattctagaaattcatttaaatggctcaaaacttctaaaattcatatctaattcatacgaactccgaattgagccattcaacttgcaaaattcatctaaaattgagatatacatgtttgtttactttttatgttatttgtttttctagtccgttagtaaaccgcgagacaaatttattaagcctaattaatccgtcattagcaaatgtttactgcagcaccatattgtcaaatcatatagcaattatgcttaaaagattcatctcgcaaattagtcacaatttgtgtaattagttactttatacatgtgttcaaacgttcgatgtgaaaagatgtaaaattttggggtgggatagccttactaatactaccacatgtgtttctcactctacttttcggagttgcactgctcaaccgcgcggcggcgcgggtgttgggtggacttcgacgcgcgcacctcgcttgtcaacgtcaccatggctcccctcgagctgcccaaaccgaggacgccgctgctctccgccgccgtgaacctctcggccgtgatagaagacgaagcctacgtcggcttctcctcgtccaccggcgtcgtcgcgagccgcgcgccactacgtgcttgcctggagcttcaagatggacgggccagcaccatcgctaaacgtatcaaacctgccggcgttgcctgtcacgatcggcagggctccgtccaacgttctgaagatactattgccgatagcctcgatcggctgttctcgtcattcaccggagacgacgtaggtatgcggagcttaaagaggattgggaggttgcgtttgggccactggttctcatacaaggatatgttccgtgccaccaatggtttctcttatgagcgattgcttggctttggaggatttggaagggtgtacaaggtgagtgcttctggtatcccgagtggagattgccgtgaaggtgtcccttgaatcctctccctacacccattactgccccctcaatggtgaatccttccacctcacctgcacctgcggcatacccgctgccgacgacttcaacctctcctccttctgcatcattgacaaacccaacatcaaacccaatgacgcctgctatcagcatgccacctcctgctctcaccacaactccacccactgccccaggtctttccgggcagcaactatggtgtgtggccaaggctgactcagcagatactgcacttaagaatgcactggactaagcgtgcggcattggaggagcagattgcttagcaatacaaccatcaggcacttgttattatccaaataccttaggtgcacatgcatcctatcactaccggagaagtgatctttgcctggtggaaaaaaaccacaatagtcccagttccaaaaactatctttagccccggttaaaaatctcacaaccattatatgatctttagtcccgattggtaacaacaaccgggactaaagatggttcatcccctgtcagcctgtcagggtgctaatgatctttagtcccgattggtgcaccaaccgggactaaagatcactattttaatcccggttggtatttctaaccggcactaaagattaagatgatcattagtcccggttggtattaccaaccgggattaaaatctaatgcgtagtatataatcactctcccttattctctcaaccacacttatccttttaacccacagatccggcccct

SEQ ID NO: 94261 - DNA, 803 bp, Oryza sativa
gaactatcaagatgcaatggcgttatgtcgtgtttatgggtctcctgatttatttgtcacattcacgtgcaactcaaagtggcaagaaatagttgaatcaatacgatttgaagatggccagctgccatctgatagagctgacatgattgttagggtattcaatatgaaagttcatgattttattactgacatcagggagggtaagacatttgggcctgtgcttgcaggtaatgatgcctattgcaatgtttctacagttagttgtgtagtatagtgtgattacaccctcctaattaaacttggtatttttttttgtcttagttctctacactgttgagttccagaaatgtggtttgccgcacatacactgcttagtatggcttgctgctagcagtgctcaagtatcagtagctgttatagatggatttatcttagctgagataccagactttgaaaccgatgaattaggttatgagtcggtaagcgagttcatgatgcatggtccctgcggtgagcataacaaacaatgtccttgcatgaaaaatggcaaatgttcaaagcactttcctaaagattttcatgatgaaacatttgttgatgaatatggttttacaatctataggcgcagaaatgatgggcgatatatcacaaaaaatggtgtgcgtctagataacagatcagttgtcccatataacattggtttgcttaaaacataccaggcacatataaatgttgagtggtgtaataaatccaacatgattaaatatcgttttaagtatgtgatgaaagtccatgatcgatca

SEQ ID NO: 94262 - DNA, 3267 bp, Oryza sativa
acacgaccagatcttacatggtctttcgtctctgaaggatccgacaaggccttattggctctgggcgtccccagccgaagttccctcaggttcctcggaggccttgtcaagacggcgtaaagggacagtaggataggtttcaacgctaggtgtcttttgtggtaagggatctctgggtaaaacacttggcaatcttgtgcacctgatatcaactttgttgaagcaggggtaatgggagaatcgctacatcgctggtcgaggaccaggcagtagtcgtaactcgaccacttaaagtggaagtagtgggagaaacgccacatcgctggtcgaggaccagacagtagtcgtgactcgaccacttaaagtgaggcgagagagatcactacgttttactggttcgggaaccagaagtaggagtcttttaatcacctataggggcgctaaagttagtttattacatgtgcatatcatgtggccagcatgactcacatacctaacttatagcatatccggatgtccgctcgcaatcatgtcgggtgatcaaaccgacggcgtttacgaggaattatccgttaacaaccttttctcgagtagtccagctatggccggtgctatgagataggtcgtcggtcttcgttggtaagttgggtgcgacgactccgcatttgtcgagaatgttctcgatagtggggtgtactcgaccacaacctactcgagtgctcaaatgtttctgaaaaatattttctagaaggcaagacatatagcagagaatatcgagtatgtactcaaaaactgcatggatcttctagtattattaggatataacgagcagatgtaaatatcaggtattatgtaaaccgtaaacaagcatgacttatacagaagaagacagagcgagcccccagcgttagatcgtagtcgatttaacatcggggacacccgcacaacaggtattattgtataaaaagcatgctctgggtaaacataataaattatggatctgacaatactgtatgatctgaataggtacgataaattgcagataaaatattgcgtacctttatagatacatgccggatgtatctacgaaattagtagatcaatttaaaaaaccaatctaccaattaccttgctgcgtactcgttcgatatcaggcaatctgacatcttttgttacgccgcggagcttgaggcttggatgatctcgatagaccaagttgtcgatgacgatgatggttccgatctagtcggaagatgtacttggacaggttggatctccccacagccgaagtcgtcgagtagcttgttgtcggagagtccatctcttaaacccatctcgtcgaaatcctgaagcaccaaaatccccctacctggcgcgccactgtcgacatttgatgtcgcaattctggtatttgcatagtatggggatcgtcggtgctaggatatacgcgagactgaggtaaaagagacggagacagggatttttatacaggttcaggcccccgaattgtcaagtaataaccctacatcctgttggccgaagccggtattgctcttattcatgataatcacaccagtataatatttggggtagcctatctaactattgtcgacatggcggtctgacgatctgactcgtagtcaacaacagggtagccttccacctcgaatccgtgcccggcgagatcagagatagcgctttcgtctctcctgacagtatccggagacaccgtagggtactagccgtgcttatccctgaagtcgatatccggcggcgtgtcttggcgtatgtaggcttctattgttgtggcttctatgtcgattgtgttgggtgttgatccttccccctctcctcctaggggagcttgtatttatacccataggtgtccccttgtccaagtagaactagggaaaccaatatggatacaatccgagtagtccttgtcatttccacgtagaactctggttgtctttccttatccggaactcctcctatatccgtaggttgtttccatgtaggacatggtatgtggtgggtcctgccgagatttagtcaactactattagatatgtggtatccataaccctgacagtagctcccgacttcaatgcaaatgtacgaattcatattctcaaccgctgaccatggagtgactgttatcgagctcaagtgaccgttcttagtgaattcagagataacattagacttcctttgttagcctcgtgcgggcacctaaagggttttctaagtcaatctccgatgtcaaccaagaaggtacagagcatacgactaagtctcctgtcttgccgtaatcgagaatttggattgaagtcaagaaattttatctcggcgggtacaccatctcttcattccgtattccttgtcgagatctagcaaccgttctcgagcgattgagaaggcgtagagtctacgacggagctttgtcaacatttgtcgtactcgccttagtcgatcttggtgtagaaccatagagacatgaagttttcgacaatgtcgaatagaattttcttgaaatcaatactcagaaaagaatattagatagaaatagccctcgagcgaatgctcaaagggtgacatgttataatatgacagactagtgaattgaatgtacagaccagtgttttgtatatgagcgtcttctctcttaccgactccgatcagtcagtttgtagagttatacactctccctagctcccagccttatcgtcggagaatcgttctcggatgacagggctcttggacctttgacctgccttggttgaacaagcactgatcctagcccccagccgtgaagttagaaaactcaatttccgattacacggcttggttaatacgcacggcgagaactcttacacgaccagatcttacatggtctttcgtctctgaaggatccgacaaggccttattggctctgggcgttcccagccgaagttccctcaggttcctcggaggccttgtcaagacggcgtaaagggacagtaggataggtttcaacgctaggtgtcttttgtggtaagggatctctgggtaaaacacttggcaatcttgtgcacctgatatcaaactttgtgaagcaggggtaatgggagaatcgctacatcgcttgtcgaggaccaggcagtagtcgtaactcgaccacttaaagtggaagtagtgggagaaacgccacatcgctggtcgaggaccagacagtagtcgtgactcgaccacttaaaagtgaggcgagagagatcactacgttttact

SEQ ID NO: 94263 - DNA, 516 bp, Oryza sativa
taattgctgccatctagagttactgtgataataattcaagaattaacattgtgccattgaaatcactagtatgtttaacatgaaggagtagcataattttgtgcttcttttcttttcatttcatgtttcctttttgctagaagcaaattgacatccattaaaaacagaggatctggactagcaatgacagtagggcttgctcatcacagttaaaactggaaatggaacataattgaagtggccagtgccataaatcgatctttctgtaatccctccttattacatgaaaatggagaaagttttggatggatgaatacaaatccaatccaaaccataccaaaaaaaaaaacaacaactaattactttctttctttttgacaccaatagacagagaatgcaacaacacaaaagctactatacaccatgaattctcgctgtactggtgttctcacatacacatgcgcgtagaattcaacacaaaattaaaccaattcaacacgagatcgacgagcacca

SEQ ID NO: 94264 - DNA, 1095 bp, Oryza sativa
acctgtgattttaccctcattcatactacatagcaatttttaggttaaaagcggaggagtgtggaggtttatcaacgatatagaggatggtaaaactaaggtacatcagaaataatatgtaccattacacgtattgaaacatagtacagtgacctcggtgcagggttatggtccattagattcatgattcctgagtcaaaaatctttggcatatagacctatgcaatcttgaatgggtaaatctaacactaagcctaacaattccagaaatcaacctacttatttttgagggagtaaatagacatgagtagaaataccacagtacaacaatgcgatgaatgtgtaatattaaaaaccataaggagaaaccatagaatacattcttttcaaaaaaaaaaaacatagaatgcatgacataagatactgtaaaaaaatgaggcctctcggtaacacacctcgtagttctttttggttagcctctcaaggaacggtgatttctctaattgttccttgctgcttccggtaatgtaaaagatgtccttctgccctggcttcatccttgaaatgtactcatcaagagaggcaagtttgccttccgacttggtactgaaacagataaaaactcagttctattatccctcgcatatataactacagcaattagtggacattagaatagaagacaaacctttcaaatctcagaagctttgcaagacggttcctgttagttgcgtcttcaatgatgcccaacttgactgattttccaaactcattccagaacttggcatactggccctttttctcctccattgcacttttttcttcatctgagtacagaagattatgtgagaattacatcataaataacagtatatgacctgtgatccacagagaacttgttacctgtcttatctttgttgctgtactcatcaggatcttcctcagcaagttttctaatcatgtcaagagctttgcggattagtttcttcttgatggtcttcaggctgctatgttgttggagcatttctcgtgatacattgagaggcaatgtgtccgagtcgacgagaccctacagataatagcttataggtttag

SEQ ID NO: 94265 - DNA, 2574 bp, Oryza sativa
aaactccacaaaaacaggttgacatatatcatggaatagcttgccactacctaaaaagctaaaagcacttcctgtcgtatatgaataatggttgaagtgacaatcacattatcagaattagctcttcatagaaatgaagaacgtgaaaagggattctccatattctccaaaagttagtggtgctaacattatgcttctatgaacaatgatctctcctaacaacagaactggaggtagtattgcatggacctattttcgtgggtatcaggctaaaaaaccatgaatcaggcacacactggtaaagtaaatgtctagaagatgtacgtcctgattccaaattatcatttctggagaatatactatgcaatcaacaaagcatgcaggtagcatcttgaatgcttaggtaataggtacaatatcaatgatgtagaggaagcatatggtgtttgtacgaagtgttttttttataaatcattaatttgatgaagcataagcgcacaagtaacacattgctacttgcttagcagcagaacaaaatcaacatgtttctttcaccagaaaaatatgctatacagtgcataggctattgattattgatttttttatcagtcagatatatagtgcattcaaagaggtcatagatatccagcaaaaagaacatgagttaagcattctatcactgtctcgacaagatgaaacaaccaccccacccaccccctcccctttccccaagaaaaaaaacaaaacatttcagtccagatcagctgtcatttcactacatcaaaataccaatacaagataatagactgcagcggatgaactaaacttcagaataatggctctggagcatggttattaaggcgctaaaggaaacctaaggaaccctcatcatgccttatgccttaaggtcacgccttacgcagtgaaaaaaaaaaggaaataaaggactttttcataataattgcagagtccaggactaaaatggaaggctttttcatgacatttacatattccaaggactaaaatggaagatggcaacagatattttatctacccatcccaatccccaatcccgtcgtcacctgtttctccgccgcttgctcgcctccgctcccttgccccggctgccgcctctatcccctccatccactctctcttcccttgctgctgccgctccttgtcattgctcgtgctggatctgggcaacgccagcagttggggacgacggcaacggtgatatcctagtcagatctttttgttcctcccccttcccctcccttcccctgctgcctccgctcttcatgactacggattattgctgccgccgcttctctaggatgggtttatcacttgtttttgccctttctcctctagctttctcgtaaggcggagtggacgccttacaccctggcagcgccttactgccttagggatgccgtaataaccatgctctggagcatgaaattttatcctacgttgactcttcttacaagcatttagtttgtaaatcaaggaaaagagaactaaccaagctagtcataatcttttttagaaggccatagataacagaagattatgaggttgccatactgaatagcagtagctggtagccaaattagtgttttagacagatatagctagtctacatctatactaggatttaaccatgctgaaacgaaggcaaaaggtagcagctagcatttagtatgttagatatatatagttagaagcagtacatgaaatttgcaaaaacagaaaggaaacataactgaccttcatttcttttcagaatttggcatacagccgacaggcatcgtacccatagccccacagactgggagctttgcagatccagattttgcaccttggcattggatactggcaatatcacaggcaccttgccccaacacctgaccactcacagcgccatcctcgcccattgttctcacctgcatccctggactgcaatacatctggtcggcacatcgaaagtcacaggagttcataacctgggcaccaccaagataacttccctgatcaacactagaaaccaaatcgatgttcttcactggcctctgataaggaaaagccccaatctccccttcaatccttcctctaatatcaacgagcaggcaccgcagcctggatacctctgcctcgagcgtggcatggttctggagcttcttcatgagctgctggtttagagccctcaaatgaacaacctcctcctccagcgaggcagtgtgagctttcttcttctccctgtacttcctcacagcggcacggttacccgacggccgcttcttggaggcattgttctccgtcggggactcggcggtctcggcagcatccgacggagtgtcggatggggcggagacgatcttggtgtggacatggacgcaagtgttggtgtgtgagaggtcatgcacaggcgggttgcaagtgtgggtgtgggtgcatgcatggtgctccgtattcttgaggatgtcgtcgaaataactgtccatggagcaactgccgtcggggtcaacaacaacgaccggcgggcaaaagaatgtgttccggttggagaaa

SEQ ID NO: 94266 - DNA, 636 bp, Oryza sativa
catcacatcctgcgcaaatacacgctagactcgagattgtactgctccattaaatctgaccatgccttctcaaactctgcctctgtttggggttcatttaacacccggtggaactcctgtttgaaactgcttcttttactgtaaatgttccccaagttctccttagcattcttcagaacatgccatttgcaaactctatgaatagtttcaggccaaaccgctttgatcgccacctccatttgatgacagttatctaaaaaagaagttcacaaccattcgagattaaaaacagaagacatatcattaaacacaccactgatccatccaaataaacatatacctgttaaaattgctacaggcctcttcccatgcattgcatcagtaaatgtttggaaaagccacttgaatgcttcgattgtctcctccctcaacaaagcgcaaccaaaaattgctgtttgaaaatggttatttacaccgacaaaaatcccaaatggcatgttgtacctattagtctgatatgtagtatcaaaagtgattgcatccccaaaatggtcaaaacttaatctggaaagagaatgacaccaaaatatatttttaatccttgaagcaccatcaatctgtatggtgtaaaagaaa

SEQ ID NO: 94267 - DNA, 755 bp, Oryza sativa
ttcagcttttgcacgaatgtgtcaccattttttaactgcacgtttcctcatcgcaggacctcgtatgccttcgagcgcgttcgcaggcacgaccggcgcttccgcgagctccgcaggggcgttcgccacctcttcgggcgcgttcgccagctcttcctctcacggagcgtcgatccctcgcccacacggtacttaagattttattaatactgttaaatacctgtacgaaactgatggtccttgtccagcaggatttgcagccgggatcttcggtactggggcctcttcgtctcacgccggtaggactggtcctactagccagttctacgacgacgacttgcacggtgcagaccaccaggacgtactaggctcctctcagcttggaggagctccagaggcgcacactcaggagcagccagaggtcacacctgtacaggcaggacgggttggccgtgccgtacccccggaccgactcacgtactcccaggggcacattagggcgcaaggtatgagggacaggggtaagaggcctcgtcagtagtgttctacctcttcagtccttatgtgaccgtttcttttggcttacaaacttgtaaagcagtactacttttgctattactactgcagtactacttgcgtttggctccgctacgtagatcttttcattctatggtgcttgaacaacttatgctcacaacaacacactttccgcgcttcacggtagtgccatattcaatagcgcgcacagttcacaa

SEQ ID NO: 94268 - DNA, 621 bp, Oryza sativa
aactgcaaattacaagtacaaggaaaattactttttctcatctggagttgacaaaaatttaaataaatgtaattcagtgctggagaaaaaaaaaatcatatgatcatctaaacagatgcagaaaaagcatttgacacaagtcaacattcttataaaaactttcaacaaattaggtatagcaggaatacttctcaatataataaaggttatatatgacaagaccacagcttacatcatacccaatgatgaaaagctgaaggctctttcctctaagaccagaaacaagacagggatgctcactctcaccactgctattcatcttagtgctggaggtcccagccggagcaattagacaagaaaaagaaaatgcattcaaattggaaaggaagttatgaaactgtctctgttttcacatgacatatatcttatatacagaaaattctaaagactctaaaaagactgttaaaactaacaaatgaattccgtaaagttgcaggatacaaaatcaacatgcaaaaatcagttgtttttctacacactaacaaggaactatccaaaaaagaaatttagaaaaccatactatttacaatagcatcaaaaataataaaatacttcggaata

SEQ ID NO: 94269 - DNA, 5947 bp, Oryza sativa
tctaactaagcaactaagttatgttttgcaatcctagggtgaaagtggctcaattatatcactaggaaagtaaatcacactttctaagtctagtttagcaatcctagggtgaaatgatctctagtatgtctctaggaatgtaaattgcacaaatgtaaatgcaacaagtaaatgagacaaggtgacaagagatttttcaccgaggttcggaaactcgccggtttcctactccccgttatggcgagcccaactctaccgctcaaccacgaagccaccgcacgcccccttcgtcaaggggtgggcaaggcgggagccggcccacggagaggactacccaagcttcgatcgctcggggtagtttttccttcactccaaaggtggtgaactccaaaccactcacaaaccggcgccgggcctccttcacaatcttctcggagaggtcaccgggcaactcctccacaagccgtctaggaggcggcaacctccaagagtaacaagcgatgacccggcgtggagatgatcaagtgccacactagctctacaatgaagcaatgcacttgactcttggctaatcaaccctcaacactacaatggatgaacactaagctcaaatatgtgtgagagaggtgcaaggggtgtatgcaagtgaatttggtgccaagagagtccccttgctgctggtgggggagtatttatactcccaccaaccaaaactagccgtcgtagggctgtcattgggccccacagccctggccggtcagaccgacatggggtggccggtcagaccggcctcggctaggtcagaccgccctcagctcgctctgaccgaatacggctccagccgctcgggatcggccatcccagagcatgccatcccggctatatggccggctggtcagactggacaacacttgccggtcagaccggctgtgtggaggcggtcaaaccggccgtgaccctgtggtcagaccagctgcactggccggtcagaccggcacttgggccgcggtcagaccggctctggtcaggccacacagtgaatgcacaaattgaaatatggggagagtctaaatgcgagcacaagtctaaatacataatgacctaatgtggcaattaaaatcatctctttgctaggtcattacccctcttaatagtacggcgaggttagaatttaactagcaaattcgatcgccctacatctcgatcaatttaaatataaagcactagtttaccatcttctcatccttcgtttgcgctgtcaattttaatccttcggtgatcatccatgtgcacacaataagtgaacctaactcaaataaatatctcaaagacaacggttagtccacaattagtgcttgtcattaattaccaaaatcaacaacgggggcctagatgcttcaatcttcccctttttggtaattgatgacaaacatctcaatcatatataatcaaatttatatcacatggatatattgcaatgaaaagcaaaagctccccctaaacatgtgcatatcaatcacaatcaacaaatatagagccaatgcacatttcaatttcacatttcaacaagcacaaacacataagcaatatttcaatgttaacttcaagaaatattcatgagcataagatggtcacacatatatcaatatcacatttaccatccatcatagcacaagatcacatcactaaccattcaaaacacataagtcacaaatgatcctaaaaagggctcacaaataaacaagggctattacaagaccacgaagggtccaaaagacatagagttcaacaaaacaaaaaagaacacataatatagagtaatagcccatatccatacataatatagcccaaccgccttaacctattagatatgaggtaactaacctcactaccactagtcccaacccacaggacatgaagcacaccaaatgacatttttctccccctttcggcatcaagtaccaaaaggtcttcattcctgtggaggagaagaaggacgtgccgaagatgaaggatgaggagcatcacggtggcgatgatatacaaaagcttgggtgctctccaacacttggacccgagaatccaatacacccactctagtgtgcaatcttcccacggatgcattcaaatttccatcatccgttcgcaaaccacgaacattctcatgcatcgcttcatgctcggtggtcaagcgttgaatgctctcacttagggtattaatagccccaagtaccgggttgaagtattcattgagttacattccaaagtaagcatattgtggatggaagaaagcattggtatcatacccatgaggaggaggcggggttgcacttgagcttgcgccttgatcaaatgttggttggcgcacacgaggagctctaggagtggagagttggagacgaggcttgtactccttgtgttcttttaagttgttaccaacttgtcccaacttgctttgaatcaacctcattatgtagggagcatagtaaattccttgtccaattgtccccttggaaatggctatctccttcatcataaggttgatgaaatgaaaccgacgaccatccatgatggcatcaatgacatgccatgcaacgccgcgaatgtcatcattgttgccacatcttgggagaatggtggccttcactatgcggttgatcacactagggatgaccctcaaacccgccacctttccataggtgtgcctccccccttcttcataaaactgagaaaagtgatcaatggggaaggggttgtggttgtgctcatcatgtaggtcatccccgttgttgaaacagatgtgcaagagctccttgaattcacggcggttgatagatcaccgaatggtccctgacatccacttcatagcatcacaatcgccggacacccacacggtggcatagaattgccagatgaggtcttcatcaaagggttgcttcatggtgataatcctatcaatgccaacggccttgaacaacccctgcaaatccacaaactccggtgtctcaccaatgtgcctccaagaaatccacttgtgttcggtgaaggctttgtttgcgtatacttgctcatacacggccttttgataccgtgtatggaaccttgaatcattacaatcattaggcctccggaattgatcgtgatgacggaggatagtgtattgctgggcattccttaaattgagcacaaattggatggtgggatcgagaggactcccatcatcacttgcctcatcatcctcaccatcgccactgccagtgtcatcaccacttacttccacctcatccccctcaacattttccgtaatttcatcctcactactttgagcatactcctatccgcttgattcctcatgcgcacttggctccggcgtgggctcacgacgaccatgacgagtgcggggaggcatagctgagaaacaaggataaaaaagatatgagcaacaattttagaagacactaggttaggtggaaggaggttgtatgctgctgttaggagcggtaagaccgagtaccacagaccggtcagaccgccggccacttgccggtcagaccaccggccatcagccggtcagaccggtgacatgcacccggtcagaccggcggcatgcgcccggtcagaccgccctttgggctggtcaagccgccactgacaggagctaaaacaaccctcttaaaccatcacacaaatgactctaaaaaatatttgctacatcaagattgcacaagatttgagcatggatatcaaggtgtaggtctattacattaagattggaacaaagggggaaaactacccttaaccctagagattgaaatagatagatttgagagcaatgcacaagagggagagtgatttaccggttgaaggagttgaatcacaccaagaaactaccctctattggtgcaaaacgaagaacacctcgtgcttcacctagggttccatgccatggatcaaaaactcaatcaaaacacaaatcaatccatggcatacagagaagaagcaaaggagaatcacttacggtgtaacctgagtgattttgacggttgaactggatggattttgtggagggaggtggctagggtttgggagaggagagagaggttgttctcgagttgaggaagaagagggctgaatgggaggaggaggactcggttaggagaaggaaagagaggaaaaggaacaagtcctgggcccactagcttggccggtcagaccggccatatgcggccggttagaccgcgcatatagcgccgatcaaaccgcctggcccccagccgactgtgcacagcccttgcacagttcggctacccccacacaataaaaattcaacaaaaattgtatttttggagcaattttgaaatgtgtgagttgaaatattgccaaccgttcataacatttgaaaattatgaagatttgcaacaaaactcacttaagtgctaggaggtgacctattatggtctataggggtttttgggccaatttgattttcaaacaacttttgaaagatttggtttttgaaataggtttgaattccaaaaacatttcaaatcttcttctctaccaactttgttttgaaacttttctcaaattccttctcaatctcattttggggataaatctcattttggccaaaactaataatctagtttcttcaaaagtgggccaaaagggcattttcatccaaaattcatttttcttgcaatgtgaggcttggaaaacatataaggaaccttttgacacattttccaagagatggctttcaaattacattgattttgcaaacgttttgacttatgttgacttgggcattttgaaaatactactagcactactagttgatttgctcacatataaaaagaagtagagcacatgcaagagttaaaaactcccccttaatgtgacatgctccattttcacaaagaagaaccaaatggcaataaatccaaagcataagagcaaataggagcaaatatacaatatgcaaaagaagcaaccatggtgcacaatgtcaagccacatttgagaaatctatgacatttaactcattcctcaacttgcaaaagcgggtttcatcaagaggcttggtaaagatgtcggctagttgatcctcggttcttatgtggctaatgactatgtcactcttggcaacatggtctcttaggaagtgatggcgaatgtcaatatgcttggttctagaatgttggaccgggttattggctatctttatggcactatcattgtcacataggagtggggttttggtgaaggatatgccatagtccaacaagatttgtttcatccaaagcaattgggcacaacaactacccgccgaaacatattccgcctcggcggtagagagggctacggagttttgtttcttggatgatcatgacacaagggatctaccaagcatttggcaactaccggatgtgctctttctatccactttgcaaccggcataatccgaatcggaatagccaacaagcttaaacttagtaccttttgggtaccacaagccaatagttgaggaatgctttaaatatcttagaatccttttcacggccactaagtgacactcctttggagcggcttgaaatcgtgcacacatgcaaacactaaatatgatatccggcctagatgcggtaaggaaaagtaagctaccaatcatggaacgataaagctttaaatctaccggtttacctccctcatcaaggtcgagatggccgttggttgctataggtgtcttgatggacttcgcatcctccaagccaaacctcttgagtagatccttgatgtacttggtttggctcacgaacgtcccatccttgagttgcttgatttgaactccaaggaagaagctcaactctccaatcatggacatctcaaattccctagacatcatattaccaaattccttgcaaaatacctcattagttgaaccgaatat

SEQ ID NO: 94270 - DNA, 521 bp, Oryza sativa
gcaacaataccttcagcggcgagatacccataactttatcaaatctaaccaacctggctattttgtacctatggggtaatgaactttcggggcctatacccccaaaactatgcatgctcgccaagatgcaatacattggtcttaacaataacaaacttactggtgaacttcctgctagcttaggaaaccttaccaggctagtgacactatccctccatgataatcagatatctggctccatcccccaagaaatcggaaatttggtgaacctcaatattttggattttgaatataataaaatttcaggctcagtaccaaaaacttgtaaaatcaaaggtgtttttgattattattctgtgatgaacaattggcatcggaggttattggttttgttatttggaatttattcacgaagtgttttgagatgattggatttacaggtgaatcgcacgttctattatttcatgtgaccggtcaaaccgggcagtgtgtgccggtcagaccggcgtgtatcgcgcggt

SEQ ID NO: 94271 - DNA, 1530 bp, Oryza sativa
tcacatattgtgccgccccaaggaacaaggggattgggaattcatgatttagaaattaagaatatggctctaattagtaagtggttgttcaaattgctctccacggaaggggtttggcaacaattcatacgtaataagtatctaggtgataaacctctttctcaagctcagtagaaggccagggactcacacttttggtctagtctcatgaaggtgaaatgtgactttctccgttttggatcctttataattaaagatggctcccaaatcaggttttgggaagacaaatggttgggcaattcaaccttgaaagcacaatatccttgcctttacaacatagttaggcgtaagcaggctacagttgcacaagtcttcaaaaacaatcctccatctttttcatggagaagagaccttataggatcaaaactagtggcgtggaataatttattaccacgtgtaacactggttttcaattaactcaggaacaagatgagtttcattgggacttaacctcaaatggggagttctcggtgaagtctcattatctagctctaattcacagcatgttcctaacattaataagcgtctttgaaaattaaatatacccctaagagttaagatttttctttggtacttgcgtcgtggagtggtattaacaaaggacaatttgacaaaagaaaagggtgaatagccaaagtggtcctccaagtttcatgcaaggatcaatttagtccttaatgtttcaatctgtccatattagtccttcaagattttattttaattcaaacttatccttgaacccacataaccaacaactctcttgataaatgacacttataccccctcattcacatatataagagaaaaaaatgcatgctatgaattctttttatagatactgcatagcaatttatgtaaaacaaaaacaaattatgtacttgcaagtgtattcgatagccattaggcccaagtttatgtgcacatgttgaaataatgggaagtatacttacaatgttgcttattcattttggttttcttttttctagtgtatagtggtatacaaattaagggcaaaatggatattttctaatagaattgttgactagaaatagccatatggcacattaagtgggcccaaggatgattttaagccaaaacaaatacttagaggacctatgtggacaaaatgaaacctgaaggactaaattgagccttcggtgaaacttgagggactaaattaactattcatccaaagggaaatggcaaagcaataagaaccgttgtttttgttgcaatgatgagataattagacatcttttcttcgaacgtcgttttgcccattctgtttggtccatcatccaagtggcatctggacttcctccaccacattgtgtagcgcatatgtttgggagttggctcgatggaattcataataatttgaaagcacatgttctgttaggagcggttgctactatttggttgctttggctatacaggaataatgtggtttttgattaaaaaaatagtcat

SEQ ID NO: 94272 - DNA, 3758 bp, Oryza sativa
tcattgtttaagatatcttacacattatttttacttattattatcatagtaaactcccgcagcaaagcgtaaggtttcatctagttgtgtaaatgttcaggtgttacgatgtcccagcaatgacttcttaagcctatagtgccatggagcaactatcgtgtgtaaatcctacaattatgaggtaatttatttcccatgaatttagtttagtttttttaatgaaaagaatggtttagttttgagcatatgaaaaagatagggccttcacctcagtaatctgcattgctaagaaacaaagcagtgtagtggatttaaaagtatggtatgagaagacaacgaaaatgaacggtgcttgtcggaatgagtcacaaattgagtactgtacaatagtcactgaatcgttcattttaccttttgactgttgtagcataacataagtcatctaattctttaccttgacttttgtgcaaacatagtcaattttggacatatttgccaatttaaaatagagttcatgcaagtatttattcagtgctgttatgaatgggctttgttggtactgcaatatatgattttgaatttactaaaactttgatactacttatgagaatgaattgggaaagtaatccttaatacctagttgcttatgaatcccatagctcatccaatataactcgactgcaatttttggatagaaaactagaagtctgataatcaattagtgtctggtagacctcctgcattgttggtcttgcttgcggagaagctttcaagcaagaaaacaccaccttaatgagggaaactatgttttcttcttctgtcgttgttggtgctaaaggtcgtgaatccaggatttccttgattgttatattgtgatcccttgatgaagtcagatgctgcaataaatctcttgggtgcttcccaatcactacctctagcataaccatgccgaaactatacacatcacatttctctgtcaccaaagatgtataggacagctctacacaaggagagaacacatattagtaatcaatgattagatatcaaagctttttgtataagaaagtatataccaggagctatgtagccatatgtaccagctagcgcactccaattagatgaatcaggtctcaaaatcctcgctgtaccaaaatctgagacataagccttcaaagttgtatcaagtaagatgttgttgctggttatatctcgatgaaatattggtggattgcagtcgcggtgcagataacatagtgcttgagctacatcctttataagaatattcctcttttgccaatctaatgccttagctaactcatcatcagctaaggtcatatggaggcttccctgctctatgtattcatagacaagaaacctgtactctggatgggagcagaattcatacagtttgacaatgctacgttgtcggatttctgttaagatgtacatttcacatgaaaatcttttttgatcacccaaccattattaagacgtgtgaagctgcttcacagcaactacctgcccgtcctggagttgtgctcgatagaccttgccataacctcccgctccaatgatgtacttgtcatcgaaatcttctgttgccctgacaatatcctcaaatgctaatcttccatcaaaattccaaacagagaacatgtcccttcctttggctgtagtactttcttgtggttttctcttgctatgaataaacaccgttccgagaacaactgtagcaagaatggcaaaacccagaacaagaacaaccggcaacagaaaacgaaatagctttcttttgttgtgaccaggtgctgagtaacaagacggcaggccagagagattaccgcatagacctttattgttgagaaaccagcttgctgaagcattttgaaatagtcgccctgctggtagtggtccttctaagttattgtatgacgcatcaagtgttgataggctcaccatgcttgcaaaggaagtcggaattcttccagtgaactggttgtgagataaatttagaaataccagcatctgcatccttccaaagtcttgcggcaacaaaccatcaagtttgttattgctaacatctagcatgatttgtatgcttgctaaatttccaattgtggcaggcaaattcccactgaagtggttgttgttgatcctcagtaactgtagtttggtgcatctcccaagttcctcaggtattggtccactcaaactatttctggaaacatcaaggtattctaaatctctcaggtttcccaactgcgaaggtatggatcctgataacttattgaacgacaaattcagactatatagatttattaaattccctatttctggtggaatcacaccatttacatgattagaactgagttttagttcaactaggttgggcaatttagacagagctggaggtattgtgcctgtgatcatattttctgctatatttagaatagctaattctggacaagcaccccactttggtgaaatctgcccagagagcctattggacatcaagctcatctttttgagttttggatacacaccaaaatgtttggatatatctcccgttaactggttgccatcaaggaaaagtcgaaccaacgatgtgcacgtcttcaagctcctcggaacagggccattgaacatatttaaagacagaaataaaagtttgaggcttgtgccagcacatatatttgctggcaactgccctgaaagggagttacttgctaggtctagctcaaccatgtttgtgatatttccaaattcctgaggaagagaattcgacaattggttactacgaaaattcagattttgcatgttttgaaagttccctaaagatttcggtattgagccggaaatttgattctcttccaaagacaaaagttgaaggttcactaggttgccgaactcctgggggatagagccatttatctgatttttactgaggtccagtgcaattagcttggtaaggttcgctaaggtgccaggtatagagccagagatttgattgctgtgcaggattaagttctggagatttgatatgatccctagtcctgggggtattgaaccagtaatttggttttcatggaggaaaagattgttcagcatagtgaggttgcctagttctgtgggtaaggaaccttttaatttattttcattgagaacaagatcggtgagcatggcgagattgcctatttcagggggaatggaaccaattatttggtttctaaagagatagagtttgatcatcttagtgagattgcctatacatgtggggatttcaccagtaagtttgttatcaccaagagcaagatattgcaagttggtcagcttgcagagttttggtggtacaggccctgacagttcattaccatctagatagaaagtatctaggttggtcagatttgctagagttgttggtatctcgccgctcaacgtgttgttgctcagctgcaaaagctgcaggttggcaagcattcctatctcctttgggatgggaccagagaccatatttcggtgaatggagagctcggtgatcatcgtcaggttacccacggatgcagggatgtggcctgtgaggttgttgtacgaaagatcaagcatggtgagcctctgaagctcactgatctcatccggcattcttcctgtgagctggttgagttgaaggtcaaggtaggtgagtgctgatagagagctgatacttgagggtattgggccatagacactgttgctgctgagatcaatatatgtgaggaagg

SEQ ID NO: 94273 - DNA, 3348 bp, Oryza sativa
cttttaagattacattttcaacacaggtctgttgaccctcctctctcccctggtcatgttatcttcctctctgtaagtttcatgttgtgactgagaatcctcccttttgacaggtagaagagctgagaactaacctaaccaccataaatgatgcaacaaaagaggtcagtgttacatcctgcaaaatttcaagttatgacttttccttctggctggcttattcagttattgatcactttgtgcaggtgaaagagtctctgaagttaaggcagataatgcagaccattcttacattagggaatgcattgaaccaaggaacagctcgaggtatcaaatagttgaagaaaaattatggaataatttcttcgatggtctttttaatgtgctgattggttgaacaggatctgcggttggcttcagattagacagtcttcttaaattatcagatactcgagctagaaacaacaagatgacactaatgcattatttatgcaaggtatgcacttggcagtgaggaagtgctattaacatatactgttgtgtgctgaagtttctcagtttttggtgtggagaatacctcaaaataattcaaagttggttagactttaatagtttctggtgaattgtgccacttgttatgcattcaaatatggtatgcatgatagtcataattttgttgttaatctctgcagttcgaataatttattcttgtacaaatttgagtttggcaccagtcgtgtcacataacttcctgtggtcaaaattattttgttacatattatctcggtctactgtaaaatattttaagatgatttagctatagatttgacaaagctcatatggatcaagtcatcaagcaattctggatttgtactattattttatatgaaagtatgcatgctcctggtctcctggggatacgtgagcgtgtagttaatgcattattaggcctcacaattggataattagttacaatactcgcttggttcccttaacaattgggtaccaggttaccatttttcagaaaaaaaaaactcacttgctatttgtgccacaaaggtttcgaagagctcttgtaggatacccccaattgttctcctagttggtaagaggactataaatctcagatgtagtttgattaagtatgtctcatgcttaatctaaactagaaacaaaaacatgagtctgggccatcaactggatggatgattcagatttcagagcataatttccttctatcctcttacagtggagggctgaaaattgagttggatcattaccccacataagcactagtatgcgaacaacaccaacttaaaagcaccggaggcaatttctttgcttaccctgtgcattgctcaattcaattatatcagaaaagacgtgttttacacttgtgcagttactactattacccatagactatatctactggctcccaaaccttttgaaaaggaacaaattttaattgtattatttacacttgggtagtacttgtgaaaagtggaattttgatcaattaataaaaaactacaaaagcatgaaactgagttttaagttttagattcagattctagttcgtttgatagatttgcatgttgcatatttccaactttgtcattaatggaaattatacaattttatatgcatgccagcatgtgttcataattgaaatgcatgcccctcaatccatgtaataagccatcccaagtaaaagtaatgtaattaattctttctatgtatgccatttcgatgaataggaaagtttgtttcttgtttcatgcttccattcctttcaaggaagctttggacgtattaacaacaatgtttttttttccgccgggaaggccgaaggaggccatccggatatattaagaaggaaaaaagtaacaacaatgtttttggtccttttcttttcattatcccatctaaatatgaacttatagaatattttcctttcaaaaaggtcaaagatgacctattacctcttaatgtgtaataggacacctatactagccaatagccatttgatcaagaattcaaaagaatcggcatccatcaaagtggagtaccatacggaaatattcagtggtaggctgttttccactaacaaacagagacactgagacagtgaaagcgtggtttatagaattttgggtgcatttgtctgacattgcaagttactgatttcaaacaagttaatgtgagtctaattgacgttattcaatcatcttgaaaagtcagttttctggggaagtccataacatcatggactcatggtatctttgcaacttgcaaggaccaacctggtttcctttttccatacactggcgctatttacacggacaacttttaagtgaactttcaaaatagttttccagtatagctattgctattcattcttttaacttttggtatgccattatagtgtagtacacacatacactggctgataaaggttcagttttagttctgcattttactctgcaagttcataaaagagtacctatcgtttaatccgttgcgtactataaagacttttgaactactattcagtcagttgccttgttgttagtattgtttgtttacacagtttagctaatttctttctatttctgttatatgctagcttctttctgagaaattgcctgagcttcttgattttgacaaagatttaattcatttggaagctgcttctaaggtactaaatctttactgattattatcttgaatattgcaatcctcgatgactattgagctgctaatcaaaatgttgctccataactgcatttattatttccctcagatccagctaaagttgcttgcggaagaaatgcaagcaataaacaaaggtctagagaaggttgagcaagaattagctgcttcagtgaatgacggtgcaatttctgttggtttccgtgaggtagaaaaattcccccttttgtctgagaaatattaatcatatttataaccagtccattgtatggaggagttgtaggttactcatttttgccaagaacactaaataaggtctgtaggttactcattaattccaagaaacactaaataacttgacactgttatttaaagtgattaagttagttgtccccaaatgatttgcaatttgatatattacagatattagtatacgttcatacaaactgcttttagtaatgtagtatacgttcatacaaactgcttttgcatgcctcctttgttaaagaatggcctgagtctgacatgcagtatgtttgatgagaatttgtgtcatgtgtgcgcgaaacaaatgaaatactacatccgtttcaggttataagactttctagcattgcccacattcatatagat

SEQ ID NO: 94274 - DNA, 5432 bp, Oryza sativa
tatatgaatgtgggcaatgctagaaagtcttaaaatatgaaacggaggaagtacccttttaggattgaatcaagataaactgcttttgcaggcattgaaaagctttcttgatgcagcagaggctgaggttaggtccctaatttccttgtactcggaagtggtgagtccctactgtatttttttttacaaagttatttgtgtttggaaagatcctgacaacattaattttgtagggaagaaacgctgattcactagctcagtattttggcgaggatccagcacgatgcccttttgagcaaggtatagtcttttttgttttggtacttcacattttactagtcattatcttatctcacaaatagttgcacattttatccacatcaccacatattactgaccgatcatcatccaatgtacaaaaatgcaatgattctcatcaaagatcaaaatttaaaattccagaccgaaaattctcgcgcatggttaaaaatggaagatgggttatctatgaactgcatcatcgtgcttctgtgaatgtgattagcattaatttatttatcagcacagctttatttactatggttgttttttttttcagtgacatcaattctggttatatttgtgaatatgttcaaaaaatcacgtgatgaaaatgctcgaactgcggaacttgagaaaaagaaattagaaaaggacaaggaaaaggcaactttgtctgcaaagaaagtcttggaatgatactactgctacactgaagttccatctttgcgaagtagagccatgatccagcaccagccatggcggagatgccaaattgtgtattgtaaacgagaacctgcttctgcttttagtggacatgcagggctgtaatgcctggaagctgccttgttggatgggtgcgatccacgaaatggtagtatcttaactccttccgtggtatataagatgttttatagtcttggctagctattgaatgattgcagcctgcattagtccttatcaatatcaatttgtgtacacaagatgttctatccaccaaatatacacaagcctgttagtattccgtatttcaaagtcatgttggaatgcatttctaatgtggtcattttcctccttgcagggtgtcatttggattgcaaccttggaaagttctgtgattaccaataggcggcattggcgatatggctgagcgaagtgcagcgagaagtgctgctgctgacagttttggtgtaaatacagtagttactaggatatagttgtattacctgtacatagaatatgcagcccaagtgggaggaaagcaattaagcaaacaacagtagtgttgtataatcaagaacaatcatgtttcccttcgtcacaggtgttaattcgtggctcgccaatttctcttgtgctttgcattttgctcctttctaatgcattggttactcaagtaaacagccatgataacaccagaatgcgcgtattgaacttgggtggacaagcaatcaagctatcttacgtactagcactgagaatttgggatgtacttctcgatgatttgttgatctcattttgtcgaacggatctactccctccgctcttcttgttgaatggaactaaccaacgtcaaacatttcagagggagtacatatattttcttctgcaagtttgtgatgaagacataagcgcgtaacactatacagaaaaacccatcttgagtttgatttagtattttgcaatttgtcaaactacggtgaaaggtttatgtaggaagcagatgatattttttagaaatggattaaaatccgacctctacatccaaactttgtggaattctgcccaacaagcagtaaccattctactgatgtagaagctacaaagttagtacacaatagttgcccttaatcaccacataacaagccgcctaggtgtacaattgagcattatcatgaaatatgaaccagtacattaattcctattttgaatatgatcgtcttctcccgctgattctttcaccgtatttctgatacatatctaactataattgaacaagtttgtcatggtcagcaatgaacactacaggaaagtacaataagctcagggatttcattgaaacctccgttccacagagactttgggggttgttcggttgactgactgcagtggctgtcgtggtgatgttacgtttgttactgtagctgctttgcttctttgcagggcatatctagtcctatcaaataacccctttattttttatttttaactttcttcattttccaataaaaaaggagaaagtttaagaaagtagaggacagatactgaaagttataaaaaggagaaaacaaatgaattaaagtttaaaaaaagtggagggcttatcttttagctttatattggtacatgtgagacagaaaagtaataaaatcttcttaagacagtaactacatatgttcgatacttcatcttagttgattatactccctctgtttcgagtcaaatttcttaattatgaagaaaattatattaaatgcggcatcatttccaacacaaagtaaatatactattaaatatattatggatattatgggactaatgagccctgtttttttagaaaataatgagccgttgtggggattgtggattggtggcctcttcttcccctccgccggcggcaatcggcgaagacggtgatgtcggaggttccaaggccgcaggcgcgcgtgccatatatcttcacgaccatctctttaaattctccttctgatagcctacacttgaatcgatcgatcattcatatctgtcgattgagaaaagttcattcaagtgaagattattcatatcgatcaatcggtttctgtttatgataaatcatacaactcctgcattgcaaaaagaccaaggatgaggtgatgcaaaagatctagatctccaggatgcgtgcttcctcatgacgacctctaaccaaatgcattggttacttaggtggatgcaagggaaggattagaatcaaacctattaagcatttgattgatgcgtttgcagtacactgaactctgaatactcaatacttaatacgctaaaatgtcttcctcgcgctaaggcaacttactgaaactgaaataagtgtttgataacaaatcaaactgcagcttttcagctttaagcagacacactaatatatattttacaagaaaccgcaagcatatttatacatctatgtatttcttagttgttctagtgtaacttcattgaaacgtatagggcatgagctagaggaatgctgctgaatgagagtctggtatgcctccatcattgttggccttgcatgaggagaagcttccaggcaagaaatggccaccttgatgagaatttctatgctttcctcttctgctgttgtgggtgctgtaggccgttcatccaatatttctttgaccaatgtatgttgctgttctgatgacaaaagagtttgcaacaattccataggatgcttccccattaccacctctagaacaacaacaccaaagctataaacatcacatttctctgtcacgacacatgtgaaggacagttctgcaccaagaaaagaacagacaagaatgaaataagtaataatcattgagaaaactgcactttaggtattactcaaattttacagaacataccaggagctatgtagccatatgtccccgctaatgcactccagtttgatgaatccggcttcaaaatccttgccgtgccaaaatccgagacataagccttgaaagctgtatcaagtaggatgttgttacttgtgatatctcgatgtattatgggtggactgcagtcatggtgcaaataagatagagcttgagccacatcttttacaagagtaactctcttagaccaatccagttcttttgctagctcctcattttttaaggtcatatagaggcttccccgttgaatgtagtcatagacaagaaagttgtagttcggatggaagcagaatccatacagtttgacattgcttctatgacggatttgtgacaagacttaaagtcttgtttcatcatttaactcttcttcaactggatgaagcttctcgacaatgactacattcccgtcttggagtcgtgctttgtagaccttgccagatcctcctattccaacgatgtgcttatcattgaagttttcggttgccctgatgatatcctcaaatgctagtctgccatcgaagttctagacagaaaacatgttccttgcaacagtaatagcactagcgctttgctgttgttttctcttgttatgaacaagctttgtgatgacaataattgtagccagaatgacaatgaccacaacaagaacaattggcagtagcaaacttagtagctttggcttatggtgaccagatgctataactgaataacaagttggcaggccagagagattaccacacaaacctttattgtgaataaaccagcttattgatgcattttgaagtagatgtcctgcagggagaggtccttccaagttgttgtaggacacatcaagaactgttaagctcaacatgctagcgatggatgatggaagacttcctctgaactggttgtgagacaaattaagaatctctaacatctgcaaggttccaagttgttgtggcaacaaaccatcgagtttgttgttactagcatccaatatgatttgcaggcctttcaaatttccaattgtgcctggcaaattcccatgtatattgttattgttaatcttcaaagattctaacctgatgcagtcccctagttcatcaggtattggtccactcaaattgtttcttgatacatcaaggtaccctaaattgcttagctttcctagctgtgctggtaaagatcctgagagctgattgaatgataaatttagcttatataggcttttcagatttccaaattctgctggaatctcaccactgatattattaagatcaagtctgagcacacctaggttggacaacttagagagagcaggaggtaacacacctgtgatcatgtttccttgaaaatacatttcctcaagctgggggctagcaacccaatttggtgtgatctgcccagagaacctattgtatgccaagctgaccgttttgagatgtggatacacaccaaaatgttcagatatgtctcccgtaagctggtttttgtgcacggcaattctaaccaaacttgtacatgtctttaagcttctcggaatggggccatcgaaggtattcacactaaccatgaaagttttgagtctgccccccatgcatacatatgcaggcaagtgtcctgaaaattggttattatcaagccaaaggtctggtatgcccgtgagattttcgaattcccgaggaagagaacctgttaatcggttatgaaacatggtcatcagttggatgttcaccaagttaccgaaagttttgtagcatcgaatcacaa

SEQ ID NO: 94275 - DNA, 1009 bp, Oryza sativa
tcactctcatcaagccttcgtcacctacatcatccagattctcgtgcccctcttgggagccattagtctcattaaattgaacgtcggcggtttcttccacaatacctttgttcttgttgtagacccggtatgccttgctatttgaggcataacctagaagaaacccttcatcacaccaactttcaaagttggttagtctagcaccctttcgataaatataacacttgcaaccaaaaactcaaaaataggcaacatttggcttcctcccaacaattagctcataggaagtctttttcaagagacgatgtaaataaagcctattggttgcatggcaagcagtgtttatggcttccgcccaaaaggaatcggaaacaccatattcatcaagcatagtccttgccatctcaatcaatgtacgatttttcctctccactacaccattttgttgtggtgagtaggtagcggaaagttcgtgtttaataccaagatcatcacaatagtcctcgatattggtattcttaaactcggaaccattgtcacttctaattttcacaagagtgcaactaaattcattttgggccctgtttgcaaactttttgaaaagctcggcaacaatagacttatcatgcaaaaagaacacccaagtatagcgagaataatcatcaataatcacaagacaatgactattaccaccaatgctcttataggttgttgggccaaacaaatctatatgcaagagctccattggtctaggtgtagacatgatactcttagtaggatgagaacatgcaacttgcttgccggcttgacaagcactacaaagcttatccttctcaaacttcacatctttcaagccaacaactagatcacgttttgaaagtttgctcaattgattcatgccaacatgggctagcctcctatgccaaagccaacccaatgaagtttttgcaactaaacaagttttcaaatttgcttcactagaattgaaatcaaccaaataaagatttcc

SEQ ID NO: 94276 - DNA, 7035 bp, Oryza sativa
catagacccgtggtgaaccggatcgatctcgcccgtcgatttggtcaagtatagatcaattagatctcggccattggtttcgtaggcctctgtgcacccggtctaccgtggactgccttcgatgacgcaataaatccctttttcctttcaaaaataattctttattgcgtcataattcaattaaaatccatataaatgatttaatccgatttaatctttaaaaattcataactaattcattgtaactcggtttaatgtggttcaagttgcaaaagttatataaaataaatatctacatattaaaattatccataaattgaattaaatttatttaatcctttttaaatgggctttaattagattaaatcttgtaaaattcgtaattaattcatatgaagtcagaatgaggccgttcaagtctcaaaattcatctaaaatcatgatctacatgtttgtttactttttatgtattgtttatttggtttttattagtctttttcctcgttttgcgtgttagcttgttgtttcgaaggttcgcgagtgcgccggaagtgttcaagaagattaattgaagacccgttattgcaaggcaagtcacacagatcccaaacacaattcctttgagaatgttgatcctatatttaaattccctatttatttcaactgtgcatttattttcgaatgtcaccgggtggtatgaaactattcctttgttatggccaatttgcattgatgaccctatttcttgattaccttgggttataattggactagttgtacttatataatggttcaactagatgttagacataattgcttagctatgcttagaaataatagcacattattgggataactaatgattcactattactttacttaataatggatatttaatggtatctcacgctggtcaatcgtgattagttaattaattaattgccaattaaaacttgataatggtgggttgtgatcacatggttttgatggtagtgctcatgacaattaaggaccggttcacgagttttggttgtgaaacattaaccgtgccaaccacaagccagaatgggcaacggctggacactttgtatagcaaggctcattgtggagtgccagactgagaagtggcggagataagcccacgggggtcgctggggagtccatgcctctagtttttgagggggtgactacgatccgggaatagtgcactgctttgagttgagttatgtgaggggtcttgtcacaatcacttgccatggtgacgtgtctgcgcggacacggtgacatgacggtgggttgtgtcttgtgggtacagtggtacacctctggccagagtaaaactattcgaatagccgtgcccgcggttatgggcgggtctaacaatgtctttcgtgattagtcccacactactcattaataataatgtggtaattgatggtaattaatttagcttctggtttggaatggtatattcctggtttggagatagatctgtacagccgggtatggttgttcaggatggttgggcctgtgcagcatgggtgtgctgttcagtgttgattaatattgatgattaattactctactgttttacaattctcaattgtttgctaaatgctgcttttgcaaatgagccctatattatgccattctttggtaaccttgtgcacttacatatttgctgtgtggcttgcggagtattccatgtactcaccttgcaataatcaatcaaacctcagttgaagacaagttgcgaaggagaagacgtttggcttatatcccagttgagctgcctgtgggagtggagccggagcttcgctagaccgtaattccgctgctattttcttttcttttgtaagtatataacgttattattatgatgaatctgtatattaaattgtcagtttgtgtacctcggttgattcctggacgaggattttatgcacaaataagttcgaaaattactagtgaatttctgggcgtgacatccagtatcaagcacccaatggctcccaccggtgcggtagttcacctataaaagaagatcaagctcttttaggtacacaaacttatttgggtccttggaggttagataccaaagctttgggcaccaaaatggcattctttttaccaccaagtataggggaacccacatatctagcaacaatactaccatcataagccttcctaagcatataatgagaatcaaacatgcatgtcttataaggcttaccaccggggcaatcactcaccaaatgcccaacctcacaatacttggagcaatgcttaccgttgctcttgacaaaacgagtggcacggtgagaaggtttcttactcttctttggaatgaatccaagtccctccttgttaaggatgcaccgttgctcactcaaaatcttgtcaagagtgttcttgccgttgaagcatctctccaaactcttgttgagcttagccacttgctccttaagctcgttgttctcaacaacaagtgaggcatcacaaattgaaacacaagagctagagctagagctaggcatatccataagatcatcacaagagatagaaatgctagatgatgcaacatgagcaatatggcaagtagcactatcatcaagcaaatcacaagatatgccaacattaatgtgagctccatgttgagtagtggaaaggaggttgtcatgagcttacttaagcttcttatgagaaatggtgagtctctcatgagaggtctttagctcctcatacaagacctccaaagaagcatgatccatttttagggccttgaacttaacaatctccttctcactataagcatggagctcctcaaacatactcacaagctcatcataggaaacatcatcacaatcatcatcactctcactatcactaagagatgttaccttagaagagccctttgccatgagacaaagtggagcgaagagtgttggagcctccttgatgacaacaacagccatcttcttcttcttggagcttgcatcatcaccaccttcttcctcggacccagatgaggcggagctctcctcatttgagtcccattctccgatgaaggcctcaatcttcttcccttccttcttgagcttcttcatgagcttgtagcctccactcttcttcttggatgacttgtctccatcatcatccttggaagggcacttggaagcaaagtgtcccttctcaccacactcaaagcacctcaagttggagagagtcttgttgggtctcctatttcttctcctattggagttggagcctcttactctctcctttcttcttcccaagagatcattgaaccttctagcaagaagggcaatctcttccttcaagtcatcattggcttcattcaccttgctcttgcccttgtcttcaacttcggcttggagagcaatgcacttcttggatggtgaggcttcctccatctccttcttcttcaacttgtacatgtcattggtgttgatcttccccaagaggcttgcgggtgtcatccttgacatgtcggagttgatgagcatggtgacaagggtctcatacttcttcggtagagccctaagcatcttttgggcaacctcaagatcggtgtaggttgccccaagccccttgagatcattcacaatgacattgagcctcccatacatgtcattcacgctctcatgaggcaacatggagaatgtctcatattggatcttgaggaaatgaagcttggcatccttgtactcacttgtaccctcatggatctccgccaacttgttccaaatctcatatgcggtctcaaggttgctcactctatcgaactcctcttggctgaaggagttgaacaaagcattcatggcttgggcattgagttggaggttgcagtgatcaatctccgtcaagggtgtgccggtgatagcaaagcctacatccacaatactccaaatatggaagctcatagctttgaggtgagtagacattttaattttccaagtggagtagtttgtgccattgaacatgggagccttccctacatggttcacctcgttcgacatcttctttctaggcggtgaagcccaatcaagagagaccaagctctgataccacttgtaggatcaagatgtcgactagaggggggtgaataggcgatttaaaactaaatgacacctaatcaaaactaacctaagttgctaggctcgatgagggacaagtctaactaagcaactaagttatgttttgcaatcctagggtgaaagtggctcaattatatcactaggaaagtaaatcacactttctaagtctagtttagcaatcctagggtgaaatgatctctagtatgtctctaggaatgtaaattgcacaaatgtaaatgcaacaagtaaatgagacaaggtgacaagagatttttcaccgaggttcggaaactcgccggtttcctactccccgttatggcgagcccaactctaccgctcaaccacgaagccaccgcacgcccccttcgtcaaggggtgggcaaggcgggagccggcccacggagaggactacccaagcttcgatcactcggggtagtttttccttcactccaaagttgatgaactccaaaccactcacaaaccggcgccgggcctccttcacaatcttctcgaagaggtcaccgggcaactcttccacaagccgtctaggaggcggcaacctccaagagtaacaagcgatgacccagcgtagagatgatcaagtgacacactagctctacaatgaagcaatgcacttgactcttggctaatcaaccctcaacactacaatggatgaacactaagctcaaatgtgtgtgagagaggtgcaaggggtgtatgcaagtgatttgggtgctaagagagtccccttgctgcaggtgggggagtatttatactcctaccaaccaaaactagctgttgggggtgaaatctcccaactctgtgctctgccgatctgaccggaggtatgtggccggttagaccgtgctactctacaacggctagttttctagctgttctagggctgtcattgggccccacagccctggccggtcagaccgacatggggtggccggtcagaccggccttggctcggtcagaccgccctcagctcggtctgaccgaatacggctccggcggctcgggatcggccatcccagagcatgccatcccggccatatgaccggccggtcagactggacaacacttgccggtcagaccggctttgtggaggcgggcagaccggccgtgaccctgtggtcagaccggctgcactggccggtcagatcggcacttgggctgcggtcagaccggctctggtcaggccacacagtgaatgcacaaattgaaatatggggagagtctaaatgcgagcacaagtctaaatgcataatgacctaatgtggcaattaaaatcatctctttgctaggtcattacccatcttaatagtacggcgaaggtaaaattacactagcaaattcgatcgccctacacctcgatcaatttaaatataaagtactagtttaccatcttctcatccttcgctttgcgccgtcaattttaatccttcggtgatcatccatgtgcacacaataagtgaacctaactcaaataaatatctcaaagacaacggttagtccacaattagtgcttgccattaattaccaaaatcaacaacgggggcctagatgcttcaacgggtagaaaatccgctaactaaatagaaggaggtacggtcttgctcgttggacccaaaacgacgcggcccttgccaataggtaaattggtatatatcttcatatttatttctgttaatttgattttttgcatcaaagcatgtttgaatttccaaaatttgcatttagacttaattttgaggaaattacttcaaatgaatttttcagagcaaaataaaataaaattttcaatgaaaatttgctatgccatgaccacactgaccattggattccaacggccaaaagtggggctggttgggcctactaggggtttggtcgaaccggccaggcaatggttggcagccgtctcttttcgaggtcacggctagttggccccacaggccagttttgaccgttgtgggcaccctatgttagccaaccggctgggagaggggatttcaccctatttcaactcattttcactccccttccaaactttgctctcaaaattcattaaagctttgcaagtttgcctcaaattcaagcattttagttgcatttgcaagttgtcttggtgaagctaaccggcgggtagaagtcttgctatcctaacccccgccgagttagtccattttcttgctcatttgtgcataatgaagagacgattgtcccgattgttcaagaagggactcagctctccatcaagtcgccatgacgagtccagtgctcgttcatccgtcgatgtctcaatggaggaagccgaagttccaccacgcctcttgaatgacgccgaccttgaccttgtcggtgatcgtgagctgcaagcctactacatgctaaaagaccggttgtttgctcacacccgggcatacgatctggagctgttgcaaaagataggtatgaatgttgattttcgtaccatttggaaagctgttggatggcagagatttgcgatagtagatgagcctggctctcgtttgctcactttgcaatttctatgcactttgaaagaaatagaagatggaatttcctttcgttttttccgtaaagaacataaacttacatggaaaggattaagtacacttcttggttttcatgatgcctataaaatcgatcttcggaaaggaatttccgggttcgagaaaaacatattttgggaagacatttctggtgctccaatttgcaagaaacctagaacaaatgacatccataatcctacacttaggcttatgcacaaatggatagctatgactttatttccttgaggtgatcttaggcccataagagaggatgaattgattatcatgtttgccatggttagaaatattaaagttgctcatgtgaactgtatgataagaca

SEQ ID NO: 94277 - DNA, 1173 bp, Oryza sativa
caacgcaaacactttattttgtaactcctgataatattcttctacagatttatccccctggtctgagcgttgcaatttctttaaaagatcacgtctaaaagaaggagcacaaatctagtgtgcatatagttgtctttaagagcaggtataatagcagactataagcaagctataaacacatatcaagaagataaaagaggagagagaagagcagcgggctacagatttgtagccagcaacagcacagactccaagacataatgtatgtgtgacaagtgggatcatatattaatagtgtagtatatgtttatagataactattgtatatattggctattaaattgaccatagatgatttggagctaatagttggttatactattaaacttgctctaacgcttctcatgttgtaggtgctagtccatcaatacttatttgagtccatcacaatgttgcaaaatcattaaattcactagtagcttgcctaaccctatgctcatcaggaataaatgtgcactaaattttttatctacagtcatttctcaatcaaaataagcttcagcattataggcaccatgaaaagagggaatcgtaaacttaactttaactttagcatatggatcatcacacacattatgaaaattacctccaatacctcgacgattgaagctcagcaagtttctatcaatattatcctattttagattcaccaacctgtcgagacaattattgatcgttgtaagattggcattcagcatgcgctggaacctctcggtagaggtttgaaccatcctctcgatcacaacagtcatatctctgttgatagctccacattggtctttgaggactttgacaagttcctccctgagcacgcagtccttaaatttatcgttggtgcatgacatggttagtagaatatagaaaatagcacaaggatattatccctatcaactactaggtgatgagagaaagacacttgcactcaagcatcttaccacacgcatacacgtagcaagagatgcaaccagtggcgagaagaatcacagtaggaagtatagtgctactatgcatttttggtggttatcagttgagtacttgagttattttatcttggacctccttgcatcattgtgcaggaagtacagccataagtaggcatgaaaattcgatctg

SEQ ID NO: 94278 - DNA, 725 bp, Oryza sativa
tctttctctcatcacctagtagttgatagggataatatccttgtgctattttctatattctactaaccatgtcatgcaccaacgataaatttaaggactgcgtgctcagggaggaacttgtcaaagtcctcaaagaccaatgtggagctatcaacagagatatgactgttgtgatcgagaggatggttcaaacctctaccgagaggttccagcgcatgctgaatgccaatcttacaacgatcaataattgtctcgacaggttggtgaatctaaaataggataatattgatagaaacttgctgagcttcaatcgtcgaggtattggaggtaattttcataatgtgtgtgatgatccatatgctaaagttaaagttaagtttacgattccctcttttcatggtgcctataatgctgaagcttattttgattgagaaatgactgtagataaaaaatttagtgcacatttattcctgatgagcatagggttaggcaagctactagtgaatttaatgattttgcaacattgtgatggactcaaaataatattgatggactagcacctacaacatgagaagcgtttgagcaagttaatagtataaccaactattagctccaaatcatctatggttcaatttaatagccaatatttacaataagttattctattaaaacattattacttaccaccctaatttaaaaattaattatattgggaaaatcccccc

SEQ ID NO: 94279 - DNA, 740 bp, Oryza sativa
attttttgtaagaagtcctgttggtgcacttggtaattcacagagaagtaataaagtggtcatccactttaagagttcttccgatttgtctttcaccgggtttgggcggtttaactggcaactaaccgcgggttagaccggtggcatcgggccggtccggacgggcgggagcaagggcgctctaacccggcggcggcaacagcaatcggcagatgatctcggtggtcagaccgaagatctaatctcggtcagaccgacgacaaccagcgggtcagacgggcagggcaatttcggtcagaccgcaatccgtcgaattcgagggtaacttttatttccgctaaaagtttttggtttttgggtataccaaccattcacccccctctggttggcttagttcttgtcattcgatcctacaagtggtatcagagtcttgttttcttctttggatttttatcgatctagagtttttgccatggctactcccgctcgtttttcaactaagcctcatgttttcgatggaacggatttttctcattggtgtagtaggatgcaatcttacattatggctgaagattatgatatttggagaaaagtttcccatgcttatgtgattcctgaagctattaatactgctgctgaaaaaactgcttttgaacaaaattgcaaagctcgcaacattcttttgagtggtatttctcgttctgattatgatcgtgttgcgcatcttcaaactgctcatt

SEQ ID NO: 94280 - DNA, 3812 bp, Oryza sativa
cttaaaatgttggtcgtaagccccccggggaagaggtatccattgtaatcccgtggtaattccatgcatgggaccttccgtatgttcctgggcccgaaataaaggcccaattcttcctcgatgttaaggagctccccattaaagagtgttgcaaaacaattgaaatgggctatccggaattaattgttgtccaccggcaatattgctttcctttccgagagttccctttcccggtaggtctcccttccatggcgtgattcaggtaccccgattggccaaggttcttgaatatattctccgcaaaattctattgtcctcctttggtccataaccccttggcgatgcttgcctctggacgagcacgggttacaaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgtttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagtagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccaggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacaagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtaaaaaaaactgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatcattagtcccggttggtattaccaaccggaactaaagttaagatctttagtcccggttggtgctaccaaccgggactaaagatcccgggggggcctgacaggtcctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgtgatttttttcaattatgtaagaatgctactcgaatgataattctatggtatttttgtaattttttaatagcagtcttgcaataacgtggaattcaaaccaatggtaaatttgtaattgcgtgtgtttttgatacaggaattttgacaccactactatttagacccatcactgttctcttatttttatcagttagctcttttgtggatcttcttgtgtaaagtcaggt

SEQ ID NO: 94281 - DNA, 710 bp, Oryza sativa
tgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagtaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctggttcttgtggatattggtcgagcattgcgacgtttactttccgagggtcgatgaattcagtatcgaaaacccttcgccgtcgggcctttgaatctcattt

SEQ ID NO: 94282 - DNA, 1304 bp, Oryza sativa
aagttctttagtcgcggttgttctcaacacccgggagtaaatatcttttcccactatttcaaaattctttttaaacccggttagggttaagaaccgggactaaagattcccgctattaattataagtcatatgattttcgcttacatatgtgtttataaaatagaagttaatgcattaacattatttaaagtacaaagattgatgacaattacttcgaaaaattatttttgtctgtaataaattaagtggataaatcgtaataagcaaatatatgacttataattaataaaaattccaatatatatatattcttagcatatatatgaatgatattattatattggtaaaaactctaattaagatattaatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgaaacctctagtaatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgctagggtcaatcgtcaccgtaaaagggggttgcccatccaactgatcgtaatcctcgtcagtcttgtcctcaactccgacgatttttcttttgcctgggagaaccacttgacgcttaggctcatcaggccctctgcccttctttcctttgctagacatgttcttaacaaaaagacttgcgttacattattggcaaagacaaaatgttcctct

SEQ ID NO: 94283 - DNA, 823 bp, Oryza sativa
cacggaacaagagaacccttaaaaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacaaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgactctgcgaaatt

SEQ ID NO: 94284 - DNA, 844 bp, Oryza sativa
tcccaagaaacagaggacatcttcgtccatctcctgaaggcgcagcattacaagacgttcatactgttgccatacacacaagagttagtttattttactgtctttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattactactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgattttttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaa

SEQ ID NO: 94285 - DNA, 3866 bp, Oryza sativa
tccaccagggaaccgtgaggcccccctttgtgagttcggccgggggcagcgggtgagatttgaggatttggtgagcgaaactgtgtggtcttgagggggttagatcccccaaagatgatgagacaaaaggggtttatatagattcgggcagctgagatgcgtagtaccctactcctgtgtttgggattatggatgagtgttacaaagattccttccctccagagagctctttcgccctacttctcatagagttcaggttttcttagagtcgtccgtttttttctcggtgggcaaggttctccttttatagttcaaggggataccatataggcccaacaacctaacttcctcgggaagtattaccatttttgcattaaatgcatgtcttgttccttaacttggaagccgcatacatgtcgcctcggtcgtggggcctaccacaccatgccgcctgacacggggggcgcctatgtcattcaccatttaatgggtgaagacttttgggctcctattacatcgggaaacgggagcctagctttgaacagagcaggaggaccgactccggctgggataagaggatgagaacctctcaccatcattatttgatgggacatgtcaggctgcacgccacctgacacacgagcagcgaacaggcgcactagctagttccatcggtcattcgaccggttgagtacactgcacgccgcattaaatggcgcgaccgctcgggtcgccataaatgcgggtaggtggacacctgtacgtggtgacctagagagggggtcgggggagccctacccctagtcacgggagggggccgccgacgcccgaccttgggcccgatcctttctcaggggagggccacgtggcgcctgtgtcagacttttacctctagtctcggcgagggagtggccgccaccctatctcgggcctgactccccttgggggagggccatgtggcattgggggggcggcctcctccgactagtctttgggaaggagtggccgccaccccacctcgggcctgactccccttgggggagggccacgtggcatttgggggcagcctcctctgactagtttttgggaaggagtggccgccaccccacctcgggcctgactccccttgggggagggccacgtggcattggggggcggcctcctccgactagtctttgggaaggagtggccgccaccccacctcgggcctgactccccttgggggagggccacgtggcattggggtgtagcctcctctctctaaacatgatacccccgggcccatatcaccgacagtagcccctggcgttagctctggccaaaacctttgacaggtggtcagggttgacgccaatctgctagtcagttgacatgcgggcccgatcttctgtcctatcattctgggagttgggcggtgggagtttagtcacgttcatacgtcgcctttacttcccactttcctcccggtctccgaggcgctgcaggctcgggagtttagcccgtaccttaggtcgtgaacttattttctgtatatactcagcaaatgttgttagactctctcgggcccgtgaccttacgccgcgtacctcgcttgcccctgcctcttgttaacctctgttcatgttctacttcatttattcaaacgattatttttgcgtgagcgtggggactgaactttccattgtcaacaatctttacccgctatcaagccaggctgggcgccgtacccagccggcggggccaaagctagctgctacggaagagccagcacagggggccccgggcgtcgacggcgaccagagctcgacgtagggctaggatagagctaggaatcatagcccccatacttctagcaaagaatcgtttgaatggatgaggtgaatacaaactttttgttaccaagggaggcaagccagcgcgcgacacgtgggtaccgcgggaccgcgaggaagagatgggcgagagataaacataagcaataataattctatgcaaacgatcatctttgcgcgagtgcgaggactaaattttccatagccaacaatcttcacccacgatcaagccaagctgcgcgctgtagccagccgacggggccaaagccagccgctacggaagagccagcacagggggtcccagacgtcgacggcgcccagagctcgacgcagggctaggatagagctaggaatcgtagcccccacacttttagcaaagaatcgtttgtatgaatgaagcaaacacaaaccttgcttgcatgtcgtgacctttcaaacctttagcttgaagagggcctccctccatgggtccctaaccactttgggaagcctgcgaccacttagcaaacgaggttaggttcccacaagcctgtgtccccacgctacacattctgtttgatctttcttttcggtggcctccttccaatatctctcccttctacacagacgactactttcgcccgagtgtgagagccgaaaaactctagagccagcgatccccgtccacagtcgagccaggccgggcaccatagccaaccggcgggaccaaagctagccgctacggaagagccagcacagggggtcccgggcttcgacggcacccggcgctcaacttaaggctagaatagggctagaaaacttagcccctacacctagcgaggaaacgttcatgtagatgggagaggaggttgggcttttaccactgagggagcaaacaaatgcgcaacacgcgagcgtcacagggccatgagaaaagaacgggggaaaaataaatataagactccaagctgtattaagctgatgaattgaaaaattgaaaatacttgaaacttgaaaggactattagttgagccgggccaggcaccgtagccagccgacgagaccaaagctagccactgcggaagagccagcacagggggtcccgggcttcgacggcacccagagatcaactataagagtcctcccaggagtagaccgaggtaggcagcaggttcatgagttaaccccgcgcttggcccctgagggccatggggaagaagctcgccatgacctgatcatcaccccccgccgcctctatgatcgtcgtgcggatctggagggactcggaggggttgacgccgtcgtcatacttctcagtgaggctgggccggaacttttgggggccatcggacattccgaagacttgcctcaaaggcctggtagccaagcttaactggtagggatgtgggggccttgccccctgcctgaggtggcgcgacactcctgaggatgctgcgccttcccccttagcggcggcgcgacactcaccacgccggcgctcgaaagaacctcaaaaatcacgaacgcgccccctacctggcgcgccagatgtcggagaatgaactcctccaccagggaaccgtgaggcccccctttgtgagttcggccgggggcagcgggtgagatttgaggatttggtgagcgaaactgtgtggtcttgagggggttagatcccccaaagatgatgagacaaaaggggtttatatagattcgggcagctgagatgcgtagtaccctactcctgtgtttgggattatggatgagtgttacaaagattccttccctccagagagctctttcgccctacttctcctagagttcaggttttcttagagtcgtccgtttttttctcggtgggcaaggttctccttttatagttcaaggggataccatataggcccaacaacctaacttcctcgggaagtattaccatttttgcattaaatgcatgtcttgttccttaacttggaagccgcatacatgtcgcctcggtcgtggggcctaccacaccatgccgcctgacacggggggcgcctatgtcattcaccatttaat

SEQ ID NO: 94286 - DNA, 620 bp, Oryza sativa
tttctccccctccttttccccttttcctcctcgccggcgtcatcctccctgtcgccgctttggccgcgaccgccgagcgccagctcgcgaccttgaccgcgcaagtcggttcccaaaccgacattgccgcccatttaaaccccagcctcccctttcccttcctctcccattcgtctccgcgccattgccgccgcccccgtgctcagtctcgcctccgccgtccttcgccgagcgccgggagagccggtgcgttcgaggacgcggaaggggacttcggccgcgccctcttcttcctcttccccggcccgaggccggagagattactcccgcgccgtcggcctcttgtcacaacgcccctcctcatcacggtagtgcctccctccgttcttcctcctcgcttcatcttccccccttagatttcggtagtagctcgagtagcctccccgtagttagccggcgccgccccgaccgtgccgtcgctcgctgtgtgctcgctgccgtcgccgctcgagctccgtagcacccgcacgttgccagcctcgctcggcgtagctccgtccaatccgacgctagcgtcgagttcccgaagccgcgtagatgctcttaccgcgggaatcgac

SEQ ID NO: 94287 - DNA, 878 bp, Oryza sativa
agagcgagggcgcccgggagagagggggccgggggagagatgggccgagcgggtttcggcccatcgacctcgggggaggcaaaatagacttttgcggaggaatttgattggaaggatttggattcggaattgaactcgacgatagatcggggattgagatcttgagatggcacggacactagacaataagcaaagaagcaaatttcgtaattagggtttttaagagataattttcccgctaggcgccacgacggaatgggcactacagaccaacccccctaacaagaatctcgaccctgagattcagcacctaagggagcagctccgggaactcggcgcggagaagatcttctcgctcccaggttgcctcgtcttcaaaatgattgctccattggactttgtagaacttgatggtcttccttcgagtctgacgttctgcctcttcaagaaccttgatcggtctttccttgtaggtcagattcttttccagttcgatattacccagggggacttgctcttctggaactcgaagacatttctttagctgggatacgtggaacacgttatgcacatctgcgagaccttcaggtaactcaagctgataagccacttcgccacgtctggcggttatgaggtaggggccgatgtagcggggtgctaactagccggacatcccaaaccttctcacaccacggaggggtgatactcgcaggtacacatgatctcctttttcgaactcaaggtcacgccttcgattttcagcgtaacttttctgacggttctgcgctgtctttaaacgttttcggattagcttaacttattcttctgctgacttgagtatgtcaggaccgaataccagtgcttcgcccacctcattc

SEQ ID NO: 94288 - DNA, 590 bp, Oryza sativa
tttccttgggttgtcgtgtccccagtacacggggcactccttggaccgtgttagccctcactgcgagctctcatgagccctttgcccccgtggaggtatacacggagccggccttgttccacaccactttaccgggggcaggcccactcttcaaatagcgtaccaggacctctcctggactgctcttcgtcacctggaccaccactacagtcaccttctcggaggctgcgtcttacggcagattccacgcctttcttctggtcacttatacgccagtttcccttgggcgtacagcgagtctcagccagtgcagactcgcatggttgtgcttcctgaggcttagggcacatcaacacgacctacttcttgaggcttaccgctcccttgcccgccgatactccgctctggaggcccgtcttgccgatgagggtgtcacctcagttgacactatctactgtgacttaggtcggctctgatacaccagtcaactgtgcttccacagctatccgtgggtgtgcacgcactcccaatggttcgtgcctcccccaacttttgtgcgccgtactcaacagtgtacttcccctacccac

SEQ ID NO: 94289 - DNA, 854 bp, Oryza sativa
tatagggcgaattcgagctcggtaccccttttccttttctgttctcttgtgacatccggaattaatttcacaatacaagaaaactaatcttttttaaataaataaataaaatgctaaatatatacggagtggaatggaaaaaaaatggtgaggtaaaaaagaaatccttgctctagatatgaagagttaaaatcagagttgatgtcgagcagataaattggtaagctgagaggagaaacgatgcgatcgtgttctagttagggaatgagagaagtgacgcccccaatcgagatccatagatcggtgaagacgaggaatggaaaattcatttttaaaaaaaaatataaaaaaactaaaattaaacgaaaatggatgatttaggaaaggaactcgtcgatctccgtagaaactacgaaaatccatctgaatacacgcgagaggcgaaggttcaggttgatggaggaggaggcagcggaggtggaggcaacggagagagcggccggcgaactcgttggtcggaatggggggaagtacgtacctggcggcgccgaggacgaggacgaggttggtgaaggtggggcggtggttgaacgccctcgacgcgccctcccacatgaacgccgtccacctcatcgccggcgcggcgccctgctgctgctgcctcttctccggtgatctcggaggatatgctcctccgctctaggctctagctagctacgctacggcgagaaggtaggaggagtagagagaaggtggtggaggaggaggagacggaattggtgtgcttttcgtctggtcgccgtagacccaggaagaagaaggcctatataaaagcttgagtattctatagtgtc

SEQ ID NO: 94290 - DNA, 1389 bp, Oryza sativa
caatggtcagcctcgacgggctggacggtctgagagaactctggcggacgagacctcagaaagtctgtcagctgggatctattgttgctcatgtgagggtggccatttccatgcgtattatgctgaaaaccggctatggctgcggctaatccttgcaagatttgtgtctgaactgccattaagtgttgcatgttgttttccacatgaggtggggaagggaggcgttcttctccagaattgtgactggcagtgtggtgagagcggtgagactattccatcttcgtatcacgggaagctgtacgatgcgagcggttgctgtggcggggttgctcaacttctgcgttgcgggaaacagtacggtgtgaacggttgctgtggtgagactgctcattagctgactcatgatttgcttctggctcggctctaccatcttcaaaaccaaagcgggctggtgcacgagctgcacggcgggggcggctagccatctaaactcccagaagagggcggggtaagagttagataagcacttaggagggcaagtagcaaagtaaatagcaactcagatagcacacactaggcataaactggatttttcaaatcataaaaacacctgatacaacgggtgtggacaagtcacagagctacgccgagcttgactgtgcgcacaccacctaggagaaccagactaccaaacaacacccacaacaaacacacgcacgcactacctcgccacgactccaaaagagttggcggcggaacaaaagggcctgacacccggacggctgctgaagactgcctcctctactcctcgtcggcctggctgcctcctgtagtcggctcctcagtcgaagaaacgtcgatcggctggcgcgaagggaccggcggaacctgtcgagggccggcagcagcacgggccgctggcggtgggggagctgggtagtggaaacggaacacggtggaagaaccaacaacacgcttccgcgcggtgcggataaagcgtgggccacggcgggaggaagcaactggggtgtgtccgggggtgtaggaagggctaactgggtgtgggtagggggagtacactggtgagtacggcgcacgcgagctgggggagcgcggaccactgggagtgcgggcagagccacgggagctgtgggaggacaggtggctggcgtgacagaggcggcctgagtcccaggagatagtgtcaactgaggtgacaccctcctcggccagacgggccttcaaagcggcgtagcggcgggcaagggagcggtaagcctcaaggagtaggtcgtgctgagtggcctgagcctccgaaagctcaaccatgcgagtcagcactggctgagactcgctgtacggacaagggtacctggcgtctgagtggcc

SEQ ID NO: 94291 - DNA, 525 bp, Oryza sativa
agacaccatcaccatcagaaaaaagttctgcgccgccgccacagaacggacactcaagcagaaaagcccaatgaggtagcttgagatcgaatatcattggtttcatgctgcctcccgctgtttcagtgctttgagcttgtcgcggtactcatcccggatccggatgaagtcttcacggcggtagttggtcatttcgtggggaccattgagccagttgacgtatccctgaccgtaacgagcgaccaacccagcttcgtattgctgcgccacggtcgcctctttggcggtgtacttgccagctccggcattacaggatttgcactgcttatgggcgttgcgttcttcaaagcgcagttcagggtaagcacctactgtcttgaaatggccgcaatcccactggccaccatgcagatcaggcggattggtctcgccgcagctgatgcatggcaaatcggcgtcgcgcgcacggataaaggcgttgaaagctttctgagcctgagccttgtagtatccgtctggcctgag

SEQ ID NO: 94292 - DNA, 3121 bp, Oryza sativa
ttttatttatcaaaatcacaagtattaaagttctgtccagattatttcaaaatcaatttttcatatttgtaatgacccccataatgacaaggaagaccattctaagcatggctaagcattatagtaacctagtgactccaaaattcatatataaagtggtatagtcatattgttcctaaggttaggaatgagggatatggatatatgtggggtcaaggtgaatgcaaacaataggagtttgtctaacaagtttaacaaaattttaatttattagtgtacaatcgacatgcaagatttgcaaacattttcaataacctccaaaacataggttcaaagtgatcaaagagatggaggtgggacttgccttgaatcaggaaaatgtcagcacctaaatcacttcttcaccgtttaagcaatcatctatacaaagtacacgttatgcaattaaacaccgaaatatgcgaaaaatccaaaatgctctaaaatggatgatttgtgcacagtgaataggtactggtctaaaattaatttaggtgaaagaatttctattttatctcattttatttgggagttatgaattttagaagtttcgtcggtatagtgtaggatttacttagttactgttgtgaaatgctattgtaaggtaattcttattaagtttatgtttgctggggtgaagatatgtgttttctaacactaacacatttggtttcataatttttagagttaatatgaattctttatgtattttacaagttttaacgtgtcatggctttagaggtttagctctagaacttgcctcatctagctagtgatgtataaaatgagtattttagttaactaatctaaccttagttcataggcttatggtctttattatcatggttcatattttataaactaagggagctctagtccatgttagcaatttattatatcaacctagaaattattatatgagctaagtgccttaagttttggtggatgggaatggaactatgcattcactggtctaacaagttttatttgagtttcattatagctagagtgtatttctatatacatttatatatatacatattgctcaatcgatactatgtgattagcacctatcctataaatttaaagtttagagctataacctgtacagaaggttccatattttattttactatgttgaagcccactgtttgctggttctatagatatttggttcacttcatttagactaaagatgaattttctacaaattttacaatttaaggttgctctatgatggttattacttacataagtatttagaggcttttatcatacagtaagtatataattttattttataatttggaagtatatgttttggtgattctacagaacttgggtttactaaaaaagatctaagatgaattttatatgaacttctaaaattcagcttatctaaaactagtcatttaaaggtaatagttttagaggcatttgatgtatagtatgtatactatttcattttgctttataggagaacataagttggtggatctgtagaaactgagtttgctccaaaatgagttgaaatgaattttgtatgcattttataaattttgtgcgtgctttctgtgtgatttaacttggataaattttagaggctaaatttgtactgtgagtgcaagtttttattccataacatcaaagttcccaatttggtgagttcacagaaatttgaatcatcttaaaatgagctatatttaattttatatggatttttacaagttttagttactgttcttttataatttcagattttgtttccaaggggtgcactgtcagtctcaggccaatatgcaaaaaggctcctatagtttcaggaaatcaacccgcagtcctatgactgttctgtgtgtcttgagcttttgcataaagagccctatattaacctaaattcttgtgacgaggtccctggttcgagctgaagcagatcaagccatggctgagctcgatctcaagcttgccagcggcaaacggtggctcgtttgagggtgcgaccaaaagacaaaatgaagatcatgctattgcgattccattcctcttcttttcttggtcagtggacatcggagtaacgccggcggcgagtccgagcggcggctgtgcttaggctgctactgcatgttgagttggtgctcaattctaagtgaatgaaatgcatgaatgcaatcctatgggctcaagggtgctcaccgaaccttgaacgaggcgccggaaagtctggacagcggcagcggagaagaagatggtccggcgacggtgtagagctccgggaagacggcaacggctcgatccactcatcgaattgacatgcatgtgttttcatggggttagtgaggtcccagggatggtgtatacgcgaagaatcggacaatggctcaccggaggaggcggaatcgacaatggcgacggcgaccggaggtggagaagacggtggacgatctccacactcgtagcaccattcttgaagattcttgaggggaaatggagaggaggttgaggtgaagctggtggcgtggtggctcgctccggcttgatctagattgatggcaacggcgacgatgttgctgcggcggtgcgcagagcgcgctccagagctccggtgtgcatggcagcgttcccgccgattggctgcaccagagaggatgaaatcaaaaggagaaatattcggcatggtgaggagagtatggaacgcaagagaagaggaaacgaccgcggctcatcaacgattgcggccatcgtcttcttcgcagccggtgatggagaaccagtggagaagagcagcgaggatgctctccctcgtatggatcggcactggaatggtgggtgaagagtggcgacgcgtctgggagaggcagaaatggagctcggcgtttttagggcgtcgacacgtcgtggccacgcgtcgtgcggcgtccagagccggtcggcgctcgatctctccctctcagtgtttctcggtcggctagggaagttgcacagagaaagggcaagccggagggactgacaaggggggcccaggtcgaagtaaactaggtggaagaagatgtgtaggcagaaacatgggtgagcttggtttttg

SEQ ID NO: 94293 - DNA, 5639 bp, Oryza sativa
tggcgagaacgacaccacctttggtcacatgtgtgctgtgatgaggggattggacaggatgcactcggacctgcacaaggcgaccaaggccttgaacgatgggaagctcatgaggatcgttgctctgaaggacgagatagcgcgcctgaagaaggagaacgctcagctaaagggtcttccagcgccaggaggagtccggatccgcactacgccccgcaagactacgacggcacccgtgcgcatccagcttgcgcccaggaacccacctccagcagcaactcccgcagcacctccagttccgcccgcagttcctgcagctccagctccagctcccgagtccgctctctccttcgctccagcatcagccgccagaggtccagccagtggcaccggaggttggttgtctgctactcccagtggcagcggcgagacgtatctgccaggctccaggagtcgctcagagggacttggtgacgagcaggaggacgccttcgactccaccgaccgcaggagccgttccgagcattaggctcgtttttcccattagtttatcgactgtctagcttctgcttgttagttggtgtgtttaggttgcttgtttggggtcagtcgacggtcgatatcatgtgcctatgatatggctgtcttaataaggatttttgcttgctctttaagtgttttaattcagatcagaacaattgcagttttaattcctttgtaataaagcttagtttctgagcatctgtttttcttctttcccccccgtctgcttttccctccagatggtctacaccaggactggtagccgcgcaacaggcgagggcagcaacggcgaagaacgcgctaatggtgtgcaccccagcagtgattccggcaatggtccgccaccacttcctgagaatccgacgctagcccaagttatggcacatcagactcagatgatggcagccatgatgcagcagatgcagcagcagcaccagcagatgcaccagaggatgatgcagcacgccgaacagcagcaccagcagtttggtccccctccccctcagtccaagttgcctgagttcctacgtgtcaggccacccaccttctccagcaccaccaaccctatggaggcaaatgactggctccatgcgatagagaagaagctgaacctcctgcagtgcaatgatcaggagaaggtcgctttcgccacacaccagcttcagggtcctgcgtcagcctggtgggacaatcacatggccacccgcccaccgggtactgaagtcacttgggtagagttctgccgtagcttcaggaaggcacaggtgccagatggggtcatggcacaaaagaagagggaatttcgtgcactccatcagggcaacaggactgtgacagagtacctccacgagttcaatcgcctcgcgcgatatgcaacagagaatgtccgcaccgacgccgagaagcaggaaaagttcatggcgggtttggatgatgagctgaccaaccaactgatatccggggactacgctgactttgagtggctggttgacaaggcaatccgccaggaggatcaacgcaacaagatggacaggaagaggaaggccgctcagttcagggcacctcagggaagtcaccagaggccgcgcttcactcccggacagcagggtggacctaccaccatgatcgtccgtcagcaccgcccgttcaactccagcaacttccaccagggctctagtggcagtcagaaccaccatggaggtcagcccaaccgcggtgcagctccacgcccacccatggcaccggcacagtcaggcccgcccgcgcaagccaagaaggagacgggagcaaaaccagggtcctgcttcaactgtggtgagcttggccacttcgctgacaaatgcccgaagcccaggcgtgccgggccaaggtttatccaggctcgtgtcaaccacgcgtctgcagaggaggcacaaacagcaccggaggtcgtactaggtacgttccctgttaactcaatccctgcaacagtactttttgattctggtgcaacgcattctttcatttcaaagaaatttgtggggatgtatgggttaaggaaagaagagcttagcacaccaatgagggttcataccccggggaatagttcaacctcagtcagttttagcccttcagtgctaatagaaattcaaagattaccatttctagccaacctcattcttcttgaatccaaatacctagatgtcattcttgggatggattggctgactaagttcaagggagtcatcgattgtgcgaatcgcacagtcaccttgaccaacgagaagggagaaacggtagtgtacaaatcactagccccgccaaagcaaggggtctccttgaaccagatcgagatggaagtcccagtggtcaccgaggagaagaatttgaagaaattggaagacatacccatagtctccgagtatccagaagtgttccctgaagacctcactaccataccacccaagagggagattgaattccggattgacttggcaccgggaaccgctcccatttacaagagaccgtacagaatggcggccaacgaattagccgaggtcaagaagcaggttgatgagcagctgcagaaagggtacatccgaccaagtacttcaccttggggtgctccggtcatttttgtggagaaaaaggataagacgaagagaatgtgcgttgattatcgcgcactcaacgaggtcaccatcaagaacaaataccctttgccgcgaatcgatgatttgtttgatcaactgaaaggagctaaagtgttttctaagatagacctgtgatcaggctaccaccagttgagaatccgggaagaggatattccgaagacggccttcaccactcggtacgggctatatgagtgcacggttatgtctttcggacttaccaacgcacccgcattcttcatgaatctgatgaacaaagtgttcatggaatttctggacaagtttgttgtggtgttcatcgacgacattcttatctattcaaagtccgaggaggaacatgaacaacatctccgtctagtactcgagaagttgaaggagcaccagctatacgccaagttcaacaagtgtgacttctggttgacggaagtaaaatttctgggtcatgtcattacagctcagggtgtggcagtcgacccatcgaacgtggagtcagttaccaaatggaccccacctaagaccgtgtcgcagattcggagttttcttggacttgcgggttattaccgccgattcatcgaaaatttctccagaatcgcccgacccatgactcagttgcttaagaaagatgagaagtttaaatggacagctgagtgcgataagagtttcgaggagctcaagaagaaattagtatccgcaccagttttgattctgcccgacccgacgaaagacttccaagtctattgtgatgcatcccgtcacggacttggatgtgtcctaatgcaagagggcagagtggttgcgtatgcctcgcggcagttgcgtccacacgaaggaaattatccaacgcatgacttggaattggcagcagtggttcatgctttgaagatctggaggcactatctgattggcaaccgctgcgaaatatatacggaccataagagtctgaaatacatcttcacccaaccggacctaaatctccggcaacgaagatggttggaactaatcaaagactatgacatgagtattcactaccacccgggtaaagccaatgtggtggcagacgctttaagccggaaaagttactgcactgccctatgcatcgagggcatgtgtgaggaattgcggcaggagtttgggcatctcaacgtgggaattgttgaacacaggttcgtagccgctctggaggcacggcctacgctcgtggatcaagttagagccgctcaagtaaatgatccggaaatagcagagctgaaaaagaacatgagagtcggaaaggctcgggatttccttgaggatgagcatggcacgatctggatggtagaaagattgtgtgtacctgacgacaaggaattgaaggatctgatactcaccgaggctcatcagacccagtactccattcacccaggcagcactaaaatgtatcaagacctcaaagaaaagttttggtgggtcagcatgaggagagaaatagctgaattcgtcgcactctgcgatgtttgccaacgagtgaaggcagagcaccaaagaccagcaggtttactccaacctcttcaaatcccggaatggaaatgagaggagattggaatggactttataacaggactgccccggacatcatcgggtcatgattcaatctgggtagtcgtggatcgactcaccaaggtggctcactttataccagtgcataccacctatacggaaagagattggcagaattgtacctcgcaaggatcatgtgtttgcatggggtacccaagaagatagtatccgaccgaggtagtcagttcacctcaaaattttggcagaagctacaggaagaattggggacccgtttaaatttcagcacggcctatcacccgcaaactgatggtcagaccgagcgagtcaatttaatcttggaagatatgttgagagcttgcgctcttgattttggtggagcttgggacaaaagcttgccatatgcggaattctcgtacaacaacagctaccaggccagtctacagatggcaccgtttgaagctttatacggtcggaagctttatacagccatatgcgctttattctgggatcagacaggcgaacgtcaactgttcggaacagaggtattagcggaagtagaagagaaagtcagaatcatcagggaaaggttgagaattgctcagtctcgacagaagagctacgcggataaccgtcgaagggagctcacttttgaggaaggagattacgtgtatcttcgtgtcactccgctccggggagtacaccatttccagacaaaaggcaagttggcaccacgcttcgtgggaccatacaaaattttggaacgaaggggagaagttgcttatcagctagaacttccatcaaacatgatcggcatccatgacgtgttccatgtgtcccaattaaagaagtgcttaagggtacctgaagaacaggttgattcggagcacattgatatccaagaggacctaacctatgtggagaagccggttcgtatacttgataccagcgaaagaagaaccagaaataaggtcaccaggttttgccgagttcagtggaatcatcattcagaagaggaagcaacctgggaaagggaagatgagttgaaagccgcccatccgcacctcttcaccagctcctccgaatctcggggccgagattccgtttaaggggggtaggtttgtcacaccccgaagtttccctcccaagccaaaattgtaatttataaatgaccctaagaaaataccggtgcaaatcaggagaaaaccctaagaaagtaatgcaaataataatcggatttgacatgtgggactttttcttgagttctacaggtcgaaattcattaacaggatttttagtggaattttcagagctctagaaataattttaaccaattaaaattgagcaagcaatattttaattccagggaaaatcctttttcctttttctttt

SEQ ID NO: 94294 - DNA, 2833 bp, Oryza sativa
agaaatgaacaagaaggttcaacatccgtgcaaatgtacgaagccggttagtaaccatctggggatgcacccggatggacccaagctctacaccatagcctcagaggctcggtctggaagagtgccagcgagagccgacagagagcatctcatgacatacactggggaacatgaacattcattccctcagatcaagcagtatgccttcatcccccaatgaatggtgaatggtgctcaagttcctctcgttaggacttgggagaaattacaaggaggatggataaaattgacatgcaaacgggagagatccaattcaacctggatgtcgatttctaggatcggcaatatattttaaaaggtgggctagatcaaggatagatggtgacgcagggattatcttggttcaagccctctgagagaggaaataccgtacgtccagtgtgttctttcttgtgtatagtggaaaaatggtcggagaagctagacagaagagtcgtggagatgattcgacctcctctagggaccccttccccctcttatataggatgagggggagggttacaaggaaagtatctagttgattgcaactagatcaacctattctatctataaaagatatgcaggatcctcgggatttatatcttatcccgggaatctctctttctttatttacaagtatgacgcatggggcctaggacacttggcccaccccatgcagtgtggcccaagggttgtcattgggtacccgggtaccgtgtaccccccactcgatgaacacttaacacagacgcaagaatgacaaccgaatgttgatgctcagttcaccaacaccaacaacgcaacctgatgcagcaacagcatgacgaccttcaagcgtactttcgcttccaggggttcaatccttatcaaggaccctgagcgaaaggcaagcttggtgggagacgtctctccccccgctgaggtaacttgtatcacattgcatgtttccctttccaaatgcatgttttattttcattgcatcttataaactaaaaacaacataaaaattgcaaaatagaaaataccaaaaaaataggttagactttattatgctaggtaagacaactttttttttgactagaaatactgccaggactttgcccagcagtgtagttttatagaactcaaaaaatgttttcaaaattacagaggaaagaaaccacacaaagactataaagtttttaaccaatcagaaacaatttgttttaagggacatatgtagaagaatttctttcacaaaaagtgatctccaagcttggaaagatggctgaatattctgtaaagtaagacaacttagttctctttgttgaaatgatgaatagttgctctgttttatatctctcatatatggggtcatggttaaatactctctcaaaagtcgaataagagtagccaacaaatatccgggagcctaagggaagtgagctgcacttgctgatttgagtctaagttgttgtgagatatgagatagtaaataagagttgttatgaccctagtctgaatttgacttgaattccaaatgttttctttttctaaaataataaactcatgaagttcctcatttgatataaatttctaccaaagccaaaagtattcttattggataaaccatatacattttggtgggctgtaattccattggactttatcaaatttttgtgacttgggtagaactttttcatgctttatgattaagatcacacacccacatatatgcacatgctaactttctacactggaagctagcatccatccatttcatcttgatattccttcataccaccatccaaataaattctccatgcttaaatgtgctttcttctcctagaaagaaaatcctttcttaaaaaaaagaagagaaaataaggagggaaaggcatggctatgaaaataataaacttatgctctctcaaaatataaatcatgatgatgaaaaaaaagtagccatgccctctccatatttatgaaaggaggattttggagaagaaagtaagcacaaaggagaagcattttctttattttccacattccattttccacaatataacacacacactttgcacgatcttgatcttgagaatgtctagtcatctattttagtccaagtttttgacttagtgataaatgtgagtacaagtatgccaatgccatcgagatcatctacagtatcttcggtgtagaaatttgaaccctcaacgacgccctcaaaacaacaattagggctctccatctctaactggttgtatatcacaatcggacacttttagataatctccatcccaaacttttccagataagcaatcaactccatccatctcccaaatagtcaaatcggcattaccaacattaactgacttgtcggctggcacgatttctatctggtctcctttccattggatcaagctctggtgcatggtcgaaggaatacaacaatttgcatgaatccaatcccttcccaacaacatactgtaagaacctttcccatcaatgacaaaaaaggtagtagaaattgtcttgctgccaatagtcaactccactttcaaaattcctttggttctgaaggattccctccaaagtctttgagcaccatcttagtcttgatgagatcatctgaattcttccctaacttcctgaaggtagaataaggcatcaagttcacagcagccccaccatcaactaacatcttggagatcggcttgccattgacaaatcccttgacatataacggcttcaaatgccgatgccctgttccttctggcttctcaaagatagcttgcttaggtgacagacccaa

SEQ ID NO: 94295 - DNA, 2649 bp, Oryza sativa
gtctctgtgtgtgctgggccttcgttgcccatgtaataagttatctatttacgcttccgcttgttaaactctgaattgtatcaacttttggtgtaccttgcctcctgggacaaggattaatgcacgcacgtaaggaatgcccgttgggttatttccggtcgtgacaacttctccgcgccgagcagtgatacggaaaggacccacataccgaggtgcgagcttcccctttgtccgaaacctgtgtacacctcgcaatggcgtgacccgaacatacacaaagtcatccactgcgaattccaggtcacggcgacggttatctgcataacttttctgccgggactgtgccacctttagattatcccgaatggttctgactttagcttcagcttctctcaggatatcagtcccgaacacttggctttctccaacttggtcccacaatagcggtgtccggcatttgcgcccatacaacgcttcataaggtgccatttgtatgctggcttgatagctgttattgtaggagaactcggcataggggagactcttatcccaggtcttcccgaaatctaggacacatgcgcgaagcatatcttctaggatctgatttagacgctcggtctgtccatctgtctgcgggtgatacgcggtgctgaaatttaatcgggtacccagctcttcttggagcttcttccaaaagtgagaggtgaattggcttcccctatcagatacaattttcttggggacgccatgcagacttacgatcctagcgaagtagagttcagctagtttgttccctccataggtggtctttacgggaatgaaccgtgctaccttggttagtcgatccacgactacccatatagaatcatatccgccttgggtttttggaagtccggtgataaaatccatcccaatttcatcccatttccattctggtacttggagaggttggagaagtccggccggtcgttggtgctctgccttgacacgctggcacacatcacaaagggccacgaactctgcaatttcccgcttcatactaacccaccagtatttctccttcaagtctaagtacatcttcgtactgccagggtggatggaataaggactttcgtgagcttcctgaagtatcagctgtttaagttctctgttatctggaacgcatacccgatttccgttccatagggttccgtgttcatcctctgtgaaaccagcggctttaccctgtttcatattcttgaggagcccatgcatatccgggtcattcttctgagcctcgcgaatttgatcgagcaaggtaggcttggcttccagcgtagccaagaatccacgactaactatgcttaggttcagggcttccatctgttgattaagttccggtggaatgccacggacgttaagagtgttgcaatggctctttcgacttagagcgtcggcgaccacgttggccttaccaggatgatagtgaattcccacatcataatccttgatgagttctaaccatctcctttgccgaagattcagatccgactgggtgaagatgtatttcaaactcctatgatcagtatatatttcacagcgattcccaatgagatagtgccgccagatttttagagcatgaaccaccgcggctaattccaagtcatgggtagggtagttgccttcatgaggtcgaagctggcgtgaggcataggccaccacatgaccgtcctgcatgagcacgcaccccaatccttggcgcgaagcgtcacaatacactatgaagtccttgcgagtatccggcaagattaacactggcgaggcaaccagcttttctttgagagttctgaacgccttctcacattgcgggctccacacaaatttctcttctttcttcaacaactgtgtcatgggtcgagcgattttggagaagttctccatgaacctctgtcacgaccggaaataacccaacgggcgttccttacgtgcgtgcattaatccttgtcccaggaggcaaggtacaccaaaagttgatacaattcagagtttaacaagcggaagcgtaaatagataatttattacatgggcaacgaaggcccagcacacacaaagacaaacgagaaacaacggaagactagggcgacgaccacaggcgcttgacggcaggcacgagctagacaccaaagccttcatcttgcaggaactcctcttctgggtttgggaaaaattgagcaagactgagtacaaccaccgtactcaacaagacacacccacaagtgcagaataaatgcaagggagtacaaaggagttatactataaaggggttagggttgcagtaaacagcatttaaagatatttagttgctcaaagctattttgtaaacacgattctagaactatacaagattatttatcaaggccgtgaacccacacgaacctgccttaacccaaggcctacgatgattcagaccgaactggcaacccgaccctgggtcccagctcgtcccaagccaacccaggccaaccattccacattttagttgttaagcagggtttaagaattaaaacactaacttgggtacattgctcggcttggccataaccgagggcgcggctattcgaatagattttactttgatcagaggtgtacatttttacccacaagaaacat

SEQ ID NO: 94296 - DNA, 3353 bp, Oryza sativa
  unsure (1)..(3353): unsure at all n locations
gtatgggcgcaaataccgcacaccgctaatgtggaaccaagttgaagaaagccaagtgttcggaactgatatcttaaaagaagctaaagctaaagtcagaaccattcggaataatctaaaggtggcacagtcccggcaaaaaagttatgcagataaccgtcgccgtgatctggaattcgcagtggatgattttgtgtatcttcgggtcacgccattgcgaggtgtacacaggtttcggacaaaagggaagctcgcacctcggtatgtgggtcctttccgtatcgttgctcggcgcggagaagtcgcttaccaattggagctgcccgcctccttgggcaacgtgcatgatgtgttccatgtgtcgcaactcaagaaatgtctccgagtgccatccgagcaggccgactcagagcaaattgaagttcgcgaagacttgacctacgtggagaggccagtaaaaatcctggacaccatggagcgcaggaccaggaaccgggtaatccgtttttgcaaggaccagtggagcaaccacgccgaagaagaagctacctgggagcgcgaagacgagctgaaggcagcccatccagatctcttcgccagttcttccgaatctcggggtcgagattccgtttaaggggggtaggtttgtcgcgtcccaaatcgactctaaaatacatcctcgaaattatgcaaagaataagtaaaatccatgtgaaagcctccaacaattaaaatgtgcaaagttaaaagtcaaataaggcttggaggatttttgtatatttcctaaaagcctaaaatgcgtaaatacattttagtggaattttcagagcacataaaataattaagaagaaataaacaaagttaaagtggctttataaaaagaaaaatccctaaaagtctttttcctcccccccttccccctcttgacatcannggcccacgtccatccctctatgtcatctcccccgcgacccatcggcctcctccccgcgcgcgcgccgctgacgggcgggcccgcccgccaccctcgctgacgggcggcgggaatttaaataaagcgataatgcaataatttaaatcaacataattttacaaactgggattcaatatgttcaaagatgatgtgacttgccttgctcgctttcccaaacgtgggcttcaacttccaagaagagcgggtcttccgaagctgcagcgtctacacgaccaacggaaaagaaaaggctttgactctaataaactccatataacaagcagaaccaaagcacaaaaatgggttcttgacttcttaaggaaaaattagagacttgacgggtccaattccgagttcaaatggtcaagttatggccatttgaagtttatatgctctttaaatgaatatttgcgattttcttcatttaaattttaatttaaaatcggatttattgcgtcagccgaggggaggggcgcgcggaccgggtccacgggagtggggcccacgcggcagcctcacggtccacggtggaccgggtgcacgcggcttacgccggccggcgccgtgggtcccacgcgtcagccgcacccgaggacacgggcggctgacggccgggccccacatggcagccgcggggcgcgcccgaaggcggcctcgccggcacagccgacgggaggcggcgcacccgcgccccgatggtcgccggcggcgacctccggcgcgacggagcggcgcccgagagaggggagggaagggggaaacgaaatgggcggtccatggctcaccccgggtcgacggcgacgacgggaacggcgaccgaagcggaggaaggcggcggcgcggctcgggtcgacgaggacggcggcgttccggcggtcggcgggcgaaacgaaggggtggacgagatcggcgaggacgcggcgaacccgaagaaggcgacgccgaaacgggaggaggcccggggcgacgacggcggcggaccggagctcggcggcgacggcggagagagaggacgacggtgcgagctcgattccgacggggagagagagcggcgagtggcggaaacgaaggagggaggcacggggagtgtttatgtagtgttgggaggaggagagagcggccggatgagggggaatcggtcgcggaagatccggccgccattgatgcgccggcgaagtttgcgggagagtttccaaacgaatccgagggagagagagagggaaaagtgggggggaaagggagagggaatcacggggaatgatttccccctctttattgcgcgcggggacggcgggatgcggcggaatccgcggcggcggcggcgctagggcacgggcgaggcggcgggtgcggcgcgaggtaggggatgacgggtgggccccacccgtcagcgagggtggcgggcgggcccgcccgtcagcggcgcgcgcgcggggaggaggccgatgggccgcgggggagaggagagagagggagggaggtgggccgagccggcccaagagggggaaggggggggggaaaaagacttttagggtttttctttttacaaaaccactttaactttgtttatttcttcttaattattatttgtgctctgaaaattccactaaaatttatttacgcattttaagcttttaggaaatatacaaaaatcctccaagccttattcgacttttaactttgcacattttaattgttggaggctttcacatggattttacttattctttgcataatttcgaggatgcattttagagtcgttttgggacgtgacacattagtacacattcgggacaacttatgactcactattatttaatgatggcttaatgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacataatgtggggttgtgtcttgtgggtacagtggtacacctctggccagagtaaaactattcgaatagccatgcccgcggttatgggcgggtctaacaatgtctttcgtgattagtttcacacttctcaccttaatgaatgatgctatattggtaataatt

SEQ ID NO: 94297 - DNA, 2088 bp, Oryza sativa
tcatgcttttttatgtgctgatttggtgattttgttcttttctgcttagattccgtcgtttccggagagtccgttttcgcacaagaagagtttgaagagttccaaggccagcaaggcaagtcacacagatcccaaacaaccctttgagcatgttgatcctatttaaagctattgtttctattcaactattgcatttattttcgaatgtcattgggtggaattaacatattctttgttatggcccttttgtacttgattactacattccttgataccttgggttattacaatttaactagttgagctttatttatattagttcaactagatattagatataattgcttagcttgcttagaaacattagtacacattcgggataacttatgactcactattatttaatgatggcttaatgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcatgggcaacggctttatcttttgtatagcatggttcattgcggggcaccagactgaaatgtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctggccagagtaaaactattcgaatagccgtgcccgcggttatgggcgggtctaacaatgtctttcgtgattagtttcacacttctcaccttagtgaatgatgctataattggtaataatttgattagctcctggtttggaatggtatattcctggtttggagatagaactgtgcagccgggatggttgtacagaatggttgggcctatacaacagggtatgttgtatagtgttggattaatattgtttaattattacttaactgttttattaaattctgaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttcttcaatgaggctgatggtgtggaggattaggtgtagccttggtcaagctgcctgtggagtggagccgtctgcgccgtttaatttatttttccgctgcttagatctttattgattgagaggaactatctacctctgtaatgacattttacacgcttattaattagagtaataattgtactctattatcaatttgttattgtgtgcctcggctgattcctggacgagggttcacacacatgtaagcgtttggaattttggatagaaattccgggcgtgacacttaagcttgacctttgggacatcatcatgtaagattagtgtgaaaacatatacgagatttgcagtatttatgataaataaaaggatccaagaccacttttctaacatgttggaaaaaagaatcgtaaagtggttgtggtcctcgcacgagggggtagtactaatcgaacaggagtctggggtttccttatatgagcatgaatcatgagggattttgaaagagaaggtttcatgctcatttgtggagtgatttctcttgtccaccagagctgatgtctcaagcttgtccatggcctgaaggttctccttgccaaaggatgtgtcgtgcatgatcgaggttgtttcctgacaactatcaagaacaacatctcgagggccagagggacaaggtttaggctcgagatgaggttgcgatggtggttctatggataacacttcaagggtctcgccggaatcttctttttgaatgaaatgataaacatcctgttctaaaagggattcaggggactcatgaagcagaatcgccattacttcctctatggg

SEQ ID NO: 94298 - DNA, 9142 bp, Oryza sativa
  unsure (1)..(9142): unsure at all n locations
atattggcgtcattatctttcgggtaacggccaaagaatgaatccggatcatanaagtttgaagtacattttcactcaacctgatttgaacatgcgtcagcgaagatggttagagttgattaaagattatgatatggaaatccactatcacccggggaaagcaaatgttgtagccgatgcccttagcaggaaaagctactgtaatatgtcagaaggtcgacatttaccttgggagttatgccaagaatttgaaaggttgaatttgggaatagtcagcaaaggttttgtggccgctttggaagctcaacctactctgtttgatcaagtgagagaagctcaagtgaatgatcctgatatacaagaaattaaaaagaacatgagaagaggaaaagccatcggttttgtagaagatgagcaaggaactgtgtggttaggagaaagaatttgcgtcccagaaaataaggagttgaaggatactatcatgaaagaagctcatgaaactttgtattccattcaccctagaagcactaagatgtaccaagacttaaagcaacaattctggtgggccagtatgcgacgtgagatagcagaatatgtggcactatgtgatgtatgtcagcgggtcaaggcagaacatcagaaaccagctggtctgttacaaccgttgaagattccagagtggaagtgggaagaaataggaatggattttataaccggtctacctagaacgtcggcaggacatgattctatttgggtagtggttgatcggttgacaaaagtcgctcacttcataccggtcaaaacaacctatacggggaataagcttgcagagttatacatggccagagtggtatgtttgcatggtgttcctaagaagatagtgtcagatagaggtagccagtttacttcgaagttctggcagaaattacaattagaattgggtacccgtttgaatttcagtactgcttatcaccctcaaacagatggtcagacggaaagagtaaaccaaattttagaagatatgttgagagcctgtgttctagattttggtggaagttgggataagaatttgccgtacgcggaattctcatataacaatagttatcaagctagtttgcaaatggctccgtatgaagcattatatggtcgaaagtgccgtacgccgctcctttgggatcaaaccggtgaacgtcaagtcttcgggacagacatattgcgacaggcagaagaaaaagtgaagattatccaataaaggttgcacgttgctcagtcacgacagaagagctatgccgacaatcgtcgtagagatttggcttttgaagaaggagattatgtataccttcgggttacgccgttacgaggtgttcatcgtttccaaaccaaagggaaattggcaccgcgttttgtgggaccttttaagattgtgagggaaattggcaccgcgttttgtgggaccttttaagattgtgagtcgaagaggtgaagtagcttatcagttagagttgtctccgtcaatggcgggaatacacgacgtgttccacgtgtcacagttgaagaaatgtttatgtgtacctacggaggaagcagatccagatcgtatagagcttcaagaagatttaacttatgttgagaagccagtcagaattttggaagtaagcgagaggaataccaggaatcgcgttatacggttctgcaaggttcagtggagtaatcattcagaagaagaagccacttgggaacgagaagatgaattgaagtcagctcatcctcatctgttcgccagttcttctgaatctcaaggacgagattccgtttaaggggggtaggtttgtcacgccctaaaaatcaactaaattaaaaatgcatattttaaatcatttttagaaattattttaaaagcctacaagctaaaccctaattttctaggaaaattttcaatataaaaatgagctagataaaattttattaaatactatacttgctcctctattttctagatttttctgggaattatttgagcaagggaagtatttttattaattgaaacaacatttcacaaattgttttatttgaaaaagttcaaagaaacccctccctaagccgttgggccgaattcggcccaacatcctctctcttccgcgcggcccacgccggcccagccgccgcccgccctcctctctctcgagtcaccgacatgtggggcccacatgtcgggctcgtcttcaacctccggccgagccgcccgagccgccgctttgccgccgccttctacctccaaatccgcctcaatccgaccccgattcctccgggtttttgaggggttttgttcctctcgttctcctctttcttttcccccaagaatcggagcgaatcgttgaggatttgatccgaatcgagttcgttttgattttatccctaaaaccgagtttgaattttttcccgagtcgattcctctcgtttggagtccaatctcttcaatctaatgctttataaagcatcccctcgtcgtcctctcccgtttgccccctttcccgtcctctcccgtgccccatagcgccgccgccacgcgcgccaagctcgccgccgccgccggccgtcttcggcgtcgtcgctgcgccgcctccgccgtcgccgccgcttgccgccgccgctgataggagcgccgtggtgaggagaagctcggccgcccatccttctttgccgccgaccgccgtagcccgccgtcgccgcgcaagccgagccgccgccgttgccctctcgtcgccggccgtcgtcgtgcatcgtttgtcgtcgtggtgagtaccatcgggttcgtctcgatgtcctctacgcgtaggtgtcctccaatcccccggtcgaccgccctagctccggcgagctcgcaaaccctaaccggccgccattgctgacgtcagcatgacgtcatcatctcctttttcttttcttttttccaattttctaatagattaaaacttcggaaaatcataactaaataaccgtagatccgttttaggtggttcaagttgctaaattcttctaaaatcaagatctacatgttaaaaatatccacatgtactgtttatgcttgtttttgtactgttttgttgattttgtttatttgctttagtttccgacgttccggaggagagcgtttccgttgaggaaggttccgaagcgtttgcggaagcccaaggcaagtcacacagatcctaaacaaccctttgagcatgttgaacccgtttaaagctattattttatttcaactatgcattgttttcgaatgtcatcgggtggtgaacctttcccagttaattaatggccgaagatgactttattttcctatgggttataatatgattagcatgaaccttatatattggattggttcagctaaatgctatatatgtatgtttgcttagccatgcttagaaacattagctaactaaaggggttaaatctaaattattttattattaattagggttatattcaatggtagctcacgatggtaaatcgtgtgatgttaattaattgataattaaaacctggctaaggtgggttgtgagcatatggttttgatggttgtgctcatgacaattaaggaccggttcgcgagctactgttgtgatacatttatcgtgccaaccacaagccagcgtgggcaacggctttatcttttgtatagcgtgattcattatagtgcgccagactgagaagtggcgagaagtccatgggggtcgctggggagtccataccttgtttataagggggtgattatgatccaggaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctggtcagagtttaaactattcgaatagccgtacccgcggttatgggtgagttgagcaatgtttttcgtgattagtctcacactactcattaatggtaataatgtggtaattaatttaattcctggtttggaatggataattcctggttaggaggtttaatttgttcaactggggttggttgttcaaatgtggttgggcctatgcaacatgggtgtgttgtgtggtgtttatttaatattgattaattatacaaccgttttactattctcttaaatatttattaaatgctgtttctgcaaatgagctatattatgccatcctttgttatcctgtgcacttgcatatttgctgtgtgacttgttgagtatgtcatatgctcattcttgcaatattcattcatcagaagaggagtatctcagtgaaggtgatgatctggtggattaggcttgttctcggttaagatgcctgtggagtggagtcgccatagctgttccgtagtttgttatagttttttttttccgatgcgtagaatgtttttctttgagaggaactatccacctctgtaataatttattatttgcgattattcgatagttatttatttgtactctattatcaaattgtcattgtgtgcctcggttgattcctggacgagggtttaacacacatgtaagcgcttggaattttggatagaaattcccggcatgacaagttggtatcagagccaccttgaccttaggataagccaaatggtaaaccttaagtagccttcaaaatattttgaaaaaaatagaactgctcttctctagtctcttataaattaattaagttggcagcacatgcaaggttatgcacaaaaatttatttaattcaatttcttttcttttaaaagcaaaaattcgtccttctcaaaatgtttctttctctctttaccaagtcttattgatttgtcggcactgtacatccattatggtatcgatacaatcatgatagcactagtactactcatctttcctatggtgacactgtaccgtgcttataatagatcataagtattttagtttatttttgttatttgtcaaaaaaaaaaatttttttgtctctgtccaaaaaagttaaattctaaaaatatttataaaatagctttgtatgtgtcttttcttttcttcctttttggtcaaaaatcagttaagtctagttggtgcagctaacttagaaaaatatgcattaattcttctcttctatgtttctttagatgccgccccattcactgagaaatttgatcaaggtgttaggattcgtcagggagctgaggttgatggcttttgaggtaggctatgaagttgctcccgagtatcgccaaatttcccatgaccccgacgaggagaagtgtcgtgttcgtgtgacgttggctagtgatagtgaagaccttccgtcttttaagttcgaagctggaggaagatcatactgccatgcttgtcaagaagcagcgttggtggccattggagagttgcgtgaacactttgaagaagagttggattcatcagctttccagtatcatcctcacaagcctcatggtcaagactatggaatctatacctgtcctgatggtgaagagagtgccactctgatgcatgcggtgcatatgcttagtgctatggatgcagtaagtgtggaacgagacaaagcagctcatgacagggaaaactggaatcgaggcaagatttgcaagttggagagcaaggtgtaccgtctacagaaggaattagctgaacttaaaggagaaacgccgccgccaacacccaagcttcgcctcactccaagaaagagaatctgtccgccacctcgtctccagttagcttcgaagattcatgtgatgggtgaagctgtgcccgatcgtgctgaacctgtcatcgacatcataagtgatgaggaagaggaggaagatcctgaagaaagagagccagctactccagaggaagaagattcatcgcttcgttccgacgcaaggcgggattagtcgcttagttagaacgttgccgtagttcgctgtgttagattgcttgtttaagtttgcttgtgagtgtgtgggttttagttgttgcttacatcatgggtgggatgtaacagcatgagtctagttcttttgcttgtcagagtgtaagatagttggtgagatagtgttaatgcaacttaaatgtaatcatacacagttaatagcaatatagaatttaaattaattaaataactccgttctaagggtgtctctctgtcgttctttcctgttgtctctgcttatcgtcagatggtgaacacgcgcaccggaagtggaagtggagctactaacaatggaggagatcccacgctagctcagattctggcccaacaaacacaactgatcaatctgttagtgcagcaggcacagaatcagcaggcaaacaatcagaatcagaatccaccccacctccccaaaacaagctggcagatttcttacgtgtgagaccccctaccttttcaagcaccaccaatccagtagaagcaggagattggctgcatgcggtggagaagaatttggatttgatccagtgtactgagcaggagaaagtttcttttgcttcgcatcaactgcatagacctgctgctgaatggtgggatcattttcgccaaggcagggctgaaggagagcctattacgtggcaggaattcatggccgctttcaagaagacacacataccaacgggtgttgtagctctaaagaagagagaatttagagcactcaaccagggatctcgttcggtcaccgagtacctccatgatttcaaccgtttagctcgctatgctccagaggatgttcgtaccgatgaggaacgtcaggagaagttcttggagggactgaatgatgagttgtcgtatgccttgatgtctacggatttccgggatttccagcagttggtggacaaggcgattcgtcaggaagacaagtataaccggatggagcagaagaagcacagggctgcccaattcaaggcacaacagggcagtaaccagaggccgcgtctcgttactggacctcaagctccaccgtaccctcaaggaggatcttcatcagttgtctgcccccaacgccagttctacaacaacaatactggtaatcgtggcaatgacaaccgtaacacggttgctcgtcctgcagcaactccagctcagaaccagcccgttaggaaggaacagggaagcaagccagtgatatgcttcaattgtggtgatccaggacattatgctgataagtgtcctaagcctcggcgtgtgaagaatgccccaaccccgaacaactctaatgttccagcaccgaaggcacgtgttaatcatgttgcagcagcagaagctcagaatgcaccagatgtggttttgggtacgtttcctgttaactctatacccgcaactgtgctttttgattccggtgctacacattcatttttgtctaaaagttttgcgagcaatcatgggatggaagttattagtcttgggagacctttactagttaataccccaggcaaccaagtattttcgacccagtattgtccttccgctaccatagaaatagaagaagttcctttcccatcctcgcttatcttgctagaatccaaagatctagatgttatcttagggatggactggttatctcgtcacagaggagttatagattgtgccaaccgtaaggtgaccttaaccagtagcaatggggaaaccgtttctttctttgtgtcctctcctaaatatcatggtgtgatcttaaaccaagttgctctacaagagattcccatagtacaagactaccccgacgtgtttcccgaggatttgccaggtatgccacctaagagggacatagagtttcggatagacttggtacctggaaccaaccctatccataagagaccatacagaatggcagctaatgagttagctgaggtgaagagacaggtggatgatttgcttcagaaaggatacatcagacccagtacttcgccatggggagcaccagtcatctttgtggagaagaaagatcatactcagagaatgtgcgtggattatcgagcgttgaatgaggtcactatcaagaataagtatcctctacccagaattgatgacctgttcgatcaactggaaggtgctacagttttctccaagatagatctccgttccggatatcatcaacttcgaatccgtgaggaagatataccaaagaccgccttcacaactcggtatggtttgttcgaatgtaccgttatgtcgtttggactcactaatgccccagcctttttcatgaatctgatgaacaaggtgttcatggaatatctggataagtttgtcgtggtgtttattgatgacattcttatttactctaagacgaaggaagaacatgaagagcatcttcgtctagctttagagaaactacgtgagcattagctttatgccaagttcagtaaatgtgaattttggttgtccgaagtgaagtttcttggtcatgtcatctcgtgtggaggagtggcagtagatccaagcaatgtggagtcagtattaagttggaagcaacccaagacggtttcagaaattcgtagtttccttggacttgctgggtattactgcaggtttattgagaacttttcaaagatcgccagaccaatgactcgtctgcttcagaaggaagtgaagtacaagtggacagaggattgtgaacgaagtttccaagaactgaagaaaaggctagtgactgcgcctgtgttaattttgcctgattcgaggaaaggtttccaagtgtattgtgatgcatcccgactcggtttgggttgtgtgttgatgcaagaaggaaaggtggttgcctatgcatctaggcaattacgtcctcatgagaataactacccaacgcatgacctagaattggcagctgtggtgcatgcattgaagatttggcgtcattatcttttcggtaaccgtacagagatgtatacggatcataaaagtttgaagtacattttcactcaacctgatttgaacatgcgtcagcgaagatggttagagttgattaaagattatgatatggaaatccactatcacccggggaaagcaaatgttgtagccgatgcccttagcaggaaaagctactgtaatatgtcagaaggtcgacatttaccttgggagttatgccaagaatttgaagggttgat

SEQ ID NO: 94299 - DNA, 812 bp, Oryza sativa
atgggattgattggctcgtctgcaagtagttcatcacttcttagggataagaacaatggccgtatcattgaccccttcaggcatcagtccagtttggaagaaacggcgaactgcaccgattatatcagctttaattgtgccccagttgcgctgatagaacctggctggaaagccatctggaccaggtgatttcaggggcccaatttggaaaattgcctgagaaatttcatcctccgtaaaatcctcacaaagcttctcattcatgatatccgtaaccttttcctggataagacgagtaacggtttcaggattaagatttggatcagcagtgtacacatcctgaaaatattcagttgccatgctctccaacttcattgtcgaactgtgaacagttccatttgcatcccgtagtttggagatttattcttctttgctctccatactgcctggctatgaaaaaatttcgtatttcgatccccatcctttagccaattaactctggaccgctgcagccacagcatttcctctctgtacaacagctcgttcatatggtctgtcgcattgcgaattaccgttctgtcggcgtttgattctataagttccgccaattttttccgagccttctccagttctcttcctacatttttcactttggctctgctccaagatcgcagcggctgtcatgaaccttttgcaaggctttggttgttgtttttgagaatcagccttttcttcccggaacttcccaaggtttcttaatttaccgggttggtttgtggtcccctctcccacacaattcttaattggggggt

SEQ ID NO: 94300 - DNA, 1675 bp, Oryza sativa
tactgattttggacgggaggaatatctcttatggtatgttgaagtggcaagtaccgagtcacgagtcattcttgagtccgtcatacccaacgagtgctagaggcccaacaacacgatcggctgctgcaacaagttaagaaacgtgtaaaggaaggaaaaactggagatttcactttggattcctcgggagctgtgcgattccatgggcgtttatgtgttccacaaaaagctaaagtcaaggaagagattttgcgagaagcacaccgaacaccatatactgtgcatcctggggagaacaagatgtatcatgatctgaagaagatctattggtggaagaggatgaaagtggatgtggccaagtatgtggcatcatgtggggtatgtcagcgagtaaaggctgaacataagagtcctgctggaaagttgcaatcattggaagttcctgtatggccttgggatgatattgctatggatttcgtggttgggttacctcgaactccacgaggaaaggacgccatctgggtggttgtagatcatctgagtaaggtggcacatttcattcctatccgcaccacttattctgcgagtgacttggcaccgatctattcacgcgaggtagtgaggttacatggtgtgcctcgctcgattgtttctgatagggatgctaagttttcttctaagttctgggaatctgtgcaagaggcatttgatactcaattgaaattcagtacggcttttcaccctcagactgatggtcaatctgagcggactattcaaactttagaggatatgttgagatcatgtatcctttcatggaaaggcagttgggaggatcatttgccgtttgtagaatttgcttacaacaatagtttccatgctagcattcaaatggcaccatatgagtcactttatggaagaaagtgtcgatccccattgtgttgggattccataggggagagagctattttaggacccgattgggtacaacagaccacataacggatagcagaaatacgacaacacatgcttgcagctcaaagtaggcagaagagctacgccgatgtcagaagacgagaattagagtttgaagtgggcgatcaagtacttctaaaggtatctccaaccaaaggtgttgtgagatttggaacgaaaggcaaactcagccttaggtatattggtccattctcgatagtggaaagagttggaatcctagcgtatcgccttgagttaccagagtccatgaaaggtgtacatgatgtattccatatttccatgttgagaaaatattgaacatcatattaccgtagagccgatgaccattgagcaagatttgacatttgagtctcatcctgtaagaatattggaggaatctgagagggtgctcaggcatagaactatcaagtatgtcaaggttctctggacgcaccagaccgagcgagaggccacatgggaacttgagtcacagatgcgggagaagtatcccgagttattcacgtctggtgagttatataagtcctacctatgagttcctttctatacttgtccgaggtataactggacgaattcgagggcgaattcgattgaaggagggaggaatgtaatatcccgtgttctagagtatgattaggcgaattcgagggcgaattccatcgaaggggggaagaatgtaataccc

SEQ ID NO: 94301 - DNA, 1777 bp, Oryza sativa
acgtcccggccaaaaagggggccaccccaccgttttcggccttccggcgcccataaatccactccccgaagtcacctctttggttccccccattggcggtcctttccaatgccccctacggggcccaggatgtcacaccgagttccgccgcccgcggcaaacctcggaccgcgcgctgtcgttgatagcttcgccgcggcgttatgcaaccacggccgctacatcggcggtcgctggtttgccaccaaacatcgccgaagcgccgcttccctcgcacgccggtgagctctccatttccgcccaactctggccggccgctctagtcgccgtggtcatcctccccttctcctaacccggtcatcgcttttcccaggttgtgcccgaccccgtccgccattgtccgaagcgccgccgccgctcgtctcttcccgcgccggtcatcgtcgcctctccggtgaggacccccttttcctccccttccactcctctctcgtgcgcgccgccgctccccgcatgcgtgccatcgcactgcgccgccgtccgcgttgccggccgctgccaccggccggtcgccggtcaccggccgccgttcgccaccgtgtgccatgcccgggttggcctcggtgtcgcccgtccccagccgcccgatcggccctcggccgatcgtggccgtccatcccatggcttgggtggccagccacgtggtgccacgtcggcgccacgtggtacaccaccaccccggccccgtggacccggtccacggtggaccaccccctttgagccgctgacccgtgaaccccgcctgccaagctgccccccctttcgctgacatccgccctggggatttattgcgcaataattaattaaggcctttttctttattagtaaaaacatagtttatcttctaaaattcataagtaattcatccgagctccgtttaagtctattcaactgtcagtaaattcataaaaatccctagaattcattaaaaatagttttgttctctgtttcagtagtcttatagcatgttttgcttgtgtgctttgtttgtcgcgtagatttcggccgtttcgtcgatccgcggttcctcgaagacattgctgtggtctcatcagtgctagagcaaggcaagtcatgcattacaattgatcatattgtacccaatttacaaatatcccacatttctattaaatgttgcattcttttacaatgtcatgtgggatgggtcctattactcagccatatattgtttaccttatgccattgatgacttgggtatcaaaatgactagatgttggtttaggaaatgcttagccatgcctagctcaactagtacacaaatggggatcacattattacatagactttgactattagcatagctttggattggtgccaccgaaatggtgttagttaattaaaatacactgaatggtgggctgtgggtgcatggtttcgctggtcgcacccatggcaattaaggaccggttcacgggaaaccctgggagacttaccgtgcttaccacaagcgggagtgggcaactgcttgatctgaagtatagctcgaccctttcctatgcaccggtggcgagggtgggcgtgatggagttgggtcagccggggtgtcccggtgtccaactgccggattcaccgcggcgcaagaggggaccacccactgtcttttgaggggtgagggtgaaaccctaacgtggtgtggatgttaggggagggtattccgaggtcttgtcacgatttctctcctttgcagtatcatggg

SEQ ID NO: 94302 - DNA, 891 bp, Oryza sativa
tgtaaaataaactacgacaaaatacaaacaaattcaacttcaaaattaagttttgaaattttaattttagctttcaagcataagagagactaagctgatattgtttttttattagtgttattatataattgcaccgtagcgttagcacgggtatattactagttttaattaggtaaagaagagctactgcactagtgcaccacaaatgtgaagttgtaaactaactagctgcctgtataaaagtctgatgactttgtgctgctatttccatgaagcatggagatacctttgcagtgagagtctggcagttgttcctggtgcgctcaaagatatagttgtggttccggtccagagagtcacgaacggagatgagaccaaacacatctattggccagcgtagaatacctttaagctccgtcacctcaaaagaaaaaacctctagtaaatctaggagcattgcgaaccagggcggttcctccgtgtaccgcatgggaccaatctcagttgcatccatccaataaaccatatcaatcagtcaagcattattgtttctttttcctttgcaacacaccaaagagacgagccattagatcacattgatgcatatccatgtgaaaaatgtcaatcccaacattttccattttcatgtttccatcctcactattgtgcgcccaggctcccgcctaccataatcagcgagtgaacatgtcgatttgagatgaaaactaaaaacctaacaagaggatgagcgaattcgtatttaccataaaatcatctctaaaacaagaaaaaagaagcttcctcacttcttttggcgatgtcgccggaatcgtcggaccacagattcgtccagtagcggcgatagtgggagagctcgttgagcagctcttc

SEQ ID NO: 94303 - DNA, 683 bp, Oryza sativa
acgttccggctcctgagtgacaatgtattcaacagagaagtcagacgagggaggggaatgcataccatcagtggcatcccaatcccagctggcgccctcgtcgaacaccacgtcgcgcgtcacttgaacacgacccgacttcgggtcgaacaacttgtaggctttggatccctcaacgtagcgaggaagaccgtgggcttgttgcggtcctggagcttggtgacatgcggccgaacatccttgacgtacgcgagacacccgaacgtgcgcaggtgcccaacggccggcttccgcccaaaccaagcttcatacggagtcttgttgtccaagcatttggtcggcgcgcgattgagcaagaacacagccgtagtgactgcctccccccagtagcacgccggcactgacttggccttgagaagactctgcgccatccccagaatcgtctggttgcggcgctcgaccaccctgttttgctggggggaatacggcgcggtgagctgtcgcttgacgccgctctcggcgcaatgcgcggcgaactcggcggaggtgaactcgcccccattgtcggtgcgaaggagcttgagacggcagccagactcagcttcgctgcgggcttggaagcgtttgatcgccactgccgcctccctcttgttctgaagcagtgcgagccacatgtagcggct

SEQ ID NO: 94304 - DNA, 539 bp, Oryza sativa
gttccgattctggtggtcttatgtcagtagatgaattactctatgcgtagacataacttatagcccgcctcctatcagtaaattaattactcacaagttagatttaaaaaattttgatcgagtaaattaatttcggtattacatcaatgatgtgatcacacatgcaatgtggtacatcggtagaataaacagaactaattaaagatcacaacagctccagtaaaaaaatcacaacagcaacaccactgaaggatacggtgatgaagattgatgccaagactaatacgacaatatagatcaaggccaatgatccatctacgcatgcacgaatccaacaagcaagacaacgccaataaaacaaatcaacgttgagccgacgaagtgctgcagattctcaagtcctccctgtcgacagatatctgtcaccacggctctggagaggcattctcatagccatctggataaaaaaaaaaatgaaggttacttctaagtatcacaaatcagcaaaataaatatgatttcacttaaacctagtattt

SEQ ID NO: 94305 - DNA, 626 bp, Oryza sativa
cccactgaagaggcacgccaattcatacaagattatggtatgtgcctctataatctattgcaactatattgttattttcataattacaaataaaattgacgataaaagattttttgatgaaagtaaggtttatttatggtgatcagtgaatgttctattgttatgtccatcagaaatttttgaccgtggaatgtatgctggacctgttggttggtttggaggagctgaaagtgagttcgctgttgggattagatcagcactactaggaaaagtaagaaaaaaatgtagtcagtacgattgatcatataattgggatgtgatgtttttttgtcaaatatgtccatgttgttaccatatcctaagggccaattagttaccaagctgttgtttgttctagggtcatagcactttagtttatgctggtgccggaattgttgaaggtacaaatccatcctttgaatgggatgagcttgacctcaaagcatctcaggtattattggtctaactcatgatggattactgctatatttctttttttttaaatgctaatgcatcccatttccaattattttcagtttgcaaagttactgcagtatcaagaacaacatatttgcttgcaagaggct

SEQ ID NO: 94306 - DNA, 688 bp, Oryza sativa
ctaaaaattgatttagcacacacttcaatgaatactaatcagcaagatactggaatataaagtattatgcgtgtagagacctcttattccatcctcaatagcagaaattgcaccaacatagtcagtattgtagcctacaagttttccattaggttttctgatgattgtattgacagctccaatgtcctggacaaaattattgcttacaaatgttactctggatttattgaagggttcaagaatatcctaaatggaaaagcaaaaaagcagataaaatcaccttggcgataggatcaacttcatcacagcacctaacagcagcttccttatggggaattgtgcaactgcagtccaaataattagatgaaatggataatggttatacacatggagtattagagcatggggtcaagaaataaaactgaaacagaaattgtgtacctaaaaccagcaaactctggtgaagagtatgtattaagaaagttagccaggtcgttcaccaaaaagggcacatatacagcattgagacccactgatctgaaagcttcattatgcaaaattgggcttttactgtggcccaacaggttttccgattataccatacaccttagtatctggaccaatctgttaaatattgaacacattaatcaagtctgttactgtgggctgagcaggcccagattctttt

SEQ ID NO: 94307 - DNA, 3230 bp, Oryza sativa
ctccttggtccttgcttcagcttgtctgcaataactgtattcttgtccaaccattccagtaaagttgaagttgtcaatatatatatcagatatttatcgtacatcatatactgatgtgcatattttgctatgcggtatcattttattcttgagcaaagtgaaaatagaaaatccaagttcagttatgcatagtatgtcgtcaggctcacatatgctatcttttcctaattatgctcttgtttatattttgttttgacagttcaaatgccccattcatattattttgttgagtggaacttagaacacatacgtgatagaattatgcatgtttgttcaccatcaatctagctagtttcaccttatcccaaaaaaaaagggaaatatttgttgtgttacattgttgctaccattcctttctaattgttttcatacagggttcttaagtggtggatagtgtatcatcaatattcttatactctctacatcgatcccataatataaggcttggtcaaacttggcacgatctccaaaactgatcttcggattatattctcatatactataaggtttatagcaaaaaaaaattataatcatatgaaagtagattcaaatgtcaatctaatgataatattttcagaaaataaaattcaattcataccatagtaattattgattaaatgttttaaaagttgaatcttaaaatacgtgcacaccttatattatgggatggaggaagtatttagtaatgtcatggatgcgtgtagggttcatctctggttctcacaggtccaagccgtgcaatcctattgatggaccctactgaatttgaaattgagctaagagtcaaggggacaagtccctccgaagataagatcttgagcgctgaagcatttgggtataatggaactgctcagagacatagatgtggctcactgcgcagtatgatgttatcaggagcacgcagcacattggagttcaattatgcacacattcctgtggcattggaggctacaatcagtgtcaggattacaggaggtttaactggtttctgtggaaagttcattgcacatactgctagtatcaatgaagatgtcatattgctggactctggggaagaaatggtggctatctcccatgatggagccattcatttctgccgcagtgtagttgcagttgaaggaaatggcggagcgttgattgttgatgttcatgcaaggcaaagtggtgatgagaacatcagctgtgcttccaaaaagtttatcccggtaagatgtggatggagtcgtgacacacttgatgttgggttttgccggatgagcgttgaggtttcttggtcgctcatgttttcatattgagaaaagcgtaggccctgataatattttttgcttgctgtgactgaagctgtttgctccacggcattgtaatatggccatgtttaatattcgttgtaaataaaattttcagtttatagctattgaattgtagagtagtcagttgctaagcacagcttcagaagaaatcacaagattagttaggtatacttaggttagcctgcaattgctagtgcatggtggaattataggaggattcaatgagccctgcactagtggtctagtggatgaaaccaacttttaggactgaattcaatatttttcatacttaaaccttgtatccataatagtttattttgtactttgtttgttgatctatatctgaaataactagaatagttccaatgtacattctctttcactctggttgaatgcagattgcatcctttgttgaagtcccttaacgaccacacaaactaatattgcactaaaagttaccgtatgcaatacggtaatactaaaacataaactaacaatcactattttatgaaatagtatcactgaaaccaacattttggtggggttggcaacgtgggaaaacgtagattaaggacacagaaaacaaaaaaaaaaacatcagcttatgattaattgagttttaattattgcaaattttaaatagatttatttaatatattagaacaacttagcagtttgaaaatcgtgctaattgaaactaagttagaatctgaatattactcaggaaagaacggggcctttgtgatgacaaaatttgaatctatgcattataatttcaacaagtatttcaaatttgactagttactaatacaatgcataaccttttcaaattagaatacaacttatgaaaatctaagacatagaaagaacctgtttgacggagtttaggattaagcagttggttattttctggattctatagttacaaattcttagaatcgggaataaaatctaggctgtttggggatctacagctagggagtttgattttttaggagaaactgcaaccgttataagctccccaaacgctccccaaactgaaccatactgagatagtaatgtgacaacattcttcttcttcttcttctttattaaaaaaaacacaaatctcattttacaatgtgattcattgggctctcccggcccaagggcccaagagtaaagccccacaaaaaagcccataactccaaccgaatctcctcacaacccaacttccccatctagggccagcgcactctcctcctcccctcctccgccgccgtctccgccgcctccagccatcgatcccggcgagccagcgaccgagcaggcctagccaccatccttctcgccccccaccggcgttcgccgactctgttcttgctgctgtctcgaggtgagtctcgccttcccccccccccctccctctctctctctctcccctccgctgtcccagatcccggataggctcgcgtttcttgattcgatggttgatggattttggtttgtggaattgtgcaggagagttgctgtttgatcggccatgccggacaacaacaacctcgaggatctgctgctgcaggcggcggggcggacgacgggggcggggaagggcggcggggcacgggggccgtcgtcgggccagggccagcggtggtcgtcgcagcagcagcagcgggggaggcgcgggtcgtcgtactccggcgggagcggctcggacgacgacggcggcggcggcggcgacgggggcgactccgacgactccgacgccgcgccgaccctctcgaggaagcggccgccgtcggggtcgcaagtgccgctcaagaagcggcaccagccggagaagggcggagggagaggtggtggtggtggcgggtggaa

SEQ ID NO: 94308 - DNA, 1390 bp, Oryza sativa
cgacaaggagcagctggagaagatgtcggagctggacagggagatgatcctggcggagcgcggcgcgcggatcgacgactacaagctgaagcagctggcgagggcgtcgtcgtcgtcgtccaaggcggacaagtcgcggagggacagcagccctccgccgccgccgagccgcgcgcggtcgtcggccaggaccgacaggtccgccgccaagagcgcgctggacgagctgcgggccaagcggatgaggcagcaggacccggaggggtaccgtaacaggttcaaggatttgatcccgcagagcggctctccgccgaggcgcagggccggaagcccgcccagcgacggtagtaatgatggtgataacagggggaggatcaccgatgaaacccgggatgatgagtttgatgaatcgccaagcaggcttgaccctctgaagtttgacgatgtgaagagtataaccctcaggagatcaaagcttgtgaaatggttcatggagccgttctttgaggaccttgtgtctgggtgctttgtgcggcttgggattggcaagtcaaaatcagggacccctgattacaggctatgcatagttagaaacgtggatgcgaatgaccctgaccggaagtacaagttggagggctacacgacgtgcaagtacctcaatgttgtgtgggacaatgaggctaatgctgctcggtggcagatgactcaagtatcagactcctttcccagtgaagaggagttcaagaagtggctacaagtggctgagaagaatggtgtgcgagtaccgactcggcaggatgtattggagaagaaagaagccattcaacaggcctacaactttgtgtattcagcacatactgtacagaagatgctaaaagagaagaaatcagctatcagacgtcctatcaatgttgctgctgagaaggatcggttgaggaatgagttggatatggccattgccaggagggatgaagctgaagcagaaaggatccgttcaaagctcaatcagctgcagaagatgtcgaagccaatatcaaataatgagaaggctgccaagttggaggcgatgaacaagaagaaccgtgctgagaacttcaagaacgcatcagaaatgaagcccgttaacacgagtttgaaggttggagaggctggttatgatcccttttcaaggagatggacaagatcaagaaattactacgcagcaaagcctgaaggagagagcgctgaagtccccaacgggaacgatggcagcgcagtagctggcgatgaagatacgaagaacgggccgcgaggtggttcagcagccactgcagcggctctagtggcagctgctgatgccggtaagctggttgataccaatgcacctgtagatctgggaacggaatcgaat

SEQ ID NO: 94309 - DNA, 679 bp, Oryza sativa
acttggtaatcaccggcaccaaggatacggaggtcgcggcgttcaaggaggagatgaaggctaccttccagatgagtgatctggggcctctctctttctacctagggattgaggtgcacccggatgtctccgggaacacgcttcgacagaccgcctacaccaagcgcgtcgttgagctggctgggctcaccgattgcaacccagctctcactccggtggaggagagactgaagctgagccgtgatagcacgacggaggaagtggatgctacacagtaccagcgtcttgtggggagccttcgctacctcacccacacacggccggacttggccttctccgtcggctacgtcagttggtccatgcagcgaccgacagcggagcaccagcaggctgtgaagaggatcatccgctacgttgcggggactctcgaccacggtctctactacccgagatgtcctggcaaggcacacttcgtcgggtacagcgacagcgaccacgccggcgacatcgacaccagcaagagcacgagcgggattctcttcttcctcggcgagtgcctcgttagctggcagtcggtcaagcagcaggtggtggccctgtacagctgcgaggccgagtacatggcagcctctgccgcttcgacccaggcgctctggcttactcgactacttagtgatct

SEQ ID NO: 94310 - DNA, 587 bp, Oryza sativa
gggaaaaggaaagctcaagcggaagttctcgcaacagaatacgcggaccctcccaagcgcccagacccataaggcagcgacacaaagaaaacatggtgccctatacacaagtcggacatacactctctagaagattgcctcgtcttcaaaaagtcgctcgcaaaacacatggcattggaaaaaggcaagcgagtacgcgtggtcgagaaggacgctgaggcaactgctcaggaatcggactcagcatacccagactctgatctccatgtctcgtacatctttggaggttccacggcatactcctcaaagcgagaatacaagaaagtggaacgggaagtttgttcgacgtggcaaggagctgtgcccaaaatgaagtggtctgagcagaagatagaattctcagaagaggaccaccccaagactgctgtcatcccagggcgatatccgatcgtggtcgaacccactattcggaatatcaaggttgcgcaagttctgatcgacggcggcagctcaatcaaccttctcttcgccagcaccttggacgcggtggggatcccaagaagcgagttgacacccaccgatcaacc

SEQ ID NO: 94311 - DNA, 692 bp, Oryza sativa
gccttccccttgtcaattatataacgtcgttttcattgcaatatatgtgaactcaatgagatacattattcattagatgtgacaagacgatcacgcgtgggcgtgattcactttatgtaaacaggcagcgccgaaagttgatagtgataactcgagctgccgcttttcatgtgtgctgttgtggactgtgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccgtgggagtacgtgagtcggtccgggggtacggaacggccaacccgtcctgcctgtacaggtgtgacctctggctgctcctgagtgtgcgcctctggagctcctccaagctgagaggagcctagtacgtcgtggtggtctgcaccgtgcaagtcgtcgtcgtagaactggctagtaggaccagtcctaccggcgtgagacgaagaagccccaataccgaagatcccggttgcaaatctgctggaca

SEQ ID NO: 94312 - DNA, 2109 bp, Oryza sativa
ttgatacttacagtcccagtcaacatattgacaactatgttgggcagcagtttatcaggtaggtacaggtaaaaaataaaaaatggaggcctgatgtccctattttacatcttcctagaaaaatcaggtaagctcaaattgcagcacaactgcatgactgcctaaaaatatgtttttttttaaaaaaaaagaaagtttaaaggatgccaccatgtgcaactgcacttcatgttcttttccagaactggtattctggaacaactttctctcaagtttcaactggctttaaggttggaacaatccctgttttcctccatattagagcaatcatcatccagaaaagagttatcaacagataatttcgtcatatgcatagactttgtaaaagctccacctccagttcttcatcatcaagttatgtcatgtctgagcattgtgtgaggcgccaattttccgaaaggttcctagcatgtgatgtcgaagaattatctttatcaggcaatattcaagtctttatatctaactggaaagtcttccattaggtagcgattatcagctttgggaagtgacaatggcaaggtctcttcgtccacagaatctcggtatttcaatggaacgacttcaatcgaaaacctattttggctggccgactttgaacgacttgtgggtaaagatggtccagtacctatttggaaaaatctcattagacatgatgacatagtagtatctatgaaaatgtgtaaaatgacagattgtggcatactgtcagtcatgtcctttgtcttgtggaggagaaatgtcccagaaaggatggtcacaaaaccacacagctccgtgacaatttgtgttggattttgtcgatcccaatcctgcacgtaataaactatgctatcacaaattgaggaaataaactttccataaggcatcaattgtttcttgaagacagcaacattgtgaaagaaaattaaggtgcgtagtgcacggtaacaacattgtgcaaaattataatcacagcagcatagttagcggagcaggacacatgtagaactacacattaagccaaaaaaaaaaattgttcatagctttctgcaacaagaaagttgagtgtataagggctgaatgcctaatggaagtgatagaaaaagcttaccttaaacattatcacactggctaaaattgttagtgaagtaaacatcacgtaatatattggtgagacaactgctgtattaaaggtgtccaatgcctgcaagtcacagagataaaagaattactattgcgttaatgtaataagcccttatgtgatatgttacaataatggtagctcaataagctacatgttctgtactattgcccagagtgacatttcaatgccccagtgacgagccaggaaagttttacagcctgaagccctggaaaaatctaactacgctgagtatatgctgcaattctattttcaatccctacaatgatattaaaattctattgcacattcaccaacgatcccgggtggctccaccactgctatgccctacatattatttgagctagtgaagattcttttaaggacaggtgcgatgaagttgtatgaatgagacaagctgttagaagatcccttaaactcaagttaaatctcttcatgtaccttatttagatagtttatctgggtgctcacacaggtggctacaattagggcaaaagcccatgtctgaggatagaataactggttcactcctgagaatgttaacttcaatgcaatgccgagagcttttacactcatcacctgttaaattctcaccatcagatagaacatggaatttagttgaaacaacagtagaaaaaacaacaaaattgattatgattgggtcatatatttggacaggaagcgtacagtgagagatcctagaagagaacagactccgatgtacaccatgatgtttgtttgtccatgttgagggacaacaaaatatataagcaccagtgctgcggcaactactatagcagcgtagcaaagaaaacctggaaacaaagggaaaacaataatgaatcagacattcagtctagcccgtggaacttacagtaaggctgctgagggctatgttatgaacatat

SEQ ID NO: 94313 - DNA, 1884 bp, Oryza sativa
tcttgctgtatcctaggaaacagaagttcgtgtatttgcttctctgcaccaaactctgaagtggcctgcagtgcagaacattcggaagcacatgaggatgaaaattcagataaaatctgttggagtggttcagctgagaatgtaagcagttttattcgtcaacgcatagatgctggtttcctccttgtagaaaagggtactggtttcctgcaattttgttcatactgaaagctgatactgacctttgcagggaacgcaaatctcagtgtctgcacttgtgttcctgagcacactctcaagtcaaacccaaggcagtccactccaatgacagctgcctcctgtggaaatattacatttacagtgatgacccaacattagcaggcattgtacttcctccataatgttcagcaatctgaagaaatttgtacctctatttggatggccttgcacctccagcagagtgatttcagagcctggcttatcttgtctccaccagctctcaagcgcgatattatgttcggtgcagaatgcgcaatgatatctggcctagctttccggtattcccctatctttacctttggctacaaggaattcaagcatgaaaacaattttactaaatagaaattcacagtacattgttcattattcatagactgaggataaatagaaataccatatcaaaatgaaagaactatacctcagttccatatgcagtgatcagctcaatgctcagaacctcaaccttgaaaaatgtagcaccactctccttgttatctttccgtggttcatcatctgtacaaattacagaaacctgtcaaaatcctatgttccagaaatcctatgaatataagatacatttctgagttcatagcaattgctacttgataaatgccttgaaaccatggtgctctcttcagcaaaggctggtctcagttgaccctcaacaacaaggcttgcaggtggtctgtccaaccagtctatactagacttggttgaggtctgcacgtacaagtgaagaacatgatgcttgaacaaatcatggcaactaaaatgacagatgctaaaattctgagtcagatacctctgcaatcatccttgcaaagtacaatggatggcaggaattcatggtttctagatctgtccatctaggcagatcttcgtcttctccatcctcatcgccatcgtcgtcatcgactgcaaacacaccctcctgcaatgttttcagagatgcagcagtgtcaaggaaaatccaatcaccaattgcaattggcaaagtaatcaagaaccctgaatttcctgagaaggatttttcatcaccccatcaaagtcatcgtcaaagtcactctcctcatcatccgagtcgtcatcatcatcgtcgtcgtcatcgtcttcttgagcaaactcagtcgcagatgccgctgccagatccaagtcagcaaagacctgagtgttgtcaagccctatgataacatgctacaaccatgaaccatcatccaaaacaagaattcagtatacaacgaagataaaaattcagaaacaagaacgaaaaccggggaaaaaaaagggcgtaatcgtcaccgcagtcttgtcgtctcccatgatgctctccaggagggcgtcgtcgttgtcgacctcgaagtaaatatctgatgagagcagattgccacacatcacagcatgcagcttcaagaacaaaattaacagtgtctccagcaaaagtcacagagaaggagctaagctaagctagctagctgcatcaaagcatcagctcaagcatccggttttctcgcatacctccgttctcatcggtgaggtaggggaactccggcaggatgatcctctcgtgcacgccctcgtcgatcagcgtcgagatcatcaccgtcg

SEQ ID NO: 94314 - DNA, 1519 bp, Oryza sativa
atatgaaaactaataacacctagagcaaattactaatttactggagtaactactccctccattccataatacaacgcaatttgggtttgtcttagagtcaaatttgaccaagtttacaaaaaaacgtggcaacatctacaaaatctctctgtcaataaaattatgtactacagtatgttttcttttgagtctctagaaatgctccaaatagaatttcttaccgagcactagagttcaagttccacacttccacgttggccggctgttcagctgcttcaaaacccttttgaaagtcttattatgacaccataacaaaaatattcccttcttacagcacacagttaactatgtgtaaataaagctttcgaatagccgatgacaaatagtagcgatgtacttatctgaatattgaatccatcaccaactggaaggctagaaaactgacttcagacagcgattactgttaaaacaaatcttgcttggattgtttgtaaatatcatcttctgtgaataacataaagtacgcatggtttaggtttttagcaataagcaaacatgacatatccaatcagcaacagtttttaagccctaggttaatataaagaatccaaatatgccatgagcgagggagtaacagaatataaccattgccctaggatcacaagaatagacttttggagcttgatcgttagggaacaaaaataaaaaactgctctttaaattaatcgatgtcacttattcactctatgcaacaatcacttagatcccctacatccatctcagtatcatctgcaagagcgccatcatccatgatatcatccgaatcttcacttttgacatccaatatagaatcagtagcaccgctactatcatcattaccaaacaaatagtcctctgaatcagacaactcggcaaatttaccaagattcttgatcctccctctatagctggtaagttgaaggactttttccttccacctcaccaatgggcacttctctattaattctgtcccatcataagactccgtcaagaatacgctaaaccgcttccccctctcagagacataaaagatgccataatgcttcagaagcagtctcatcaacttctgcggcataacaaactcacgacggaaatgtgtgaggtgatcagtcaccagcctcttttccaacgtgaagttcagtatctcatgcatcactgcaactgccctcttgtcaaactccggcgagccaggagtcaatcctcctggttctgcataaggagataggtatgttgtcttctgaaactgctcagtattgccttttttcacataatgatgaacttttccgcggaatttgtagtaacttgtaaaatttggtgggaacttcatggggaatgatagtgagagctctcctggtggactggcaatgtcattagcatttgcatcaccagtcaatgctgccgtctttttctcgagctcggtgactgcccagtttggattccaagagacaagctccaggtaatcgccgtcctccaacctgac

SEQ ID NO: 94315 - DNA, 1503 bp, Oryza sativa
agcaagcgtgaagcctgtttgataaaggagttggaggatatacttgaaaaagaaggattgtcaacaaacccctctgaaaaaggttcatttgttgttaaattgtttacaataacttgtgcgggaaaagttcatttgttgttaaattgtttacaataacttgtgcgggaaaacttgtgttgaattgttttctattttttctatacttctatgggtaggattaggatgtttggtatcacagtcatcattcaattttctcccaaactatgaacactacataaggtgtatgtgcccaataataagttattactgttaaatgcaatcttatgacctcacctatttctctcttttttttagttggttcatttatgagtggcatataaagctgcgtatatatggcgtaaagcatacctatataattacttgacacatgttatgctttctttgtacagaaattaaagcagtcaagaaaagaaaggaaagagcaaaggaactcgagggcatagatatgagcaacattatcacaagttctcgtcggagaagtacatcgaatttcatacccctgccaacgcctaaaatagtagctgatagtgatgaagatgacgaagaagacgcagaagatgacaatgatgaggaggtgaatgtggagggtggagatgaaggtgacaatgatgttggaaaagctggcgatggatctgctgatggtaagattcaataatacatggtatttcaatttcactgtcaccagctagtcatttataatctcattagttattgcatccaggggaatatccagtggcatttacagcatgttcagtgttatttcgcattccaagcgattccatatctctttttctcaataaaatccatatgcttctgcagatgctgagcacgacagtgattgattcttgcggtttctaaggtggaagcaggcaattctgaccatgcaagttcatctcatgttgatttggcctagacgcctagttggctgtccgtgcgtggatggaggcagttgttcagaagtttaacttatgagtttattctgttattcgaaacatattctttagctctagcgttggtgaaacattagcgcagatgattcttgtagctcccatctcattattatgtataatatatatcaggtttgttatctgaattttcgatcgtgtattcctgtagactctagtttgaaagcggcgtgacattcctgtatcggacagttattttattagttcatcacttatagtgttattttagaggaggaattcagcttttttttttactatttcaaaatctatttggtatttttttataattagcaaggttcacttaatattaactattcgctcctggtagcaaagtttcatattgtgatctgataggcttacttggaaaatcaaacaaagttctcaaaccgtttgatttaattaaatgtaggttataggatatcgaaatttaattacacagtgctacatcagtgtagtaagaatttgtaagaactgtgta

SEQ ID NO: 94316 - DNA, 579 bp, Oryza sativa
ggtgagtatcgactgagtatagggcgaattcgagctcggtaccctttcgaaccattcagttctgccggataatgaatcgcagccagtacatgtgcacctgccggtgccgcacggaaatgcaggtcccgcaacaccgccggaagaaaacgtttaacccgaccgtactgctcaaccatttcgtcatggaaattattgttctgtggacgagcaagttcattaaccttgcttacagattctgccagtctgtttttgggtacgcacttgaagataacctgcctgagatctgggacatctgtattatcatccagcaacaatgcacatgcccgcgccagtaacaatgcggcctgatcaagatctttcagtgtcctgagtctttttttttgcccggttttctttgcttcgcggataatgtccagaattagcatatcaagcacatcaacggcatcggctaatgccgttatttcctgtgctttaacgaatgcagtaagtacagcaagctttctctgctgtggcattcgagcgatatattttaccgacaccatgccagcataacgagccagattactcaaattgaatggc

SEQ ID NO: 94317 - DNA, 4055 bp, Oryza sativa
agtagagcataaagtacatttgacatgagaccttcaccgcagcgtgccaaaatttgagctagcaccacaccaggtgatccatcagaggggtgctctcgagattctagtgcagcagcgaggctaacatcaagaaaacctacatgtgtcatggcaaatgatcaaatgagcacaaaaatatactaggtgctacacgatgtttcaagtgcaatagcttgagctgaatgctgaagcatatgtcacagtaacagattaaggtatgtaaacggtatgaacagtgcagcaagtacaaatagatcttttaactccaaagggattataagtgtgatgaaaagaataacgctttctaccaccaactcacattacagtgatacactagttccaacagacataataatgtaacaaaccttatccagaaagtagctgaaaaggcatccatgactttgcaggggaaaaacactaacttgacatgattgcttaccagtagaccacaatccaagcattatttttctttgcatatactttatcttctcaggggaataaatttctttaaattaaaaaaccaacaggcccaataggacattatcctttttgctgaaatgaatgagcagtatgcattcattgtttcccctttatgcaactggctaatttactaacattccatgacaaaaaaacaaatgctctaagaaaaaaggtgttcaattgataaagaaaaaaatatatacataaaggtggatagatatcctcacatgacatatatgacatcgcagcaagtgctgctcctcggtgcattgctgtagagcatatagctgccttttgaaatgacaactcaagcagggagccagatgcgacaatagcttcctgatgatatatgcaatcaacacagataactactatcagactcactatccatatcatgcagcagcaatgaaccaaaacaccttaacatataagacacaataaattcacctttgggcagcagcgaataaatgtggatgtaaagtttgcataggcttcaacaagatcaggttcttgatcacatgtgtaagaagaattcaaagtagatattgaagctgcggagctaagtgcttcgaaagttctgacacataaagcaacatattcttccttgtgaccaaattcttcaataacactggcagctgaaaatgtcgttgatgtcaaggcagtgtggagtccacaaatatattgaataagatgctgcagtagtatcttagtgttttaagcctatcttgtgcattgttttgtaaatgtaaagctacaaaatacttcaaaaattatattctaagagcatgggatggtggctaaaaatatatcagaagtacatagcaaaggcaggtaaatagcagctattgatgtccccaaatgctttaattaaaggcaaacctatgtagatgggattaatctattcctgtgagtactagcatatgtattactgtgatgtaggtagtaaaccacaagtcaaatgtacatgtaaatcagcaactgctagcatgttggtaaaaatactagcaagttcattgtagagttgaataacagaaagcaaattacatatgcacacatgtaaaccctcttacctgttcttaagaagcagtcatgcctttgaaacagtaagaaatttgttgataagcattccagaactttaggtaacaaaatctggaagtgttgtcctgtaaaatgcaattgcttgatcagcacaacgatctaatgctattagtcttgaaattttgcattgcaggtatcatttaacttaccacaagaatgtatggctgaagaaagagaacgacatgcagctgcagataaactaacattctccatatgagatgatcgggaaagtctttcaagaagtggccagaatataccaagaagaaccaaaaccgtgtcatcatcaatcagactagatgtaattgatgtcgccaaatggccaaatagagcacccatcctgaaaaaggaaacttcattttcatttgcttacattgtagatcacagcatgtttctaattttcttccacggcatccaaaaatccctcccaaaatacaatatccttaaaaataggttcaaaatgactggttgttacttgtgttcttttatctgtcaaattctatgatccggtcaaagcatatcatattgttttttctatagcttgccataaatgatctaagtgggaggatgtaaaagtatccacctttccaagaaccaaataactcccaactaaatggtaaagccatctttttattaaagatcacatcaacatcaaccaacaggagatgcttctccacttgctttgctctccttttgttaatctagaacaaagtggtttcatgtttacagtcaatttttcttccgcgcagctgactctagatagcatttattcatctctattggctagaatgtagttggtgatactgcacagctttcactggatagttcaaaaagtaatatgattggatacttatacatcaattgaatatatttatgctggcatgttcttttgatgatcgccccaaaagcaaatactcgctttctgcacaactttgtacttcaagttgtagttattagttaagttatacttcaattaaatatcattcaacatgaggctttgcatagtttatgactttgaatagtctataatatgttgacacaacggaaaattgcaccaatattaatcaaatttatattatttacagtacaaaaaactatttttcttcaaactgctaactttagtaccatttcgttaacatgcttgattcttgaattagtcaagtgtagtagtatcattgaaaagtgtggaagatacaaaaatatatatattgctagaaaaaatggggccacaaaatgtaagaatgaaagaacttaaaggctaagcacctgtagagaccatggacagcaaggttcaatgcttctgtgtaagcagctggattttgacgcagagattgatctctgtctatgtcaatctgtaaaggacagcaaaaagacaacattaatagttttagatgatgtcatggtcaaattcatgaatgtgtccatgcagagttcatatgcaaccattaaaaataacttgagaatgtttcacatgaaacttcatggcatcatagtcctcgaaatcccatcaactaaataatgtttcgactaactaggaatgtccacagatagaagcaaaatataatcttacaagcatttaagtggacaataaagcatctcagaacacaaatgagaaaattatgaagtagagttcatgagcaaccattgtggactactggcttgtgtactggagtgcatatcaggaaaatgaatcctaaacaaattcattggtgtacatgttggatgttgaaagttgggacatgtgcacctgtaaatatatgcacaagaatatgatcgttatgtgcaataaaaaaaagttgcagtgcaatgggaacatgtagattgtcctactcatacagtgaatcatattttcacaaaaaaaaaacgtggcaggtgcacatgttcaaatatgctgtgcatctaggaatgtttggctaatttataaaagcgtacaaaccacaattgagattcacctgatatatgatgccattagtgtactactaaaatacaaacattcagatgcaaataaacactggcattgctgaaaagcaacagagatatggaagaaccattaagcttttgtcaacaaagttaaaggttcattcaaggacttatcatggacacagctaatacaaaggttcataatggttctctagatgatatcatggtgataaagataataaaatatcagcaaacattccgggctcctttaaaatgcaagaattttacaggaatttcacaggaattagttccacccatgaaattcctctgtttcaacgaaagcccaaggctgaactagggagagagtacatacaagcttctccactgctgtgtagctggaacaaagtaaccttgctagtgaacttttccttaactctttgtcaagaacagaacataaagcatgtgtaattgcagtaatgatctcttcctcatcctctattcgcagattccccgcatccatg

SEQ ID NO: 94318 - DNA, 4078 bp, Oryza sativa
tcacccattaagatttgctgtattctgccagtatttttttctcagcacttgcctagtttactcatagaacagcaatcataggaagcatattgagtgttttaccaaggataggcatccattaagttcgctgtgtgctctgctggacagaatgttcacaaaatgcattatgattgaaaaatcgaaggggcttccatcttgtaaaattgtgtcagcgacctgaaattcagtaacttgcaagtaaggcgtagatttaacatgctggttccttgcatgcttacgtgcaaccagacaaccacacaaagacaaacaagcacgcatattttcaatcaacaaagaaacagaacaagagaaaatttaacttgcaaagcaacaaggcaggagtctgaaacacaagcaaaataacaatttgctcaagatagagttgatagacagccatatgttattaccaagtttgtcaaaagctaactgtccaagatatttgcatagtaagataggcaattttctatgcatgtaattgttctgcccatacattgtctcaagtggcaaaagtttttgtggtcatagcctcataggcagtattgtgaactagggctttctgtggggctagtgtacaagcctaataaacccatcagtaagattattcttgccattatgcacattatactttcatatttatatagaattacagataagcgatcaacctatgggctgacaacttaagtgacaacctatgggcgatcaacctaagaatcatcaacaccttcaaacaggtggtaacattttgggcacctgggtgatattaagcgacacaaacttttcagatctcaaccttgataagtatcaacataatggtctaatggacataatgatgaaattgcatttccatcttatctagtagtaagcaactttactgaatgatcttaattatcaacaagtataccaaaagatatgaggcacttaccatgctaagtgcatacattcgaacttctacctctttccaaggaattgattggctagccaaaccccatccaccagaaaaaagctgcatacaaaaacatagttcaaagttaatcgccataatggtctcactaggggagtgtaataaaatcatctaaaataattgtcacaaaaggggctcaaaagtatcccacgtatcaagatattagaagcaatatgtagaagtttaataaatcgatttcaagaccagcacatagggcagtataaatattacagaaaccataagggtatttgtttgctgcagcaaataccaagaaggttcagattttcagaaccatatggtttatttctgtgttttctatttttagtacattcatatatatatgcaatagtatagttgtaaatagtgtttatttggaacaatggtgcataacatatctacatcatactattgcatatctagcttataaatacggttattggatgtctaaagataccaccacttctgcaaattacaatcttttctccccagacatggaatatgaggaatctttcagcaataaaccacataccttattaatatatgcaggagcacctagaagcaagcaaatatcaacaagaagctcctccaagttcattctgaactgtgctagtccatcaggtatgcataattccccatcagtgccatgttcatcagtgtcaatctatggtttatcagataaaacaaggcattaaaaagtggatggatttacaaatttgggtttaaatgaattggatataccgaaaagcaaaattggaatttctactttagtgtacagataaggaactgcaaccaatctgaattctgaagtataaaaattgtgaccacatgcacaattttgtaagatagtactttcagttgatcattagaaaataaataaatgaattcatgggaaaaggagaaaaaacctgagcacgaaaaagaagtgcatcaagcagtgaagaaaacacaggggaaaatatctcttgtgcagcattccttttttctgtttgtgcatcactatcaagtataaaatgtgctaaactgcacctgcaaagtttcaacgcacaagtataaatacttaattgactacagacatgaaagaaaagttagtagtacgattttagctctactctggaagtacagaatggaatattggaattcaaatctgcacacttgtattatctaatactccctctagtcattttttttaactggagggagtagttgccttatcattgatgcttatatgatccaaaaatatatgtaaaagcatgtgttttaactctcaatgagattgcaatgaggggaccatgacaagaaaaacaaagtcagacatagctagaaggaccataggcatatcaggttacagtgtttttattaaatccggtcctgaagtatggtaatcacaagtcctttgagaaagtttgtacgtagattccagtcgaacaccaaaaatcttgtgatactcctagaccttctaaaccccccacacgaccacaaggttacggaatatgctcatcagcaacccagccatcctaaatttccacatagacaagatgcaggaatacatcgcaacacaaacataaagaaaataatacgggaataatatgtttccgaaaaactaatacttgtaattaatcagaagaagagcttgtgattcatgaaaatgaaacaaagcaaagacatagacattattaccaaaattgcaaggttgaatctgcaatctcccaatcatcactagaaaaggctacacatctgtgttgaggataaaactcatcaggatcacaacaggtaataaagtgaactgaactatagaatagcatcatttgaaacattgaaacgtgcaacttaaaaactcaaagaaaagtaccacaaacaattcaatagattgacctcaaaagtgcatcggcaagagcaagtgcttgaacactcccttctgcaaccaaagcaggtgcctaagaaagttcaacggttatcagcttatattcaacagtctcacacttagaaaacaatgcaatgtgattatgcatataaggtgtgttctatttcacattggaatttctctcaggttcattctctgagccgttactaaaatgctgatttcaggaaatacatgacagttaattcagttatttcactaacttaactacagtagaggtctaatattcacttcaacttgatagtagaacaatgaatggaggaatattttgagtaacagaaatgcaacatagataggttgcaaatatgacactgcagtacaaccaccaggtgagacaacttactgcctgaccaacttcacacatcaaacaaacaagaccagcaatagtcttctcgcttctgttggcaagagctggcagaagaagagcttctctaatatatggcattttacttagaaatgcctgaggtagatcctacaaccaaaaagtggcacgcatcaagattagtggaactgtattgaattaatcaacaaattcaacaaggggaacagcagtcatgcttctagtcattgtctgagaaaataaatgaggagcaggacgggcattgcaactcttctagtcataatattcacatcatgtagatatctgaggcaaaatataactacattaactagcagcttaggttgaacattattaaaatgtaaactgaaatgaactctgatttagtttaatcaaattggtgtcttgacacaaacagaagagagcaaactcaatcgtgcaaactattccatggcaaacctcaaatgttacattttcatacaacagaaatgcatgacatcaaacagaagattagggccaaccgataagtgacaacttgggacaggctaagtgactaacaagtccaacagtccaactcaatcgaaaaagcatgcagccaccagatagaaataagttactgatcatcagttggctgcagcaatgaagtgaggcactatgcagcaatcagaacttacttggtgatgactgacaagctcggtcataacctctacggccacatcaaacgagaaggacaccttcattagtcagatgacaacaaagcaaaatgtgaggacgtgaatgcacaaacttgtccttcaaagtacacttttatgagcttataaag

SEQ ID NO: 94319 - DNA, 1199 bp, Oryza sativa
ctataggcgaattcgagctcggtaccctttaacaacaaatgaacttttcccgcacaagttattgtaaacaatttaacaacaaatgaacctttttcagaggggtttgttgacaatccttctttttcaagtatatcctccaactcctttatcaaacaggcttcacgcttgctctcaggagccatctttgccttccgatacacagtaggtgcgatactagttaaaaataaacataagtcggtaaatttatcattccgaaaatccataaaactgcattcaagcatgcagaagtacctcattccacaagatttgattattgacttcagccgttccacccgtttcccgtaagctggagctacttgtcgttttttctgcatattgagatataaacaagttagccaaaattatatttacactaatcatgcagtcaagaactcacacaaaataccttattatcttcttcagctgatgaatttgaattatcttcttctgatccactccgctctttacttttatctaaatcttttttggcaacctttttagcctttgaatttgacagttgtttctccactgtagtttttttctgcctttttacagctttgcccttttcagcctttttcttttttggccttgcatcctcatcactgtctcccctctcacaatggctatcatttatttcagaagtatcagagtcttgacgagctctcttagagtttttgcttgtcttctggccagaatccttatgagattcagttttactagttttctttgtcccatttgcaggttcttgaagaatctgtcacacagaaaattaatgaaacacaatgagttcgacttcttagtccaatcatcaacatgcatctgaactaatacatgtgtgcaccgctgcaccctcaatccaaactttaaacttacattgtctaattccgtcgaaataaaagacttgtaagcatccaaagctttcttctgaagcttgagatcttcttctaaagtccggcgaactccttgtaaagtaatagttctgcattgctttcatattgtgaatacatgctgaagctgactagccaaatgcaatatgagcaggtaaagtggacatcgaacatgcttttggtggcagcaagcatccgtatggcgcagaatccaaaatttaaaccagaataaagtaaaatgctgaagtaacatgattggacatacttaggaag

SEQ ID NO: 94320 - DNA, 2092 bp, Oryza sativa
  unsure (1)..(2092): unsure at all n locations
ttcaagtttgaacctttgactaacttctcaaaggctttgtgctatacccgcattctagggaggagctgcggaagtggtttctctccatggagactacgctttttcgctatcgctttcggctcgagagtcctgaatcacaggtgactttctgtccttttcttgcatacaaggaaagctatcatgctttaaccgttccttgccacactgtatttttcagaggatgcttatgagtgagtttcaacttccatacaaagcattgccacactcggaatttgaggtatgtgttatggtcactctgttgacttggaccttgatgatttcagtaatatttacagtagtgagatgttcttgttttcacgtttttaggctgtcaaagacaagttgagccaagttgcacgcaccattggtcaatctgcagctggtatggaacatcttactatgtgatacctgttctttatgttgtttcagcacaatggtgcttcgctgcttgcaggtgtgatctttcacttgctaagtttgttctatgttttcgttttgcagttgaatctgtgttcttcaaggtatttgcatcagtttattttacctcttcaattccatatccagtagaaaaaaattgttcgtgtgattacccagtctaaataaaccttgttcgttccatgtaaggtgccttttgaagaagttccagatcttgttgccagccgccgagtatttctttcaaaaggatatgcttatgttgcgatgagtcaggtttgctgcgaaaacgagactggaaacttctatgtactttttggatgttgtttcctgcccattctaaacatacttgtataatttaataggttgattcgcttgtggttacccaattccgctgcaatatctcgaaagcacttgttttaacaaataggtacatggtacaaatgttctactttactctgcctagctacatatcatgtncgggagtgtgctttcttagttctttgctggaaaattgttgcactcttaggtgatataattaggaacattaacagcattgtctactatttgccaataatttacatagaacaaaagccccttgacagttggatttatttctcaacttagaacactctttagtacaggctgtactaagctataatataaataattcgatgtacagaaaatggacggccaccattaaggaacaagaaaaggataggttgactcctgtgagtatcaattaaccacttcccgtattcctccagacaatcttttcataacttttataatccacactttttatcttaacagattgtcgaagcattgagtaatgcatattttggacctgattactctcaggtatgttgctttatctataggtgtttttccagatattgttaatgggattttcttcaatgctaatgtttactatatttgttattaattgtctggcttatcaaatatccaatattctatacagccaaaggatgctgttgagatttctctgaaggatattgaccaactggctaaaacttctttccctctttgtatgcgccacatgctagagaaggcaaggcaccttaaaagttcacatactttgcttaccttatgatcaggttatttagtgattgcttttatttttcagttgagagaaaaccatcatctgaagcatgggggcagaatgcagtttggtcttttccttaaggtaataacttaatgaattatcttaatactggttctgttatcagtgaacacttattttatttatgtcacattaacttgcttcttaaaactatggtttaaggagctggactaaagttggaagatgctctagcattttggagggcagagttttctcagaaggtgcctaattttctttcagaatgtaaacagcaactatgttttggaaatagcacatgcaaaccttttctgtttctttacaatacaagtaagccgtgtcaagaaaattttctataggatcgtgtactgcattcttatctatagtgttgaacattgagttaaccagtaagaagccccaaactaaacaagtaataccccgtgttgcattgtgcaagccatcacaaattatattgcttcactgatgttgggttttctttgg

SEQ ID NO: 94321 - DNA, 2065 bp, Oryza sativa
ctatagggcgaattcgagctcggtacccgttctgttatcagtgaacacttattttatttatgtcacattaacttgcttcttaaaactatggtttagggagctggactaaagttggaagatgctctagcattttggagggcagagttttctcagaaggtgcctaattttctttcagaatgtaaacagcaactatgttttggaaatagcacatgcaaaccttttctgtttctttacaatacaagtaagccgtgtcaagaaaattttctataggatcgtgtactgcattcttatctatagtgttgaacattgagttaaccagtaagaagccccaaactaaacaagtaataccccgtgttgcattgtgcaagccatcacaaattatattgcttcactgatgttgggttttctttggataaggttggctctgagcgatttgacaaggaatatgcctacagtatcaggcataattatggaaaggaaggaaaacgaacagtaagccccttgttctatttttggtgcttgattggataatcaacttattcatctctcagacaaatggctcctccaggattacactccgtattcatgtcaaaagattatctctgcaacacctggtgttggtgatcaccatggttgcccttatcgacattttgggtataatctcattctaccatgccattaacagagtagttaagcatttatttgttttatggttaactttctgttatcagtagactatttatcgaatatgtcaatgggacatgggatttcatatcctaaaactctctgttagcagtagactatttatcgaatatgtaaaagaacctacagctatcactgtctttgtgagttacatgtgtccttttcttgtgtgatatttctagtgaagacaacttgagagcagctctcaataaaatgggaatcagtggtcatccattagaagagataatggataaagtgaagaacaggcactaccaggtactgcacctcacagttctacctttaataagcaatcttctaaacttcgtctgcttgaaccatctgagttatgaaatacacagctagcttgcacgatgacttttgaggcagaacatggtgtctcatgtgatactggaatcaatcatcctaatcagtatttcagtgaaagccagaaagtcttgaaagcaaaggtgagtcaccatagttgatttgcattcatttgtgcattttgtcagcatatgagatgttcaaattgacagtaatttcgttttattccacagaatcaagcagtgcagagccaaggaacaacctaaactgtaatgctgctggcaaaagtcagtccatccaaatgcggaatttcaggtttcgacactactagtctgtcagctgttgcgatgcattgttttctaatatctactggttattggcaacaaatttctaatgttcaattgtgcgaacataaacatcattctcaccctttgcttttttatagctatttttcagtattcagcaatcaaatccatgatatgtgtacaattggcagcaattctaagttatttttcttttaatttctgtttttagttttgatgaaataattttgctgtttttccatatgagatgtttttactcctagatttaaccatgaattaaagttttactcatggtcacattggacgattttcaaatgcccattttttgattcaacggtagtttctaggtttgcactacaaattttcccatttatctttggcttctaaattgcccatgaagttgtggctttgcattctgttcaagtgtgcctcgtcgtttggcctgtctattgttattggaaaggggatataactctatgctaagttctgatctagattttaagagagtatttttctgagttggtttctatgaacttcctgcaaaattcttactctaaacagggttcaaatatcagaacctgctattcctaaactaaggatcattgctgtaatttatacacaacactagcaagactctttgaaacttgtagaataataataataccgattcatttgctaatactactgggatgtctgtaaataagatttgcgttaat

SEQ ID NO: 94322 - DNA, 2074 bp, Oryza sativa
caaaatctaaactttattaagcatgaaacaaaacaaactttggcaaacattggggttaacaccattgtgccacattattcatagcaagtgcttacatgattggaaaaataaaaccaagcacctactactattttattcatgggaaaggaaacatctaattagcataatatatatttttcttccccatatctatgaatgcacgcttgattttagcgcacaaaccatgactaagggtatcgaaattattcctaatttcagcaagctctacccctagctccgcgttgcgatccctaagctctatgttctccttgcggagtttcttcacttgcgcagcgagcttatggatcgagggctccggtgatttcacctcattttcttggaattggccgggagccctcacaattggagggggcgtcaagtgacgcttcaccttcataggtggatggctacgggattccgctgccccctccttctctgatgccatcaaaggcgggagtaaacccttaccatacctaccgttgggagttcgcactccctgaatgcggaatcgctcctccttcggagtggatggagtagcggtgggtgtggtgtacttgtgagcacctcatccactgccttggtgaacagggtgcccacataacactcggtgggaggcggcgcggccttcccgtcatcttgaaaaaggcgacatgcctttaagagaccgagctctcccatcgtcagccgttgagcagccgaatccccccgaatttttgtccttgtgacatggcgaggggagagggatcgcgctgccgaacagggggccgaacggggccgagaagggtttggccgaaaccctggtttggtcgaaccagggagctcgtcgacgggctccagattttcaggggagcccggcactgctgcgaggggctgcacccacagtgcattcaccccttccactgtgtaattttccaccgggatgagttgattcgccggtgttggctctccggtgaggttgtccggttacggttcgttgcggaattagttcattttgagcatttgcaacgaccgtcatttctcctttttcggcacaacctggactgggctaacccactcactgtatggtacgggataaataatcccggcatgcaggagtttcaagacctctttctttacaacctctcgcattgcattattgagccatcgttgaggttccctggagggagtactctcggggtcaataggaatacgatgggtgcaaagcgcgggattaatccccctaaggtcctgaagcgagtagccaagaacagaacgatgcttttctaacacggtgagaagacgttgagtctcgtcttcagagagcttgtcactgattatgagacaggggcctgtcacgcccagaaattcccgaatagaatttcaagcagaatgtgcattaaattccccgtccaggaccggccggggtacacaaacgacaatgttgacattcagatccacgtcttacaaacatcataaaagtcttacaaaaaatgcagcggaaagaaagaaagacaacaggagctaagccttgacttgaactgcagcgggaacaccactccacaggcatcctcgacggcacggacaaagcctactcctcggagaaaccttcatctgacccgaactcgaactctggggttgggaaaagtagagcaagactgagtactacccactgtactcagcaagtcataccggaataggggtatgatgcagggaatcatcaaaggagagctgaagtggttcatttgcataaagcgagcatttataagcagaaattgaaagatttaaacggttgtaataattaattaatattaatcatccgctgtccaacgctaacccacgttgcgacaggcccaaccatccacctaaactatccaaattcaaaagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagagg

SEQ ID NO: 94323 - DNA, 606 bp, Oryza sativa
caaatggacgatataagggatcaaaagagggggaattaccatgagacaagataattcaccctcgagagagggaatgtgtgaatctatttcaagttgtgctaggaccaaaattcattgaaaaatgagatccccgtacacatagattcaaaatctccacaaaaaaaatgactagtgtccatccatgaattgaatgaccattttgtcacaaagtggtatgcaaacctattctaccaagcaaacatgcatgcaatagatcaagccacattccgagaatccaaaatatttagttcactcctcaactcacaaaacctagctttatctagaggcttggtaaatatatccgccaattgtttgtcggttctcacatgttggatgtctatgtcgcctcttgtggaatgatctctcaagaaatggtggcgaatatcgatatgtttggttcgggagtgttgaatggggttgttggctatcttaatggcgctctcattgtcacataggagtgggattttggatacattgaggccatagtctctcaaggtatgcttcatccaaagaagttgagcacaacaactccccaccgaaacatatcccgcttcggcggtggatagg

SEQ ID NO: 94324 - DNA, 1831 bp, Oryza sativa
  unsure (1)..(1831): unsure at all n locations
aaaggnaagagatacccttagtggaagnaggagtgcttagtgcaacctcttgaggaaagggttagccaagacccggctctttagtgagctcctcaacgtagagtagaatcccctcaaggattcgaacttcgggaacaacctcgtgagcttcatctttggtgacttaacttcctccctctcctctagctttgcttgtttgagccgctataggtctagttgctgtttgtgctagcatattcttgttgtaggcaactagatctaggatttactttcctgtttgtgctaactccgaaaattttcggatatatccgaaaatttcggaaatatccgaaaattactgcttccgcttttagttgatttttgaattagcctattcacccccctctaggcctaattgacactttcaattggtatcagagcctaatctcctaattaggcttaaccgcttggagagatcatgtcgggccaaacgggggaaggaaaacatggtgataagggagctacgtttccttatgactatccacctacatctacatcttatgtgagtacctatagcggcaaagctccgtacttcaatggtacggactatgccgcttggaagcataatatgaagatgcatttaaagtctattaacccatctatttggagaatagtcgaaaaaggctatgttttgcagaatcccgaaaatcccaccaaggaggacgacgagaacgagcacaagaacgctcaagccgctaatgcaatacttagcgccttgagtggaagtgagttcaaccgtgtggatggcattgagagtgccaaagtgatttgggacacgcttcggaacttgcatgaaggcacggatagtgttcgtgagtccaaggtggagatcctcaaggggcaatttgagagatttgtgatgttggatggtgagagcccaagtgacatgtatgaccggttgagcaagatcgtcaatgagatcaagggacttggctccaagggcatgaccgatgaggttgtggtcaagaagatggttcgagcaatcactccaaggaactctaccttggtgactatcattcgtgagcgtccggacttcaagactctcacacctcatatttgctcggacgtattcttgcccatgacatgctcgtgcaagagtccaaggatgtcatccaatacatcaatcaaagttcaaccacaaacatcaagaaagaagacttggcgttgaaggcgaaggaagaagaagaagagaatcgcaagagcaagagcaaggcggagatcgatgatgaagagatggctctcttcgtcaagaagttcggcaagttcatgaggcgaagcggcttcttcaagggaggttcttccaagcactactccaacaagtcaagtggaagacactccgcaagagtgtgctacgtgtgcaaagagcccgggcacttcattgcggattgccctcacctcaaggatggttcccacatcaaggaagataagaagaagggtgagaagaaggatgagaagaaggagaagcacaagcatagcaagcgggaacattatggccaagctcaccttgggatgatcttcggctccgactccgagtcaagctcaagtgatgaagaaggagtcgccacatttgccgtcaagccttcatcaccaccgagactcttcgactactcaagtgatgaggatgctcccatttgcctcatggcaaaggagcctaaggaatatgtctccggtggaagaagttgggtgattgatagtggatgcaccaatcacatgaccggagaagaatcaatgttttcatctcttgatccaaatggctcttcacaagataacatagacttcgaggacgatggaa

SEQ ID NO: 94325 - DNA, 757 bp, Oryza sativa
cggttgcagtgatcaccctcctcgacaccctcctcaaggaagatgcactcaatcaggccgatcatgtcgtcaacatcttgaatcagacgaagaccatgatcgccgcctcgatcccagctaactccgtaagcacccgcacgccgactggcagccgagtcctccctctccgatctcaagactatcaccaaccaagcctcagcgtcgttggcgccggatccaatcgcaggagcaggggtcacgacgagcgatctgtccattcacctcccgaacgacacagggagcgccgagttgaacgacctcgcaggcaccccatcgatcttcacgataccatcaaccagcgccgcgcggcaagaggctacgctccccaccgttcaccagactgctacgatgacgacgtggatggtgtagctaccttcacggccgacctgcgtcgagtggattggccagccggcttcaaaccgactggaatcgagaagtaggacggcaccactaacccggagtcctggctcaccgtctacggtctcgcgatccgcgctgcaggaggagatagcaaagccatggcgaattatctgcctgtggccctagcggattctgcccggtcctagcttcacgggttaccccgtggcacaattggatcttgggtggaacttcgcgaacacttcatcgccaatttccagggcaccttcgaacgccctggcactcagtttgatctttccaacgttgtccagaagtccagagaatccctgcgagattatat

SEQ ID NO: 94326 - DNA, 1288 bp, Oryza sativa
ggacttcaaaactctcacacctcatatttgctcggacgtattctggcccatgacatgctcgtgcaagagtccaaggatgtcatccaatacatcaatcaaagttcaaccccaaacatcaagaaagaagacttggcgttgaaggcgaaggaagaagaagaagagaatcgcaagagcaagagcaaggcggagatcgatgatgaagagatggctctcttcgtcaagaagttcggcaagttcatgaggcgaagcggcttcttcaagggaggttcttccaagcactactccaacaagtcaagtggaagacactccgcaagagtgtgctacgtgtgcaaagagcccgggcacttcattgcggattgccctcacctcaaggatggttcccacatcaaggaagataagaagaagggtgagaagaaggatgagaagaaggagaagcacaagcatagcaagcgggaacattatggccaagctcaccttgggatgatcttcggctccgactccgagtcaagctcaagtgatgaagaaggagtcgccacatttgccgtcaagccttcatcaccaccgagactcttcgactactcaagtgatgaggatgctcccatttgcctcatggcaaaggagcctaaggaatatgtctccggtggaagaagttgggtgattgatagtggatgcaccaatcacatgaccggagaagaatcaatgttttcatctcttgatccaaatggctcttcacaagataacatagacttcgaggacgatggaaagggaaaggttataggattgggtaagattgcaatctctaatgatctttccattgccaacgttctcttggtaaaatctctaaactacaatcttttgtctgtttctcaattatgttctatgggttacaattgtctttttaccgatgttgatgtgaccgtctatagaaggaatgattcctcgatagtctttaagggtgttctcaagggaaagctttaccttgtggatttttcctcaagtaaagccaaacatgagacatgcttagtggctaagtccaacacggggtggctttggcatcggaggctagcccatgttggtatgaggaatcttcccaagcttctaaagcacgatcacatccttggtctaacaaatgttcaatttgagaaagatagggtgtgtagcgcgtatcaagccggcaaacaaattggagcacatcaccccgtcaagaatgtgatgaccactacaagaccattggagcttctccatatagacctcttgggtaccgagctgaattcgccctatagtagtc

SEQ ID NO: 94327 - DNA, 1769 bp, Oryza sativa
tctcatttgtttccaggatacggattggtttctcaacataagtcaaatcctcttggacttctatcttctcaatattagcttcttcggtaggtacccttaaacattttttcaattgtgacacatggaacacattatggactcctgccaaagattgaggtaattctaactgataagcaacctctcctcttctactgacaatcttataaggtcccacaaaacgcggtgccaattttcctttggtgtgaaaacgatgaactcctcgaagaggcgtgacacgaagatacacatagtctccttcttcaaaactcaaatctctacggcgattgtcggcataactcttatgtcgagactgagccactcgcaatctttcttgaatgacctttaccttttcttctgctttccttaggatatccgtcccgaaaacctgacgttctcccgtttgatcccacaaaagcggagtgcggcacttccgaccatacagtgcttcgtaaggagccatctgtaaactagcttgataactgttgttgtatgaaaattctgcataaggtagattcttatcccaacttccaccgaaatctaaagcacaagctctcaacatgtcttccaaaatctgattcaccctttcggtttgtccgtctgtctgtggatgataagcagtactaaagttcagcttagaacccatctcttcctgaagtttcttccaaaaatttgaagtaaactgactgcctcgatcagacactatcttcttagggacgccatgcaaacacacaatccttgccatatacaattccgccaagcgacttccggaataggttgtctttaccggaataaaatgagccactttggtaagtctgtcgactatcacccaaatagagtcatggcctgatgacgttctgggtaaaccagtaataaaatccatacatatttcttcccatttccattcaggaatcttcaaaggctgcaacaaaccggcgggtttctgatgttctgccttgactcgctgacaaacatcacatactgctacatattccgcgatttcacgcttcatacttgcccaccaaaatctttccttgagatcctggtacatcttagtactaccagggtgaatggagtataaagtatcatgagcttctttcataactgcatcttttagatctttgttgtcggggacacagattctctcacccaaccatacagttcttgctcatcctccaagaaaccaatagcttttcctcttctcatattcttcttgatctcttgaatatcaggatcattaatttgggcttctctaacttgatcaattagagtgggcttcgcttctaaggctgcaacgaaacctctaccgacaattcccaaatttaatctttcaaattccttgcataattccaatggcaactgtcgtccttctgtagcattgcaatagccttttctgctaagagcgtctgctacaacattagcctttcccggatgataatgaattcccatgtcataatccttaattaattccaaccatctccgttgtctcatgttcagatccggctgagtaaagatatactttaaactcttgtgatcggtgtacacttttgtacgagtaccgaaaagataatgacgccaaatcttcaatgcatgaacgactgcagctaactcaatatcatgagtagggtagttcttttcatgcggacgtaactgtcgagaggcataggcaaccaccttcccatcttgcatcagaacacaacctaacccaagtttggatgcatcgcaatacactt

SEQ ID NO: 94328 - DNA, 1600 bp, Oryza sativa
cgaagatgttcctcatgctcttctttggttcgaaggtagataagaatatcatcaataaagaccaccacgaacttgtctaggtattccataaacaccttattcatcaagttcatgaagaaagcaggggcattggtaagtccaaaagacataacagtacattcgaacaacccatacctagtggtaaaagctgtcttaggtatatcttcctctttgattctcaactgatgataccctgatcgaagatctatcttggagaaaacagtggcacctttaagctgatcaaacaaatcatcaatcctgggtagtggatacttattcttgatagtcacatcgtttagtgcacgatagtccacacacattctctgagtatggtctttcttttccacaaaaataaccggagctccccatggtgatgaactcggtctgatgtatcctttctgtagcaaatcatctacttgcctcttaacttctgccaactcattggctgccattcgataaggtctcttatggatcggagttgttccaggtaccaaatctattctgaactctatatcccttttaggcggcataccaggtaaatcatctgggaacacatcaggatactcccggactataggaatctcttccaaagttatctggttcagtcttgaccttaaagactcagatgacaatgcatgaacagttacaactcgaccatcatagctggtgagagttacttttttgttggcacagtctatcacacctttatatctggctaaccagtccatccctaggatgacatcaaggtctttggattctaataagataagattggccagaaatggtactccttgaatttctattctgacagaggggctacgttgcaaagagagtgcttgattacttggggtactaaccatcataggacgtctaagatcttctacttccatcccatgatttcccgcaaaactcatagataagaatgaatgtgtagcaccagaatcgaaaagcactgttgcaggaactaagttaacaagaaacatacccataatcacatctggagcatcttgagcttctgcagcagcaacatgattgacacgggcctttgatgctggtgcggtagagttgctctgggtagggacaaccttcacacgtcggggcttcggacacttgtcagcgtaatgtcctgggtctccacagttgaaacacaccacgggcttgctgccttgctccctcttggcaggttgttgctatgtcgaggctgcaacagggcgtggagcttgattacgaatgttgttgccggcattgttgttgaagaactgacgctgcggacgaacaacagacgaagaacctccctgtggcatggactggggtcttaaagtaagacgcggcttttgattatttccctgttgtgtcttgaattgagcaatccggcgtttcttttgctccatgcggttgtacttgtcctcctgacgaatagccttatccactaatttctggaaatcaggataatctccagtcataagtgggtaagaaagctcatcattaagtccttctcctggcgctcttcatcagtgcgtacctcttccggagcataacggggtaccgagctgaattcgcc

SEQ ID NO: 94329 - DNA, 914 bp, Oryza sativa
atcgaacggtccacgaccggctcacggcgggacgaccccgatgacgtcagcggtgacgtcaccgacagcggcggcggctcggcggaacggacggctcgggcggcgcacgcttgccggcgaacggcggcaccaggacgcaaacggagggcaccagcacgtagaggacgacgcggcgaacacaccggtgaccaaaacggcggcggaagaacaacggacgacgacgacgacgaggaggaaacggcggaaaccttcgggttgtcgacggcgacgaagctccggcgatctccggcaacggcgaaggggcggacgagaacggcgacgcgacggtgaccacgacgacggtcttcccgagcgacggtgacggctgaagcgacggcggcgcacggctggagcggcggcggcgacggcaaagctagggcacacggcgctagagctctttcggcgacgagaggcgaaggcgagggtggcggcgggtagaggagacaccgagggtccttttaaaggggctcggaggcggcggcaaaggcccacgacggcggcaacggcgaaggaaactcgcggcttgaaggaaagaggtcgatccgaatcgaactcgattccacgaacttccaaaccgatttagccgaagattccaaaggagaaaaaggtagaggagatcccggagattgtttcccctcttttgattcgaccagagaaggaaaggaacggccggatttggaaggaaacggcggcggcgcgaaactagggtttcggcggcggcggccgaaggaggacgaaggtcctgacaggcgggaccctcctgtcagcgacagcgagagggcgcgcgcgcggcggactgggccgaactgggccgaggagagagagaggggttttgggccgactttcggcccaaagccaaaagagactttttaaaa

SEQ ID NO: 94330 - DNA, 774 bp, Oryza sativa
  unsure (1)..(774): unsure at all n locations
aatttaaaatttataaattgttgtttaaatggaatttttagaaataattttaaaagtcttgaagagaagatctagttttaattaataaattccaatataaaatgggcccagataaaatttcattaaatactttgcttaattctataattcctagatttttctgggatttatttgagctaaggaagtatttttaataaatggaattgcatttaagaaataatttaaattgaaaaaggttttaaaaagtctcttttggctttgggccgaaagtcggcccaaaacccctctctctctcctcggcccagttcggcccagtccgccgcgcgcgcgccctctcgctgtcgctgacaggagggtcccgcctgtcaggaccttcgtcctccttcggccgccgccgccgaaaccctagtttcgcgccgccgccgtttccttccaaatccggccgttcctttccttctctggtcgaatcaaaagaggggaaacaatctccgggatctcctctacctttttctcctttggaatcttcggctaaatcggtttggaagttcgtggaatcgagttcgattcggatcgacctcttttcttcaagccgcgagttttcttcgccgttgccgccgtcgtgggcctttgccgccgcctccgagcccctttaaaaggaccctcggtgtctcctttacccgncgncacccttcgctttgccttttgtcgacgaaagagctctagcgccgtgtgccctagctttgccgtcgccgtcgncgattcagncgtgcgccg

SEQ ID NO: 94331 - DNA, 986 bp, Oryza sativa
tcccgttgtcttggccgtttgcggtttgggggcttgacatggtcggcccgttcaaaaaggcagtcggcggttatactcaccactttgtggctgttgacaaattttccaagtggatcgaagctaaaccggtcattacaattacgacagacaaggctagagatttcttcatcaacattgtacaccggttcagggtacccaatcggatcatcactgataacggcacccaattcacaggcggagtattcaaagatttttgcgaggacttcggcatcaaaatttgttatgcctctgtagcgcaccccatgagcaatggacaggttgaacgtgccaatggcatggtacttcaaggaataaaagcgcgagttttcgaccgattgtgtccttatgccggcaagtgggtagaacagctgccatctgtactttggtccctacgcaccactcgtagtcgagctaccggctagtcgccttttttcctagtttatggagcggaagcaatgttgccgagtgaggtggaatttgaatctctacgatttcgcaacttcagcgaggagcgctatggagaagaccgagttgatgatatcaaccgactggaagaagcccgcgaagcagccttaattcaatcggctcggtacttgcaagggttgcgtcgttatcacaatcgcaatgttcgctcacgagcttttttagtcggcgacctggttctgagaaaaattcaaactacacgggatcggcacaaattatctcccttgtgggaaggaccgttagttatatctgaagtcactcggccaggttcttatcgactcaaacgtgaggacagtactcatatcgacaactcttggaatattgaacatcttcgtcgtttttatgcttaggcattacttttgtattttcctctttgacttctaacatcaagcctttccttgagttatcagttgggggctactataataataacggagtgtgatttttatcaattcaatttgctt

SEQ ID NO: 94332 - DNA, 3281 bp, Oryza sativa
atccggttgtcaacctccacatgtttatcaaccgatcgcatgtataaaaggatataaataaatgatgagtattaatcaacaccacaagtgtcatatacttaaatatatgctcaaatgtaaatatcttaattaaataaaagtgaataacttggatcgattacatgcataactaaagtataggatttgctacccctaaatgtatgcatacaaaatgtttgttgtgtgaagtaagaatatgcataaaagaatgaaacattaggagcttatcctatacaagaatagaaggcatttatcaaatataggcattaaaataaaaacataccttcatcatctccatgttctgaatgtaaatagactaaataagatatggctcaaacaaaatattagtctcacatgcttatgtaatcacataaaaatattatatatgaatatattaatatgtgcacggagagaaagagtgtcatatatagcttgatctccatgcatttcatccttgttatttaggtacaccatcaatgaacgtttctctctcatattccattttcatatccatatgagactagtagacaaagaaatatttataacaatgttagtctcatgtaattggatttgtcatttatcaccaaaaccaaattaaatggatttgtcatttatcaccaaaaccaaattaatggcactcgaactttcaatttacaagtagattttcttgactcgaaactagccgagccgtctaatgtagtagcgagttgaatatacttttctcctctcttttttttttaagtgaaagcggcaaagcattatcgaatatattagaaggccagaaataaagtttttacaatagggtgattacatatagcatttgtgagcatctaggagatgaattaacatattaagaaactataattgaggcgtttggaaggcgaagtcacactcatgcagatcttccgggactggacgtgccgttctctgtgtgttcggttcctccccttggaaaattttcatgtttctctgaagccaaacgtgctaccacatccttattagggttccaattttactcatggctttccaacctgctcctcgttgaagctatgcttgtcatccattcaataatactagagcctggggcgcgccgttggcgcgccgcctgtacacaacgaaattgaaacaacacgtgataagcagggaacaaataggaaaaggaacagggaaaaggagagaaagcagggagttatagataaacaaactgcagcactaattacatatatgtatttcgatacataggagtctttaataataaacatatatagatggtagtatgtaagatatgtaaggcagctcagtacttctgataagaagtgaagacgcagagctaattagcatagtaatagtggtagggttggtgagtggttcatcttcatagcgatgaatgtgcttactgctagcaaaaggatgatcctaatatagttatgatcgttcagatgctgttcacagaacatcgatagttacttcaatgtgagttgccttgtagaagtggaagatgcatactaatccagcatatatgtgattgtgccttgcaaacttcatccaccctttcttcaagttgcagcgaccatcagatgaaacgtggaggatcacgttggttgaaatacactgataggtcacggcaattgagaacaacagctcccaaattcagcaccatttcgatcaacatctgagtagatcctccacagcttccactattccagtagcctggcagcatgtaaacaaaattttcaatgataattagtttctcactccaaacaaaaacgtacaggaggcgcgcaataattagtttctcatgatcgctaaaaactttaatcaaagaatgaaggaggagatgcgggcagcggcggcggcgagggcaagagagggagaatgaccatatcaacacgcacctgaaaagacttgagaagaatacaattggtcgtccataccatcaggaagattcacagcttgaatcgttctccgatttcttgaataagtcatcacttttcttgagaattccttaactaatgaattatctgaaaacgtcaagggaatctctcagcaattggatccctcacataaaacagtcgaataggcatcctttcaggatcatcagttggagtttcttcaggtatatcatggtacagatgtttgagaatgaagagagcagtatcatgatctcgccaataattgctacaagaataaacctgcaggccagttaaatggtgaaatagacatgataaaacaattagcaaacaacaggattggttatggaacctacatatgagatccaagggcagataagtataggtgttgaaatgttttctcctgaaatcagatgattcagactgtaagctacaacatatttgtactgacaaataatatacaagccagaaaataaaggggtcaagggaattggtgatgctgacaaaagggttcgcagtcctgacacaggaaccactaaaccagcagagactggggaaccagccaattaagcttgccagtggttatatgatttccactgtcagttccttcaaggcacagtagttggttaagataggttagctaaagggttactgaacatattaggcatattttaaatcatgttctcactcatttggtatataagtgcatttaacagtatttaacctcttggatttatgtgctcttttatgagccaaaatttaaccaactttagagtttatgggtttaactctcttgtgaagattaaccctgaagctaatttagggtgttaaactaatcacttatattggttagggtgatttaagctctcaccattcatgtcaaaagcaatgtacagtacttttcatatccacagcagaccacacaatttcaatgcttacacatacaccagcagagagtgaaattgaacttgctttaataggaaaagtctgataacctgaagtacatggtcaatccgaccatctggtgaacctgtcagcctttccatcatcatgtaaccatatgacttctctttctcattattgctgtcaacatcctctgaacaaccaaaaaacgtaatcagaacattgctttttgtgacttgcaatgcgtagaagacagaaaaaaaatctactatatgcataccggctgtgtcatttctgctcagtgatagcaaagcaactactgctttaacctaaacacaaaagggagattaaaggtcccaactcattaagaaagagctacgtgaacagctatgtttctagatcattcacaggtaacaaagcatttatgta

SEQ ID NO: 94333 - DNA, 1354 bp, Oryza sativa
gactactatagggcgaattcagctcggtacccctagatagataattacttatatgtatgcggtcctctagacaatacatttcatcatgaaaagaaggtgtagtcaaattcgaacaaatatatactcgatgaacattatattctcctttactatcataattgccaataatatgaaaaatcacatcagaagggcatggcaattccaatctagcaaatagtttcttctctaaacagttgagtggacaaagatcatcaaattgaatataaccccaagtatttaaagaagatagcaatttaagctcttcattctcgctagcaatgtgaataacatgtttaaactcaacacatagtggttctactatagaattaacatgttcattcactagttgtggcatggatataagtgaagcatcgcacaactcttttttatcactaaaaacatcaagcaaattgttttgtgacaaaggtatttcaacaattgtttccactatgggttgctctaacgtagcataagtagtggacatagttggcacaacataaatatgcataccttgaatagctatagcaccattatcattaccttctttctcatcttcctcttcgtctttcttctcttcctcattaccttggttgttctcagatgcatgcaaaatattagtatccaaagcaataggcacaacaatacgttcattttgtaataattcaggaggcccgaatccgaatccaaaacgtgtagaactttatctctgatcttctatggaccaaaagtgacgtgatgagatggaagtggacttggagaaggtcttgatatggtccccaatcaacttctttgattatccatgaattcgttacgctcagtctcctttcctttgcccaagcaagtacctctgcaaaacaaaaacacaggaaactcatagtgtagcaacgtttgtgttggcaactttttttgacaagttgacaagcacgatcgcaacacctaaacgccttgcggtgatatggagtcgccaaccacctcgatctagccaaagggccaaatcaagatgggttttgtagaaaaacaactaaaccggctaccggctagaggataactacccgtctcgtgggcaaaacggaaggttttcaggacaaacctacaaagaggtgtcgcactctcgcagcgacggcagacggtttacggcgcaaaccgacaaagatggactaaaactggggtaaaatagaaaacatagtaaaagaacgattcaagtagattgtattctggggttttacaatgaaccggccttgtcccttaaataggggttggtcttgccctatacaggcccttctccacgtccaactcgggatagaaactaaagaaa

SEQ ID NO: 94334 - DNA, 738 bp, Oryza sativa
tgtgtctcactcttgtcatgcaaaaagaatacccacgtgaagcgtgaaaagtcatcaacaataacaagaccatatttgttacctccaatgcttagataagcaattggcccgaagaggtctatatggagaagctccaatggtcttgtagtggtcatcacattcttgacggggtgatgtgctccaatttgtttgccggcttgatacgcgctacacaccctatctttctcaaattgaacatttgttagaccaaggatgtgatcgtgctttagaagcttgtgaagattcctcataccaacatgggctagcctccgatgccaaagccaccccgtgttggacttagccactaagcatgtctcatgtttggctttacttgaggaaaaatccacaaggtaaagctttcccttgagaacacccttaaagactatcgaggaatcattccttctatagacggtcacatcaacatcggtaaaaagacaattgtaacccatagaacataattgagaaacagacaaaagattgtagtttagagattttaccaagagaacgttggcaatggaaagatcattagagattgcaatcttacccaatcctataacctttccctttccatcgtcctcgaagtctatgttatcttgtgaagagccatttggatcaagagatgaaaacattgattcttctccggtcatgtgattggtgcatccactatcaatgggtaccgaggtgaattcgccctatagt

SEQ ID NO: 94335 - DNA, 2039 bp, Oryza sativa
atgtggtacacgcgttcccgtgtgtcctgtgagctttggttcgtcggagtggccggggacttcatcgaacagctgagggctcccaccggcggcagggaagacggcggcatttcgggcggatggaggcagtctttgatgggcgaagtgagggtggtgaaggaggagagtggtgaatcttgtgggcaaggtcttgggcgctttggctgggtttacgacataagttggatggggatgtcacgagctcgtattcacgttcacggcctcactgcacagcgccctgtcctggcgacatccagcagaacggatgggacaacacggatgggggagtcttcaaggctcgaatggctgccactctgccagaggtggagtaaaggagaaggatttggtcggggcgtggaggatttggccgggacggcgaggtgacgaggtcgacacggctcagccatacccgcgctggggcgcgtccatgtggcgcgggaggttgggtcggcggacaaggggttgtacagcgtggcttgggtgcagggtttagtcgagaatgaggggtggagccaggtctgggacgaattgaagactggggcgctcgttgtcttcttcggaagacatagcacgccacgtgttcgacggattgcccaagagggcagagtgtggagaagaggaagggaatgggttgggcgtctcctggggctttactatggatgacaagtggggtcagtgcttccagggcccacgaacagaggaagggtgagtagataggccagtaaacacaagatttagtcaaattccaggatttttccctctccctctctttgaaaatcgatttgaccaagatacctaagggtagacattatggttgatttttgtggaggtaggctgtggtgcataggttccatttttcaagatgccactccaaatttcgaagtggattgctcccagaaatcaaataaaagggctcttgctgaaggtttgttgaatttttagaggggataaactgactgaataaattctggaaaatttatattacttcatgataaataaactagtatcttaataaattatataatgtatatgtttctgttcaatttgtttactatcctagggatgtatcggcttagccgatgatgattttgaattaatttaaatttgatgggtttgtttgggctatcaatctaactgagagctatctatgatgcttagtatttatgttgagtttactggaatttttagacacatagattagtcaggatgatttcataattggttgtaaggcatatgagtgcaattatggatgcatataaaatccaaaaacaagccaaaataaacatgcaacacacagggggcacactctattccttagcagtcagcacaagagattacacctcgaaatgcttggacttcgcggtactaagatctaggcaggctatgctagctcgcgcttaattagttcgctcaattcgccttaacacgtggcctatgcttcaacatactcgccttttatgcttgcgcatggcttgctcttcagcttatatggttcaaaaatttgcaagccatttgataggatttatttactgtacccaggttcaatagcttaaattttatttgtcgtcccatatttcttgtgtgtgtaggatttgattagtcacgccaactctttaggttttgttgataatatttaaaagtgtcatggcattctctctagattaaacactccttatatttgaccttaattatcattcagacatttagtaaaaaaaacattttctagtgtcttttattctcaagcatgtgtgctcgaatgctctattgtctttatgtggccgtgtctaatttattacttccccacatcttgattttattttctttgccaaaaatgcacagggaggaacaactccataagtttttatttttaatgatttcagaataactgattttcatatttttatttcttggtatgtcacatgtactacccttgactagactcatagattttaatactgcatagtgtagagatgagagacatgagaaccttgcctaatgag

SEQ ID NO: 94336 - DNA, 3452 bp, Oryza sativa
ctatagggcgaatcgagctcggtaccctatgtattaatcaaataaaggtgcatatgttctacattagatttacttgttatatatttgaacaaacgttgctacacaataagtttcgtgtgtttttgtttgcaaaggtacttacttgggcgaaagaaaagagaccgagcgtaaggaatgcatggatgaaagaagacgatgagggatgttaggtcctgatcttccgataggtattgataaacagtcaatttgggcggagtcgcgacacaactcgatccggcttctgaatgaatacactactgagccccgcaatcgcagcaccacgtctcctctggttatcaaccgtgccgaaatccggttgacctcgccgagagggctaatccctgcatgcgaatcgaagaacacaagcaagaacaagatagattgcaaccaaattgcatatgaatgattaagcactcgaatttggggtttcacaaaccaatctagcggcaaaacagttcttgatagaataatctaagcaaaacccaactctaaatgatgacggctactgaattaatatgattagggacgtcctagggttgtcctaaggcgcacacccccttggcctaagcccacgacataattacaaggcccaaaactcaaatcagattcggactggatgagatacgtggtttgttttgcagtttcccggcagctcggtaggaattttgacgtgggaccaaaaccatctgaaagtagactccataagctttccaacaagtactcatgggccgtgaaattccttctagatcagcggctaggttcatttgaagttgatgctgtcaggcggcccgaatccgaatccaaaacgtgtaaaactttatctcttgttttctatgaaccaaaagtgacgtggtgagataaaagaagacttggacaaggtcttggattggtccccaatcaacttcttcaatcatccatgcattccttacgctcggtctcttttctttcacccaagcaagtacctctgcaaacaaaaacacacgaaactcattgtgcagcaacgtttgttcaactatataacaagtaaatctaatgtagaacatatgcacctttattttattaatacataaggtactcatggttatatctgagcaagttatgtcctcatcaggtttggcgtgaacgctccagatcattccctaatggcggttacggggcatttcggacatttccctttcgccaaccgtcatatctacccctatataaagacatcagtccctcacttcacacacacacttccaagcttgagctgaattataagaggctctattgtactatattgtatactagaataggaagagagtagagtaggagttggaagaattccggagttgtcgctaatcttctcctatttcttttattctgtttattactctgaattcaatataatattcttcttgagtaatttagatttatcttgtgagaattatctcttggttagttcctaaatagcatataggattattgttcactataattaactaaaatatagtgattgctttgatgagttataaacactaaagtagatattaattgcttagacgtggtgtttaggtaattgttatccagtaattgctgcgtatcccacagtacgtttgaggtgggtgtagaggtggtgacagccctcgagatcacttaagtcctccctgttcgagtacgtagtagagcgacatctggaaacagtgggttgccagtgcctgaagtattgcgttggaattgaagttaagctttccctagacactgtttctcactagtgaatcctctctatcctggcctatcctttgcttggtgtccttggatgaaccagaggaagatctgaccacacacgttcccttggattcgatacccttggaatactccgtaggggaagtgctacatcggtatatccgtgcgcttgcggattttatttgtgaccgtattaaataccaacaagcatttctggcgccgttgccggggaacggttgctgatcattttcgaacccagttcatcctttatcctttttcattttttattctaccttcacccctgctatcctagagaagtattcctgtcaaactcttctcgaccttggagcaacctctttttgagctatctgctcctcggggcgaattctacgagccacctccttcatcggagcccatttatacaactggctatgaaattcgtcccgaactaattagtatggttagggaaaatcctttttctggctttgatctagaaaatccctaccatcatctgcgagactttgaacaagtctgctcgtgccttaagattcgtggcatgagacaagaaactgtgcggtggaaattgttctcgttctctcttcaagagagagcaaagcaatggtatacctctaccgttggatgtgtaaacggtagctaggaaaagctgcaagacagattctgtcttgccttcttcccagttacttgtatcactgcccttcgagtagaaattctcagttttaagcagatcgaaaatgaatcaatcggtgcagcttggtccagattcactaatttagtgcagtccggaccaaccctgtccttacccgagtatgtgcttctccaacatttccatacgggtttggataaggagtctgcattctatctggacataactgctggaggatcattcatgcacaaaacgccgtcagaaggaaaaacgattttggatcgcattctagaaaatacttccttcatgatgcagtccaatgaaccccagctggaggcatccgtgtccaagatagaggaacttctaacaatcgagccacttgctgaaccatccacttctgctagctcgattgatgagaaggttcctgtgtagccgtccgtcgggaatgaagaaattcagactccggattgtaccgtaattatgttcagggacagttttgacgaagactacggcaataccctgaactattttagcaagaggaaaccacccgttcctttgtcacctcccgatcctatggaactcgggttcctgtgagaaactgtccgagttgacatccataatgagcaatgaatggctaagggaggtagagctttcatccgaagtaattcagataaatacggctccccgaatcattccatgccatctagaagggaacgatgtcggtattctctacagtccatctgtgggggccaacctcgtctctgagtcttttgcactcgcttatttaagcgataaggcagtgtccccgacaaacaaattcttcaagcatccgaacggaaatatcatcgaagggtttgggattgtgcaagatgtgcctgtctgctttgaagacatggaggcgatcttggatttccacgtctttgaaattcaagatttcgacattctaatcgggcttcccattgagcaacttcttattaacacaccccgattaggtagcctcaaaataacactgggagagaatgaa

SEQ ID NO: 94337 - DNA, 633 bp, Oryza sativa
ttgatatgtatgcatagcttctttggatcctatttcactattatcccgcaagacattgtcattatcttttccaacatccacatgaccgatttgtgattcgatcttaggtgacaatgctatttcatctttgcttgtaatacaatccgaaccgtcatttagatcggctatatcttcaatgatgttattctctaagctagcaacacaatccgaatcaccacttggttcggctattccatcgttgtctaaactagtaacacaatccgaaccaacacttggttcggctataatggttgttgcattattatccaagctagtaagacaattcgaaccaacatttggttcagctatacttattatggcatcattgcacaaattattaacacaatccgaaccatcgcttggtttggctacacatgatattgcattttcatctaaactagcttgtaagctattgtcatccactcggctttcctgagctagagcttcatgcaacacatgatcaacatcaagaaatatctggccattcaatttctctttaatagaatcaagcatctatcatatgcaatgttggctaaatctttgtcagttattttcaaattgaaacatcagtttttaacatctctaaacctttca

SEQ ID NO: 94338 - DNA, 645 bp, Oryza sativa
cggggcaccagactgagaagtggctttgataagcccacgggggtcgctggggagtgcatgccttgtttataagggggtgattatgatccaggaaggtgcgctgcagcggattgtgttatgcgaggggtattgtcacaactactttccgagataccgcggtggtattgaggcacatggcgacatgatgtggggttgtgtcttgtgggtacagtggtacacctttgatcagagtacaactattcgaatagccgcgcccgctgttatgggcggatctaacaatgactttcgagattagtctcacacctatcatcatatgaaaagatgcttaaactgataataatttgattagctcctggctcggaatgtgatattcctggagcggagatagaactgtgcagccggggtggttgttcagaatggttgggcctatacaacagggtatgttgtatagcgttggattaatattgtttaattacttaactgttttatcaaattctcaaatgtttgctaaatgctgcttttgcaaatgcaaccctactatgccatcctttgttatcctgtgcacttgcatatttgctgcgtggcttgctgagtatgtcatatactcaccttgcaatcattcatcagaggaagagttctacaatg

SEQ ID NO: 94339 - DNA, 730 bp, Oryza sativa
ctatagggcgaattcagctcggtacccaggtgattgagcactctttacatgttaaggaagacgctaaacccatcaagcaacgactccgtcgttttgcataggacaggaaggatgcgatcaaggaggaattgaccaagctgttagcagcgggcttcattaaagaagtccttcatcccgactggctcgctaacccagtcctggttcggaagaagacggggcaatggcgcatgtgtgtcgattacaccgacctcaacaagtcctgtcccaaagatccttttgggttacctcgcattgaccaggtagttgactcaacggccggctgcgagctactcagttttttggattgctactcgggatatcatcagatccgactaaaagaatccgactgcttgaagacctcatttattacgccttttggggcctactgctacatcaccatgccctttggattgaagaatgtaggagcgacctatcaacgcatgattcagagatgtttttcaacttagatcgaccgcaatgttgaagcttatgttgatgatgtagtcgtcaagaccaagcagaaggatggtctgattgcggatttagaagaaacctttgcaagcattcgcgctttcaggatgaaactaaacccctgaaagtgcatcttcggagtaccgttagggaagctgcttggattcatggtgtctcatagaggcatacaggccaacccagagaaaatcaacgccatcct

SEQ ID NO: 94340 - DNA, 601 bp, Oryza sativa
atactcaccttgcaatcattcatcagaggaagagttctacaatgaggctgatggtgtggaggattaggtgtagccttggtcaagctgcctgtggagtggagccgtctgcgccgtttatttattttccgctgcttagatctttattgattgagaggaactatctacctctgtaatgacattttattcgcttattaattagagtaatatttgtactctattatcaatttgttattgtgtgcctcggctgattcctggacgagggttcacacacatgtaagcgtttagaattttggatagaaattccgggcgtgacatccataaatgcctaaggcccgatgatcggcgatgaagaagtcctaaggattcaatcagctgaagattcatgcccacccattttagtcaagtggtgggatgacgacaagcaacctcagggaatcgtgataaacagacaaaaagaagatgaggaagtatgcttgctgaaaaaggcactcagccaagccactcgcattgtaaatgtaagtttccttatccgcagccgcaactatcctgcttcctattttgatcaaatgccgataaattcgtattgcagagaatccatctc

SEQ ID NO: 94341 - DNA, 1289 bp, Oryza sativa
taattttggaactctcgaggccactaggaaccagctgcacgaggtcaaggagctcgccagaaaaactgagctgatttgagggatcgagttgctgagctccaggagtccaactttgaactactaggttcatcaaaaggtaagtaccacctctgtctaacttactcatgttgccatccctgtcatatctattaatcaggaaacaatacagtacaagctgccaggatttctgaattagagaagcagatccaaagacagagttgaattggcaaagcagagagactcggctctgaaagatgttgaaggtactagtgattaattcctcatgtctttacgcccacttgctgatataagtatatttgtgcagatcgcaaaatcaagtcccaagcccaatttgacgtcctggtgaacaaaatcaagaggcttgagggagctagagatgaggttgccaacgttgctacaccactcattcaggctatgttcttcaataacaatggtccgagtgcattcgatgcttccgaaatcttcgacaagctaagagttgctccggatacatactttaagaacatcaagaaagctgggagtatgggagcgagtctggcgttggcaatgaccaagtctttgtatccgaagattgatgtcgatgccattgatggattcgcagatgggacgagcgaagaagccgcctttgacctcatcaatgatgcgcagaaagctgccgagaagatagccgttgatgtagttgatagattccaggataacgacctccggccgactggttctaataactccgatgatgaaaaaactgacaccgattgatgttatattgtagcagtgattctgatgatgatggaggcacaatttgtataatattgatgaatttatgctgtgcttgatattccaaacttagctcctgatttcttaaaagtttttatcaaaccttgttgagcctaaaacccgcaaaagttattaaaaaactttcagtcctcattgactaagccaaaaaaatcaaacaaggcaatgataaatcgagtaagcaaattgaattgataaaaatcacactccgttattattatagtagcccccaactgataactcaaggaaaggcttgatgttagaagtcaaagaggaaaatacaaaagtaatgcctaagcataaaaacgacgaagatgttcaatattccaagagttgtcgatatgagtactgtcctcacgtttgagtcgataagaacctggccgagtgacttcagatataactaacggtcgggtaccgagctcgaattcgccctatag

SEQ ID NO: 94342 - DNA, 1806 bp, Oryza sativa
atctttgaatactccgcctgtgaattgggtgccgttatcagtgatgatccgattgggtaccctgaaccggtgtacaatgttgatgaagaaatctctagccttgtctgtcgtaattgtaatgaccggtttagcttcgatccacttggaaaatttgtcaacagccacaaagtggtgagtataaccgccgactgcctttttgaacgggccgaccatgtcaagcccccaaaccgcaaacggccaagacaacgggatggtttgcaactcctgagatggtaaatgagtttgtcgggcaaaaaattgacaaccctcgcatgttcgcacaattttgtcggcgtcggatacagctgtaggccagaaaaaaaccctgccgataagccttgccaatgatggttcgtgcggcagcgtgattgccacaaatgcctgaatgtatatcctttaacaattgtcttccctcctccaaagacacacagcgttgcaggattcctgatggacttttcttgtacagctcggtctcatgtatgacataaagtctgttgcgcctggagatccgctcggctttgtctttatcctgagggagttcttgcgtggtcaaaaatcttatgaggggctctctccagtcggcttcaaccatgcttacatcttgggtgtccgcggcctcgattatttctttccttggtacagtcggctcataaagatgttcgacgaatacgtcagaagaagctgcttctcgctttgaaccaaaatgagccaatctgtcggctgcctcgttgttgtgctgaagaacatgagtgagctcaagtccgtcgaatttgtcttccaatttgcgtaccttctgccgataagcagtcatattatcatcaaggcaggaccactctttcatgacttgattaacaaccaactgagaattccacggacgatcagacgccgaatgcccaaagagatcgcgatccttaatccatgaagcagcgcctcatactctgccacattatgggacgcagaaaaatgtatccacaatacgtagctcaatctttctccagtcagggagatcaaaacaaccccagctccagtgcctgaaagcctcttcgacccatcaaaatgcatggtccaatactccatcttctcctcgggcatgtcttcttggcactcggtccacttggcgacaaagtcggctaaagcttgggacttaatcgaagttcgtggcttgaaggatatatccagggacatcaattctaaggcccactttgcgattcgtccatttgcttcgcgattacgaagtatatccccgagtgggaacgatgtgaccaccgtgaccgagtgaccttggaagtagtgagataatttcctaacggtaattaagataccatataataacttttgaacctgaggatatcttgtcttggagtcggccaaaacctcgctaacgaagtagattggtcgttggactttttgaacatggccttcttcttcatgctcaacaaccaggaccgtgctcacaacctgagaagtcgctgacacgtataacaatagtggctcttgcagatatggtgaggccaaaattggtggagtagtgagaagtttcttgaagtcttcaaaggctttttgtgcttcgggtccccactggaaattgtcggttttcttcagcagcttgaaaaagggcatcccccgctcgccgagtcgtgaaacgaatcggctgagcaccgccatgcaaccagtcagcttttggacatctttctgggggctcggcggtttcatgttgaggatggcgttgattttctctgggttggcctgtatgcctctatgagacac

SEQ ID NO: 94343 - DNA, 1088 bp, Oryza sativa
gggcgaatcgagctccgtaccctgataggtcgctcctacattcttcaatccaaagggcatggtgatgtagcagtaggccccaaaaggcgtaataaatgaggtcttcaagcagtcggattcttttagtcggatctgatgatatcccgagtagcaatccaaaaaactgagtagctcgcagccggccgttgagtcaactacctggtcaatgcgaggtaacccaaaaggatctttgggacaggacttgttgaggtcggtgtaatcgacacacatgcgccattgccccgtcttcttccgaaccaggactgggttagcgagccagtcgggatgaaggacttctttaatgaagcccgctgctaacagcttggtcaattcctccttgatcgcatccttcctgtcctatgcaaaacggcggagtcgttgcttgatgggtttagcgtcttccttaacatgtaaagagtgctcaatcacctctctaggaataccaggcatatcagatggtttccacgcaaagatatctttattattttgaagaaaggtgatgagcgtgctttcctatttacaatctaactcagcgcctattacaacagtcttagtaggatcagagggatctaaaggaatctttttggtcttggcgtcgctttctccactcttgggcatcttggtcgcgggcacttctccttcgcctactgtggacgcagccagtcggatttcttctcgggagagcgcgatctcacgggtctgggccatctcgcaactttccttatcacatgtgacggcttgcttgatgtcgctccgaagggatatgactccttgaggacccgacatcttcatcatcatgtaggtatagtacggaacgaccatgaacttggctagcgccgggcgtccgagtatggcatgatacgccgtctcgaaatcagcaaccttgaaacatatgttttccgtgcggtagttttcccgagtgccaaaagtaaccggaagagtgatctagccgagtggtgtagcagatagccctgggatgctccgtgaaagggcgcgttactcggctttagttcctctcgagggatctgcatgtcgtccagggtcttggc

SEQ ID NO: 94344 - DNA, 666 bp, Oryza sativa
ctgattgagtgcatcttccttgaggagggtgtcgaggagggtgatcactgcaaccgcgttttgctggggtgtgcggaaaaccgctgtcccgtcgacgtcttgttgcccgatgagatctcgtgctcgtcgcccggattccaaggcgcgctgtcgtcgatcctcaacctccttcgcaacccgttcgcgatcttgttgttcacgctgtagtcgttctcgctcttgttgttgtcgttcttcctccagtcggcgacgttcagcttcttgtcgcgtgcgctcttcttccgcttctcgggctcggcgttgttctgccgtctcgttgtcggccataaatacgccgaaaaagagaggcgtgtagtcgtcctcatagccatcgtcgaagccgttgaagttgccgtagtcgtagtggtagccgaagtcgtcgtactcgaggatctccgttggtcaggaactgacgccgggagagctgaggtagccatccaattcttcagtcgagaccgtcccgagaggttggagtataacgccgacctccttagagctagattggatctgggctaaagccgaatcccgtctaggtcttcggatgggagacgccttggtcatgaagacagcagccagatcgtcgggaagtctcattaggattgggggataggacccatcatcttgatc

SEQ ID NO: 94345 - DNA, 2487 bp, Oryza sativa
aagtagttttaggaaagggttaatttgatgcatgccactataaatatgacatattaaaaaaatagcattacaatttgtgttatcgactgggtgccactcaaaatttctaaaattaaaaccatgccactctcgtaactaatttcgtcctcctctctcaggtcgccttcctcacccgtgacatcatgcacagggctccaacggcaaggtagggacatcgtgcaccgggctccaatggtgagcttcccaaggagggcggcggcgtacatgcgcgccatcaaaccacggcccgccggagcacgaagcactcaaggtagggtaccatgaaggccacgcgcgaagcactggttcctctcatagccggacaggtcactcccaatcagctccttgatttgggacaggccgtgcgacgggccggacaccgaggtggtaagcacgtccaggtccacggtcgccgtcttcctgacattggtgagctcggcggcgagccccgcggcaatgtccgccgcctcggcggcgctcgacagggtcatctcctgcactacgaagtggagcagcgtggcttcccgtcggtgccctcgacataggtgaatttgagcagcgcttcgagcttgaacgccatggcgccgccgcaggaggtcccaacgttcatcctgttcccggtcttgagcatagcctccagcagcttcaggaataacttgctggacattagctccctgcacgcgtccttccagacaccaagaacagcatgccaattaaactccgagtataataaatttacaattacaagcaggatcgctgagaccggcggccattgcgacgaacacccaagattcacctcgagcatctcgaacgacttcctgatgtgtccgacctcgtcggcgaaggtctcccggtacatcatcgtgattaccaccttcagcagcctttccgccgagaccaggccgtcgacgtcgccgtcatagccggacaatgtcgacctcgtccttccagctgctgtgccgacaggccgttccctgcgaacaattgttatgtggggaattccctttcagcggcacgggcgaacggacgaacgccgtgcctgacgggtgatctagcgccaactgaattcggtggattcggatttgcttcacagtttgtttctgttatcccttttaattagcaagtttgttagcatgtaaggctactattgacgtaaaacacgtggcctgggagatatgcttaactctagtgcaggtccaaaactcgccttcgggtatgctagcgtgccagttgatttgatcctgcaatcaataagaaataaagacaaagaaaccgcggttaaacctataaacgatagccgatcggcttgagtgccgatgacatatcatttatctttgagccgatgtcatataggtatcgatcgacaatcatgaataaataagaaggaactaaatcaactcgatcggatgtagatattaacaatatatactccttatattgatatatacttaaatcaagtgattgggatagatcggtcgccatgccgagacaatataaatcgctttgatcgaaatatatattgataatgggactatatatgttcatagcatagccgatcagatagatctaacatgtatcggctaatactccgataccactctatattaagatattaaagcaagtagaatatatcaaacaaaggcctaataaacttaaatgcaacgagatcttaacataaaggacagatttaacatatcaacgaagcatatagagtaaatatagttaaatcaggtaagatctgatgaaaccctgatatatactatcctaatcggcaaccaagaagcaggccagatattggaattttaatcacgacttataagatcaaactcaactgatgcagctatcgagttttatagagtggtggataccttatataatctaagtcaacatcgatatctaacctaatcggctgccctctaccgacaaatgttagccttttgtaggttagatagcaatattgccagagattatgatatatgataactcgatgaattacataaacaagattagagtatcataaagatggaagcactaatcccgagaacgcaagccgccataacaagttttacctcttgttgaagatcgaaaccgatgcagctcaacctgaaagcaaaaactcgtcgaaacacaacaaaagtaaaagggtggcgatgcgcagagattgtattgaacatgtattaattaattacatggggttcggggtctatttatacccgagaattacaaactatgtccatatcagacacgactcttatctctaacaaactctaagataccataagtctttacggcagacttttgcccaaacatatctctaaggaaattacataaaatatcctaattaatagatacaactgccttctcaggactctatccatgcacagcaatcatcatgaagctcatcaacctaaaccgacaacgtttgctgtgtcatatcgtcggattcag

SEQ ID NO: 94346 - DNA, 1486 bp, Oryza sativa
gaaggttaggaaatggatttgcctcgtcgaggcgaaggtattggcgagagggcttggccggtaatgctccgataagggagatcgaccgacggccggcattggaggagagagagagctcggtttgatttggggaaaagaggagggatggccggctacttataggcggcggacgtcggtttgcgaaggtcggttcgccggaggaggacgaggaaggcacgacgatgaccttagtgaaggaaaaggggacggtgccggcttccgctcgtgattggctggtgatggcggctgcgtacacgcggcgacgccagggatgttgggcggcagaggaggagaagcacggcacaatgatgacgtcggcgcgactcggtggcgtgaggaagagggacacagcgacggctgcttaggggagaagaaaacggcgccggcggcggcgcgcgtgttggacacggcgacgcgcgcccagagagggggcggctgcttctgccagtgggaccggctgggccaattgagccgaagggagagaaaaggattcggcccaaaagaactattttggaattttgaatattttgcctaaggagaaagaatttatctagatatctttagaagagttttgcaaagattatgcactataacaatgtctcactaatagaagggtaatctagagaaagtttctaaattttggaatttgaaggaaatttgctaaattcactaaggtttaggatagggcaataatctagggtttattggtaaactagcttaaggggcttctaggggtaatacttgaaccaaaatcaagaataaaaagagaacttttaaagagaattttgattttgctagtctaagattaaaaccagtcaaaagccagcatgatgcagtcaaattttagtttaaaatttgagaatgttacaaacctaccccccttaaagaaatctcgtcccgagatttgcttaggagtcttcaaatagataagaggaattccaattgtaaataatattcccattcccaagttgcttcatcctctgtacgatgattccattgaactttaaacattcttattgccttagtacgagttgttctctgtgcttcttccaaaattctgatagggtattctggataggttaagtctttattcagttcgacagtacttagtgatatttctttctctgggatacataaacatttctttaattgtgaaacatggaatgtaggatgtacatcagatagataatctggtaaaaccaattagtgctcatccataaacttctccatcgagtccttgcaacatgtaagctcccttagacacaactctatagatttggaacagtccttcccaattcggcaaccacttcccgaatttgctatcccgagtcccaatcggcaaaatcaacttccatacaagttcaccttccgaaaaagccttgggcaccactttcttgttgtaatgccgagcaacacgttccttatccttggtaacctttgcaagggc

SEQ ID NO: 94347 - DNA, 1103 bp, Oryza sativa
cccaaaagaactattttggaattttgaatattttgcctaaggagaaagaatttatctagatatctttagaagagttttgcaaagattatgcactataacaatgtctcactaatagaagggtaatctagagaaagtttctaaattttggaatttgaaggaaatttgctaaattcactaaggtttaggatagggcaataatctagggtttattggtaaactagcttaaggggcttctaggggtaatacttgaaccaaaatcaagaataaaaagagaacttttaaagagaattttgattttgctagtctaagattaaaaccagtcaaaagccagcatgatgcagtcaaattttagtttaaaatttgagaatgttacaaacctaccccccttaaagaaatctcgtcccgagatttgcttaggagtcttcaaatagataagaggaattccaattgtaaataatattcccattcccaagttgcttcatcctctgtacgatgattccattgaactttaaacattcttattgccttagtacgagttgttctctgtgcttcttccaaaattctgatagggtattctggataggttaagtcttattcagttcgacagaacttagtgatatttctttctccaagaaacataaacatttctttaattgtgaaacatggaatgtaggatgtacatcagatagataatctggtaaaaccaattagtgctcatccataaacttctccatcgagtcctttttttgggggcccccaaaaaaaaccccaaaaatttgggttaaaaaagggctcccttagacacaactctatagatttggaacagtccttcccaattcggcaaccacttcccgaatttgctatcccgagtcccaatcggcaaaatcaacttccatacaagttcaccttccgaaaaagccttgggcaccactctcttgttgtaatgccgagcaactcgttccttatccttggtaacctttgcaagggccctcaatctggactgaaccaactcttccctttcatctgccatgaggttataatactcatcggctgttaaatcattttgcaactacgttctccttgagccgattctaatctcccat

SEQ ID NO: 94348 - DNA, 520 bp, Oryza sativa
cacgggcacggcccggccatccacgggccgtgcttgggccggcggctcggcacgtgggccggcacggcacggcccgtttcatcagccgtgcctaacgggccgtgccgaaacgggccgtgccggaaccgtgcccgtgccgggccgggccgtgccgcccgtttggacacctatacccatgcacgtgatggatagggagcacggatccacaatatgacttttgctaccggccacggcgcctctaggcctcaggagcttgcatccacaccaccgagcctggcatttcctccttagctcctgccgtcgaccctgcctgcagtcaccaggccttgtgggaccggatcatccagcactggctagcctcaggggcatggatccaccaaccgccagccttggaagcgtggatccactttccagcctcggaatcttactctttgacccctttttgtgatcaatttattgaatggattttgaggattgtgataagtttgtgaatggattatgggtggcaaggggaatagag

SEQ ID NO: 94349 - DNA, 646 bp, Oryza sativa
ggattacatagagattacgtacccctgttcagattcgttgtactaggatgtgtcccatccactacaaagtttgctatatatattttgggacggagagagtaattcggtttgtcaccaagctccgaaggcccctgcaccacactgggagaaaccaaaaaggagatcgagatgaagctaaatatcgatggctcttttgatccagtggaagagcggggggaatcggtatgatcctgagagatgacaatggggccatggtcttttctgcctgcagatttatggagcgctgtaatggggcgcttgaggcagagatccttgcctgcgtggaaggaattgcattagcgcttcactggactatgctcccttttgaagtggaaacagattggttaacgctgacacagatgctgcaatcaagagaaaaagacctgtcggcctctgcgcacctagtcagggagataaggaggctcattgacggggacagggaaatctctgtcaggaagatccatcacgctcagaaccaggttagtcatagcttagccaataaagcctggtctgaggttctaaatgaattctggctggaaggtggttgtaattgttggaaatatggtcatgaatcggcatattttaatccaaaactttaaagcaataa

SEQ ID NO: 94350 - DNA, 1561 bp, Oryza sativa
  unsure (1)..(1561): unsure at all n locations
cccctctctttcacctctcctctccctctctttttattttgtcctctccctctccctctatgagagtgggtgccggcagccgggagcaagggcggcggatcagcggcgcctccttcgggaaggtcagattcgtcaccctagggagcggctgcagctaccgcgacggcgggcgcgcaattgggacagtggatccagcgagtgggcggcaacgcgggcagcggcgccaccgccatccccttctcactgccaacgccgacaacgacgacgaggcaaccctccccccctcacctccgccatctcctccagcagcggtggcggcaactccagacatggcgagcagtcgtgcgggaggtactccccaaaaacctgatcacccgcttacccggtgtagatctcaggcgaaggtgtggtttcggaggcactgctacttccaatctctcgtgcgtgcaagagatcagaagcgaggaagcgagaacagtacaggcgcggaggaggaggaactaacaccgggaaagaagcaagcgatcagaatagatcggactcgcggcctccttatctatcaggagagagaggcagtcgtgggaacgtgaacgcgctgttgtgaaaaaaaaaaaggggaaaaagggaaaaaggggtttccccggtttgggggaaacgtgggttagtggctgcaaaagaatagcgacgtgacgcacgcacgccgccgccagccagccacgcctcgcctcgccttcgcccacgcccacgccctcggcctcagcccggcgcgcacgcgcgcgcgtgtagcattccgacccccacctcaaccagtcaacagggagcctccaataactccctatttaggttgagatattcctcacttaaatcctgagatagtattattatccttaacacttattatgggcctttgagatttaataggataagttgggcctagcccaattattctaacaatccccaccaaatttcaaggctcataagaaatgttctcaaatgttgtgcctgtgttgatacccacggttttggtgagactgttaagttgaacttccccctaggaaatgagctacatcagacccattctgaacaatggatctgtgccttgaattgtcagttttgtgtgatcaggtttcactcagaaccttgactggtactgggctgccgttcgcatcccctctgtttgggggaaaaaaggggggcccaaaaatttaaatttaaaaaagggttccaaaanctccaggcctttcatgagtatcttgagatcgcccaaacctcatagactgtgactacagtcgaactcatataggtgtgttccttctgagatgttctgcaagtcaatagctctgcttggaaaagccactcggatcacattaaggcatgagccatcctaccatgcaggaaagaaaagaagcagcacatcatgaaaatgagcccttttcaagggtctcttctctcagtcacacaatagtttgtttcgccatccaaattcacaggatctccgatcacaatggacaggtttccactattgtgcaaccttaggtgggtaccgagctcgaattcgccc

SEQ ID NO: 94351 - DNA, 691 bp, Oryza sativa
ctcggtacccgtatagatgataattctactttttctagagagttgttaacagtgaaatttggtaagcccctaagagagttatcacgtcgccaatagtcggattactgttatattcggttaaggaaattaatctgttaaagaaagcttatctaggagtcaccgagttcaagtaagatgcgacatgacagtttatctattaattaggcacaatttgttagtttcttttatctttagaaacgtgtgtttagtgtcctataaggactttatgctttccttttatcttttaggaaagtttctttcttgtcctacaaggactagtatgtccccatgggtataaatatgtacatccgggatcattgtaaactatctcttgatcaatactactctcggcgcatcgccaccctctattctgaggtttttacttatcaaccagtggaattaggcacctgacgcggggctgcatcggttcaaatcgatctccggcgaaggggtaagttctacgttccgccggcccaggcaattgtctcgtctatgtcggtgtcgttcaatgctgcatcagtgcattcaacctcttggatgctcctgtttggatgatatatttgtctgcctatttatcatatgtcttcgttaatctagtcttagtatctcaatttagctttattggttgtctctcgctttagggtttctgctg

SEQ ID NO: 94352 - DNA, 1097 bp, Oryza sativa
ccacctcccacctcccacgtcgtcggcgaaatcgggagcacctaggccgttcccgaccttcccgcccctataaaatccatccccgcgtcctcctcctcgcttttccttttgccgccggcctctcccgagctctccatcgcccccacgccgtgtaaccactcgccgccgccgctcccgctactccggccgccgctagccgctgctagggtcgccgccgcaccgcgccgtcgctgccgtcgggttcgcgaggccgaactccacctcgtccgccgctcctccgtcgagattcgtcgccggaacccgcatcccctcgcgctcaggtgagccctacccctaccgccgccttcggccatggatgccggccgccgtggttcatctccctccctctaatctctctctcttccttccttagggcatcccgaagctcgtccgcccgtcgccgccgtcttcccgtggctcgccgtcgccgttagccatcgtctcccttagcgccggccactcgcggtgaggcattcatctcctctattccccttcctctccctcctagtgccaagccgccgcttcaaatcgcgcgccgtcgctttcgaccgccaccgccgcctcccgtgccgccggtcgccgtcgccgtcgaccgcgtgccgccgccgctagccatggccggccggccggctttggagccaagccaagcccggcggccacttctgccgccaccgcccgatcggctcggggccgatctgggccgtcagtcccgtggaccggtggtggaccacccgcgtggtcccggtccatggtggaccggcccccttgagccgctgccgagtggggccgtgtgccggcgcccttcccctctcttccgagccactgaccagtgggacccgcctgtcggcgccgccccccctgatgacgtcagccctgggaattatggcgcaataaattatataagggctttctgttatagtaataaacacagtgaatcttctaaaattcatatgtaattcatccgagctccgtttaagcccattcaagtcgcagtaaatcaagaaaaatgtgtagaatccattaaaaatggttttgttctctgtttcagtagtcttata

SEQ ID NO: 94353 - DNA, 678 bp, Oryza sativa
ataagaggaattccaattgtaaataatattcccattcccaagttgcttcatcctctgtacgatgattccattgaactttaaacattcttattgccttagtacgagttgttctctgtgcttcttccaaaattctgatagggtattctggataggttaagtctttattcagttcgacagtacttagtgatatttctttctctgggatacataaacatttctttaattgtgaaacatggaatgtaggatgtacatcagatagataatctggtaaaaccaattagtgctcatccataaacttctccatcgagtccttgcaacatgtaagctcccttagacacaactctatagatttggaacagtccttcccaattcggcaaccacttcccgaatttgctatcccgagtcccaatcggcaaaatcaacttccatacaagttcaccttccgaaaaagccttgggcaccactctcttgttgtaatgccgagcaactcgttccttatccttggtaacctttgcaagggccctcaatctggactgaaccaactcttccctttcatctgccatgaggttataatactcatcggctgttaaatcattttgcaactacgttctccttgagccgattctaatctcccatggtaaaacagcctcatgtccataaacaagcaaataaggaggg

SEQ ID NO: 94354 - DNA, 945 bp, Oryza sativa
gacatattgtatggaggctgccttaagaaattaaacaaagaagttaccacgttagcttctatactaacaggtggagattaaaaattttttatggcatttctctttgggcaataggtttcataagcattgactgcggcctggaggcagacagcagctacctgggcgacctgaccggcctcacttacgtcccagacggcccgtacatcgacggcggcgagaatcagaaggtgaccaccgtataccgcaatcgctggtggggccctgacacacgtactctccacacggtcaggagcttcccatctgccaagggtcagcgcaactgctactcgctgcccacccatatcgggtcgaagtacttggtcaggctggatttcttgtatggcaactacgacggcatggacaacccatcgctaaaattcaaccttacccttggtgtgaaacactgggacaccgtgagtatagacaccaccgacggaaatgatggttataatgttcacgaagcggtgttcgtggcatgggcgagctaggcgccggtttgcctcatcaacatcggccagggcacgccgttcgtgtccacggtggagttgaggcctctcggtatcttgccctacccggctgtcatgggcaatgtgtcactctccctctatgttcggagcaacgtgggatctagccctgacgatgacaatttagtaaggtatatatgttcttaatttccttggatcttgtacattttgcagctcagttagtcagttgtacgttaaccaatatatcacttgaagctattttctgattttattaatttagctaaacaacgcactacaaactgggcattactcgcggttccacattaccagctatgtttgggagacgaccagcagcgatactgatttttacaaaagaaaataaaatgattttaattcatacagacaaaaaaggatcctaaat

SEQ ID NO: 94355 - DNA, 1792 bp, Oryza sativa
ttgaagtactaaacaatttcacctaaaaaagtcgtcaagaacaaagttgtatataactcatcgagatatataacttttattttggtcatttcttcatctgacaaagtgatagtaacattattcataaaatttacacatctcttatatagttttataaaataaaataaagatatgtaatttttggaaaatattactatcactttgttggatgaagaaatgaccaaaacaaaagttatagatcatgatgagttatacaactttgctgttgatgaccttttcagctgaagttatttactacttcaaaatattatttaaaattttaaattcaatttttttttttttttttttttttaaaaaaaaattttttggaaaaccaaaaaaacaaagttacaagaaaaaatggccaaaataatagcagaaagaacacaatgacatgatagagcatgattttggaaacatttagaaaaaatgatcatccaatttggagttcatgagtgagataaactggtttcaattttttaaattttatatgcaggctcttaagtggcccgtatggaaaaatttattttttcatacgggcgtgttaagtagccgtatgcgaaaatgccgctcgatttttttcagacgcggcaagttatgttccgtttgtaaaaattatagggtcttgtatagaaaaatcgtctgtgtagtagtggctgtagtcgtgttagaagcagcggttcgagcggacagccagacacaggtcaccttgatttttctgttctgttgtccctttcactgcaaaactcttactatctaattttacaaggcatgatcttaaaaaaaaatggtctacacatatacacataataaatgagtaaatttcataaaactatagatatttcttttgaaaaaaagataaaatatagatttaaggtggtgttgtatcacgaaactacatacatacatagttttcattgagttcattgtgaaaagtcgctgtatatatggtaaaactatagatcgatcgttaatttaagacaaacctgaagtggagctgttcggtgggacttgttgcagcatcctggctgtgctgttaaggtgatgacttcaaatgtaaatgttaaggttatcaactataaaattataaaattatatatcttacttactgtataattttgatatagagtttgcgtcgatttcaattcatatgaaaattttaaagcatttatcaattagatctgataacttctatcacacatatatatgatcacataaactatgtcaaataaaaaattgttcagcaaccacgttgtagatcttgtcaagaaatataactttggcagaaagtttatctttgatcatcgacttcatataaaaatattattaatttctttatcattttcacttcgatacgcagttaatggtgggctgtcacgcccagaaattcccgaatagaattccaagcagaatgtgcattaaaacccccgtccagtaccggccggggtacacaaacgacaatgttgacatacagatccacgtcttacaaacaatataaaagtcttacataaatgcagcggacaaacgatagataacaggagctaagccttgacttgaactgcagcgggaacaccactccacaggcatcctcgacggcacggacgaagcctactcctcggagaacccgccatcggacacatactcatacgctggggttgggggaaaaataaagcaagactgagtactatccactgtactcagcaagtcataccggaatggggggtatgatgcagggattcaacaagggatagct

SEQ ID NO: 94356 - DNA, 1571 bp, Oryza sativa
ctctccttgtgaaggtgcacctgctgaatgagctgccgcaggagaatgaattctctaacttgagtagtcgagttcatccttctcatctgccttagccagaaatgaccttggaattcccgtgctactgtcctgttttttcttttctggtcacgagttgatacagacatgggattagctccttgggtgacctaccatctatcatcggtccttcacaagctacctatccgtttcatcacaaggtaggatggaaccttaccatggtttgtcatatgcgtccaatcgaaccagagctaccttagttgcaatgatcccgttccgggaaaaaaaaaacccaaaaaaattttttccgcccccaaaaaaaaaaatcagttatacctatgcccgctaaatttttttggcagcataccctttaccagttcactaagcaatgtccgtcgtgtgtctgttccgaacctgtctagaggaaacctcgatgaaatttgtccatattgttttcagtccacttctttaggtgggatactgtgaggtgggtatgtcggcagggctgaaagggtggacttaatcaacactaactgacttgttttgttaagcaaccttcctttccacgttggtagtctagctgcaaaccagtctataagcggttggacatccaacttacgaattttcctgatgtgtagaggaagtcggaggtaggagcttggaaaagtttttttgttgggctgggaacggggagagaatatcctgcagattggggtcgttgcacctgattgcatatactttgctcttttccagattcgtggtcatcgttgtagcacgtccgaaattttgtagaatggcatgtaccgcttggagttcctatttgtccggtcttgtgaacaccaccccatcatctgcgcataaggctatgttgaaccatgttgttcttccgtgcaagggctgtagaatacatgtttgttgggcggcggattaaagcttttgcagcgggtctatcgcaaggatgagtaacatgggagagagagggtcgcgttgacgtaaaccccggtcatgttgaaagccggtccctgccctgccatttaggatcaccttggatgacgtgcttgctataatggaggtgacccaatttatccacctggccaaaaccaagatctctcaagcggtcgagaagatatggccagttgacagaatcaaaagattttgctttatcaagcttgaggaggatcgctagaattttggatgaatgaagttcttttaccatgttattgacaacaggaaagttgtcctttatgtttctcctcttaatgaaggcactctgatttttggataccaattgttgtagtttcggtgtcaatcaatttgctaggagtttagagaacattttgccgaaagcaatgaatgaagcttattggcctgaaatcccccactctgcaagcattatgctttttttggcaatagggcaatataggcccaagtcatgagccagagatggtgaaaggaggtgtaatatgcttggttgatcacctgtaccaaatcttgtatgatctctcagcatttttcaataaaaaagctcctgt

SEQ ID NO: 94357 - DNA, 6229 bp, Oryza sativa
atgctagttgatgcgatcatggctattaaatatgagtatggaataaagaagaactggatgggtgatccttgttttccacatgaatatgtttgggatggtgtgaaatgcagcgatgcaggtgataaaatcatgaggataatatctctgtgagtatatttgaaaggtatgcatgtactagcattattaattgtatacatcaggctaaattttgttggattacttgaaattattatgcagtgatctttccaacagcgaattgcatgggtcgatatccaattctttcacattgtttactgccctcaagtacttgtaagtatatctgagatcccctctgccttcagttgttctgcatttaaaactcccaattgacatgactatgcatcatcttccattaaaaatgaaaaacaccgactaaatattatctagaggggtgaaaatggtacggaaactttccggattctggacctattttaaaaaacggaatctgtcggtcggagtttttttggaatttttcggaaacggaaacgaattcgaaaatattttctcggaaacggaatcggaaatgataaggccagtttccgtcggaactcggaataagtcggaaactttccagaaattttctaactaaaataccctggattcatttttaagcactgaatagtgaataccatggtgtttggctgttattctttaaaatatatttgttatgcaaatctgaagttatataagaatattttttttctgcattgggattaatcaacatcattactctcttaaacatagataatttattccatagattgtgttttgtgatgtactgttgagacttaaaaattggacttatatgattgtgttttatgatgaatcgttgaccgttgagacttgagaattggatttattggtttgaggggttttgtattctcataatttttcgttaccgtattcgcgttggttcgtttttgctccgttttcggtttcgataatattcgattccgttttcatatccggagtttccggttccgattccgattgcgaaaaaaaatgaaaacgaaaacgataatgatggttttcgtccgtttcagtattgttttcacccctaatcaagagtgatgcagctttactttcataaagtggtaaaaatgaactaaaggtatgataactaggggtgagtgcgagtggatattggctgctcttgggctacaagctaccccctgtagtgaaggaatactattcttgagactccagagagggtaccacttagtatctattatttttcattcagaatcactaaatcaattgaaatatataattgagactttaaaccagggacatgaagatcccagttatcatagtacccacctgtaagactgttatcatggttctgaacctataaaagaaatcatatcatatgaaaaacaacctcattaacagtttggccaagtgttactatacgtgtccgaattcgtattaggtttgtgtcacatctcgtactaggtttgtttttttatgggacagagctggtaattctctatgtaccacagtatccaaagctgaacataaaaactcttggtaattttaaagatatctgagtacctgacggtatttaaagtggtttgatacttatacttggaactttacagtgttgttataaaagtctgcagtttgttaacaagccatagacatattgcttaatgccaaaattatatatctctttgtacagaaacttatcatgcaaccaacttaatgggacaattccatactccctcctcaaaaataatggatcaattgatttcaggtttggatatttttattaacgttggtttctttcagtaatctttaggcaaattagcactgaacaacgattcttttgaacccttcaggactgatagttttatgtaatttcagttatgagactgatggaaatatgtgcaaaacacctgttactccatccctgtcaagaaatagagccgttaccttggctgtttccgtagtggccccagtgctggtactggccatacttgttctcacatatttgatatggagagccaaaagaaagctcaatagtacgtatgctctgttataatagtctgtactgaaaataattgactcttatggtttaataactcaatgtaatattgctaatactttttttttttgcactagcttcttcaactgatcttgccatggtaccagaactcaggggtgctcctggacatatcacaaatcattgggaccatttacaagaacctgaaaatcgccgattcacgtatcaggagctagagaagtttactgataacttcaaacatttaattgggcatggaggcttcgggcatgtgtactacggttgtttagaagacagtactgaggttgctatcaagatgcggtctgaattgtcttcgcatgggcttgatcaatttttagctgaggtgacaaattcagttaccactaagttcaccacagacaaagtcaatattgtcactgtcatataacttaatcacagccacagtgagatttcatacacattagtccctcgtgttctttggtgcaagttcccaactttagtccctcgttttccacactcaagtttcccaaactgctaaacgatgtatttttggcataaaacattatagaaaagttgccttaaaatatattaattaatctattttttaaattttttagataatacctaattaatcacacgctaaacctctgctccgttttgtgtgttgtggggaggggttcccaagccccacaatcgaacacagcctaacagacttaaccttcctcttgcttatagtacaggttcagagcttgaccaaggtgcatcacagaaatcttgtttgtttggttgggtactgctgggagaaggaacatttagcacttgtctacgagtatatgtctagaggcaatctttgtgattatctaagaggtttgtccattgcaaacttcaaagtattgaatgttgcgaaatcatagggaggatagttggacacaagtgagcacctacacatagcgtaaactaacttaatgttctacatgctccctatagatgtacgaagcaatttgcagcacaataactactataagtacttaatacacggaatgaccacagttacaagtgagaacttaattatcactttatttagtaatgtgcctatatgtgtttcttaaaaaataaagataccgatttttgtttagtggcggcatattggcaatctctacataagggaactccatggccttcgttaattaaactcactatagatacgacaacaaatttagttgtcatctttaaggaagtatcttgatcttgtatttccaatcatttgtagaagttttgtcgtcattgttttttttagaactgtcatatttgttcattgtttcattctcaacataattgattcacacatcatgtaaatattttaaacataattgcatatggaataattgttttcaattagttggacatgaaaatccatcttgactgatttttaagacatgaatgcatatgtgatgtacaagcttttttataggtgtaatctacatctgtgctttgctagtccctatgatacaaagtgatatctagtatgattcttagagatcaccgcattaactactttttgttgttaaagggacaatactattttgattatttatgttattgctccccctgccgatgtgtgcacacacacaagagacgagtgttttacaactcccttaattgctatttgaagttgctcgtagaattcctttctaactgtttgtctgtgaatatattaaaagggaaaattggtatgggagaaaatttgaattggaagacacgcgtaagagttgcacttgaagctgcacaaggtattctataatagcaaggcaaaaaaaacaaagcaaaagtgttatggctcatcttttcttctaactatagtttccttatttgtaggcctggattatctccataagggttgcaacttgccaataattcatggggatatgaagacgaacaacattctgttgggtcaaaattttaaagcaaaaatagcagattttggaactcatattgggagccagagttgctgctggatctatgggttatattgactctgagtatgaatctcttctacacactataatcacttatgcaatctctacatatattaacacgggtcaattttaggtactacaccactggtaggctcaccgagagcagcgacgtttacagcttcggcattgttttactagagataacaactggcgagcctcctataatacctgaaaaaggtcacattgttcaacgtgtgaagaaaaagattgtcagtggtaacattagctcagttgcagacgcacatcttggaggtgcctacaatgttagctccatgtggaaagttgttaacatcgccatgatgtgcacaacagatatagctactcaaaggccaaagatggctgacgtggttgttcagctgaaggaaagcctagacttggtggaagttcaaggggacagaggagacaaggaaaacctagcaagtgataccatgtcttcgatgtcgacatttggtccatcggcaagatgattaaataatacatacctagccttggctttcactacattgatggatccctgtgacaagtctataacgatatatacaatgtgcatgcacagcctgtttgttttgttaatgtcaataattgagacagccagtataaaacatagatgtcatggaaggatcatgataggtgtgtatatggcccataatgtatagtttgcatctatctatgtgtgtcaactattactcacattagctccaatattcttctgatactacaactccaattaatccttagcaaagattgtttgcacatttccttattgcttcttatgtcctatttcacataatctatcattagtacttgtatgctccagcactagtacagatctagacatttgtgatgagcgttcgtgctgagctaaggtgactcgtttgtgctgcatattcatatattttagtgattctatacaatattatccttaatcacttggcgctatcattatgtttatcaatatgggctattttttggcactacatcaccgataggcttactgacagcagtgacgttgacagcttcggtgttgttttactagaggtaactatcggtgaacttcccataatacctggaaatggccacatcattcagcacatgatgcagattgtcactggtaacatcacctcagttgccgatgaacgtctaggaggttcctatattttcaactccatgtggaaggttctagatgccatgatgatgtgcataacagatattgcttctcaaaggctaatgatgtccgccgtggtcttgcaattgaaggaaaaccatgaattggaggaagctcatggggatgggttacttggaaaatgtagtaagagataacacatcttcgatgtccatgtttagtccattggtaagatgaaaaaaaccattgatagctcgctttggaacatactgatggctctcttcttcaagtctaaaataaaacaactgatttctctctagacgatttcttctgtgttaagacacaatgatttatatacagtttgtcttcataaacaatgccggtaggatccttaataggtgtgggtattgcaaagcaatagtttgcttcagtgtaacagtaagctgtttgtgagctttctaactatagggtatcattgctcaaataatatgtaacaaagatatcgaaaatgtttacatgtttcgttatcatatccttttctgtgttgatttttacatactcattatgtattttttaaataatagtactgattatggtaattaatgctgattacgggggtggggattgcgcagcgcgagttgagcagctggcgcttgcgcgcccactaggaagccccaggtgaagagtgatcgctgccgcggcttttggcactaggctttggctgatgcaggccatggacaccatagtcaagcacaaacttttgtccacatgtccgaccgaagcttagatggaaaagcatttcagggagatgcaggggaagcattgcttggactgcatcaacaacggcaagctcctgctgatgttggacgagcccaccggagtcttgcttcttctggcctacgcctcatcgccgtctcacggcagtccaagattctgctcccaccgctgcgactgccgaccaaatatgtgggagcgtttggggtgccacgaaaaaaaatatgtggagta

SEQ ID NO: 94358 - DNA, 640 bp, Oryza sativa
cttcctaggtgtatataggaagtcaaaagatacacatgaagcacgtaatgatctcaagcatatggaacaacgcggtggccatcatccggaacaaaagaagaaaggaagccattacttgagtaaggaagagaacgaaagtatgtttgaatgcctagagagcgtcaaggtaccgtctagatactcctcgactacaatgagaataataagtatgaaggagaagaagttcacaaaactgagcagctcacgcaaaaaattgctagtagcctagtatagccctgaccatgtacaaccttgctacgtagctttgtcagaagtgaaagtaaattttattgcccatccataaagaaggcccatcaacccgcggggggaggggggatggatctgctgccctcgaactccgcccaatgccgtcgtcaccctctcggggccaggggtggctgatccgccctcccgagggtggcgccgtcggatccgctgtcgccacccaatgtcgtggtcacctcttatgtggccaagggtggcagatccgcccctcccgaggatggcacggccagatccgtcggcctcgagctcatcactccggccagatcccatagcctaggacaccgccgttgtcgcccgataccatcaccgccgctcc

SEQ ID NO: 94359 - DNA, 1073 bp, Oryza sativa
ttcgagctcggtaccccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacggggacctatagtatcgacctccaggcataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttg

SEQ ID NO: 94360 - DNA, 1719 bp, Oryza sativa
taaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcaggtttcctttatctcgtcgaagctttgccacacaccagaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaataaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtccgcgcctgacgggccgccggcgtgccgtgccgtgccgtgccgcgggccgtgccgtgccggcccg

SEQ ID NO: 94361 - DNA, 2325 bp, Oryza sativa
  unsure (1)..(2325): unsure at all n locations
cggccatttctgccgccaccgcccgatcggctcggggccgatctggaccgtcagtcccgtggaccggtggtggaccacccgcgtggtcccgccccatggtggaccggcccccttgagccgctgccgagtggggccgtgtgccggcgcccttcccctctcttccgagccactgaccagtgggacccgcctgtcggcgccgccccccctgatgacgtcagccctgggaattatggcgcaataaattatataagggctttctgttatagtaataaacacagtgaatcttctaaaattcatatgtaattcatccgagctccgtttaagcccattcaagtcgcagtaaatcaagaaaaatgtgtagaatccattaaaaatggttttgttctctgtttcagtagtcttatagcctgtttgcattgtttgccttgtatgtcgttagattccggctcttccgacgctccggtgtacttcgaaatagtcgctgaggttccttcagcagcagagcaaggcaagtcatacttgtcacttgatcatgttgatcctacattgcaaatgttctattgttttccttcaaatactgcatttgttttgcaataacactatgggatgtttacctattgttacagccatactattttggtaccttgctcctttgttagctcgggttataacatgaatagattttggactaggagttgcttagccatgcttagttcaactagcacacaatggggaaatctcatttaaaatatagactgtaggtttatatgataatgttggattagtaccaccgctttggtgttagttaattaaaatgaatcacatggtgggctgtgggtgcatagttctgctagtcgcacccatggcaagtaaggaccggttcgcgggaaaccctggaagaactcctcgtacttaccacaagccagcgtgggcaacggctgggcttgtagtgtagcttttctctagctgacgcatcctggcaagggtgggcgtgatggagcggggtgggccctgcgacggcctctgtcgcttccgaattcacttaggtatgagaggggcctgcccgtcgcccgctggggacgggggtgaaacctgaggtgtggtgtacttggctagagggggttatgcgaagggtcctgtcacagtctctttccgatatgtcgtggtggcatgtcggcgcacggaaacgtgtcgtgggctgtgtcttggggtacagttgtacacctctgatcagagtaaaactattcgaatagccatgcccgcggttatgggcggtcaaccagattcaccgtgattagactcatcttagtttagtctaatgaaattggatggtataggtggatggttgggcctgttgcaacgtggtatagcgttggacagtggatgattaatattgattaattattacaactgtttaaatctttcaacttctgtttataaatgctcgctttatgcaaatgaaccactctagctctcctttgataattccctgcatcatacccctattccggtatgacttgctgagtacagtgggtagtactcagtcttgctctattttttttcccaaccccagagttcgagtatgtgtcagatggaggtttctccgagaagtaggcttcgtccgtgccatcgagggtgcctgtggaggttttaagggggggctctcttttttttccccggggtctttccccccgggatgcctgtggagtgtgttcccgctgagttcaagtcaaggctaaactcccggtgnctttcgtttttccgctgcatttatgtaacacttttagtgtgtttgtaagacgtggatctgaatgnnaacatngnnnntccngccccccggccgntcctggacgggggttttaatgcacattctgcttggaattctattcgggaatttctgggcgtgacagcctaccattaactgcgtatcgaagtgaaaatgataaagaaattaataatatttttatatgaagtcgatgatcaaagataaactttctgccaaagttatatttcttgacaagatctacaacgtggttgctgaacaattttttatttgacatagtttatgtgtgatagaagttatcagatctaattgataaatgctttaaaattttcatatgaattgaaatcgacgcaaactctatatcaaaattatacagtaagtaagatatataattttataattttatagttgataaccttaacatttacatttgaagtcatcaccttaacagcacagccaggatgctgcaacaagtcccaccgaacagctccacttcaggtttgtcttanattaacgatcgatctatagttttaccatatata

SEQ ID NO: 94362 - DNA, 3968 bp, Oryza sativa
  unsure (1)..(3968): unsure at all n locations
cgagtttcagttgtgaaacattaaccgtgccaatcacaagccagcatgggcaacgactttaccttttatatagcatgatttattgcggggcaccagactgagaagtggcggagataagcccacgggggtcgctggggagtccatgccttgtctataaggaggtgattatgatccaggtacggtgcactgctttgagttgtgttgtgcgaagggtactgtcacgatttccccctttgtagtgccgtggtggtacttcaaggcatggtaacatgtgtggaatcatgtcttgtgggtatagtggtacacttctagccagagtaaaactattcgaatagccgtgcctgcggttatgagcgggtataacaatgtctttcgtgttagtctcacacttttcaccataataaatgatgcgataactggtaataatttgatttgctcctggtttggaatggtacattcctggttcggagatagatctgtacagccgggtatggttgttcaggatggttgggcctgtgcagcatgggtgtgttgttcagtgttgattaatattgatgattaattactctgctgttttacaattctcatatgtttgctaaatgctgcattcgcaaatgagccctatattacgccattctttggtatccttgtgcacttgcatatttgctgtgtggcttgctgactatgtcatatgctcaccttgcaataatcaatcaaacctcattgaagaaaagttgcgaaggagaagacgtttggcttataccccagttgagctgcccgtgggagtggagccggagcttcgctagaccgtaattccgctgctgttttctcctttcttttgtaagtatgtaatgttgtatttttgatgaatctgtatattaaattgtcagtttgtgtacctcggttgatcctaaacgagttttttaacacacaaattagtcggttgattcctaaacgaggattttaatacacaaattagttcggaaattactagtgaatttctgtgcgtgaccgtgcatcgccacccttttactttcgttttgtttcgacaagttcttgctttcgggttgagctgcatcggttttgatcttcaacaagaggtaaaacttgttatgggcgcttgcggtctcgggattagtgcttccatctttatgatactctaatcttgtttatgtaatttggcgagtattatatgtcttacataatctctggcgatatcgctatctaatctacaatcggcttacattatcggtagagggcagctgattaggttagatatcgatgttgacttagattatataaggtatccacaactctatgaaacttccaatggcttggntgtcttgatattgcccttctttccatacttatagctgcatcagttgagtttgatcttataagtcgtgattagaatttcaatctctagcctgcttcttggttaccgattagggtagtatcggggtttcagccgatctttcctgatttaactatatttactctatatgcttcgttgatatgttaaatctgccctttatgttaagatctcgttgcatttgagtatattaggcctttgtttgatatattctacttggtttaatatcttaatatagagtggtatcggagtattagccgatacatgctagatctatctgatcggctatgctatgaacatatatagtcccattattaatatatatttcgatctaagtgatttatactgtctcggcatggcgatcgatctatcccaatcacttgatttaagtatatatcgatataaggagtatatattgttaatatctacagtcgttcgagtagatttagttccttcttatttattcatgactgccgatcgatacatatatgacatcggctcaaagataaaagatatgtcatcagcgctcagccgatcggctatcgtttataggtttaaccgcggtttctttgtctttgtttcttgttgattgcaggatcaaatgaactggcacactagcatacccgaaggcgagttttggacctgcactggagttaaacagatctcctaggcctcgtgttttacgtcaacacgcttttggcacacccagtgggaccgatcagaagtcaaaatcacaacagcagtttttcccatggccgagaaaccgccagcatcgccatcctcggctggtgaacttggttctgttaaagctaaggtccacaagctgggtctatctgaggttgatgaagccaacattgtgctcgtcactatggacaaattgacacctgaacagcaaaaggatcttgaggtaatgatgcagcaagcacggaatcagttcttgagctcattcacgaagactcgcaagggaacacttgttcagaagtacaaagtaaaagtaattgccgatgttcctgggacaggttcttctaaggttggagaagtgaaacaagctccagatgacgcggctcaaccgagtattaaaggtgctgcagatgactttcaaggagatcaaggtgatggctctcaagaaattcaaggtgatggtgttcagggagttcaaggtggaggtcttaatcatgacggcaatgcagcacaattacagtttaacaacttccaggatcaggttgactatgccgtgcactatgctttgatcaatcaatctagaatattagtcaacactttgtcaaacatggtgaagacaatggttgatggttcaatggctgaatatcaggctacaggacaagtttatctactaggaggggtattcccgaattatcggccattagtcactgataatcagccagttgttcaatcaattcctcttaatgcaccatcggctcagccggcggcaccagtatcggctcctgcacctgctgcaccatcatcagcgccaggtcaattagtgaatccttgattgttggtgagagagcaatcacagcatagtggacagaatgtgaatcggctaaagcaagatcaggttgcagctatgttcttacctcctcaacctaccgttgatccaacccagcagaagtcgattcagcaaataccaccaaggcagcaagttctgcagtcgattcaacaaacgccacgaatccaacaggttgtgtagccaattcagtagacgccacgtaggcagcaggttttgcaaccgattcagcaaacgctgttaaggcagtaggttgttcagccgattctgtagcaaggtttgatgaatgcatcgactgggtttgtaacacctgacaatcagccaaggcagcatgctgctaatcaagttgtgccagagcacttggttcatcatgtacagccagatcaaacgatgatacctcaagttgatcccgagcatttggtgcgcaatattcagccgaagtttcaaaattaccaggggggcaatttgaattatcagtatcagcctccttcaccgcaaatttaatatcagcagggaggatcggctcaaccccagtttgctcctcaatacaatcaattcgaactcattccacaacaacctcaaggagtacctcagcaacgaccatgggccgatatgattgcggatgtgatgaaggagcagtttgggcttaagccgaaagacgctggaaacttatatcggcaaccttcccctaaatggtttgagaaagtccctctacctaaccggttcaaggttccagacttttcaaaattctcagggcaggatagtatgtcaacttatgaacacgttagccgatttttatcatggatgctttgagggttaggttgttccggttgtcattgtctggatcggctttcacttggctttcttctttgccatgtggatcaatcaacagttgggccgatttggagaagcattttcatagctatttctacagtgagattcatgagttgaaattgtccgatttaacagcgatcaagcagagatatgatgagcctgtgcatgagtatattcagagatttagagagatgaggagcaagtgctacagcttgagtttaattgatgcccagttag

SEQ ID NO: 94363 - DNA, 721 bp, Oryza sativa
ggcacacccagtgggacccgacaagaagtcaaaatcacaacagcagtttttcccatggccgagaaaccgccagcatcgccatcctcggctggtgaacttggttctgttaaagctaaggtccacaagctgggtctatctgaggttgataaagccaacattgtggctcgtcactatggacaaattacacctgaacagcaaaaggatcttgaggtaatgatgcagaaacaacggaatcagttcttgagctcattcacgaagactcgcaagggaacacttgttcagaagtacaaagtaaaagtaattgccgatgttcctgggacaggttcttctaaggggggttttttttgggggccaaaaaaaaaagaaaaaaaatgttttggaaaaaaccaagctccagatgacgcggctcaaccgagtattaaaggtgctgcagatgactttcaaggagatcaaggtgatggctctcaagaaattcaaggtgatggtgttcagggagttcaaggtggaggtcttaatcatgacggcaatgcagcacaattacagtttaacaacttccaggatcaggttgactatgccgtgcactatgctttgatcaatcaatctagaatattagtcaacactttgtcaaacatggtgaagacaatggttgatggttcaatggctgaatatcaggctacaggacaagtttatctactaggaggggtaccgagctcgaattcgc

SEQ ID NO: 94364 - DNA, 817 bp, Oryza sativa
ggggtggccgaaagaaagaaccgtactttaactgagatggtgaatgccatgttagagactgcggggctttccaaggaatggtggggtgaggcagttttgactgcgtgtcatggcctgaataaaatttcaatgaagcataaggaagtaacaccattcgaggaatgggaaaggaagaaattaaatctctcatacctacgaacatggggctgtttggccaaggtaaatgtacctatagccaaaaagcggaaacttggaccaaatactgttgattgtgtgttccttggttatgctattcacagtgtgggttatagattcttaatagtaaactctggagtacccgacatgcatgttggtacaattcttgagtccagagatgctacattctttgataatgaattttccatgaaacatacacctagcactttgcaccgatagaacacaatgatcaaacgcctgagaaaaatcctgaggaggacaacattgtagacactcacaagagtaagagacaaagggttgcaaaatcctttggagatgactacattgtataccttgtggatgacaccccaagaaccatagaagagacatattcatctcctgacgctgactactggaaggaaatagtacgcagtgaaatggattcgattatgtctaatggtacttgggaagtcgttgagcgtccatatgggtgcaagcccgtaggatgcaaataggttttcaagaaaaagcttaggcctgatggtacaattgaaaagtacaaggcaaggcttgtggccaagggttatacccaaaaggaaggcgaggacttttttgacacata

SEQ ID NO: 94365 - DNA, 504 bp, Oryza sativa
catctacaggctttgttgtgaacgaagctgacaaatgtgtgtactatcgctgtggtggggagaaggagtgatcttgtgcttatatgtcgatgacatattgatctttgggaccagccttaatgtgattgaggaggtcaaggactatctgtacaagagttttgaaatgaaggatttgggagaggctaatgttattcttaacatcaaactacaaagaggagatgagggtgggattacacttgtgcaatctcactatgtggacaaggttttgagtcgctttggatatagtgactgtaagccagctcctactccttgtgatcctagcgtgctattaaggaaaaaccgaagaatagtaagggatcaactgagatactctcaaatcattggttcattgatgtacttggctagtgcaacgaggcctgacatctcatttgctgtaagcaagctgagccggtttgtctcaaatccgggagatgatcattggcaggctctggaaagagtaatgcg

SEQ ID NO: 94366 - DNA, 1000 bp, Oryza sativa
gtgggtattgtcttggtttgcttcaaaatgaagacgagatttggctattttgattcttccgttcgatcacttgtgtgtaacgtcatttttcttttctgtgtgtattaggtttcctaagcatcgactgtggcctggatcaagattccagaacagacagcctggttggcggaatcacctacgtctccgacggtgcgtacgtcgacgccggcgaaaatagaagggtgaccaccgtgtacaaggacgactggaagggccctcgctaccagacactctacacgctcaggagcttcccaacatccgttaccggtgaacggagctgctactcgctacccaccaaaaaaggggacaagtacaatgttcggctggagtttctgtatggcaactacgatggcctggacagcgcatccctgacgttcaacctgacccttggggtgaaccactgggacaccgtgatcttggacaccaccatccactacggttataaagcatacgccgcggtgttcgtcgcatgggctatgtcggcgccggtgtgcctggtgaataccggcggtggtacaccattcgtgtccacggtggagctgaggccgtttgaaagcttggcctacccgaccgacaatcagtcactctccctctatgaacggaagagcatgagatcaggtgctgacgtcgatataataaggttggagcactactactgtatttcctaatttccggccgtcgtagtaattaaggagcagctcatttaatttgcaccttaatataatgtacaaatggattggagaagaacctgtatattctctgattttactaactcctaattttctatatcaacctgtccttttgttccttgtggtgaaaaatatttacattaaggataaagtttgatcagactttaatttttataccctaactattaattttacagtaattaatggaagtgctcttggattcgtacgtacactattttttggaaagcatagaacccttcttatataagggg

SEQ ID NO: 94367 - DNA, 532 bp, Oryza sativa
cacgtcgccggcgaaatcgggagcacctaggccgttcccgaccttcccgcccctataaaatccatccccgcgtcctcctcctcgcttttccttttgccgccggcctctcccgagctctccatcgcccccacgccgtgtaaccactcgccgccgccgctcccgctactccggccgccgctagccgctgctagggtcgccgccgcaccgcgccgtcgctgccgtcgggttcgcgaggccgaactccacctcgtccgccgctcctccgtcgagattcgtcgccggaacccgcatcccctcgcgctcaggtgagccctacccctaccgccgccttcggccatggatgccggccgccgtggttcatctccctccctctaatctctctctcttccttccttagggcatcccgaagctcgtccgcccgtcgccgccgtcttcccgtggctcgccgtcgccgttagccatcgtctcccttagcgccggccactcgcggtgaggcattcatctcctctattccccttcctctccctcctag

SEQ ID NO: 94368 - DNA, 2425 bp, Oryza sativa
attcacatatatatcattcacatccatttttttttttttaccgccgacatgcatcaaaacctgcaaaaataagttataaattggaacaattttatatgtaactagaaatgcagtatacagagacgagctacctaggactttactctaaagaatataattgtattacaaagaatatttacaaaaatcaaatgtttgtcacatatgcattgcgaatgttctgccattgcgagacgagctacctaggacttcactctaaacatccctttcaatgacaagatatcatctagtatgaattgtgctagctcctctctaatgatttcgaagttgatttccggaatccttcaaataaatttctgcacgttcggcgccaacatcgtccacctctgttatggtgtagacttccttaggaattttattctgggtcctaggattccggctcgatgtagtcccagtagtggtcgtcgacatcggttcgccttgctgcgacatgtcctatgtcactgttgtacggggagaaagtactttttaaacacaaaattgcatctacacacattctcttatggtttgatatacctctatctcctacctacgttcgcctcgtcgacgaaaccatagcatccatactcaatagggccggagcagccgggaactcgacctcgacatcagtataccactcgaacttgctatcaatgtcacttggtgctggccttggagttatattgatctcaatgctgtgcttgggccattgaataaagttcccacgtgcagccccaagggtcagaatctcgtcattaggtgggtgtaggatagtgtagccaacccaatcgggcttcactaagtccacctgaactttggcattgccggcttgcagctgcgccccatgcactcgggtctctgggtaggcttgaatgcttgaccctctgcggcaggaattgcaaatcctggtgtcaccctaacgactagggtacacgatgtgggttcctgcgattgattcattagtgtccttagtatatgttgcaatgtattgtggtgctaatataatatatacgttattaagttgtttctaccattatgtggtccaccgcggcggggccttcaggctgttctgccggagcctcagttgatgcgcagctgctacgcctctgcgtggggctcacttgtactacgggaccgggagtggcatcggtcgacctatccctgatgcgtgcctccatccgagccttcatacctaacagctcggcagtgacctcttctctaagctcttctttaagctcctatcgaagttgggccttaatgcgtgcagctttctgcgccttggaaagcttgtgcttcttgtactgccacgcatattggggaaacccaaacttccatggaacattggagccaatgccccttgttcgtccacggtgttcttcgtttcccaatgctttcgtgaggatgtcatcctcgcgtttttgtgagcaaacctcttgggaggcctgtctctcagcattcagttcgacctagagtacagttaggatgcgttagacgaacaacaagatacaacataatgaaacttattctatgtgttcaacatacgattttctggtacaccgcttgatcttcgggatttgggaacgaaagagttccgtcactattcttcttcacccttgcccttgcccagttccttgcccgctagaccgggatatcagcaagcactggttgggtgttagattccgctgtagcttcatcctccttgtcccattctgcctgtttccccgcgtagcctccggtgccaagccggtgcaggtgaaggttccttgcctgcagatcacggtaggtctggcttttttcctgagactctttcgttgatttggcggcatggaactcatcccacacgggtttggtgatgaatgggtatttcacaaatggttctggctgggcagggttgaggacgtactccgtgactagcgttgtcttgaaatttttccaacaattccccatcttgcggatagcctgccgcttcagtcctaccttggcctctgtagggtatcggaagctttccttgaacttcctccatgcctcttctttttcttcttgagggaccagatcgatgtggtccttcagaatagtgaagttccgcctccctaggactccgcatatcgtagggaactttttgacagctttcgtcggagccgtcggatatccaacatcgtccatctctgttatggtgtagacttccttaggaatcttattctgggtcctaggattccggctcgatgtagtcccagtagtggccgtcgacatcggttcgccttgctgtgacatgtcctatgtcactgttgtacggggagaaagtactttttaaacacaaaattgcatctacacacattctcttatggttgatatacctctatctcctacctacgttcggctcatcgacgaa

SEQ ID NO: 94369 - DNA, 1770 bp, Oryza sativa
  unsure (1)..(1770): unsure at all n locations
ctccggccctaaggaatatggttgctacacacagacaaccaaaaccctaacaacgtgcatcttcttgtttgcagggtcttttatgtagaaaatctgttcgacctgcttcgctagtacgaatggttcgtctgcgtatccaaccttggccaggtccactaatgtgaagccttccttgtcgaccttgacacctctgcggatattcacccaactgcaacaaaacaaagggactttgaagttcagatagttcagctcccatatctgctctatgcggccatagtatgtgcttgatccagcctgatcctgatatgcatctatacggagtccactgttttgcactgtgcttttctcatcttgtgtgacggtgtaaaatgtgtatccattgatattgtacccttgccatgtgttaacatcccaagatggaccccttgccaacctttgtaatatctcacttgggccatcggtcgaccgtgctacatgatccttcaaccattcgttgaagcgaaaaccatgttctctgttgatccaaatatctgatcgaccaatattgtcctgtcagaccttcgctaaatgctcctcaaagtatggggttacttcagccatatgttgcagcactgcgaaatgagcctgcgcataggaagcttgatcgggaacaattctttttctgccagttgtgccaacacttgccaaccttccttcgtggcgagacgtaggactcccgatagnataagtctcagccatgtaatcgatacaaaactcaatggcttcctcggtcatgtaaccttcaatgatgcttccccctggttttgctctgttccgaacgtaggacttcagaattcccatgtacctctcgaatggccacatttctctcataaaagctggcccacatattttttttgcttcactaggtgaatagtgagatgaaccatggtatcgaagaaagctagtggaaaatacatctccaactgacacagggtactgacaatatcggcctgcaacccatctaggtcttctggatctataatcttctgaccgattgcattgaagaaggcacaaacccgttggatcatgtgacggacttgtggtggtagaatgcctcttatagcaattggcaagatctgtgtgattagcacgtggcaatcgtgagacttcattccaaccagcttaagatcctccaatttaacgtacttacttattttcgcgcaatagcccgaaggaactttaatatccgccagacatgatagcattgcgatcttctcatccttcgacaatgtgtggcaagctggtgggaggtacactcttcccgtctacacatctgtaacaggctgaagttcactgcgaatgttcatctcctgtagatcgagacgcgcattcaacccgtcctttgtcttggcaggcatattcaacaatagccccagcaagctatcgcacacatttttctctacgtgcatcagatcaatgcaatgacggacctcaagatcttcccaataaggtagccgccaaaatatggattttttcttccacatcctcttcttgtcctccttactatgttttcttttcttatcaaactcattagtaatgtccttcaccatgttgtgtacctgatctccggacaaatccacaggggcagacccaagttctttcttaccattgaaaattttcttctttcttctaaaggcgtgccgtagggggagccatctcctatgacccatgtaaaccatctttcttgatttctttaaccacctactgcatgtatgttccatacagtcagag

SEQ ID NO: 94370 - DNA, 641 bp, Oryza sativa
  unsure (1)..(641): unsure at all n locations
tttaatatccgccagacatgatagcattccgatcttctcatccttagacaatgtgtggctagctggtgggaggtacactctcccggtctacacatttgtaacagggctgaagttcactgcgaatgttcatctcctgtagatcgagacgcgcattcaacccgtcctttgtcttgccaggcatattcaccaatagccccagcaagctatcgcacacattcttctctacgtgcatcagatcaatgcaatgacggacctcaagatcttcccaataaggtagctccccccccccggggnaaacaaaaaaaaatttaaaatgggggggaaattttttttttcttccacatcctcttcttgtcctccttactatgttttcttttcttatcaaactcattagtaatgtccttcaccatgttgtgtacctgatctccggacaaatccacaggggcagacccaagttctttcttaccattgaaaattttcttctttcttctaaaggcgtgccgtagggggagccatctcctatgacccatgtaaaccatctttcttgatttctttagccacctactgcatgtatgttccatacagtcagagcatgccttctttccgttcacgatttgtccaaaaagattacccagcgcggg

SEQ ID NO: 94371 - DNA, 525 bp, Oryza sativa
tgctttcggcgtatcggctggccagtttttgggatttcttgttcatgagaggggaattgagataactcaaaggagtgttaatgcaatcaagaagattcagtctccaaagaacaagacagagttgcaggagatgatcggcaagataaattttgtgagaaggtttatttttaatttgtctggaatgttagagccttttacaccattattgaggttgaaagccgatcaacagtttacttggggggcagagcaacagaaagcgttggacagtattaaggaatatcttagctctcctctagttttgattcctccacagaaggggataccttttaggttatatctgtcggccggtgagaagtcaatcggctcggtcatgattcaggagctcgaagggaaagatagagttgtattctacttgagtcgtcggctcttggatgcagagactagatattcccctgtggagaagttgtgcttgtgcttatatttttcatgtacaaggttaaggcattatctattgtccaacgaatg

SEQ ID NO: 94372 - DNA, 673 bp, Oryza sativa
tctgaccagctcaccagttccaaacaagaatgataaaaaagaactctagcagggtagccgggaaataacaattcaaatcttaaaaccctcctctcaccttttcattttcatcttcaagtactgttactgctatatgaatccgccctgtctttatattcttcagagcaatccatatgtcgtgcctttgtccacctctcaatttgttgatgcttatggaacagtcactacatgagaagtgagtcaatgtttagccttattgggactacatggaggtttgcaacctttgtatgaactataaaatataattcagaacactactaagtactaattggaccgttaaaagcaggttccatggacggtattaaagagaccaacccgagtgtgtcgtcaaagatgggatccttatctcgaacttgaagagagagaagattgagagctgcccatgaggttactggtattttgaactcctccatccattttggattgagtgttttcttgtggatctttgtctggaaacgatagggtccaagatggcctttcacgtatggatcagctaatcctgcacatagatccatcaaagcagcattgttgtgagaatcaactaaatatgaacaaggaccagtacagtaattcaacagagaatctcatgtggaattttcctagtcaaatatac

SEQ ID NO: 94373 - DNA, 983 bp, Oryza sativa
atgcaccaattttttttttgtcaagactaacacatgtcggatgaattttatgtctataattttacaggatgacaaatggcattccttgaagggtttgaatctagtattttcctatatcgtcatagcggtgtgctttttcgtcatgaaagctctcccaagtaagcacgctgcacattaatacataatcatgcctgaccatttaatctaatgcattcatgtaaataaatttctgcatattacagaagttaagtaaaacaaggatttgatctaaccgagatagaaaaataagcatatatactaatctacagaaaattaatcacattttgtggaagatattggctgatttttatctatgtaaatagagtaacatccttaaataacttatgactcctttgtttatctacttggtgacacagcgctaaaaaaggaagatgactaaatgtgttgttttgaaccgaatcaagagaccgatgagacgatgcatgcatgtgagttgaagactgtagctagatcggtgagctcctgatcaagctgttcatcatcatgacgggttcagctaattaatcagcaacaacagcagtgaatatatggtaggttcatctgaagcgacgggaacaagattactgatagatgttttgattgctttggtgttttcaggtgattagtgtagatttgggaaatgatcttgaggtattcgtaggatggtgtttttagtgtaaaccatttattgggtcaatgcgttatcttctttattaacgaaaggaggcagagcttctgcctttattttaacaaacaagatcacagtagccttggttcttttgcctatcctagtgtggtcgagcgacagtctgacttgaggaaaacaactttttcttcagcacttattttagtttcattttatccgtgctatgcactttttttttcttagagaagggtatcctctacatacaaccggatatatatagtatttttaaattagaaac

SEQ ID NO: 94374 - DNA, 761 bp, Oryza sativa
tcatctccacaaggtcaaaaagggtttggggaaactagctggtgcgatgttcaagagcccaaagaaagagagtgatgatgaagcctcgcaatgtgtgacgcctcacccaaatataaaaccacttggagaaaaaagggtgtcagtaagatacgtcgtcgatgaagatccttctgaaaacttgccagatgaccagcattccagtcctgagagaggcgagtcggaaagtccgaccaagaggcatttgaggaagaaggctgtgcacatggtgaaacatgcggggaacaaaacagctcataatctgaagaacatgttcagcaggaaaggcagtgacaagagcaaagaaggccaagatgaccagaaagacgatcctgatactatagtagtagaaccttcaaaagttaagaaagacaatcctgatgcaagtgaggtagacatagacccttcacaagttgagaacgacatccccgattcaacggcaattgaccctttgaaggttgattctaatgtggccaacaacattgtggttgatgcactagagtatgcatctgaatctgatgcgaaggacaaaccacagtgaaatgtgttctgctatttttggcggtcctcgtgctgttgggactgttcatgtaggcaggatactaggtagcaaaatagtctgatagcctcctgacagcaagcgaaggttgacagtatagtccgtttggttggttgagtcctccatcttacctgacgaccgatgtttttcttgtattatagatgct

SEQ ID NO: 94375 - DNA, 3803 bp, Oryza sativa
agtaattaattctagtatcactaattatgctcatattccttccatctttttgaggaaaaaaaactgaagcaactaattaatattatgtttttttcttaagaaaccgtactaccgtgtctgtttcatattataagttaatttgactttagtttttaatcaaatttctttaagtttgatcaagtttatataaagaaatataatacaataatttgaacttaaaacaaacgtattatgaaaatatattacattttggttttagtgaaactatttagtgttaaagaaaccatccatatcttgctaatgcgacttattccagatgactcatctctaacaattcaaaaggtagtattacgtttaagatatgactaccagggatgactcgtcaccgatataaggtcatctttgacagattgtaattctaacacatcacggataacctataacggatcacaaccatgtcccgtcatggataatatgtcatccgtcatccgtgacggatgtaatgagatgacccgtcaaagatgagagcactcatccatgacgggtcttaattactacccttcacacagataatgttatccgtgaagggtgatagttacgaaccgtcatggataacgaaaaattcaatcttttgaaattttcaaataatctcacattgagacatatcctatatgaaagttgtagatctcaatgagatatgtaacttcaaaactgacaatatttgaacttgagatagtttacatgtccgaatattttataagtggtgagatctattttgaaaaatgtgattttaatttttcaaatgatctcggatggagacatggcctatgtaaaagtcaaagtgtttgatgagatctacaactttctaattgacaatattttcatgtaagattgttttcatccccgaattttgttataggtgatgtgctctatttccaaaatattttttgaatttgtcaaatgacctttggaccatggatggagacataccctaaactaaagttgtagagctcgatgagatctgcaattttgtagttgaaagcattctcatttgaaatcatctagagtttcatatttgaacatgaatagttaaaacaataacatgtgatcacctatatggtctataggtgaagctgttagaatggtttgtatgtgttgagagatcttagtttcaaaatcacatatggcatgcatgcacatatcacttgaagaatcataaacttctatctagtgacgtatgtgtgaccatggtttgaatatgctagtaatatttagaatttagaatatttttagggcttcttgatgcacttaaaataaaaaaaaatggatgactctcatcccattgaaaattaaaaaatgtgaatatcctaatatttagaatatttttagggttttttatgcatttaaaattaaaaaaaaaagtatattctcatccatgaaggttcataactaaaaatagtgagattagagacttcattttgccgctttgtcttccatatccgcgcatacctttgaaagtcaatagcatcatatttttttcattaaaaaaaagcattttagaaagctttccttgttttgtaaaaactcacagcgtatacatgtcttatcgtgtttaattacacctatggtacaactttgcaagtcggtgtgatatagtgcgagaacttaagaattgaatgtctaagtgtaacaacttaacaagtgggtgcgctctagtacaagaacttaacaatttaacaatttagtattttggtatatcaacttgactaagtatatgctaggtaagttatttttatgatgccaatatgccattacatagaaatcctacggatattaccttataatattaaatttaatcttgaagaattatactgcacataaaatttacatccaattacctttaagaattttttgttttctttatcttttcaaatatcaaccgaaatataataatttctacatccattttaattgactttcaattattagttattatgataaaaatataattactgcttatacaaatccacattagtatattgtcaaaaggttgaatctatataaaaagggctccaaataattaagttgtcgcataaatcataccaaccttgcaagttattgttattgtatttatacgatcacttataaagtttttatactaaattgcacttacctgccaagttattgtattagaacgcacatttctcaagttcttgcaccaaattgtacccacatactaagttgatacaccttgggtgcaatttactctaaaacgctggacacatcacgttaagaagcggtgaacaggtctttttttattattattctagtgaagaggtgtcttttgaatgtaagtggacatgaatttggtatttactacttcctccatctcattttaagtacacttatgggtttctagtccaaagtttgaccgtccgtcttatttaaaaaaaataaaaataagtcacaaacatatatacccctaaatatcacaaatatatataaacattaacccctcctctcccctcccaatctctccctgcacctcctctctcttcgcatctcccttccctagcggcgctgcctctcccctccccgctccccggtgccagattgaggcggcaatggcggattgagcagcggaggtggtggattgaggcagcgtcgccggatcgagcagcggacgcgacagattgaacggtggtggtagcggatcgaggtggcggcggcatcaggatcggggccatcttcttctccccgacctagctcctcgccatcttcgccattggcatcagaggtagttggccgcaaggtcccggggctacgacacgggacaacgcctctcccccaacgcagtttctcgccagttcctcgccaaaacctgacgaaactatttgatgctctgcaaggggtcgtggtactatgtgagggagcggtcccggccgagctggcgcaaatatacccctagggaggagtaaaaccacgctccagcgtggagcgttggccatggccgtattcgcacttcgtgggcacacctccagtaactagctgtccatgactccatctccatgttcagctggcacgtggcagtggcaaggaaaaagtacaatctgactcccttaaatatacgtcgaatctaatttgtatccctaatccacgaaaccagatatgacgactcctccaactattaaaaccgtctaaaacgactccctcagctattttaagagtggttttcgctgacgtggcatccacgtggcagtccactcatcagacaaattaaaaataaacatggggcccacatgtaagtcacaagagaaaaaaataaaaattgtgggccggcgatcagcagcatgatgagggagaggggcgggtggcggagtccagagcatcggcggcagtggtgaagaggcagttgtcccccctgggggcggcggaaacggattccccgggcaacggcagtgccgacggagggcaccgggcggtggaggagagccgatggggtccggtggcgtggtgggcggcagcggcccaccagatcggcatagggccctcctgcggcggcggccaagaagaggctggccggtggtggaaagacggtcggcggggaggtcgtcgaggtgagctcacggaggatgaccggcgcacaggcaaaggacgggccctggtcggcgacatcgtcccctccggtctccggcgagagggcgagaggccatcctcctggagacgacggggacgaaaaagcccagcgccgacgcgagcagacggcgcactgcgttgccgaggggacggcgcgtggtggggca

SEQ ID NO: 94376 - DNA, 1212 bp, Oryza sativa
  unsure (1)..(1212): unsure at all n locations
tataagttaatgaatctagacatattgtgcctagattcattaacatatatatgaatgtgggcaatgctagaaggtcttataacctgaaacggaggtagtacttgttagtgaatgtcatcttatcttatgctttttttttcactacatttgcatgatctgcagagagggggatcgagcagcaagttcctcaactatttcgttaagcaaattgttccagtttttgacaaggtaatcttctttatcttgtacattggtccctgtgctttgttggaaaaaacagtaaatgcttctttttaattatattatgcatggcagctctacaacccttgttttgttgtcatacataatgtaacattttgcagtttgcacaccattttttttttgaaacatttggttacattccttacttgtgataaagaaacagctcttgcaatcatgcacatttctgcattctgcactaacattgcatggtaaaaaaaagtctgtcgtatttttttgtgaactatggatattctaatngnatngccatcattttggcaatcagactccccaccatgccttgaacttgtttatcttcaaaacaaagtgaattcgcatcttagagcatgaaggttttctagagcatgaaggttttctagagcattaaggttttcccctcttttttacctgttttagattcctgaagagaagaaactggatttgctcaaaacagttgctgcaagctcaccatatgctacagcacaagatgcacggcagctgcttccccctgttgttcaattgctcaaggtctgtgcaattcctgtctgataggtgtccaatccccctttgttaatgttttattttgtcccctagaagacattgttagatggtttcccctccaccgcggtgttacacaataaatgtcgtgtcttaccattgcatttacgttttcttttacagaaatatatgcctgggaagaaggtggaagatatcaaccataattatgttgagtgcctgatgtacatttttcaccatttagcccataaggtttgatgacagaatgtttatcatctattatgaaccatgtcttttcttcatggatggccttgtgctgaccaaatgaaatacagacaccaaacaccacaaacagcctatgtggttacaagattgttactggacaaccatcggatagacttggagaggatttctcagaacattacaaagactttacgg

SEQ ID NO: 94377 - DNA, 982 bp, Oryza sativa
aagatccttcaaattgataagagtacgcacttttgcttgagtaacagcctacggagttccaattccaagttatgtcatcagagttttgagaaaattggaaatcttgaagcaaccctcccaaccgcacaaggtcatggatctcctcgatcatcgtaaattgtctgaaggaaactagccagttgcttgaagacatttccggttgaacacttctttgctttcgttttgccaattgaaaacaaaggggggcaacatctttaggacaacttccatgcagccaatgatcttgccagaaactagtttttgctccatcgccaattacaatcgtagttgctgcttgaaacaaccgtttgtcaatatcatcgcatggtagattcatgccggcctagggtttatcaacccctttccatttgagccacagctagcggagacgaagagctctagagaatctttccaaatcagggaggcccaaccctcccaaggattttggtctgcacactgtctgccagtttaccagacaacttccaggattcaaatgatcagggtcctcttccttccaaagaaacaatctctgaaatcgatcaatcctcttaaacacccgtttcggtacttggagggccgaaagatggtggattggcattgaactaagaactatttttaccagagtctctcgccctgaagatgagaaaaaacgtcctttccaagttgggaggcgcgcctaattttttcaattaggggaagaaaatcgattttcctcaattttcggaagtggagaggtaaaccaagataacgacaagggaaggccataactatacccgggaatatctggagcaatggagttaaatcaacttcgtcacaccttatgagataaatttctatcttgccaatatttggatggaggactgacacttgtgcaaagaggattaaaatcttggagagagtgctaagctctggcccatctggctttgttaacacgggaacatta

SEQ ID NO: 94378 - DNA, 1394 bp, Oryza sativa
acagagcagcgattagcgcgtgattaattaagtatttgctatttttttcaaaaatggattaatatgatttttttaagcaactttcgtatagaatttttttgtaaaatacgcaccgtttagtagtttgaaaagcgtgcgcgtggaaaatgagtgagggaagttgggaacctttggtatagaacgcagcctagggatgatataggaatggtgtcaatagttgtaattatcattgtgaacaacagaacaactgcattttctactgcaggtaggcaaacatttctttgggttgccagatagggaaaaacctacacagtaatggcattgtccacttagctgcaatttgggatcatttacccatattttaattctgtctaaaatttatactctgtttctttttgtttctttttaccagtatgttttctctgttttgaattaaaatttcagaatctttgaaatgtaggtactgtggagtttgacaaataaaaacacattaaacaagattgttatttttcttgtttttggacacggtgcaccatttcaaacttactgattaaatccatcttctcataacacttatttgggcgagcattaaattgcaggacagttcagatagcagtagcagtgaagatgatgctacagacaaatcagttataggatttgccagtgcaatggtctggttgatagggatggccgtaatcactgctatagttgctagttatgttgttactacaatagaggtatatttgggaagatgatgaacatttataaacatggtagtcattttcttttcatcacccaaatttcaattggattgactactgtaccaatctctattaacaggaagcatcagaatcaatgggtatccctgtcaggttcattagtattatcctactacctattgttggaaatgcagcagagcatgcaggcgctatcatatttgccttcaagaacaaaatcgtaaggacgtatccaatgtttctactagtcaagtttgtacatattatgtgagttcagattacccaagttaactggtagatgttatgtaggatatcagtctgggaattactcttggatcagcaactcaaatatcgatgcttgtggtgcgtaattaatagtagtgttcttcgactttgaaggactttctggtatgattatctttagatttttcatgagtgtatttattctacatgattaggtaccagtcattctaattgtgtcctgggtgaatgccatccctatggatcttgacttcaaccttcttgagactggatcattggcaatggcagtaatcaccaccgcatttacacttcaggtaataaaaataattgctaacagatgcaccaattttttttttgtcaagactaacacatgtcggatgaattttatgtctataa

SEQ ID NO: 94379 - DNA, 982 bp, Oryza sativa
acagtcttacagtctttaattacttgattgtttcctctaatatggaatttattttattatagctggtgggattatgaatgcaacatgtgggaatgtacctgaattaatcattgcactgttcgctctgcataagaataagatggaaattctcaagtggtcactgttaggttccatcttatcaaatttgttacttgttcttggttcatcactcctctttggagggatcgttaatatcggcaaggagcgtccactagataaggtaagtgtaaaagtgcacatacaggcagtaactataacatatgtaaccgtgttaactttttgtgatcgatctattttaacagagacaagcagatgtaagcataggccttctgttgttgggtgttctttgtcatattgctaccctagtgtctaaatacacaagtagcaccggagatagcataaactcaagctcagttatgcaattatcaagatcatgcgctatagtaatgctaattgcttactttggaagcctcatgttccagttgaaaactcatcgtcaaatatttgagcttgaagaggtacaaaacttacttcactaagtcaagatgctgagtcgatttcacttacttcactaagggctcctttggatgcagggggatgaaacccccgggaaaaagtcccgtacagggattttcccctgcaccaaccaatccccttccaccaccaggggaatcactcctgttagggaaattttccctgctaccatttgagagtagggagagggggttgatgggggaagggggatttagagaggcaaactgctaaacagtgtttgaacaacaaaacatgtctatatgaaatattatagaaatttcaggaaaaatagaaagtatatagaaaatccatataaataggaaacaacctacaaaaattccagaaaaaatataaaaacataaaaaaatcaacaagtattagaaattcagaaaaatacaaagaaatatag

SEQ ID NO: 94380 - DNA, 646 bp, Oryza sativa
atgcatgaatgcgccatttacacccctcatgcttgcagtgggcaatgaatcttgttggatctgtttgcaaattacagagttcaaatcctgtaacaaccgcaaagtgcctaatagcttttctgaatgttatcatgtcaggaaaaacagcttcctccttaatcactggcatctcagggttatgaagaacattaaactctgctaggtcatcatcagtgacctcaaccttaccatgaggttgagtagtcctagaaggtccaccaggttcagcattttcagcacatggttcagcattttcagcactaggttgaccagaggtttcagcatgatctgtaggtggaatggtgtgaataggttgaatataaattccctcatcatcaacacccacatactcctcctccatgtcaaacacattaggcaatgtttcatccgcttcttgagttgcaggttcacctgaaactgccactttagatgcagatgctccctgccctgtctgagtaagtggaagaacacacaatggcattgatgttggctctatgttattagcactagcatcgcagagtacactctcaacaactaagaccattaattcagcatgcatttctgacttgtacatttcaaacatgtcaaccagttgagattcatggac

SEQ ID NO: 94381 - DNA, 638 bp, Oryza sativa
attctaagatttaacaatagatgtgacccagatactagcgtcatggcatcactcattttttacatgtcaattaccccttacctcaggatcatactcagacaagatggattccttcaccctagtgctagattttttttgtccacttaagcacgtggtagtcatggtactactgcaactgccccaatgtatgataactaatgatttggtggaactaatttaaaaaataaccattgtctaagctgtggttcttaaaggaatgcacacaaataaaaatagttcaaagaaatcataaggaaaatgcaacctacctctccgtaaagtctttgtaatgttctgagaaatcctctccaagtctatccgatggttgtccagtaacaatcttgtaaccacataggctgtttgtggtgtttggtgtctgtatttcatttggtcagcacaaggccatccatgaagaaaagacatggttcataatagatgataaacattctgtcatcaaaccttatgggctaaatggtgaaaaatgtacatcaggcactcaacataattatggttgatatcttccaccttcttcccaggcatatatttctgtaaaagaaaacgtaaatgcaatggtaagacacgacatttattgtgtaaca

SEQ ID NO: 94382 - DNA, 1786 bp, Oryza sativa
ttcttcaaattgcagtgaaaattcatgcattattcattcaggggtaaattaccattgattcagagatggcgatcgttgccatttgttcattttagtctatgaatcattgtgttcattttaaactacaagaaccgcatgtggagggagtgaaggggcttgtgcttcagaataattttgatgtgtttcgtgttgaattgaatcttatttaaccctagcagtggcggatcgagcttggacttttgggggctacgaacaaacaaaacaagagaagagtttcatccagatgtagaagagaaggtagggttaatgcaagcaaatttgagacaaagtaggtgtgtgtgagagagatgaatcacagaatcagaaagaggatgtggatgctcaccaggatgcagcaggaccacggcgcccctcccctacccggctgtgctctgcttgccgctgacattcccaccagcttcggcttcttttttggccttggctccagctgcggccactctcacgtcgtcctcctgtggatggactccaacctcgccccgtagatcgttgcgagatgtttccttaacaatagattatatgtgctttctgccttatggagcagaaattataagccagcagacagcaagcaaatataccatgtcaagtaaataaatggatcagttaattgatatcattgacacattcaagaggaccaacttacagggttgtgcatctcttcacttaaaccaaaattttccagaatagaagcaaccaatgtggagaaatagtgtacagcataggagccaacccctacctgaacatcggaatactaatgatatgttatgtaaccagaactaattgcaatttcctgaagagtgtgccaacacaatttataccagaaagctgtgggcatatggaacttaccacagatccataaattgtgaggtaaaataaacttttccttcccattggtaacaatttcatcccctataacgaataataggtcacaccaacaatcaatttgatagaacacatttttccataagcaaaaaaaaaatcctagttaaaattgagtcactgaacgttccttatcaaaagaaaatggtattacttcttggtcttcccacacagtttagagttgcctcatggtgtattttacaacaaactaacaaaattacaacaaaaactatcttcgctaattagagcaagagatttctatgtttagactggaaaattctataaataaactcagagtgaggtgtttaataacaaaatacagtaagttaacttaacaatttcatatacttaataataagcttgatggaagttcccaataacaaaatgcagtcagttaacttaacaatgttgtctgctgataagtaatcaattagaccatcatgttatgtagaagactgtcaaaaaaacacagaaaaaaataataataggacattggaaccataaaagtttgaagatacaaacttacaaggggattatgaaacaacacaaatatgcgaaccatacgaaaatccaagtgttgcgctaaaaggaatatgtaaataaaaggactatacacgaaaagaagttcataccaagcacagagattaatcgaaacaaagtgggtacggtctagctattaagagatgttattcaggtaaaaatcatccatctgtatacttcgtaaaacgggaatacttatccttcaaccaaataggccgaaaccaccaaatacaaaacaaattttgagacattaccgaaatgcattggttttgaagtgaaaggaaagggcatgttactgcagatttattca

SEQ ID NO: 94383 - DNA, 2241 bp, Oryza sativa
cccatgatacacaagcgttacaaataaataatgatttacacagtacagcaagcagtgcaatggtttctacaaatataaccggattttaatttcataggcaaatgaaagacaagcataaattctacaatgtcagataattcaaattgtattgtcatgctccactaagtaatgattttaatggaagaatgttgaaaaaaaagtaataagatttctgccagaaaacataagtttcagttcagtacaaaccacccataccaagagaatagcaccagttttgaatgatccaagtgatagcatctcaattccctgtaagataaagagaatcagtaggtttatctccaagaagtttgggaggaaaacagaacatatttgtgaagctcttgaaccatagtcatttcaataatgcacattaaccttatatctcaagataagacaagagcatactgaatgcagaaagcaatccccaaaacattgtttgctagccaatgcttcttcgcagaataccatatgcaaaagaaaaatcctgggatcgatgtaacaacttgagacttggtaaactccactaagagcgctgaaataagaaattaatgaacttaaaaaggccaccaagatagcttgtaacatgattcataattgcagcaacaatctgacatatgatacacaattgcaccgatgattgagcattttaaaaaaaaagaagtttgggtcctacagacatacagtggaaaaaatgcagcacgctgaatgatgacattatcattccattcttttggaagaaatcatttcatggaaggcagcaatgttgcactgcatcagaaaaaagaagcacataaacaatcttaattgcccaaatacaatattacgtagttacatgaatggaaaagctactgtatcatccaacctgcaagcttttgtgtacatcattgatttattttcctaatgatctgcaacagcaacagtgaaaaaaatgattatagagatttggtgggggcaattagatgagatgaaggaaggggatattagatataaggatgtaccgtgaataatggcactactggaactcgccttcgatttagcacaacactaatgaggtaaattagaacatggacaaccagacaactaccctacccctgcatcagaaatatgaagctgcacagatgagcttttatctcagctgtcataagcagtgaagaaaatcaagcaaaacttgtaattgtaccaacgagtgagatggacagatggttgcacctcattaaaaataaaaaggcccaaacctcctgtcccacctgatgctggcctcctcctttgttccccatcacatcgctccagccgctgctgccatctctcccgcgcaacatggtcagaaatccggccaccctcactgcatgcaaaattgaagctcatcagaaatgactctgtgcaacaaagaacaaccaagcaactcctctgagcacggtcttgccacctcttaattatcagtgcatagtgatgtaaacacattcatgaaacaaaaaaaattatccacagccagagaaacaagcaacctttgatcgtgcgaacacgataaaggatcagtcattttgtgcagctccattatcctcatatactgtgaataatagaatccatacaaactgggatcgtgctgcatcagtaaagaatcggggatgagaggagatttcttcctgtaactcaccgagatggccactgggaagagccttggggatggggcttggacgccgccagccacctgcctcatgaccgctacgagcagttgtagcagctagtacacgaactgccaccatggttgcgcggccattgctgtcatcgattgaaccggcaattttttctctgttgtgaaagggatgaacaccgcggcaaagacaaggggaaggaggatctgagacccttagcctccctgttgtggccgattcgtccccttgtcatcgttgacaatggtggcaagctgctcaaggagagctcgattctgtgtccgctagatcaaccacaagcaaaagtcagtattgcttgagatcacaacacacaatcatcacagctgcacaccttggcccttggggcgaggcggcccatgagagtggcggtggcattgccggcattgttctcctcaatgaaactgattgtggagttcattatgagcagtgtgatgatgcccacgaagtcctgccagcccggcagcttccctgaaaacaccaaacaaatcaaccctcgtcaattcaatcaaac

SEQ ID NO: 94384 - DNA, 1125 bp, Oryza sativa
taatgcaagtcagtgtgttgaaagcgaacgagacatctagttaagtgggatggttcagtgagtgaggcaacttgtatgatcccttagaccctaatcacagtctaacaaggtggctataggattaactgcaagaacaatgacttcagtcgtttgttttcattccaaaaattcacgaaatcacactactacatagaatctggatctcaaaaactattttgcaagcaaacagtaactatatcatcacaggttgcaacttctgatatattctttttaacaatcaacttctaataaatttctcctacagttccaaaacatatcgattatgtctctacatcgaatcagttgaaatattgcaaaataaatgcataaatacatctttcaaatgaaatgatacttacttccgccgcatcatcttctccttgtagtagttcttcttggacgacatcttatccaataagccctagcaagccggcggtgggtggggtcagcggcaggggcagaaaacccgcgtggtcaggaggcggcagcgcctagccgccggagacggggcaagctcggcggccggggggcttctcgccggcgctgaaggagacgagacgacgaggaaggcaagctgtgcggcggcagaggaagagaggtgggggagacaacaagtagcgcagctagacgtagggagagtgggggggggcagagctccgcggcggccgggaaggcgagtgggtggaggagggagggaaacgaccgaggtggcctcgccggcgccggagtagcaaacggggagacggagacgacggcctccgatgggaaatttctcgtcggaggaggaggtaggggagtccgtctgatttgcgctgggccgcggccgcgagggtaggatcacatgggctattattgggcttcgtggcgcacggcccatactgatccaaaaaattcggcccgctatctcaagtggtcgaactaacctggatccgatccgatcgtccgcgcgagtcggaatggaggtggaattttcctcctccatactggacgatccattcgttcgcgcgtttgtttggattgcctcttcttcctcccgtctacgactacttcttcacgaacggcctcctcttcaacgatcaggagaac

SEQ ID NO: 94385 - DNA, 586 bp, Oryza sativa
gagctcggtaccctttttcttttcgtagtaaaacaaagcaaattacgggctgttctgttataaaaatggatgatttttatattatcactgtttcagctcgaaagcatggccatcccgttctttttcccttctgcaccggccaaaacgcagaacattacaactgtcaggtgttcatggcactgtaattcctagtacaaatacagttttacctctcgcaggataaactataagtgtctaatagcatcaggcacgttgcttcttcccacttggcatatcatcatcgtaatgcccgccatcatgccctccatctttgtcacctttctttctcgcaagtatcttgttgattttgtggaggtcattcgtgagcttctggtccttgttctgcttccttgtcttcctgccatcctgcatttttaccccaaaactggaatggaaaccttcgcatggctttcctttggtccgttgaatgtggcccactcctttttctgtctcaaagtcccccctgggaagacggccccttaacctgcaaagggaatcatacatttataatgaagcctggaataaggtagtatttagttttttaaaa

SEQ ID NO: 94386 - DNA, 841 bp, Oryza sativa
tggcttgagcagggtcagatggtgggatgggcccatagataggtttctcttcagtgaaataggactgcttctgatggttatgtggggactcatccatatcttcagagacagggctctggctcatttccttgttaggaacagaatagtaaaccccatctccaacaaaaatgtcatcttcatctgctctagcaactggagcagacggtttctcatttttgcttaaattattatttcgagggggtggcggcggtggcatatccttttcaaattgatgtttcagagcagacccattagtttggccaggtctagctacctcatcgtagtcaccacttgctaaactgttcttccctgcgtaacaagaatcaagatatctaacttcatcgagcaaagcaagtgaagatatggatgagaaagtacatacattgcaaatacattaagtgaactaattaattcgttcataatgtaaaacaaacgtgtaacatatggtcataacttaaaatacccaaacttaaattattgacgtgagactataaaacaattgaaacaagactcaaccattgtggaaaaaagtaccaatcatacttttcttttctttttttcacaatgcaagtatcagcttccaaacaaatcatttcagcgtatttcacatattatcttaaccaagaacattttcctaatgtcacttagtttttcagtcaacttccactgcacaaaatccattttaattttcaagtaacataccttttgtgtccctctcctttttctttttcttcaagactttcccagatgatccaagtcgaaggtatgacatgatttagcaatcctatcaagtacagaacca

SEQ ID NO: 94387 - DNA, 756 bp, Oryza sativa
  unsure (1)..(756): unsure at all n locations
gaaacgcatcatatagggcgaattcgagctcggtaccctagtttttaacgacccacgaaaagcggagcgttacagaggaggcctggggcggcgcgacggcatgcggtcgtggtggcggccggcggcgaggcagcagctggctgcggctaggccggcccggcacgggcacggaggcggcggacagcggcggctcggcgtggaggcgcgcggaggtggcttgtcagcggcgggcgtggatgcggcgaatggccgcggctcgacggggccgacccgggcgcagaggtggcaggcagcgcagcctgcccgccgcggcagccgcccccccctcccctcactcgctcggcctggccacccggcggcagcccatggcgtggtgggtcgtccaggcctcggtggtggctcggcgtggtggctgggcagccgggatgcccgcgccgtggccaggtgtggcaccaagaccgggacttgggggccgccggttcggagcggcagcgccaccggcggccagatggcagtgcaaagggagctggcggcggtgggtcgtcttcctcgttgccggtcggcaccctcggccttcatggagctcctccccttctttgcggggagtttctatgttggattgaggcggtagctcctcagtgggggaagctcangctaccgaagcaatgccacctagtcccaggttcttcttcggccaaatctagcggagcggcccgtgggtggtggaacggaggagtctgggcgagcttctcaggg

SEQ ID NO: 94388 - DNA, 1339 bp, Oryza sativa
tggcctcatgatgcatacaaagaaggttgcaaaattgggttcccaaatcttcatgctatctcccacttgttctatttctggtttatgacgattatattctttcaattgtcccatttctgtcttacaatataattatctgatattgtttcaatatatggatccatcttgtagagcctgacaggaatcaagggattatctgaagcaaaggtagacaagatctgtgaagcagctgaaaagcttctggtgtggttctcttttcattgtttttggtctgaaatcttcattacgtcagttctgtatgatttgttcttctgaaactgctatgtttgtttttctcagagccagggcttcatgacaggaagtgatctccttatcaaggtaagttaataggagctgatctgcgtactaatgcatttaaggatatggtgttatggcaaataagtggaaactattccttgcttcatggacgctagagtgcttttagttactccagctgtgcactttccctaggctgttcggtttattatttttcttattttgaagcggaagtctgttgttcggatcaccactgggagccaggcacttgatgagctgcttggcggtaacatatatagtcctctgactctgttatgatcagttgttccattatgttgttctaatctacttacatttttcaatttttcaaggagggattgaaacactctgcatcacagaggcatttggagagttccggtgcgtagatgttcatgttccttttgatattttttgccctcgtttacaactgcagcttggttgtatcaatgaaatttatgatgtgtggccatacctgtctaataaatatggtgaaatcaagcttactaatactattagtattctggtttaagttaatttgctagtgccttttcaaacctgttgtgcacccatttctatcgtctattcatgccagtgcatacagcaattcctaaacatgttctgtgttctgctaaaactgagagcttaatactgtacttctcatttgtaaacttcaggtatatacacatcaatattgtcaaactatttcctttgatgttataccaaattggttctactaaacattacatttagctgatttatcttgttttgcaacaaatttgatgtatgatagagttcttcctagaattgtatcgcgtggaacaatttggatttctgtagcacataaaacatcttactatttaattttaatgtgagccagccaaactttgaaccttgatgtgctctggagttagttttcactatttctcaatttggttccggcttcctagctttgtaatctttcacttttttggtcctcagatcaggg

SEQ ID NO: 94389 - DNA, 1630 bp, Oryza sativa
tcggtgtactttttccgcgtgccccacgaccgagttcgaacttgattccgtctccgaacacgatcagcatatctccctgcaaagctcttcaataaatctctctctctctctctctctctctctctctctctctctctctttgtttattttgaaaaaagatattccaacaataaatcttgcagtctaggtggtatcactgtatatcaatctgttcgttctgccggaatatggcgggtgaagaaccatggtcaagcgaggcctccgacgatgtccccgacacatcgcacatgtcggacgaacaatttcaacagttcatcgaccagtactgggcagagcaaggattcaacatttggagttggattcgtgcttccaggacgtcgtcaagctccacgccggggccaaccaggcggacggcggcgtcatggcaggccgtcactttcgacggggacggcgtcgcgcgcttctccggcaactccgaccgtagcggcggactcgacgaccaagccaccagcggcttcagcatcgtggacctactggacggtatcctacaagcggatgacgacggcaatggcggtggagctacgccggcgtcgagcatggcgatcgtaaacctgccggagattaccgtcggcgacgagaaaggcgaggcgaaggactgcccggtgtgccttcagggcttcgaggagggcgacaagcttaggaagatgccgtgcgctgattcgcactgcttccatgagcagtgcatattcagctggcttctgattaaccgccattgcccgctctgccgcttcccgttgcctgctgagacggaggaggatgaagaggtggtccaggcagagaacgacgacgacgacgatgatgaagagaccatcctatgtctgcatcgactgttcgctgatgcggctgatgagtatacgagttgatcagcattgagagatgcaatttcagtttttgatgtaaatatggatctgaatggctggaattgttcattacacaattatgccatgtgaaaagagaatatcacgattaattaagagaatttttgagattgctaatgcgcgcgcacgcgcgagatcagcaagtcacgagcgtttcggcgtttgacatggtcctgctgggcctcgtgacttcggaatcgctaattcgcgcgcctcctcccacgccttttttacgtttttttaccgatttttttcattttttcccacttttttctgatttttttaatcttttagcatgttttgagtttgaaagtttttaaattttgagtagaaaatttttaaatctgaacttgaaagtttttaaatcttgagttgaaagttttcaaatctcgatttgaaagttttcaaaattttcaaatatggacttgaaagttttcgactctcaagttaaaagttttcaaatctcgagttgaaaattttcaaatctcaaattgaaagttttcaaatctcaaattgaaagttttcaaaatttttaaatctggacttgaaaattttcgaatcttgattctcgagttgaaagtttttaaatctcgagttgaaaggtttcaaaatttaactttaaaatttaaaacttaaatcaaaagttttcaaatctaaacttaaattttttcaatctggtagtaaaaaaatct

SEQ ID NO: 94390 - DNA, 3732 bp, Oryza sativa
cgtcttaaaaaaaaaaagacaaaccctgagttttcgtgttcaactttagctgtccgtcttatataaatttttttataattcgtattttcattgttgttagatgataaaacataattaatattttatacgtgacttgtctttttattttttttttcataattttttcaaataagacggacggtcaaacgttaggcacggaaaccatagtttgtttttttttggacggagtgagtacgagcaaggaacatggctgattgcatgattgctccgacaggaccgtgcccaaacttttgcaaccctttcacgatcgcgacagcctaacagagcagtagtagcatatccatcgcctacagagaaaggtagataggcccatatgcactcgatctcatcagctagcgtttcaagatcagttatctgtctaccaatctctcgatcgatgacgttactgctgcactgtactgtcaggtacgcagtacgaactcgcgtcggcagggatggaggcaagcgagcgtgcgcaatcggtcgcaaacagcagctagggacaggtccattatgtgatccgtcgagagagaaaggggaagcagcacagagcactggagcagcgtcggctctgcagttgctgtatgttactgagatggttgaacgagtggtggtgattcttcagagttcaagctagctagtgtgcaagatggaggcagatgtgtgttggcttactgcatctgaactatgcactgtattctgtttcgattgcacactcatactcttaggtcttttagacagtcaatagttgcatcctgtgaatgtgaagtctgagatcatgcattcactgctttcttggtaataccggatggtcaagcagtcaaactttcttgcatgcaggtcccgtttctgagcatcactgtgtgctatgctatatgtactgtagactgtagaactgaacttgtcacagaatctttccagtctagaaaaaaaaacactaacagtatcaagattgataccgagtgatgttgggctaacagtttatgatagtggtatgacaaagactgccacccaaacacagtggaacgaggaaacggaatgtgacctttccccgttgctcatagaacagcatcttgctgatgatactgtaggggatagccatataaacgacaagatgataggactagctaagtactactagtacacaacaaaatgttgcttgtaaccggtatccacagcattttaggtcattttacaagcagcacaactctgctgcctactgtttacataccaagttacagatcaacaaaaaagagggaaatgcactacctatgcgagaactatttttctataattttttctatgtttagtctttcttccaagataagagcagctgcaaaacgacctaacgtcagcaaattgattctgaaagcagccgaagattgatagggtatcctttgagagttcgtgtggtggggaagaagacaagtctatcttcttcggtttcttcccagctgcaaattcattggtcaagttgttatggaatcagactggtgcccaatttggatcacaatgtggaaaatccatttgcagattatctacacctttctggctagcaagatagcgattgaatttgagagattaaggtggcttacctaaagcgcgttacaagatgatggaggaagatagaaacgacaacccgggcaagctcatagccaggacacaaccggggtccaccgccaaatggagtaaatatattggcccctaccgcattctgaagtttattgttgatctgcacaggaacaaatttgttgcagatagcttcagcgtgaattttacttttgtagcacaggacataattgaataagtagacccaatagcaataacacagagcccctaggagtacctgccatctccaagggttaaatgtccgagcattctcgtagtgttcattattaaggtgcacagctcggaatgaagcaaaaatcttgcatccctttggaattgtgtaatctaagaaacaaagaaaaatgccatacataatgagcatttctgatgaaaaatgtatggggatttcttttagataatgaataaaatgtacgtggacttagtatagtttatattgaaatacctttataatgaatatcagtgtttgctcgcctgaatactccactaataatgttacccacacggagtgtctcatttatcacctgcagaaatgttaacccttcatttaatcatgatgtgagtaaaccaactgtaccgtttcaaaggttcagttaagagatgccatttacactagatggattcgtgctgttggcatgatatttttaggagtagctaatttttaagaaaacaagggctttccaacttacacattgagtaaatggcatggacttgtaatcgctccactctagtggttgttttttccctttcatatccctgatattggcatgctcttcctgtaaaatcagcaggatatctggaatcagttacacatgtagtgaagtaaaaaataccacttggaccaatcttgaggactctcaaagcttaacatattggaaacaaaacttgtaccaggaaaagtcatgaagttcagatttctaagatttggacctattgtgatattattgctacgattctctcgctttgttgttagactgaggaacctagcactcatcaatgcaagtaaataaaatgagaaaaaaataaaatgaggaaaccagagtactgactgaactgaagattcattcttacacagttaaactaaaagaagtcaggactcaagaacataaatggttcgagtcaataataaattaatactcaggatcaagtattcaagtcaataacaaaccaggaacaaagctgtagtgaacttgactaaaaacaacagaccggaaatagaaagtagaaacttctcttttggacagaattggtgtgaaagatagtctaacaaccatatttttaacaattaacactcaactataataaatgaaattcctccctatttcaggcgttatttgacaattgacagcacctggtacctactaccgcacgtgtatacaagaattgacaattactaccaaacaactaatttaaatagttttataccttgagctcagctagcgcagcaggcgtctcagtgaggaacttgaccgcgagcgtcatgagcatggacgtagtctcatacccagccaccagcagagaaaggcagaaatccaccatctcttcctccgagaagctgccaccctccgcctcaagaagctcctcaaccatgtccttcttctccttcttcccctcatcatccccaatggagccaccattctccgctttctcctccatcctcttctttatcacctcccgcagtgcaccggccaccttcttcctcgcctgcaggaatcaaatcatgcaatgccacatttttatgagagatataagagtacatcaatagctgacgccaattcgttgtaaggcaatgtaagatgcatagggaaagattaaaaaaaatgaatggaggcaaaagaacgagcaccttgagggcctggccgtaggtggtaaaagggaggaggttggcgagaggaaaggggatggagaaaaagccgtcgatgagcttgacgtactcgcggcggaggctcttggtccacggtcccggctcgatgctgacgagctgcttgacggtgaggttgaaggtgattttcttggcctcgtccatgaggcgcacggtggcggcgggctcccactggcgcatggtgg

SEQ ID NO: 94391 - DNA, 3210 bp, Oryza sativa
ccttgttagggtcaagctccatgcgtgctttgttatatgcatctactgggaaacgtttcctcaacctagcctggagttcagcgagttcatccttatccttaggaacctaaagagaaatgaagaaatgttgatcagtacggtatggatattgcaaacaaagcggactggacagtgctatcatgcatcatgctatgaatacaatgcaagggaggtcattctctcgaaattaacatgtctgacgttgtttttttttggcggtgaacatgtctgatgttaatttcaaccattctgcagcaatggactgtactaacaaacaataaataaaaatagctgcccagatcttgcatcaagcagtgaaagttcgcacctcaattttggcccagtgttcatatgcagaataaccatcccatagatttgtttgcgtcttacttctgtaattaaaaatttcctctgtaatttccttcctttggcgagcatccgacgttgggaggtacattattatcccaacctgcacattgatcacaataaatcaggtcactaaaactgatgttacagactacaaagtgaaactgcataatgttggacatttctcaaagaagaagcactactacatcagttgacagtaccgataagaaaatctcgaaaaaagagaaattgcacagttctcccggaaccagttaaatatctatatacagttagttgcctaccatgtattcaataaatattgctcgattgtggtttataccttagaaattctagagggggcatagcaaatgttgcagaacatgtgaacagatcatctacattgaagttgaagaaaatatttttcgtacatgtaaacagagtaccattgaagcaagagggagcatcctctaaactatatcatatgaagaaactagccaaattccaagtgcaatcaatgtggtaatttcgagcccatgagagcaaatgccaaaggttctttttctattgtttaaatatgtttaaatatgtaataatatattataagaaagactacctatatctatatgtagacacatttgctgtcagaaatgcaaatgatagctattgtagatttgtaggcagaggaactatctgccatcttgtatatcaattgcccagtccaactgtttaccaagttatccaatattcattacaacaggaaacaagttagcagtaaaatatataaacaaccagaggtggatggtggcaacaaggaatccttgttaaatataatgaaaaaggtaatgtgcagagcaaattacccatgaaaatatgtcatcttcttgagagcttgatgctgggctcatgggactcctgctgcaggcagtccaacgctgctcaataggtgccggtgcgggtatatcttccttctcaatcaactgcagcagctcctctatataatccagatccttcatattaggctttgctagggtccctgcagggaagcaagtttcagaaacccactgctgcccaccacaatcaaagcctaatatttcgtcactccagcccatgcgataaccctctgacttcttccaatattcagcttctgctttgttaattctgatcacatgatctttgtctagaggatccagggtaagcaaccgatccctcaattcagtgaatgaaagctgatctacttctgggtcattactttctgctttagttctgaaaagcatctacaagatggcattagctagaaactagtgaaatgctattgctgagtaaagctagaatgtttagtgcaaaagaaaaaaaagtaccattgagtagatatgtacagtgcatacagctacaggttgaatgcagtgcatattgttttgaggtagtacctatatttcttcaatgactcatgataaagatcacgaacatgttgtatagcctcatcctttccatattttgaggtaaactttggagttctccaccttgaaggaggattgcattggacaacaacaactgtatcggtgtatggaatccataagtacttaatatgtttattttcagagagccatttcctgagaaaggaggggagtgaaagaaagtcagttttctccagtaaatgatgacaaaattgataagcaaaccaattccagacatccatttaatgatcagaatgagataacattacttgtgatttttcttgacttcgtctgcattggaaacgaaagtgtgttcaataagttggtgtctttccacacattgaagagtaacttctgctacaactccaaggccaccaagtccacagcgagcaagatagaataaatcaggatccttctcccttgacaactctattgtccccttggcaggggtaaccaatttcatgctaataacttgttcatcaattggtggcaatcttgcaccagtgccatgggcaccaacctgcaatcagtcatgaaatgatcatctgattccgaggtaagctgtacagaaatgcatatggcctgaactgcatgttaagtcccatctatttattctggtttgagtaatactccctcgtttcatagtataagttgctttgaattttttcctagtcaaacttgtttaggtttgaccaaacttatagaaaaatttagcaacatctactataccaaacaagtttcattaaatgtaacattggatatattttgacaatatgtttgttttgtgttgaaaatattgctacatttttctattaacttgtcaaacttaaaaaaaatcgactaagaaaaaaaattcaaaacgacttataatatgaaacggaggtagtacttctttatcctccctacctaatccacaaacacatcttccctaacaagcttaagccaactttcatcgaagggaacaacatacagtagatcttatttccatcatttcaacagtaaactcagtgaatgcttataaggtagccatgtcattccatacatgagaatcaacagatatgtgataacagagtgacaaaaaaaaagttatattccttgtccaaatacaaggaagaacaatagctgcggaagttttcagtatatcggaatgcaatgccatgttaagaacaaacagtgaatgcatttctagcttccccaaattactatcaaatgcataaaaaattacaacaagattgtagagtagagataaccgtgacatttttccgatttgttactttttgttggatgactatcgtctaatcagaaagcctctctatctcaccaatttatctgggaaagttctattgatgtc

SEQ ID NO: 94392 - DNA, 1928 bp, Oryza sativa
aagcccatatatctaaaggcccaatggctgcaagttagtgggccgtactagcattccgtgggcccaagggctgcccgactccgctgccaaatcaaaaccctagcttagctttcccctttgctcgaggtaaaaaacgatggcgcccaagaggtagccggacgacgacgacgtacgtgggggaatcatccgacgagttcgcaaatccattcgacgacacgatgcagttcaccaagccggtttacctcgtggcggtgcgcgacgacgaccaggcggccgcctactccgttctgaagatcgatgccgccgccgttgccggtaacgacgagccgcggcgcgtccgcgccgtcgccgtgctgacgaccggcaccgagcctggcatgtccttcgtcacggcgcgttcgaggcacgggtcgtggattgtcggcgtcgccggtgggctaagagccggcaccatcatcttcgacccgggcaccatcatcacgcggctcggctaccccaagcacaagcccgtcttgatctcccatggcagcgaggtgtatgccatctcaggcacccccagagtgaagccctccatggactgcgagccatggtttgaatctctcagcttcaaagatggtgtcccctccaaggagtgcggccgttgggtctcatggcatcacctgccgccaccacccttcttcccgtgtttcttgaatccctatgaatttcgcaatccacctgaaatttttcagtctcatcctatgctgtcattggctcatacattttgatttccccacagccggaactagtggtaggtacttacgcttttcatgtggtgaacaaaatttgggagaagatccatgaaaagaacctgccttttgttggtcaggcagtgcaccttggcggcagcctcttcgccgcctgtcccatatccaacactgcctcaacctcaacatctgcctctgtgttccacatgtccatcaaaatctcctcgtccattccctcattatcaatccaaaagttcaaggtgatggcatcagtggacaagattaccttcccgctcttctgccccatgggaatgggcagcttctgttgcatcaggttggggccatctcgtctccggcacagacgaaaaaccaactatcgtcgctggcgcagcccaaaaaccagctgcttgaaggaggtccatgttatctcgactgcctttcggatagagaacattgaagctatcatgactcattgtcagtcccaggaatctaaggctaaggatcagctacttgcactacaagtgaaggaacagatgcattcatgcgaatccaaggaaatacatggtttgctgggttctggcattcctgtggttgctgccctctccatgtaagcacatgaggagtctccctcttgttcttatctattatactcccatttagtttgtgattttattcaagtacacatccgaattcgctgaaacaagacagatatgaatgtgctttgactcggtccaatttgaatccaatcagtttttttttttgagaaagagggcgaagccctcccatttcattaacgaaataaaaagatccttgaatccaatcagttacaggtgacaaatttcacaacaatgtgttactacatcagtaaacaatttgctactagtataaaggttaaggcatcttcactgtaggccgaactactgagagtgatcacctcattccagttctgtcggcttcttcacgtaagttgggctttgtcgaacagaactagacagccagactctgtccattctgattagtgattacttgtgcttctgagcccatcccataaattcacaattgtgacttcataattaatatggaacttttcgcattaacacaataacacagattatacaacagatgcaatgaactttctgcatgattcgtctccacgtctccagaaaaaaaaaaacaaagagt

SEQ ID NO: 94393 - DNA, 698 bp, Oryza sativa
tcgagctcggtaccccataactgaggtggacaaagacggccgacctagtgccccgacagaagcagctaagaattttgtacgccacagcggttgggttgtgagggacaacgtgcctgtcagcatggtgtactggcgcagaacaagggcacgcggggataatgacagctttgtctaggactcagagaaagagatgttgtgaaccacaatgctcgagacgttcacgctacccgcaggtacggagaacataatgaaacagtggactctgaagaaaatggcaaaacagttccagagcttcaagggagatctctacaagaaatacatcctgaagggattaacaccgagcttcgacgtattcccaaagctaagggatcattgggacgagttcgttgcttacaagacagggcaacaagggcaagtgatgatggccagaaacaaagaaaatgccgccaagaagaagtaccatcaccacttggggtcaggcggatatagcgtcgcgatgccgaagtgggaggagatggaggctagcttgcttgagaggggtatcgaaccggccaccgctaattggctggaacgatcgaagttctggtactatgctcacggtggaacgcttaacccagttgatggctcccttgtcttcagcgatcagatacgcgaggctgccagtcgactaacggacgcagtggtagcctcttctcagg

SEQ ID NO: 94394 - DNA, 1153 bp, Oryza sativa
catgtggtactgaccgttaagcaccggttctgctaatttgggaaaatcctttttgttgatcttggggatggcctaaaattatgcatcaaattaatggccaaagaataactcgtaacaaagcatgtaagagccataatggaagcaggtaacatatcagctgttatgtctcctttgtaacagttgtatcttccaattttgcttaatattcaaggtacacaaagataatagatttcccccaaaggatataagttgaatgtgggggagtaaaataaaccctggatgaagctagaatctaaaatcgatctttactggctacttctctcatgacataatatgtaagactaaaaaaatcgcgactgccatgatgagacgaaataaaaataacagaagcacacccgtctaagatgatcaaatagttgaagtaattatataaagatagtgttatgtgctctttcatgagcagacttgtgcatgcaggagaagcaaataacacaattaagttaaaacaggaagaaatggcttacccattcaacaatatttcgctcaggcttagctcgactgtcatctataaccttttgtcctgtgatgacctccaacatgaccacaccaaagctgtaaatatctgactggacggtcagtttaccactctcaagataatcaggagcacaatatccaagtgtgcccatcactctagtcgaaatatgagtgtcatcaccagttggacccatctttgccaagccaaagtcagaaagctttggatgatatccatctccaagcaaaatgttttcagatttcacgtcgcggtttatgacgggagggtcaacattgacatgcaagtgctgcaggcctttagctgccccgacaagtatcttgatccttgtgttccagtcaagaggcttcttatcaggggaaagatctggaaaaattaagacccagttctgattagacaaacttctaattatttagaagcagtgtaatgaaggagggaactatatatgttactagtttgtaacatactaacataccatggagatgacttttcagggaacccaaaggcatgtattcataaactaaaagcctctgatcaccatcctgacaacagccaataagcttgacaagatttgtgtgatgtagtttactcaacactgaagct

SEQ ID NO: 94395 - DNA, 871 bp, Oryza sativa
accagcttgttcttgaggaagttgtacgagaaagatgcccaaaacttggttggtgtttcaatgatattattactacacttgtccttttgtagcattctgcatttcacattatcttaaaaaaaacatggtcctggtcatgcttttgtattcagttgaaatgttgagatgactttatttgtttgaacacataatgtatcaactttgtggtgtatcactctgtacttacatcaattacaaccctctttcagcaaagcatatggatttcctgggagttcaggtggcatgggtgactggaccatggtttctttcaattttcatcaatatgcttccatgggaaagtggtcaggttttatgcaatagcttggtgctttcattaagatatatactcatacttatacatttgatgttcggtaccagtcccttaaattgaacgaaacatgcataccaaattgttaggataatgagaatcccgttctattattttttgaatgttccatattcttgtcatgtatgttaataatttgttaggtttaacatcatctgattgaaacttttgcattctcttagttcttcgtgtttgggatgtgatcctttttgaaggaaatcgaacgatgttgttccggacaacgcttgctttgctcgacttatatggtataacttaatccctgaaaaagctattgtttcctattatttgttcttttctaataagcattgatgtgtaagtgtaatctacactgttgtctttgtatgttgatttgtagggcctgccctggtgaccacaaaggatgctggagatgcaattacattattgcaatctcttgctggctctacttttgacagcagtcaacttgtgttgacagcttgtatgggt

SEQ ID NO: 94396 - DNA, 730 bp, Oryza sativa
cgcttgtttgtcattgaacctaagaatacgggtaattacattgttatggctaatttatactcaaatgctggcaaatgggaagaagctgaaaccataaggagcatgctgtggggagttggattggagaaggttcctgggtgtacttggaattgagggagaacaatcgcttgcaagttttattcctgtgtttgccttaaagccgaaagctacacacattgatttggttgttgaggggttaaatgggttgaatgatagaaaagatcttgacatcaacctaagagttggatgaagacaagttatgtcgatagcattcaatagagctaaaagttgaaatgtgattatcatgcctgaaagcacatcggcattttggaattatttggaccatcggattccatacgccattatgtggtcaattatattgatctgaccaattatcaaaccctaggatgacaaaggaaaatgagaactggaaacaataagagctttgctaccacaatcttcaaacctttcgaagtgtatgatcttgagctctaatttttaataaggccaccagttactacagcaacaggaaagtcaatgattacaaaaatgatgaaagcagttgcattctgatttgaattttcaggaagtgcctccacaagttaaatctcagtgtttgatgaaacaccaaaagagcagcatacaaaagttagttcagttcatcaaaagtagttgttctagcttcagtgtt

SEQ ID NO: 94397 - DNA, 771 bp, Oryza sativa
actaaatgaagtgtctcctttgttaaactaattttctgcctctcctagctttgcatcagatatgttgcccaaacaacttatttcagttactaactctcatcttgtttacaaggtttgggactggatcttcaaatgaaaaggcggaggaacaaaagaggaagtccagggctgagaggtgtgttaataccactatttgcactctgctattgtagatttttcttattccccgtaatgccgaactgatacatagttggatgaattgtcactttgtcagatttggccttgcctcatcttctgctgacgaagacgctaagaaaaaagctcgtttagagcgatttggtcagagtacaaatgttcacaagggggaagaagaaaaaagaaaggcacgagctcttaggtacgaatgtggcagtgctatatcattcttgctaatagaatcttaacctagctatcagctatagctgacatctcttcactactttcccaggtttgcagaaacatctagtggaccatctcaagaaaatggcaaagacagctccaagccggtaagtttatcatggtattgtgtgtaacttttgcttcttttgtgtgtttttgtatccgacccatatgtgtgttgcaaacgcaggacgcggccactgtggcaggcacggcataatgggagcactccctgccttttgtgaggttatatattgctgctatcatcctacaatatttcccattgccaagggcttgttgcttgacatgcaaagtatcactccattcttgcag

SEQ ID NO: 94398 - DNA, 11864 bp, Oryza sativa
tcaagtgcaggtccttctgcagatagtgcggagaaagtaaaagggcctccccaaaagaagccgacaacaataacaggtaaaagacctcacgaaccgtatcttggtcaaattattctgcttgcccattgactaattccaagcgcaaatcctataatcattgaagatgaagagaagatcctaaggataaagtctgttgaatattctctaccatcggtgaagctctcctggcgtgatgctaacgggatcacacatggtgtcatcctcaacaagcagaaggaggaagatcgccattgttggtgaagagcctaaatgactccaccaggatgttgaatgtaagctttaatcttctttgtcttctgaaatagtccttgtatgaaaactcatagaaattcttatcctaatgaagagaatatggcgtcaatctcaagccatatccaaaaccctagaaaagcgggtggcgcacttggacactctggaagatgttcaaaaacaactaaaggatgccaaggatgcaactaaagctcgagaggcctagttgttgacagaaataaacaacttgagagatgccaacttggagcttcatggaacactcggaggtaagtgtaatgccctagaaaagaataatatcgtagaagatattttggaagtccatatgtatttggtgtttgaaaaatagaagaaaaaccttaggtatactctagttgggctagcttctggctagcccaaggcccagttgccctccgcattcccaaaaccctacgtaggggacctcctagggttttggggaaaggtgaagaaagaagaggtgtttttatgttgccgctgctcatcgtgacctaggtatgaaaccaacgatcttttccccctattttggttttcttttagggtctagatcaagtgttgtaagcgagtaagttaggatgaatcaatttattcctcaaccaggtttttgctaatctgcgcctacgcattactatctcggctaccttttcggccaacataataggatttcctacgaaaagtctatacaaaagttgtagataacgtgtagatctatcttctgatcaaatggcatgattttatctagagaggtatcaatttttgaagttggctgtctaaataatcatgcattttttgtagtcgagattcagagggattttagagggtcttaatgatggaatcagagaatcttgtatttacaaaaattgtagcatgttgtgatctacctcctatataaaaattgttagcatctatcttgtagtttaggcttcagtggctaggtttcttgtgaactgggggatccgcttgggagctatggttttagtgatgaatttttctgttttgttcttccatttgatgtaatggtgatgcaaacgattttatttgaattttaggtttgatatgtggaaatgggatgattagatttgaatttcgtttttgattcatggaaatgggcagttgaatgcatgtggtattcttttttgttgccaaaatccatctacactggcaatcgccttaactcgctacttgcaaaaattggatttccgcaaatgatcagttaaacctagctgcttgcaaaaacaattttcgctggcggctggattaggttgcccgccagtgaaaatggtttttccctagaggctggtggccggcattgaaaatagtgtagtttcaccggccattggttgatggcggcggtgctggccatcatagaaaacccaaactagccgtcaggaaaaatcaattctgcagtagttggatctggtagatgtggccctcggcgatgacggtggtggtgtcacgggccatagtcaaagaactcgtgcggggtgtggagtaacacatacatccattttcgtagtgagtaaaataaatctattcgaatagtcgtgctcacacttgtactactctttttatagataatggaattgaatttcggcttttgctttaagaaagctataatcacataatacaaaaatccgctcaacagagagcacttgtactactctttactagccttagaagttttaatcttgcttaaaataggttttgggaagaacatgtgaccagactcggtatgcaggaaggttcgaattggttaaaaggtgaattggacacgagggtaaactaaaccggataattaatgttgctttcagttaaaactgtcaagttataggtttatcaaatgatttaaaaaactagctttgtacaaataaccaagttatccttagatccctatgtgcactcatgcatcttgtagtggtggcttgttgagtactccatccgtcataaaatataaaatataagaatctagaattggatgaaacattttctagtactacaaatatgaacaggctacttgtctagattcatagtattagaaaatgttacatctagttctaagtttttatattttgagatgaatggagtactatgatactcactctttcctatttaactcttttagaggaaggtgttagagacaaccgtgaacgtgtcacatggaatatatgtaccatcttctgatttagtaactgcaacaagctaatataccggtcatcattatgttgtcatgttgcagctagcgcaagtattccctcttataggatcgaacacaagtaaccaagcctaccagaggggggtgaatgataggaaaaaccaaaaaaccaaaacttttagcggaaataaaagttaccctcaacgtagtcctgtcgccgccggtcggaccgctcgcacgccgccggtcggaccgtctccctgccgcctgaacccgaaaaaacacaaatcgaagaactctcaaagtagataacaactttattgcttctatttatgtttacaaagtgtaacaacagcactccttacaaaaatctcgactaaactcgaaaccctaactaaactatcaactcaattgctctcaaagcgataccaggaggcctcacgctccctctctatttataaaaaaaaaacccatactcaaagtaggtgtataactcctattcataataggactcaattccacgttaccaaaatcatacgagccagaatcctatccccatccatatcggactctgcatttgatctccagcccacgtaggcccctgtctccagctcggtctccagccaactgccaccgagccgctctctgctgcctgggccgactcggcttgccagccaaccgaagcctccagcccaaccaactagctgcacctgcgcatgtcctgcatgctacacaagcatacaccacgatacagtatacacacatatatgcatgctacagtatcatatgtactgtagcaccatatactcctcactaatttccttcaaccaatttccttcgcgaacaccgacgcttgcacgcacacctcgtgaagaccgttacgaagatctctcccccacgatgtccatccactgtatgccatctcgtatccaacttcctcactcggtatccttgaccgtctggacctcaactcctccctgagcctagtcccgatccccaccgttaaccgaagttgacctccaagaatcctgactctagtcacctgctcacatggtatcccgaccgcactagacctctgctccaccctgagcatagacccggttctcaccattgaccaaggctgacctcaagtcacctgcacacaatcagataaaacaaccgtttctgggcacagatatcacaacctgacccacattagtcacacgcactcacaccaacattcacacaaactctcaaaccaattctttgattaaatcatttgcatagccaattgttcatcataaatattaatcataacaatgatttcacacctttgctttcaatactcgtagttattattcacctttttaactttaaccattcgtcttttccacataaaaattatatgtatactgacatattatggatcaatcatttaaaaggtattaatgattagagttaaaacactaatggtcagcaatgacaagtactcccttcatagcacatcccagtactattaatgagacataaccctcctaattcatagtaaaagaatgtgcatccaattaaaattgcttatattttgggattatggacagatttctaaagaacagtactactccctccatcattcataaatttatattttggggctagccggcatggcaccaaggcgggggggcagggggggtggtagtcacgcggccgcgcatgcacgtatacaaagtttacgtaaacccaaaatatacacgtatacaaacttacgtacatacgtataaaaacccaaaatatacacgtatataaagtttatatacgcgtatataaagtttgaatacacgtatacaaagtttgtatatacaaagtttatatatgcgtatacaaagtttatatacgtatatataaaatttgtatgtatacagagttttataattacatattaaaaaagcgaaactaaaaagatacggaaagacgaaacataaaaaaaaaaggaaaacgtaaaccgcaaaaataaatacggaaagaaaaaacaaaaaagataccgagagcgccgggaagaaaaaaagaaagcgccaaaaaaaaaccgcgccatccgccgccctcctctccccacgcgacatctgtccagtcgcgcacacgggccggccagtcgcgaattagccttctcgccaaggctgacgctcttcatcctcctgctcatggaagttccatggcacgctcctagggagcgacatccagtgatggtaggggctgtacagatcgattgtcgacttcaccgttcgctagtcgcttcgcaaaaaacaagccatatccggctgtagagcccggcctactcacagacaacgccagcactcgccgccacgcccctcagcaccgggatccatgcatggcaccctcagcatccccgaccatgcatgtacgcgcaactgctgcatagattcaagatgaaggatgaggcacatctattctcctgagtcctgatgccggtgctcgtttccgggattgtcctcctagcctgagccgcctccatccctgtggccgctgccgtaggcctgccatcgaggcgagcgtttgggaaaacattgtaacttaattatcaatttgacaccggcgatgccgacgggtagagccggataccgatccgccaccaagtctcgcaacttaattatcaccgcctcacggcttggatctcgtcgcacgttgcctactgcggatcccgccgcgaacacgacgatcacgacggcgtggtggtgaggtgccggtagggcattctacggctgggtgctgggtggatggatccaaaaatttcgggaattggaggtttgaatggttatgggcttattgctggatacaaatacatatataggcggtacaaattgcaaaatgcaagtaaaaatattactactacggttaggggtggattgaagattggtcgtcggtgagttaaattttaactatgcattatggacctggtggggagcgtgggtgggtggggctgaaggctgtgtcaggtactgtttagaacgtagcgccttaaagtgctatattatagaagttaaggaaatggtaaaatgacatatgatgagcaaaaaatggtaggtgaggaaataaattaatacaaaaggttttagatgtgaaataaaatagtgtaaatgtggtggagtggataggtggataataagataccgtcttggaaccccaaacccctaatacgaatttaaagatcaaaatattttatattatattttaaaatgaacttaaagattaaaattttttatattatgtaatgggggaaatatactattatgatactactagtaaggtcaatatataatccaaaagtggtactacagtttacaatcccatccaccccaggtttttgtttggtttagagcaatattaattaattgaatccaatcaaatgacgtttgatgatcttttacgcacataagtagaattatttatgataaaacaactgaaggagttgctttcgattagagtgtgaatactcggtgagcacgccagcagacgagagaagtttaagcgtagatgttgttatttgggtgatccaaatcctcttgtgttcgttcccccatggtggcggagctaggctgcgctacgccgctagctgtgcaattcgttgcaaagcagccaagcaggtacggtcccttcgtttcaggcgcatgctattgctacttgtcttcatcatatatgttcgttgttcaattttgctatatatttgtcgataaattttaccccaaaaatttgacagatataattagaatacaatcgtagtgtaattacactgtaacttacatgtaattacactgtaactatagtgtaacttgtacgtaacttttaaaaatctcttcgtaacatgttatttcgataaaatggaggttgtgggaataaattctttcacatatgtgtgtgctatgatttgttttcttcctcaccaaaacaaatcttgtaatagatctaacgattcaaaattatgtgaaacttacatataagttacattgtagttacatgcaagtcacagtataattacatataagttacaatgtaattacactacgattgtactataattacatctgttaaatttttaggagaaaatttgtcgacaaatatataggtggtccctttgttgttacccgtgatttactctaaagttctaaatttctccgaatttgggatctacaagagcagtagatacttccagtagatgagggaagttcaagtgcggaccggcgggcgcagacggcatcccggcagtaggcacatccgcggttaggtggcagcacgcggcgccgccgccgccggtcgttcgcagccagtcggcagtgttcggccgctgcaagaccatttctaacaccaagcaggcaagcaattgtgtcctcagccctcacttctccgtgtcttgctatctactccctcctttaaaaaaagacaaaccctgatttccgtgtccaacgtttaaccgtccgtcttatttgaaaaattagaaaaaaaattaaaaagacaagtcacgcttaaaatattaatcatgttttatcatctaacaacaatgaaaatacgaattataaaaaaatttcatataagacgaacagtcaaagttggacacggaaatccagagtttgccttttttttttttaatggagggagtagtaatcttttcatgtccccaaggtgtttgatgaaatgtggcagcgagccatataacctatgcgctgctcagactagtgcgtgagacaggggggggggggggttgtggtgtgaggattttcctttttaaaataagttcaaagaatattggtaaatttcagtctaagtaaaaaataggtggcccattgtgcagttcacctaacattgaaaatttcaaaatatttatcatcaaatggctatttactaatattccgtttctaccatatatagacggattacatcaaggcataaagatcagcttccaaatcttactgagtgtattctagccaagaataagcatggcagaagccttggtttttgttgtccttcagaaaataggagctattttaggggggcaggtgctgaatgaaataagatcgcaatttggaaagaagtcacttatatttgaagtggagaacagtgtgatggaactcgcaagcgagtttagggtcatgcaggcttttatcaaccatgttggaatgtgttcacatcaaaatgcagcttatgaggcctggttggatgaagtaaagtcagttgggtttgatgctgaggacataattgaagagtatgcatatcttattgcgcaaacatcaaatgaaggcggcttgattaagagtgtattacatcgatccatcaatgcatggtgccatattgcgacacaactgaaacaaattgaagctcgtttacagaagctcacagccatgaaagatcgttatggtattttgatcagtgaacaaaaactgggaagtaatcccagtcatgatgatctcaaacttatgtcggattctttgtatttttactctcaagatgatattgtaggaaatgaagaagaacttgcgtggatcacacagcggctgatacaaggacggaaatcccgtacagtcatctccatttgtggcatgggaggtttagggaaaacaactcttgcccgagttatatacaaaaacaatgacattaaaaaacagtttgattgttgtgcatggatttcagtgtcacaaacttatcaagctgaagatttgttgagaagaatattataacagctcctaaacatggatgggaagacttttcatcacatatatgatatggatcgaattagtttggcagaaagattaagagatcacctgcagtgcaaaagttatctaattttcctagatgacatgtggagtcgagatgcttggatattcttaaatcatgcatttgctacaaataataaaggtggacgggtaatcatcacaactagaaatgaagatgttgcaatattggctgatgaggaccattgtattatgctaaagactctacaatggaaggaagcatggaatctcttttctagaaaagcctttcctagtcgaaaagaaaatcaatgccctgaaagtgtcgtacaatgggcggagaaaattgtggataaatgtaaagggttgccacttgcaatagttgctattgggagtctactttcccacaaaaagaaagaagagaatgaatggaaattgttttataaccaactgaactggcagctgatcaataacccggagttgaactttgtgatagctgttctgaatcttagctttgagtatctaccaagcaatctaaaatactgcttcctgtattgtggcctatttcctgaagactatctgattaaaagaaaacagataattagattttggatagctgaaggttttgttgaggaaactggagccaatattactatggaagaactagccgaagagtatctcaaggagcttgcccagcgttcacttcttcatgttgcagaaagaaatgtgtatggaagagcaaagtcattccaaatgcataatcttgtaagagatatggttgtcagtaaatgcaagacctacaagttttctgatcttgtggttgaccattgtgttacaaaacacaaatacaagacgcgtcgtatatcagtattagaagctgatcatgcctctgaagcacctacctatggagagaaggttcgctcatttatcctgttcgataagaaagtaccttactcttggttggaaactgcaagtagagattttagattgctaagggtgctgtccttgagaagagcaagcatccataaggtccctgatgttgtgagcaatttgttcaatttgcgctaccttgatttggcctatacaagagttaaggtgattccaagatcactgtgccgactgaacaaattacagatgttggacctttggttcactggcgttgtcgaactgcctcgagaaataaagctgctaacagagattcggtacatggttgctactgtcatgagtgaagataatcacagaattttcaactgcttcctgccagttcgatttccttgcgaagtttgtcatctcaaggatttacaggtactaggatacatagaggcaagcaaagatatgatttctaatctcagaaacttgaatcaactgcgcaaccttttcatgatgaaagtggagcataattatttaacagagctatgggcctctatcaaaaggatgccaaatcttgtcaggttggatataatctcgtgcgacagcgatgaagttttcaacatggagcacttggaccctcttccagaattggaaacattccatcttagagcaaagttacaagatggtgttcttcccaagatgtttcatggtcttgttaaaatcagagacctggagatggggtggtcagggttacaagtagatcccgtttgtaccttttcacatatgtcgaaccttactgaattgcgtctttacagggtttatgagggggtgcttttgagcttccaagctggtttgtttccaaaactcaagaaactctccttggctgatatggagaacctcacatggattgaaatggaggatggcaccatgcaaagcctaaattttattgcacttattggtttaagaaacttgaaggttgtgccagaaggatttcaatatctaatgtcactccaagagatgttccttcaggatatgccacaagagtttataaagagggcacaaagagaagaccgggtttacatccagcacatccctaagatacgaaaattttgacaaagcaaattcactcctatgattgtaacctttttaccttggccttgtgctggaatgtaattatagcaaagtgcacggttggttgcagctgtgtcaactaggtctccaaattctcaaaatgcaaatccaggtcctagaagttgttaaattgcattattctggtcacaaactacgacaaccctttgagatcttacatggtgctgatgtagaattggtaacgatgctagtcggtgtagaattggtaatgatgccacgtcagcaccacatgagatcctggataagttgtgttagcttgggactagaatgacacgatttaacatgttccgtgacctggattttcattttaatagtttgaggacctagatgacataacaacacaagtttaaagaccagctgcgcacttactccaattataatattttccatgtgataagagtgaaatacatcatatgattactatgaatagagaactcaacaagatgccgatatttgaatgtccaattatcgaagtgttcagcatatgagtacctaatcctgagagatttttacttttgttactagagggagtaaaattttttgtcgacttcttgagcatggttacgtggttatgcctatagacggtggaaatggtggccatcgagaaagcaacaggggagacggaattagttgacttttgtacaataagccttacttgatgtccagtagtaagtctgcgtgggtatgcctatagacggtggaaatggtggccatcgagaaagcaacaggggagacggaattagttgacttttgtacaataagcattacttgatgtccagtagtaagtctgtttaaacacatcaaatggggcaacaaacaatggtagtgagttcaaccgtacaatccgtggttgaatttgttatagagaatacttctaaggcccttcacactaaggcccttcacagtacgagtacgtggctcgtgggttcgctacgacacgtcggagccggacttccacgtcgttgtgggtcggttcccaacttggtagcgcaggtctttgtgaggtatcgtgtttctcacctgcgcagcaggcaaacggcgctggatcttggctattgtctgctatggagtagtactactgaacctggacccacttaaaacccatttgaaaggcaactagcactgtcagagctgtgacccaaaccttcactaggcctattcggcacacgaagttccaatagtgcatacaacgtgtcaagaagcaaaagcagaatcagagaagaagatgatatcaatgacatttcacaagtcagtcgttgtcaccaaaattccacattagggtgatcatgttagacaaaccaatttatgtaacagtttaaactccaatatacgtcggatatattgttcagttgtaaatttaagagaaatcaagcaaggaggtcggccatctctttggtgttggggttgtcggtgacatgggaccgggagtatcatgactagaggcttgaggcagacacgatcacccacgtggcctaaccccctcggggggggggcccgagggtgatgtggccgcccttctctttgtctccccgaggggtcggaccgctcccgtttcggccccgagggccgaggcgccccgaccccttgtgggttttacgccgcatgtatgggttagg

SEQ ID NO: 94399 - DNA, 1005 bp, Oryza sativa
tttttaagaattttgtgattcggatctgtgtatttgatttgtgtgtgatgtccgttaatatgtgatgtatttgtgatgaattttgtagaagttgtgatgtaattttgttttaagcttttgtgatctatttgaatatggccgatttggggatttgaggattcggggataatttatttgggattttgggatggggatggagtgaaatcaatatattaaaaacacaatgaagaaaagaaactaataatagagcaaccggatctagctaggctagctctaccaaccgggactaaaaaggctctatctttagtcccgattggtaacaaccaaccgagactaaagatgtatttttactcccgattttttcacccgggacaaaagatagtgatctttagtcccggattggtagtcccgtttgaaaaccgggactacaggggggttacgaaccaggagtaaatcccctttctccaccagtgtgagcgaattgacagtaacatcatcagggatagggaagcgggtattcaccatatattcctgcttgcacaccaagtattcaattgtccatcgtgatcttaatggatgaaccatcaccaacagcccagtgcacccccttctttaacaactcctgcccaaacaaaatattacgccaggtgaaagaggcagatcgaggtttaggggcagaccaaatatctgagtttgagaagtacctaactttcagaacccttagcaaagcgaatttggatctgtgagaagatgccaaccctgtctggtcagtatcgcttggttaaagatgaccaagtccctgaaacccataccgccaagatattttggcgtagacagccactcccacgagggccaatgcatcttcttcctcccgcctcttgagcaattcaagcatgctagaggcatcagtcgagacattttcattttctaaaaaagttagtcgagacattttggcaggtggtcaaaacatatttactactacctccgtttttttaatagatgacg

SEQ ID NO: 94400 - DNA, 742 bp, Oryza sativa
agcattgcatccctgtcaaaccccagtagggcatgggctttccatttcttatattagacccctcaaaagcatgtggtttcagtgttgtagcaaagccaactaccgaaaatgaccaattaggtttttggtttattgaaaatttggtcataattcggcatattttatccaaaataacaagataattaccatgatatttacaatgggatttgatccagtgatagtggtgaatgtaatcaacatgagcatgcttaacgctgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaatccatggctcctttgccgacgctgagtagattttagtgacgggtggtgacaatgagttgatg

SEQ ID NO: 94401 - DNA, 710 bp, Oryza sativa
cctgggagtataaggagaacgagataattgagggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacttactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaagtgaataccgaggtcagatattgacagcaattgggtgtgatgggaacaccaggttctaccta

SEQ ID NO: 94402 - DNA, 3552 bp, Oryza sativa
ggcacgctaacacatccgaaggcgagctttgggcctgcactggagttaagcagatctctcaggccacgtgttttctgtcaacatcacgggactacgtaacatgtttgaggaccaagcaagagctgagaggtttaatacctcaaagtccttgtttgcgtgcaggcttgcagaaggtaatccagtgagcccacatgagatcaaaatgattggttacaccgagagtctggataagcttggctttccccttagccgagagttggctactgatttgattctccagtcgctccctcctagctttgagccgttcataatgaatttcaacatgaacaacctgaacagaaccttggctgaagtgcatgggatgctaaagactgccgaggaaagcattaagaaaaactccaaccatgtgatggttatgcataagcgcaaacccaacaacaagaagagtggtcaaaagagaaagctaaactctgatgagatcacgagtactagcacgcacaaagatggcttacctcccaggttcacacagatccaccatcgccctggtctaaaacattttccactagatcattactacacaatgcaacacatgccaccaagaagatagcacacagccacacagtttatataaaaaaacagtgataagtagatcattagtcaatattatatttttctttgtaaaagtgtgagcagggctaagcaaatcaactgccctgagccaataccccatgtttgactctcatacaatctaggtgacaaataatcaaggataatcaacaataattcaaggcatggaataattaacaagtaggtcataactacccacacgataatttatgaaacaaatcatgcatataatttaaaacaagataattttgcaagttaggatcaacatgttcaagggtacacttgcctttacccatgggatcttcggactgaaccttcacctgcaacagcaacatcctcggcaacggcgtctacacgatcgcaaaaaggagaaaataaataaaaaaagaaaaggcagaaaaataacaacaaatgaaataaccaattaaatcaggaggtaaagctcaattttagaagaatttaggaaaaagaatgggccatatcggagtttggatggaagagatgtgaccttcggaagattgaattattcggaaaccgtgaataaagaaagagaaatatttataaaatattctctgaagttaaggaaacaaaggaattatttttggtggactgacgggcgtggtccacctgtcattgggatgatcaacggttaattggttacaaggatcagagttgtggactgattatatggaggctgagatttatttgtgaaaatcgatgacttggattggtattgggttttagtggaccggcttgtcctggacgtgtgtgacatgatgcctcgcagcgtggacgtcaacggcatggtgatggcaaaactccggattgaagtgggtgaaagaagcaagagcataccgggagaagatgatggcaggctcatgaaagagagcggtgatgctgattagtgaagatatgattgacaaaagattgaattggaagaatggaaaataagaaatattttccggcatttgtggattttattagaatcattttcgtggctaaaggatggggttcactgattgatgggagtgagatagcgaacatgccatgccagtctccgagacaatgacagaggtgacggtgtgacgtggttgccgacctaaggcagcgagaggacagcagctgtgttggccctctggagtggacgatatgatgacgacgacatggtcactggtagttcggtagcaatgggagcatagaaacaatgcgacggcatctcagcatctgggaataaaaattaaaggggtaccggtgctgggatgaagaagagacaccaggttcatggtataggatgacgacgttggacgtaggaggggaggaatattgtagagacagcactggggaagtagaggggcgaaaacggaggcgatgcttatgcaacaactattgcttgagctcgaggttgttatgaacgccaggaacaagccacgagagaagatagagcagagcagggtgtatgcactgattgtgctcctgctggcatggactactccggtgaagaaaacagtgatggcggtgcagtaatttcggaatggaaccgtgatgaccacaacagacatgtggtaggaacaccatatcgtttaacagtgaggcggtggcaccggcagacaatagcaacttgacgagagactgtgccggagacaggtgaagacgatggaagcggaggataagagcagcggtgctgctagggccttggagattaccgacctcagcgacattcataggaacgtgatggcgacaatgtggttcagctcgggttccattgcgacagcgaccatcgtggtgcgcaaacagatcagtgatgaccaacggccgcctttacgatcacaagagagaggtggcagcaataatggaagattgaattaatagaagatagaaaggaatattctctcgtgttttcaggttgattggaattattttgtgtaccaactggtatggttcatatgtcatctaaagagagagattaacagtggtgcacgcacatgcacgctgtgggcatggtggccgaggcaaagcagcagtacgacatcttttggacatgtgcgaatgaaaagaaaagaagataagggctctgttaaatacatataaaggaggaaggttgacaggggctgctttcgtgatggacgaaacaacatatagcgctatcaccgggtgataaaaatggaaggaaataatggaggaggaacatcaagagctcacctgtagatgtggtctcaacaagatgaagacatggtagcagcggcttaggttccaaggatggcgatgacttctttgcttgtaggtggcgttaatggtgacagaagttggtttggaaggggatgacgaaggagcagcgttggttcactgatgatggccagggccggccctgacgggggtcgagcagtgcggctgcactgggccccccaaacccaggggcccctcccaagatgccgaagagtaggcctactctgctgccgcgtatgatgatcaatccgtctagccctaacgattagcgacgtgctgatgccgacgttctcaattccctagccatccgcgagattagcagatcaatcttcttcttgtccctggcaggcgacggcaaaaagcaggcgtccacatgcggacagcctcgccgccggctgctccccgcgcgaaaacggcagccggcaacctcctctacggttccgctagcttcaaccgttacagcagttctgcacttctacacgcctactacctgtctgccgatggcgcctgcaggtgaggtgagttccctgctggattaattcagatgtgggaactgaaaatatcatgcgaaaaaatctattaagcctacaacttgtagtctgtaggtggactagacaggcctgcatgcagtgcagtctcatcctgctagctgttgcaagcacacgccggctagccgaagaattgtaattagtaagtgttgtt

SEQ ID NO: 94403 - DNA, 708 bp, Oryza sativa
catagggattccgtccctcatcggagtcgcggtcatcctctatgtcggcttccgtccaagtagggcggaggaacagtctatatgtcctatgcagccaacgaagatactctgagaaaagatgattttggtgtatagtctcgatgtacctgtagttccttccggctgtcctccattcatcaatgtatctattatgctctagcccccagtctttcaccttctttgttctcaccctgtcatacctagacaagtagaaggtgatgaaacaatagtgagcatcaacaagggttaaatggtacaaaattgaacattgacaatgaaagcaaacaaagataagaaatatttacttgtgtaattcaactccagttgagatgtcctcaaccggccagtcttgtttcttcccgaactgtccatgacacggtgcggaaggtggtactcaactgcccagaaacaaatcaatgggcactggtacattaaatagtcaaagtctcgattgcacatcgagttcagggtcaggcttgaagcctcatttgtgtggtatggtaaccattcaatctgcaaaagttgaagagatgtcgttggttagtatctcaattaaagaagtaaatgtctaactagaagtgatattggaagtacttacatgttgagactgtaagcagtccatctcattgacataatgcttgtatgccacatcccggtgagcatgtgcag

SEQ ID NO: 94404 - DNA, 659 bp, Oryza sativa
cctgggcgacggctcgtccaagaccacacgaatcggtggtcttctggacgacaaataggaagacgcgctcgtctccttctgccggcaacgccgacgtcttcgcctggagaccggcagacatgccaggggtccccagggaggtgattgagcaccgtctcgccgtgcggccgggcgcaaggccggtcccgcagaaagtgcggcggcaggccccggaacgtcaagccttcatccgcgaggaggtggcgcgacttctggaggccggattcatccgtgaggtcatccatctggagtggctggcgaacccggtcgttgttcccaaggccaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcagcgtactactcgaatttctttgggtagccagataggaagcaatgttgaggcctatgttgatgacttggttgtg

SEQ ID NO: 94405 - DNA, 3747 bp, Oryza sativa
gggggagatatctctccccccactgaggtaacttgtatcacattgcatatttccctttccaattgcatatttccttttccaaattgcatatttgctttctaattgcatcttacaaaacttgaaaacaacataaaaatttgcaaaatagaaaaataccaaaaagataggataggattgagtcatgctaggtaagacaagctagttctctttgttgaaatgatgaatagttgctctgttttatatctctgatatatgggttcttggtaagtgctctctcaaaggttaaatataagtagccaacaattatccgggaacctgaggtaaatgggctgcacttgctgatctaaatctaagttgttgcgagatatgagatagtaatatgagttgctatgatcctgatactagtttgacttgaattccggatgttttgtttttcaaaatgataaaattgaaagttcctcatttgatataaattcctaccagagccaaaaaatatgctatcatgattaaaccatatacattttggttacttgtcattccaatgaactttgtcaaactcttgtgacttgtgtagttacttctcatgctctatgatcaagatcatacacccacatatatgcacatgctaaactcctacactgggagctaagcaatattccattccatttccatattaccaccaaaataaattctccatgctttcatgtgctttcttcccctaaagagaaaagtccttttgaaaaaaaaaagagaaagaaaaggagggaaaggcatggtcatgaaaaaatataaaaaaaataaagttatgctccatcaagcatgagcatgatgttaaaaaaaaatatgtagctatgctctctcctaatcaataaaagaaggattttgggagaagaaagtaagcacaaaggggaagcatttttcttttatctttcctcatataccatttccaccatatactacacacacattttgcacgatcttgatcttgagtatgtttagttatctgctttagtctaagtttttgacttagtaataaatgtgaatgcaagtatgccatgtttgatccctaccgagctccacataccaaaccttagagtaggaatcaaaaaggcaacatttggtgaggaattcatattgatacacttagacagactgagcgaatcatttgagaaacttggctttctttagcaaaatcattgaaaacttccggaatgagagttaaataaagattgggtgattggtactctaaattgctgttctgtctttcaaccacccaagacaaggagaagcagtgtctcgtgggaatcaggggtaagggtaagccatcgtgccaaagattatttaatccgagagagagtacatataccttgcacctatatctttgagatatgcagcatagtagcaactcatgatcaacaaccaagtctttgtttcctttcgtccttcactcgggacgagcaaaggttcaagcttggggggttttgttgacggtcgttatcgatcagtttcaaccgtcaatattactaaaatagaggagaactagtgatgtttgcaatgcatatatctgttagaataataaacttccactagtattaggtatattaaccttttgcagagaatgacaataaagtggaggagaatcgacatcaacatagatgacaaatcaatcggacgatgtcgagaaccagacttacgtatgaataggccaagaactcagaattgatacgaagaattgggccaaaattgacaagtcagcgaatagaagcaacagaggaggccgcctgccgaaattgggctggattgggccgaccccaggttcggccgaaccctcctcagcgccatccgatccaaggcttcgcctggacggtgtggattagcccccaatgacggttggagggtatttccgaccattccaaccgtcacaaccgtcattgtgaggctatataaggagttgccattctcacttcactcatagacctcaagcaatagctttctcatttctgtcaagtttagtttagtagtatctagctggtggaataggaatagagtagaaatcaagtccggaagccttcggaagagctcttctcttttcttttgtaagcattgtacttttattagaatactcttctttatacatttatggtattgaaacactttccgagtatatgaatgccaattttacattatgttcatgttacactgaatatacggctagcttatttgggagatgctttggtgcgggtataatgtttgcttatgcaattactctatctcatgacgatgatattagagtagtatctggtagtttagacgtggtgtctagattacgggatatcattatttgaggttatatattgcagatgagaggtgggccgctgatggtgacagctcagtacaggtattcctccgcgccggtatataatcctaagttaatttcctggggagggtattcctccgtatttagccccggttgaatggtcatgacgggctgtcgtaaggaactcggcagtcaggggtggcttctcgaagtaccaagagggcatcggatatagggtattagctagtatatcagttaactagaatatatgtatactatgtataatagaagtataggaatagatttcctttctcttttctttccacttagcttagatgagttattatgagaatgagtagttcatgcttgtctgttactctatccttggattatcttaacccctgtttagaatatgattatcacaagtaatatataaattattagtcaagctctctctacatgatcttcccacaggataaaataaatacgatacccttggaatactcttgggtgaaatgctataatggtatatccgtgcgcttgcggatgaactctgtaaacataatataccagaagtatttctgcgccattgttgggaattatatttccagcaatgtcgttaagaaatacccacaataacccttcacccatcctagccatgaacaaaagaaccgacccaaccctgcctacggccggtatcccgagacaggcaggttaggattgagcccctagcaacaggacctagaccgggtgcgccacacacataggggtgagaccacccgcgtactagtccagtgccatggcatctcgactaacggacaccggcccgtgtagccttcatttgcctagacatctcgactgccgagccgtagctcgtgtagctttcatttgcctcagagatatccatcgtcgcaacgacttcatccatctctatccgtgtccttttattcaggactagactgagcaccgagttaagccttatccattacacgtcatctcaatcagggtttagaattataatcataattatactcgagtatcatagaccatttacctgtacatggtaatggaaaaaattgcccttcgtggctatagttgctgtcatgcccagaaattcccgaatagaattctaagcagaatgtgcattaaaacccccatccaggaccagccggggtacacaaacgacaaagttgacatacagatccacgtcttacaaacattataaaagtcttacataaatgcagcggaaaattaaaagataaatggagctaagccttgacttgaactgcagcgggaacgccactccacaggcatcctcgacggcacggacgaagcctactcctcggagaagccaccatctgacatgtactcaaactctggggttttggggaaaatagagtaaggctgagtacacccaccgtactcagcaa

SEQ ID NO: 94406 - DNA, 6103 bp, Oryza sativa
ctactgaaacagagaacaaaagcatttttaatggattttatgcatttttcttgatttactgcgacttgaataggcttaaacgaagctcggatgaattagatatgaattttagaagattcactgtgtttttactttaaacagaaaaatccttaattgatttattgcgcaatatatcccagggctgacgtcaacaagggagggacggcgccgacatgcgggccccacatggcagtgactcgggtggcggtccacggtggaccgggtccacggaccggggaaggaggcggcgcaccacgtggcgccgacgtggcgcacacgtggcagccatgtggcacgccacgcgggcggccgaaccgacggccccgatctacccgagggtagatcggatggcggcggggagcacgcggccggcgcgctcgggcggctcaagccggcccggcggccatggcgcacggcggcgctaacgcggggcggcggcggcagacgccggcgaccgatggcggcgtaatgagcgccggcggtgcgacggcgcggacggcgatagtggcggctaagcggctaggtggtggcgcggcggctaagtggcgcgggagagagagagaggaaggggagaggggaggaggtgtctcaccgacggcgattgacgacggcaagcgacggagggcgatgacggcgacaggacaagctccggaaccacctagcgaacacggtgcaaggggttagagatggagaggaaaatggaagagggcgaggacgccggccgaaggcggcggccatggcagtgctcaccggcgcacggcgcggagtgagttccggcggcggaatctgacaggagaggggtggacgaggtggcccgcacgacggcgaacgcgacgacgtctacggcgcggctcggcgcagcggcttgcgacggtagcggcggccggagcggtgtcggcggcggcggaaaagaggacgacggcgctagggcgatggagggcacgtgaacggatggttgcaaaacgaaaaagagagaggagggaacggggaacctttatataggcccacaggggtcgatcgtggccggggtgaccacgattttgccagcggagtggggagaggtggggaggaaaaaaaggtgggattcaaaaattgaatcccggccgtctcgagtgcgggcgcgggagggagagagagggagtgggcgcggggaaggcgggcgcgagcagcgacgtgggcgatgtggcccgggagacgtaggagcgaggggcggcggcactgattggaggtgggagacgggcccgataggtgggccccacctgtcggcgaccccgggagagaggaggggctcgggcggccggcttagctgggccgtggccttcggccggcctagcagggatggggaggaggaagagaatgggccggcggcccattcgaaaaagaaaaagaaaaaggaggaaatgaattttcctgggattaaatattgcttgtgctcatttttaattggttaaaattatttctagagctctgaaaattccactaaaaatcttgttagcacatttcgacatgtagaactcaagaaaaactccacatgccaattccgattattatttgcattaatttatttagggtttcactcttgcttttacaccggtattttctcgagaccaattgtaaattcaattttggcttgggagaagaacttcagggtgtgacaaacctacccccttaaacggaatctcgaccccgagattcggaagagctggtgaagaggtgcggatgggcggccttcaactcatcttccttttcccaggttgcttcttcttctgagtggtggctccactgaaccctgcagaacctggtgaccttgttcctagtcctcctttcactggtctcaaggatgtgaactggcttctccacatatgtcagatcttcttgaatgtcaatgtgttccgaatcggcttgttcttcgggtaccgtcaaacacttctttaactgggacacgtggaatacgtcatggataccgaccatgttggatggaagttctagctgataggcaacttctcctcttcgttcaaaaattttgtatggtcccacgaagcgtggtgccaacttgcctttcatctagaaacggtgtactccccggagcggagtaacacgaaggtacacataatcccctgcttcaaaagtgagctcccttcggcggttgtctgcgtagctcttctgtcgagattgtgcaattctcagcctctctctgatggttctgactttctcctctgcttccgttagcacttctgttccaaacagttgacgtttgcctgtttgatcccagaagagaggtgtgcggcacttccggccatacaacgcttcgaacggtgccatttgcagactagcctggtaattgttgttgtaggagaactccgcataaggcagacttttatcccaagctcctccaaaatcaagcgcacaggctcgcaacatatcctccaaaatctgattgacgctctcggtctggccatctgtcaacggatggtaagctgtgctgaaattcaaacgggtacccaattcttcttgcaacttctgccaaaattttgaggtgaactacctccctcgatcagatactatctttttgggtactccatccaaacacatgattcttgagagatagagctctaccaaccttttgcctgtataagtagcgtgcactggtatgaaatgagcaactttggtgagtcgatccatgactacccaaattgaatcgtggctagatgatgtcctgggcaaacctgtgatgaaatccatcccaatctcttcccatttccattccgggatctgaagaggttgaagcagtcctgcgggcctcttatgttctgctttgactcgctgacaaacatcgcagagtgcgacgaattcagcgatttctcttctcatactggcccaccaaaatttctctttgagatcttggtacatcttggtactacctggatgaatggagtactgagtctggtgagcctcggtgagtatcagatctttcagctctttgtcatcaggtacgcacaatctttctcccaaccagattgtgccatgttcatcttcgtggaaatcccgggcttttccgaccctcatattctttttcagttcagctatctcaggatatttacatgagctgctctgacttgatccacgagcgtaggccgtgcctctagagcagccacaaacccgtgttctacgattcccaagttgagatgtttaagctcctgctgcaattccttacacatgccctcagtgcacaaagcattgcagtagctcttcctgctcaatgcatctgccaccacattggctttgcccggatggtagtgaatgctcatgtcataatctttgattaactccaaccatcttcgctgtcggagattcaggtcaggttgggtgaagatatatttcaaactcttgtgttccgtatatacttcacagcgatcgccaatcaggtaatgcctccagatttttaaggcgtgaaccaccgctgccaattccaggtcatgtgttggatagtttccttcatgcagacgcaactgccgtgaggcataagcgaccactctgccctcattagaatgcatccaagcccatgacgagacgcgtcgcaatagacttggaagtctttcgtctggtcgggcaaattcagaactagagcagacactaatttcttcttgagctcctcaaaacccttgtcacactcggctgtccacttgaatttctcgtctttcttaagcaactgagtcataggtctggcaatcctggaaaaattttcaatgaaccgacggtaataacccgcacgtccaaggaaactccgaatctgtgacactgtcttaggtggggtccacttggtaactgactccacattcgatggatccactgccacaccttgagcagtaatgacgtgacccagaaatttgacttccgacaaccagaagtcacacttactgaacttggcatataactggtgctccttcaacttctcgagtaccagacggagatgttgctcatgttcttcttcggactttgaatagataagtatgtcgtcaatgaacaccatgacaaacttgtcaagaaactccataaacactttgctcatcagattcatgaagaatgcaggtgcattggtaagtccaaaagacataaccgtgcactcatacaacccataccgagtggtgaaagctgtcttgggaatatcctcttcccgaatcctcaactggtggtaacctgatcgtaggtctattttggaaaacaccttggctcctttcagctgatcaaacagatcatcaatccgtggcaaagggtatttgttcttgattgtgacctcattgagtgcgcgataatcgacgcacattctcttcgtcttgtccttcttctccacaaaaatgaccggagcaccccaaggtgaagtacttggtcgaatgtaccctttctgcagttgctcatcaacctgcttcttgacctctgccagctcattggctgccattctgtacggtctcttgtaaattggagcagtccccggtgccaaatcaatccggaattcaatctctctcttgggtggcatggtagtgaggtcctcagggaacacctctgaatactcgcagactatggggatatcttccaatttcctcgaacttttctccgcggtgaccaccgaattctccacctcaatctgatttaaggagattccctgcttcagtgcgactggtgacttgtacaccactgtttcccctctctcattggtcaaggtgaccgtgcgattcgcacaatcaatgatacccttgaacttggtcagccaatccatcccaagaatgacatctaggtctttggattcgagaaggacgaggttggctagaaatggtgatatttggatttctattgttacagaagggctgaattaaaccgaggtggaactattcccgggggtatgaacccgtattggtgtactaagctcttctcttattagcccatgttccccaataaacttctttgaaatgaatgaatgcgttgcaccagaatcgaaaagtactgttgcataaattgagttgacaggaaacgtacccagtacgacctctagtgctgcttgcgcctcttccgcggacgcgtggttgacacgagcttgggcaaaccttggcccagcacgccttagcttcgggcacttgtcagcaaagtggccatgctcgccacagttgaagcaggaccctggctttactccagtctccttcttggcttggactgatggagctgcctgtgctgtggccattggtgggcgcggagctgcactgcggttgggctgacctcccgggtggttctggctgccactggcgacctggtggaagctacttgagttgaacgggcgatactggtggacaatcatggtggtaggtccaccctgctgtccgggagtgaagcgcggtcgctggtgacttccttggttggaccggaactgcgctgcctttctcttcctgtccattttgttgcgctgatcctcctggcggattgccttgtctaccagcttctcgaagtcagcgtaatccctagagatcaactggttggtcagctcgtcatccaggcctgctaggaacttctcctgcttctccgcgtcagtgcggacatcctccggtgcatatcgcgcttggcgattgaactcatggaggtactcagttactgccctgttgccctggtggagtgcctagaattctctcttcttttgtgccacgaccccgtctggcacctgtgccttcctgaagctgcgacagaactccgcccaagtgacctccgtacctggcggacgggtagccatgtgattgtcccaccaagctgacgagggaccctggagctggtgtgtggcgtaggtgaccttcttctgatcattgcactgcagaagattgagcttcttctctatggcatggaccaatcattcgcctccatggggttggtggtgctagagaaggtgggtggactgacgcgtagaaacttcggcagcttggactgagggggagggggaccaaactgctgctgctactgttcgacttgctgctacatcctctggtgcatctgctggtgctgctgcagcatctgctgcatcatggcc

SEQ ID NO: 94407 - DNA, 1977 bp, Oryza sativa
cctgctaggaacttctcctgcttctccgcgtcagtgcggacatcctccggtgcatatcgcgcttggcgattgaactcatggaggtactcagttactgccctgttgccctggtggagtgcctagaattctctcttcttttgtgccacgaccccgtctggcacctgtgccttcctgaagctgcgacagaactccgcccaagtgacctccgtacctggcggacgggtagccatgtgattgtcccaccaagctgacgagggaccctggagctggtgtgtggcgtaggtgaccttcttctgatcattgcactgcagaagattgagcttcttctctatggcatggaccaatcattcgcctccatggggttggtggtgctagagaaggtgggtggcctgacgcgtagaaacttcggcagcttggactgagggggagggggaccaaactgctgctgctactgttcgacttgctgctacatcctctggtgcatctgctggtgctgctgcagcatctgctgcatcatggccgccatcatctgagtctgatgggccatcacttgtgcaagcgtcgggttctctgggagcggtggcggaccattgccagaggcgctgttgggatatccactgtcggtgtgctcttcgccattgctgccctcaccggctgcgcggctgccattcctgatgttgaccatctgaaggaagagcagacggagggggtggaaaagaagaaaaacagatgctcaggaactaagctttattatagaggaatttaaactgcaattgttctgatctgaattaaaacacttaaaacagcaagcaaaatccttattaagacagccacatcataggcacatgatgtcgaccgtcgactgacccacaagcgaacaaacctagacacacaaactaacaggcaattactaagcagtcgataaactaagggaaaacgagcctaatgctcggaacggctcctgcggttggtggagtagaaggcgtcctcctgctcgtcgccgggtccctctgagcggctcctggagtctggcagatacgtcttgccgctgtccggctcggagctactggaactgctgctgctgtggtcgcggctgccactgggagtagcaggcaaccaacctccgttgccactggctggacccctggcggctgacgctggagagaaggagagagcggacgccggagctgacactggaacgggagccggaaccggagctggagctgcgagcgctgcgggaactgcgggaggtgctggaggagctacgtgtcacgcctggaatttctatccaaaattccaaacgcttacatgtgtgttaaatcctcgtccaggaatcagccgaggcacacaataacaaattgataatagagtactattaaacaattaattaatattcgcaaattaaataattattacagaggtggacaattcctctcgaaagaataaaattctacgcagcggaaataaaaacaaaagactaaacagctatggcgactccactccacaagcaacttgacccgaacaaagcctaatcctcctgatcatcaccttcattgaagtactcctcctctgatgaatgaatattgcaagaatgagcatatgacatacttaaaaagccacacagcaaatatgcaagtgcataggataacaaaggatgacattatatagcttatttgcatcaacaacaattaataaacatttgagaatagtaaaacagttgagtaattaagcaatattaaataaacactatacaacacacccgtgttgcataggcccaacctcatctgaacaaccaaccccggttgtacagatcaaacctccataccaggaatataccattccaaaccaagagtcaaattaattatcacagtattatcattaatgagtagtgcgatactaatcacgaaaaacattgttaaactcacccataatcgcgggcacggctattcgaatagttttactctggccagagatgta

SEQ ID NO: 94408 - DNA, 899 bp, Oryza sativa
atataccattccaacccaagagtcaaattaattatcacagtattatcattaatgagtagtgcgatactaatcacgaaaaacattgttaaactcacccataatcgcgggcacggctattcgaatagttttactctggccagagatgtaccactatacccacaagatacagctccacaatatgttaccatgcgcctcgataccaccacgataccttggaaaggaaccgtgacaatacctctcacacaacacaactcaccacagtgcgccattcctggatcataatctccccctcaaaaccagaggcaatggactccccagcgacccctacggacttctcgccgcttcacagtctggcaccccgtaatgaaccatgctatacaaaaggtaaagccgttgcccacgttggcttgtggttggcacgattaatgtttcacaacagtagctcgcgaatcggtccttaattgtcatgagcacaaccatcaaaaccatatgctcacaacccacctttaatcagcttttaattatcaattaattatcataacaagattaaccatcgtgagctaccattagatataaccataattaataatgtagtatgattcatcccattaatgagctaatgtttctaagcatggctaagcaattatacatatagcatttagctgaaccaaaccaatatataaggttctagctaatcaaattataacccataggaaaaataaagtcattttcggccattaattaattgggaaaggctcaccacccgatgacattcgaaaataatgcataagttgaaataaaacattagctttaaacgggttcaacatgctcaaagggttgtttgggatctgtgtgacttgccttaagcttccgcaaacgcttctgaaccttcctcaacg

SEQ ID NO: 94409 - DNA, 1541 bp, Oryza sativa
tggcggcgaaggagagaggccgagagagatcgatcggccgaaaacgtttaagtgttggtgaagaagacgagggcgcaccgggaatatatatacccccggatctttactcccggttgttctcaacaaccgggactaaagatatctttagtcccggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttgtctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactagcatatacatgatttaaacttgttgaaacctctaataatcgtgcgtaattaacatatgccatacatcaattgatttatatggataatcaatacatccaaaatagtttacatcgtgtacacaataattacggcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattgccaaggacaaaaggttcgtccgagtatccaaccttgttaaggtcaacagttgtcatcccactgtcatcaatcattacgcctccactagtcaacctaacccattggcaccggaacagaggaaccttgagaggaccatagtcaagttcccatatgtcctcgatggcacc

SEQ ID NO: 94410 - DNA, 1286 bp, Oryza sativa
ctagattctgctatgtgtacctattgaaaacaaaggacgaagcattacattactttaagatctataaggctgaggtagaaaaccaactagaaaggaaaatcaaacggttgaggtctggtaggggtggagagtatttttccaatgagtttacttctttatgcgaagagtatggaattattcatgagaggacgcctccctattcaccccagtcaaacggggtagccgaaaagaagaaccgcactctaactgaaatggtgaatgccatgttagacactgcaagactttccaaggaatggtggggtgaggcaatattgactgcgtgtcatgtcctgaatagaattcctactatgcataaagaactaacaccattcgaggaatgggaaaggaagaaattaaatctccctcacctgcgcacatggggctgtttggccaaggtaaatgtatctatagccaaaaagcgtaaacttggaccaaagaccgtagattgtgtgttccttggttatgctatccatagtgtgggatataggttcttaacagtaaattctggagtacccgacatgcgtgttggtataattactgagtccagagatgccacattttttgagaatgaatttcctatgaaaaatgcacctagcacttctagtcaagaacctattttatcccctgagcactttgtgccgatagaacacattgatcaaatgcttgaggaaaattctgaggaggataacattgtagcaactcaaaagagtaagagacaaaggactgcaaagtcttttggagatgactacgttgtatatcttgtggatgatactccaagaaccattgaagaggcatattcatctcctgacactgactattggaaggaagcggtatgaagtgagatggactcaattatgtctaatggtacttgggaagtcatcgagcattcatatcggtgcaagcctgtaggatgcaaatgagttttcaagaaaaagcttaggcctgatggtacaattgaaaagtacaaggcaaggcttgtggccaagggttgttgtcacaccctgaagttttcccccttttgcttgctttaaaaattggttaaataaattgcttgaagaaattatcttaattaacctagagctaaatccctagttaataaatgcacttaataatcggaaatagtgtggtggaatttttcttgagttccccatgctccaatgcattaacaggatttttagtggaattttcagagccttggaaataattttaaccaattaaaaatcactaaagtgccattttaaatccca

SEQ ID NO: 94411 - DNA, 619 bp, Oryza sativa
caggcctcggggcccaaggggagcgctcccagctcccctagattgattgcttggatcactgagatccaggcgtacctcgcagataagactctaccccaggaccgcgaagagagtgaacgcgtccggcgcatctccaagcgttacgtgctggtggaagggaccctctatcggcgcgcggctaacggagtcctcttgaagtgcattcctcgggaacaaggcgtcgagcttctcgccgatgtccatgaaggcgagtgtggagcccactccgcctcacgcaccttggttggcaaggcctttcgccagggtttctattggccgacggctctcaacgatgcggtcgacctgatccggcggtgcagggcgtgccagttccacgccaggcaaacccatcggccggcccaggccctgcagaccatacctctttcgtggccgtttgctgtctgggggctcgatatcctgggtccgttcaggcgggccccgggcgggttcgagtatttgtatgtcgctgtcgacaagttcactaagtggcccgaggcttatccggtcatcaagatcgataagcactccgcgcttaaattcatcaggggcatcactgttcggtttggggtgcccaaccgta

SEQ ID NO: 94412 - DNA, 692 bp, Oryza sativa
acagtttaataacttccaagatcaggtagactatgccgtacatcatgctttgatcaatcaatctgggatattagtcaatactttgtcaaacatggtgaagtcgatggttgatggttcaatagctgactatcagactacgggaccggtttatcttcaaggaggtactttcccgaattatcggcccttgatcactgataatcagcaagccgtttaatcagttcctcctttgttatatcgcccttagttgtttttcatattgtaatcggttatggtttgccgatgtataatggccgatattgttgtatcgcccttagccgcttttataattttatcaatgcttgtgacattgtaaaattagggggggcacatatatatatgaaaaattgcatatttttgagccaaatatggggtcatattaaatcggcttaaagattgttgagatgagttacataaagagtcagagtttcttagccgattgcaaaaaaatttctaagacctattacataagatatcactaagacaaatattgctggaaagctgaaatagctctttgcctgattttttctacttcttcaatggcatgggcaccttgagcatcggttacagggatgacttttaaaaacttggtcagatcagcaacatttttgatagccgattttagtcttgccttctgctcttaacaaaatttggga

SEQ ID NO: 94413 - DNA, 788 bp, Oryza sativa
ataaaggattacaaatgcagcggaaaaggtaatagcgagctaagcctgaagacttgactcctgcagcgggcgattccattccacaggcaacccttgacggcagcgacgaaaccaacctctctgagacggctccaattgagaagaacttctactctggtgtgggggaaaagagagcaagactgagtactacccactgtactcagcaagtcataccggaagaggaggtatgatgcaggatataaccaaaggaggctagaggttcttttgcataaagctagcatttaaaagcagtagttgaaggcagtaaaacagttgtagtaattaatcaatattaaccaatcactgtccaacgctacaccacgttgcaacaggccgaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccgcataaccctcccctaaccatccacaccacgctaaggtttcacccccacccctcaaaaggcagtgggcggtcccctcttgcgccacggtgaatccggcagctggacaaccggacaccccggccgacccaactccatcacgcccaccctcgccaccggtgcctaggaaagggtcgagctatacttcagatc

SEQ ID NO: 94414 - DNA, 1992 bp, Oryza sativa
ctatagggcgaagtcgagctcggtaccctgcatgcgcgcgggcgggaagggcggaggagtggggcggcgacgtgggcgcgcggcacgggcggagtggggcgtggagaacggcgggaaacggcggcggcggcatgggcggtttctacggcagcagttggagctccggctccaacggctggaggtgggagaccaccgacaggtggggcccacctgtcggcatcccagagagaggagggaggggcgcatgggccggcccaacaagaggaaggccgagcgggagagggatgggccgacggcccaacaaaggaaaaggagggaaaagaaaaaaaagaaaaagaagaaaggatttttcctgagatttaaaattgcactttggtgatttttaattggttaaaattatttccaaggctctgaaaatttcactaaaaatcctgttaatgcattggagcatggggaactcaagaaaaattccaccacactatttctgattattaagtgcatttattaactagggatttagctctaggttaattaagataatttcttcgggcaatttatttaaccaatttttaaagcaagcaaaagggggaaaacttcagggtgtgacaaacctaccccccttaaacggaatctcaaccccgagattcggaagagctggcgaagaggtgcgggtgggtggccttcaactcatcttctctttcccaagtggcctcttcttctgagtgatggctccactgaaccttgcagaatctgattgctttgtttctggtccttctctcgctggtttcaaggatacgagtcggcttctccacatacgtcaagtcttcctggatttcgatttgatccggacttgcctgttcctcaggaactctcaaacatttcttcaactgggagacgtggaacacattatggatgccaagcatgttggagggaagctcaagctggtaagcaacttcacccctgcgttccaaaattcgatatggtcccacaaagcgtggtgccaactttcctttggtttggaagcggtgtactcccctgagcggagtgacacggagatacacataatcccctgcttggaaaacgagctcccttcggcggttgtctgcatagcttttctgccgagattgcgcgattctcaatctttccctaacagctctgactttctcttctgcctcatttaaaacttctgtaccaaacaactggcgttcccctgtctgatcccagaagagcggagtacgacaccttcgtccatacagtgcttcaaatggtgccatctgcaaactagcttggtaactgttgttgtacgagaactcagcatacggtaagcttttgtcccatgctccaccaaagtcaagcgcacaggctctcaacatatcctctaggatttgattgactcgctcggtctggccgtctgtttgtggatggtaagcagtgctgaaattcaaccgggttcccaattcttcttgtaatttctgccagaactttgaagtgaattggcttcctcgatcagacacgatcttcttaggtacaccatgtaaacacataattcttgccagatagagttctgctaatttcttccctgagtaggtagtgtgcaccggaatgaagtgagccactttggtgagtcggtcaacgactacccaaatagaatcatgccccgatgacgtcctgggcaaaccggtgatgaaatccattccgatttcttcccacttccattctggaatctgaagtgtctgtagcaaacctgctggcctttggtgttctgcctttactcgttgacagacgtcacagagtgctacgaattcagctatttcccttctcatgctgacccaccagaacttttctttgaggtcttggtacattttggtactgccgggatgaatggaatattgagtttgatgagcctcggttagtatcaggtcttttaattccttgttttcgggtacacacaatctttatcccatccagattgttccttgttcgtcctcaaca

SEQ ID NO: 94415 - DNA, 660 bp, Oryza sativa
ttttgggtactccatccaaacacatgattcttgagagatagagctctaccaaccttttgcctgtataagtagcgtgcactggtatgaaatgagcaactttggtgagtcgatccatgactacccaaattgaatcgtggctagatgatgtcctgggcaaacctgtgatgaaatccatcccaatctcttcccatttccattccgggatctgaagaggttgaagcagtcctgcgggcctcttatgttctgctttgactcgctgacaaacatcgcagagtgcgacgaattcagcgatttctcttctcatactggcccaccaaaatttctctttgagatcttggtacatcttggtactacctggatgaatggagtactgagtctggtgagcctcggtgagtatcagatctttcagctctttgtcatcaggtacgcacaatctttctcccaaccagattgtgccatgttcatcttcgtggaaatcccgggcttttccgaccctcatattctttttcagttcagctatctcaggatatttacatgagctgctctgacttgatccacgagcgtaggccgtgcctctagagcagccacaaacccgtgttctacgattcccaagttgagatgtttaagctcctgctgcaattccttacacatgcccttaat

SEQ ID NO: 94416 - DNA, 3246 bp, Oryza sativa
tttttcttctgcctaagcgagatcccgtcgcgccctccccgccattccaagtccagccggtctgaggccgaggagacggcgaccgcggaggcccggaggcgggaagctgaccggcgagaagccgcggaccgcctccgggaagccgaggaggctgcccaggaggccgtccgggttcgccaggctgaggaggccgctcgggaggaggctagactccgccgggccggggagtccgtccgggaggcagaggcggcgcgcgcacgccaggcggcctgccaaacccccgacccgactccggccgaggcgacgccgacttccgaggccacccacgacgaggccgcgggcgcgccgctcgggcccgacccctcgggcgacgcttgggacgagccaggttcgggggacgcccccgagtccggcacgtcgatcggcgggccgagccgcgcggcacccacactgaggcggctcttccctctgccttccgctgccccactgagcgcggagcccctcctgcaggccttggccgccgcgaacagcacggtgctggacgggttaagtgcccagatggaggccctgcatgcggagcgggcggagctcgacgcggcgtgggcgcacgtcaaggagggccggcgctcggtggaggccatggtggaggcggcccgcaaggcacaccgccggcacgcctcacagctcgaggcccgtcgtagggacctggcggagatcgccagggaggtggagaagaagcggaagactgccctcatcgccaccgccgtgctcgacgaggcgcgggacgacctccgcctccaatacgggagccgggcggcggagctagaggagaagctcgacgctgcccggggagtccttgacgccgccgctgcccgggaacggcgggcggcggagaacaaggcggcgtcccggcagcgcgaagaggcccttgaggctcgcgccacagcgctggaggagcgcgcccgcgccctggacgcgaaggagagaaacctggcggaccgcgaggccgcctgcgctaaagaggagtccgcactccgcctccgcgaggacgcgctcaccgagcgggggcgaactctcgaagaggccgagcccgcggcgcagcgactggcgaacagcctgttcctccgcgaggcagcgcgggaggagcaggcgcgccgcaatctggaaggcgcccgccccgagagggccgcactggatcaacgggccgctgagctcgaggcgcgggccaaggagctggacgctagaagccacaacggcggggcggtcgcgggccaccgcgacctatccgccccgcttctagccggcgaacacaccatctgcgagctggagggcgcgctggactcgtccgccggggaggtcgaggccctccgcttggcgagcgaggtaaggccccgccatgcttcgggcagcaggcgggcctctggggcgggcggtacgcgaagtacaccgccaaccaggggggcctcgcccagcgcctctcagagatggccggggccctcgagcggctccccgaggagctcgaggagacgatcaagtcatcctcgagggacctcgcccggggggcggtggagctcgtactggcaagctaccaggccagggaccctgacttctccccgtgggcagcactggaagatttccctcccggaaccgaggacggcgcgcgcgcgcaggtccgggattccgccgaccacatcgtccacagctttgagggtacggcccctcggctcgcgttcgccctcgacttcgacgaggagggcggtgacgacagtgcggacgacagcgacgacgaggccggcgacccgggcgcgtcggagtgagcccccaaggccccgccaatcttaataacttttccttcttcttccgaggccttcgggccccctttttgtatagactgatttaatctgcaatcaagtaaagaggaaatttctgcgtcagttctgtttgttgtgtgtataagacgaggatggtctgtgccgcggtccttctgtgtcttggcttgaacaagggctagtgcccaggtcccagcctcaaacggcgcgggtcggggctagtgcctggggagatccacgtgtcgagactggccaggccgggagagcggtgaccgagggttatggatgacccgattgtgggcctttgccgattcccccccggagttcaccacgccccgggaaacggctcggttctgggccccatttggcgattttagccggcccgggccaccgagggcagggtcgagcacgagcgtgctaattcaagccaagattcttcaaaaggaaacgatggcacagacacagtcctcaggaaatcgaaaatgcttttattgaaatacggaagagaaaaaagataagtatatgcatgtggtagcccccggccaaccctgcacgcccgggggggtgcggggttggcccgagcccgagacatgacacccgacccccactaggggtagaagcgacgaaggtgttcgatgtttcacgggttaggcagctctgtgccgtcgcccgtggccagccgaatggagcccggccgggggacgccgatcactcgatacggaccctcccacattggtgagagcttgctcagtccggcacgcgtttggacgcggcgtaggacgaggtcgtcgacgcagagtgatcgggcccggacgtggcactgatggtagcgccgcaggctctgctggtagcgcgcgccgcgcgccgccttcgctctttcaaatagtcgaggtcgtctcggtgaagctgatcttgatcagcctcgcaatacatggtgacccgaggggacctcagggtgagctcagatgggaggaccacctccgcgccgtagacgaggaagaaaggcgtttccccggttgctcggcttggcgtggttcggttcgcccagagcaccgctggcagctcctcgatccacgagtcgccgtgcttcttgaggatgttgaaggtcttggttttgaggcccttgaggatttccgcattggcgcgctccacttggccattgcttctagggtgggcggggtaggcgaagcagagcttgatgcccatgtcttcgcagtagtcaccgaagagctcactagtgaactgggtgccattatccgtaatgatacggttgggcaccccaaaccgaacagtgatgcccctgatgaatttaagcgcggagtgcttatcgatcttgatgaccggataaagcctcgggccacttagtgaacttgtcgacagcgacatacaaatactcgaacccgcccggggcccgcct

SEQ ID NO: 94417 - DNA, 2279 bp, Oryza sativa
gtatggtctgcagggcctgggccggccgatgggtttgcctggcgtggaactggcacgccctgcaccgccggatcaggtcgaccgcatcgttgagagccgtcggccaatagaaaccctggcgaaaggccttgccaaccaaggtgcgtgaggcggagtgggctccacactcgccttcatggacatcggcgagaagctcgacgccttgttcccgaggaatgcacttcaggaggactccgttagccgcgcgccgatagagggtcccttccaccagcacgtagcgcttggagatgcgccggacgcgttcactcccttcgcggtcctcgggtagagtcttatctgcgaggtacgcctggatctcagtgatccaagcaatcaatctaggggagctgggagcgctcccctcgggccccgaggcctggactccgacgggcctcgggggccgttcaggcgcgtccgtctcccctagggggtcgggtcgcgccgacggctgggcaagcctttcctcaaaggcgcccggtggggtctgggctcgcgaggaagcgagccttgagagttcgtcggcgaccgcgttatcccgtctgggcacgtgccgaagctctatcccgtcgaaatggcgctccatatgccgcacctggcgcacgtaagcgtccatctgcgggtcagagcactggtactccttacagacctggttaacgactaactgggagtcgcctaacaccaggaggcggcggatccccagtccagctgccactctgagccccgcaaggagtccctcgtactctgccatattgttggtcgcccgaaaatcgaggcggaccaggtatctgaggacgtctccgctcggcgaggtcaacgtgacccccgcaccggcgccctgaagagacagggaaccgtcgaactgtatcacccagtaggcggtgtgaggcagctgcgaggggcccgagctggcctcgggggcggagacgggctcgggagctggggtccactccgccacaaagtcggcgagggcctagctcttgatcgcgtggcgtggttcaaagcgcaaatcgaattcagagagttcgattgcccatctcaccacccgtccagtaccttctcggttatgcaagatttggccgaggaggtaagacgtaaccaccgtgacccgatgggcctggaaataatggcgcaacttcctcgaagccatcagaatagcgtaaagcatcttctgggcctgagggtatcgggtcttggcgtcccggagggcctcgctaacgaagtatacgggccgctgcacctttcggcggggccaatcctcttcgccaggggccgcatctccagggcgctcttcgtccgagaggccacgcggggcgcactcgcttctgtgccgatgacctcggggtcagagggcgacaggcgcagccttcccgcagtggccccggggccatcctgggggtcgggggcgcctggcaccgtcggacaagcagcggagggccagctccgaccgtcgggggccttgggccgccgttcggctcgggggcctctcctccctgctctctcccgggtcgagtcgacacagggtggggatgcgcggagtgagggttgtcctcgtcgcgctccacgaccaacgccgcgctgaccacctgcggggttgccgccaggtagagtagcaacggctcatctggctccggggcgaccaggactgggggagaactgaggtacgccttcaactgagtgaaggcctgctcagcctcctccgtccaggtaaacggcccggagcgtttgaggagcttaaataggggtagcgccttctctcccagcctcgatatgaaccgacttagggcggccatgcagccggtgacgcactgcacatccctaagcttgctgggggggcgcatccgctctatagctcgtatcttctcggggttggcctcgatgcctcgggcagagaccaagaacccgagaagcttgcccgcaggcacgccgaacacgcacttatcggggttcagctttatgcgggtggagcggagacttccgaaagtttccgctagatccgagagtaaggtctcttggttgcgcgtcttcacaaccaagtcatcaacataggcctcaacattgcttcctatctggctacccaaagaaattcgagtagtacgctgaaaagtaggacctgcattctttaacccgaaaggcattgtcgtataacaataagttcctatgggggtaatgaatgcagttttttcctcatcctccctagccatgcgaatctgatgataaccagagtatgcatctagaaaaca

SEQ ID NO: 94418 - DNA, 671 bp, Oryza sativa
cccctttcggggggcccgcgaagcgccctcgacggcgaggacgtgaccctcgtcgtcggaacgggccgaccccttctttctcctcctgtcccgccgccctgaccgagcggcggacccgggggcggccgaagctgccacaccagaatcggaggagttccaggtccaggcctcctccttttgagccacacggtccgcgagctcaaaaagctgcgcggtggtctggggctccttggaggcgatcttctcgagcatgcggttgcgccgtacgccccccctgaacgcgtagatcaccccgtgtgcggggatgcacggtatggtgttgcggacttgacagaaccgctgaatgtacgagtgaagagactcatcgtcccttcgctgtaccgcatgcaagtccgcttcttcgcctgggcgcggatatatgccctggaagttcatggtgaactgctggcacaaatccttccaagagtggaccgacgcgggtggcaagttcattagccaaccccacgcctgacccttcagggccatggggaagaaattcgccatgaccctgtcgtcacccccggcggcctcgatcccggtcgtgtagatctggagaaactcggcggggttgacgcttccgtcgtatttttcggtgatgggggggccggaaccttggggccaacggacgttcc

SEQ ID NO: 94419 - DNA, 696 bp, Oryza sativa
aatttgatgaacaaggtgtttatggaatttctagacaagtttgtcgtggttttcatcgatgacatacttatctactccaagtccgaggaagaacatgagcagcatcttcggctggtacttgaaaagttaaaagagcaccagctatatgccaagttcagcaagtgcgacttctggcttaaggaagttcagtttctcggtcacatcgtgaatgctcaaggagtagctgtggatccagcaaatgtggagtcagttaccaaatggaccccaccaaggacagtcactcaagttcggagtttcttaggacttgcgggctattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaatcctgcctgatcagacgaaagatttccaggtctattgtgatgcatctcgccaggggctaagatgtgtgttgatgcatgatggcaaagtggtttcttatgcttcacggcagttgcgtcctcatgaaggcaactacccgacgcatgatctggaattagccgcacttgttcatgctttaaagatttggcggcactatctcatcggtaaccgttgtgaggtatatacagatcacaaaagt

SEQ ID NO: 94420 - DNA, 512 bp, Oryza sativa
tgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggctatcagatacgagaggctgcgcgacgactaacagatgcagtggaagcctcctctcagggcacg

SEQ ID NO: 94421 - DNA, 1601 bp, Oryza sativa
aattgagatccagtgcagtcctaactgtgactgcaacttaggaactacacattatctcagccatccattttttcaatgaacggtctaaatctgatggtacagtgttgatgctatagtagttctataatttttttcggatgtgaacagtactttgtagattttggacccttggatttgcatcaaaaggtcttagcgtgactgcttatgttgcagtcacactaggtactgcaccggattcaaatccgtttttgagatgtcagtcaccaaacatactgatccctgcatggtatagctagctaacgtctggctttttcaatcgactccttcaatgttcaatgtgtgtacccagacacgccgtagtggtttcccttaatgctcctgtttacttttcctctgaatttagtagtagtagagttaatttacggtcgtctaacagatccagtgcagtgctagtatgtgctgtagtacgaaagtaaaccactttaatgaaagatcctgtcgttacaggcttagtatttaaatgatgttcgtcccgtacataaaacaggggtgtaaagaatttggatagcttccgattgatccggaagatttttagaaatggatagtaccccatccgtctccaaaagttaattaatttttcatacaccccacacacacgaaaataaaaacaaaaagacaaataatccactttatcaacccaatgtaattattcccaattttatctattttcaattgtgagacgataggactcaacgcgataatcgtattgataccgatgtggagtatatataggcacacaaccttcctaaatctactcaaccaatttatataaacagaaccaagagagatataaggagattgggccacaaggaaacaaacgatctacatgccaacatatatgcgtcatgctaaccgccccccccccccgggagagcagtcttagcgtcggctggccaaacgttaagactggatcggaattccgaaaacacagtcgagggcaaacccttggtgaaaatatcagcaaactgcgatgtggtaggtacgtgtcgaacacgaacagccctgtggcgacacgatcacgaatgaagtaaagatcgatctcaacatgcttggtccgttgatgctataccaggttgatagagagatacacaacgctgacattgtcacaatagacaagagtagccttcctttgaggagtgtgaaactcatgaagaagttggcgaagccagcaggtctcggcaacagcattggcaacaaccctgtacttagcctcgcactggagcatgaaactgtgttctaacgctcggaggaccaggagatgaggttatcacctaagaacactgcatagcctgaggtagaccaccgcgggtctggacaaccggcccaattgacatcagattaagacaccaggtcaatagtgggacagcgatgaatatgaagactgtaatccagggttccatgaacataatgaatgatgcgcttgagagtagcaaggtgtggctcctgtgggtcatgcatgtgaagacagacctgctgaacatcatatgaaatgtccggtcgagtgaaggtgagatactagagagcacctgcaagactgtgaa

SEQ ID NO: 94422 - DNA, 973 bp, Oryza sativa
cttggctcatttgaccatcgtgtggtcgttgatgaccggagagacaccgagttgtggtggtggcgccgagatacgcggaacacgggcgctgccaggacgcgtggtggcgctgcttggtggaaggagccgcatcaggtcgggagccagtgcagcagcagtcgggaatggagtcgctcgtgtggtcgaagaggcggctggcggcaaagcagaaggcaccgagccaagggaccatgtcccaggggaggcaggtggcccgaggcatgcaggcggcccatgtgacaccgcccacgagctagaagatgctggcagcccaggtggtggcgaaggtggcccgtgaggtcgtggagtcaatggcccacgggaggtggccggcccatgctgtgagccatcgtgggaggctgaccctggttgtgcagttatgcggcgacgcccgatcggacctggtattgttgcagaaaaatcctcgagaaaatcaaggttagtagcatctgcattattaactatctcagcatatggaaacgagtgctcatcaaaccccacatgacacgaaatgtagatcctattggaggaaggaccaaaactcctgtaccctttgtgatccttaggatatcctaaaaatactcacatgatagagcggggggcaagcttgtggggtgtggtggcggataggttgggatagcacttgcagtcgaaaactctgaggtgtgtataggaggggtgtgcaccataaagggagaaaaacggtgtgtggtgtgtggagagtcttggtgggatggcggttaatgagatgggtagctgtgtggagggcttccacccaaaagggcggtgggaggctagcctgaaacaggagggagcgaactatgttattgagggaacatagcatgcgctcaaccataccgttttggggggaggtgtgggggcagaacaaacggagagagacaccgttggtgagaaaaaatactttgggcgctag

SEQ ID NO: 94423 - DNA, 1844 bp, Oryza sativa
gtgccggtcgccaggaggagagccgtccagaacgccgaagtgaacactggatcccgatcagagacaattgacacgggaacaccatgtagccgaacgatgtctgcgaagaacgcgcgtgccaccgtctccgccgtgtaggggtgtgcgagggcgatgaagtgggcatatttggagaagcgatccacgaccgtcaagatgacggtcttgccggcaacgcgcggcaacccctcgacgaaatccatggcgacatcggaccagacggccatcagaatcgggagaggacgcagtaatcccgctggatgcaggtgctccgtcttgttgcgctggcatgtgatgcagccctgaacgaagtcgctgacgaggtggcggtcgttgggcgtgtggaagtcgcggcggaggcggtgcagcgtcttctggatcccctcgtgcccttcctcgtgggcggccgccacgatcgtcgagagccatggcgagcccggtgggacgtagatgcgccgcttgtaggtgacgaagccatcagtgaccgtccacggtgcgccacgtgtaccggcggcgatctcgtcacggagagctagcaacaccgggtcggacgacgtcgccgtgcgcaggtcatggagtaggtcgaacaccggcgtcgtgagagcgaggagttctcccttcggtggtgcgcgacgggacaagtcgtccgccgcggcattctacttccctggtttatactccgcagtaaaatcaaatcccaagagtttgcttacccaatgatgttgtgggatcgtcgacaagcgttgatcaaggaggaacttgaggctatagtggtcggtcttcaccgtgaattgccgcccccagaggtacggccgccaatgtcggatcgcttgcaccaacccgatcagttcacgttcataggcggcaagagcttgatgacgtgtggcgactggtcggctgaagtaggcgatcggcccagccccttggagaagcacggcctcgaaccccatgcccgatgcgtcgcactagaccgtgaacgccgatctgaagtcttggagtgcgaggacgggcacggtggtgagggcgagcttgagccgctggaacgcgtcgtcggccggcggcgaccaggtgaatcgatccttgcggaggagctgtgtgagtggcgccgcaggcatgcaactgtgaagaagtccgggatgaatttgcggtagtaccctgccaggccgaggaagccacgaagatccttgggcgatcgcaggcgcggccactcgacaacggcctgaatcttggacgcgtccatggcgacgccatggagcgacacgatatgccccaggtatgcgatgctggcgtccccgaacgaacacttggcgcgcttgacgaagagtcgggccgctcggagcgcggtgaagatggtgcgcaggtgctgtagatgcgacgtccaagacgggctgtagatgaggatgtcgtcgaagaagacgaggacgaaacggcggaggaacggccagagcacatcgttcatgagtgattgaaacgttgccggcgcgttcgtcaggccgaacggcatgacgagaaactcgtagagcccatcatgtgtgagaaaggccgtcttgtggacatcatcggagtgcattcggacctggtggtagccggaccgcaagtcgagcttggagaagatggtggcgccgtgtagttcgtctaggagctcgtcgacgacagggatggggtatttgtccttgtgcgctcgttgagagcctgataatcgacgcaaaagtgccacgacccatccgctttcttcaccagcagcaccggcgaggagaatgccgacgtgctccggcggattaagccgttctcctccatcacacggc

SEQ ID NO: 94424 - DNA, 760 bp, Oryza sativa
gtggtgcctccgcctacacggctggcctattatgccgctgctgttgggcgtctacgtcttcaccgccggcctgcctccgtcgccgccgactggtgcctccgcctacacggctggcctattatgccgctgctgttgggcgtctacgtcttcaccaccggcctgcctccgtcgccgccgagtggtgcctccgcctacacggctggcctattatgccgctgctgttgggcgtctacgacttcaccgccggcctgcctccgtcgccgccgagtggtgcctccgcctacacggctggcctattatgccgctgctgttgggcgtctacgtcttcaccaccggcctgcctccgtcgccgccgactggtgcctccgcctacacggctggcctattatgccgctgctgttgggcgtctacgacttcaccgccggcctgcctccgtcgccgccgactggtgcctccgcctacacggctggcctattatgccgctgctgttgggcgtctacgtcttcaccgccggcctgcctccgtcgccgccgattggtgcctccgcctacacggctggcctattatgccgccgctgttgggcgtctacgacttcaccgccggcttgcctccgtcgccgccgagtggtgcctccgcctacacggctggcctattatgccaccgttgatgggcgtctacgacttcaccggcggcctgacttcgtcgccggcgactggtgtcctcgcctatacgggtggttggtcacaccaccgttcatggg

SEQ ID NO: 94425 - DNA, 1765 bp, Oryza sativa
ttcctaccacccgggggctcgttggatggaccgagtaacgcagggtgctaagtattattcggaataaatcaaaagcatagagataagataatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagtcgggcagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaaccggccgcctcgtctgccgccgactggtgtttccgcctgcacggctggcctttatgccgccgttgttgggcgtctacgtcttcaccgaccggcttgccttcgccgctgccgactggtgtttccgcctgcacggctggcctttatgccgccgttgttgggtgtctacgtcttcaccgactggccgcctcgtccgccgccgactggtgtttccgcctgcacggctggcctattatgccgccgttgttgggcatctacgtcttcaccgaccggcttgccttcgccgccgccgactggtgtttccgcctgcacggctggcctattatgccgccgttgttgggcgtctacgtcttcaccgaccggccgcctcgaccgccgccgactggtgtttccgcctgcacggctggcctattatgctgccgttgttgggcgtctacgtcttcaccgaccggccgccgcatccgccgctgactggtgtcaccgcttgcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgatgggcctattatgccgctgttgttgggcatctacatcttcatcgtcggtcgtctcgtctgctgctgactagtgcccttacctctacgtctggtttagacagctaccactactgatggacatcatcgtcttccgttgccgactggttatgccgccgccgactggtgcttttatcttcacaactgcgcgtcttcgctaccagtttgcttctgttgccgccgactcgtgttcacttcatcgcggcgatgccactttgtcatcatggtggagcgacttcatctttattatcttcgtcactggcaaactctattgctgctacttcgcaagttttgcgggttcaccaaccacgacgtctttgtgcaacctcgacatctcggcatgcgatgctgtgttattttactacaacaagtggctctccaatattcaggatttctacttggacatcttcaacacatatcttcaatcaagcaataactattcgacgacaagaggctacagttctcgactctatgttcagttgtttcccaactaatcaaagagtcgggggctacacaaatacacggctcaaaattcgacaagctttatgtcaagatgaagcaatcaatcaatacgaatcaacttggggagttat

SEQ ID NO: 94426 - DNA, 642 bp, Oryza sativa
ctctctctccctcggattcgtttggaaactttccccctaacctcgccggcgccattaatggcggccgggactcccgcgcccgtttcccccctcctccggccaccccttccctctcttaaccctatataaatcctccccgtgcctccctccaccgtttccgccactcgccgctctctctccccaccggaatcgagctcgcgccgtcgctctctctctccgccgtcgccgccgagctccggtccgccgccgttgttgccccggaccacctctcccctcggcgccgcctccttcggcttcgccgcatcctcgccgacctcgtccacccctccgtttcgcacgccgaccgccggagcaccgtcgaccccgtccacccgagccgcgccgccgccttcctccgctccggtcgccgttcccgtcgtcgccatcgacccggggtgagccgtggaccgccgattcgattcccccttccctcccctctctcggccgccgctccgccgtacctatggccgccgccggcgaccataggggcgcgggcgcgccgcctcccgttggctgtgccggcgtggccgccttcgggcgctccccgcggctgccgtgtggggcccggctgtcagccgtccgcgcccttaggtgcagcagacg

SEQ ID NO: 94427 - DNA, 4709 bp, Oryza sativa
ccaccaccaccagacaccaacgccattctcacccaaaccctcgcccagcaggccaacatgatgactgctttcctccaccacctccaaaatccgccacaacagaatgctccaccaccacccccacaacactttaaactcgccgagttcctccgcatccgtccacctaccttctctagctccaacaaccccgtggatgcgttggattggttgcatgccgtggggaaaaagctagacaccgtgcagtgcagcgatgaggagaaagtcgtcttcgccgcccaccgactgcaggggcccgcatctctatggtgggaccatttccaggctacgcagccagaggggcagcctattacttgggcccgcttcaccgccgccttccggaggacccatgtgcccgccgaagtcatggcccttaagaaaagggaattccgagagttgaagcaaggcaaccgctccgtgatggagtatttgcatgagtttaacaacctggcccggtacgccccggaggatgtacgggaagatgaggaaaagcaggagaagttcttggcaggaatggaccctgagctgtccgtgcgtctagtctccggtgactatccggatttccaacgtctggtggacaagagcatccgcttggaagccaagcacaaggaactagagtcgcacaagcgccgcttggcgaatttccgcaatcaacagggtgctaaccaaagggtccgctacaccaatccctatccagggggatcgtcctcgcagcagcaacagcagcaacaacctcgctccgcgccccgacctcaattcgtggtgcgcgtcccacagccgcagcaacagcagagtcaacaagggactcgtgcgacccgtcctcctatgccagccgtgcagcctggtcaaggccgcagggacgttcaaggtccgcagcgtctgtgcttcaactgcttcgagcccgggcactttgcggataaatgcccgaagccgaggcgccagcaaggccaaccgcctccccgctccaacaacggtggtaaggatgtcattcgggatcgtgtgaaccacgtgacggccgaggacgtgctgacaactccagacgtcatcgttggtacgttcctcattcattccatccctgctaccattttgttcgactctggagcttcccactcgtttatatcggtgccattcgtggggagaaatcagttgggggtagaaaggcttaggaaccctctgctcatcaccacccctggaggggttatgacagcaaagtattatagtcctgccgtccctatagaaattcaggggattccttttccctcggatctgattcttctagacaccaagaacttggatgtgatccttgggatgaattggttggctcaattccaaggaatagtggattgtgcaagacgcactgtcactctgtaccgagggccggaacaaccggttgttttctttgcacccccaacctctatcagtagttcagaacttcatcagataggactgtcagaaatccccatcgtcagagagttcggagacgtgtttccggaagaactacccggtatgccgcccaagcgagagattgagttccggatagatctttctccaggaaccactcctctgtacaagcgaccctaccgtatggcagcaaatgaactggccaaagttaagaaacagttggaagagttgaaagaaaaggggtatatacgtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcgatcagcttaaaggtgccacggtattctccaagattgatcttcgttccggatatcaccagttgcgcatccgtgaagaagatattccgaagaccgcattcaccacgcgatacggactgtatgaattcacggtgatgtcattcggtttaaccaatgctcctgccttcttcatgaacttaatgaagaaagtgttcatggaatacttggataagtttgttgtggttttcattgatgacattctggtatactcacaatcagaggaagaccataagcaccatctccgtctggtgttggggaagttgcgggaacatcaattgtatgccaaacttagcaagtgtgagttctggttgtccgaagtcaaattcttagggcacgtgatatctgctaaaggagttgctgtggaccccgaaacagtgaccgccgtcactgattggaagcaacccaagacagtcactcaaattcgcagtttcttaggtttggcaggatactaccggaggtttatcgagaacttctccaaaatcgctcgacccatgacacagttgttgaagaaagaagagaaatttgtgtggagcccgcaatgcgagaaggcgttccaaactctcaaagaaaagctggtttcctcgccagtgttaatcttgcaggatactcgcaaggacttcatggtgtattgtgacgcttcgcgccaaggattggggtgcgtgctcatgcatgacggtcatgtggtggcctatgcctcacgccagctacggcctcatgaaggcaactaccctacccatgatttggagttagccgcggtggttcatgctctaaaaatctggcggcactatctcattgggaatcactgtgaaatatatactgatcataagagtttgaaatacatcttcacccagtcggatctgaatcttcggcagaggagatggctagaactcatcaaggattatgatgtgggaattcactatcatcctggtaaggccaacgtggtcgccgacgctctaagtcgaaaaagccattgcaacactcttaacgtccgtggcattccacccgaacttaaccaacagatggaagccctgaatctaagcatagtgggtcgtggattcttggctgcgttggaagccaagcccaccttgctcgatcaaatccgcgaggcttagaagaacgacccggacatgcatggactcctcaagaatatgaaacagggtaaagccgctggtttcacagaggatgaacacggaaccctatggaacggaaatcgggtatgcgttccagataacagagaacttaaacaactgatacttcaggaagctcacgaaagtccttattccatccaccctggcagtacgaagatgtacttagacttgaaggagaaatactggtgggttagtatgaagcgggaaattgcagagttcgtggccctttgtgatgtgtgccagcgtgtcaaagcagagcaccaacgaccggccggacttctccaacctctccaagtaccagaatggaaatgggatgaaattgggatggatttcatcaccggacttccaaaaacccaaggtggatatgattctatatgggtagttgtggatcgattaaccaaggtagctcgatttattcctgtgaagaccacctatggagggaacaaactagccgagctctacttcgctaggatcgtgagtctccatggcgttcccaagaaaatcgtatctgataggggaagccaattcacctctcacttttggaagaagctccaagaagagctgggtacccgattaaatttcagcaccgcgtatcacccgcagacggatggacagaccgagcatctaaatcagatcctagaagatatgcttcgcgcatgtgtcctagatttcgggaagacctgggataagagtctcccctatgccgagttctcctacaataacagctaccaagccagtatacaaatggcaccttatgaagcgttgtatgggcgcaaatgccggacaccgctcttgtgggaccaagttggggaaagtcaagtgttcgggactgatatcctgagaaaagctgaagcgaaggtcagaaccattcgggataatctaaaggtggcacagtcccggcagaaaagttatgcagataaccgtcgccgtgacctggaatttgcagtggacgattttgtgtaccttcgggtcacgccattgcggggtgtacacaggtttcagacaaaagggaagctcgcacctcggttcgtgggtcctttccgtatcattgctcggcgcggagaagtcgcttaccagttggagctgcccgcctccttgggcaacgtgcatgatgtgttccatgtgtcgcaactcaagaaatgtcttcgagtgccatccgagcaggccgactcagagcaaattgaagttcgcgaagacttgacctacgtggagaggccagtgaaaatcctggacaccatggagcgcaggaccaggaaccgggtaatccgtttttgcaaggtccaatggagcaaccacgccgaggaagaagctacctgggagcgtgaagacgagctgaaggcagcccatcccgatctcttcgctagttcttccgaatctcggggtcgagattccgtttaaggggggtaggtttgtcgcgtctcaaaacgactctaaaatacatcctcgaaattatgcctagaataattaaaatccatgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatggttttataaaaagaaaagctctaaaaagtcctttttcccccttcccctcttgggccggctc

SEQ ID NO: 94428 - DNA, 10281 bp, Oryza sativa
cgatgattggcgcactcgagggttcggcggaggtcgacattgtcgaaggtggagttgtcgccgcaagggggttcgcctgcgaagtcgccggagaactcgaggaaatcgccggagaagattggggaaagtttcggttggggcggtgaaaacggaagtgacgccgtgaaaatttcaaagcagtggttactatttaaaagaggcgcgataacggccgaaacggaaaggaaaccctagattcactcgtaaacgaaattaagcaaaatccgcaacattacgaatatagcagacttggggggcatttgttgacgaccaaatttggttagagcatgtatcagattcgaggttaagattgaagcggatttggcaaaggagttgttctcggaaacggagtatgaatcggctacgggggcgtcggctgaagactgcatcggctaatgatggatcggacggaagatagccgatctcgctaaggtggttatataatcatctcctggattgatcaacgtgctgcacaagcattgccacgattgagataagctcacggataggcaattgtatctattaattaggatattttgaataatttctttagagatatttatcggcaagagtctgcctaagagacttgttcgtatcttaatggttgtaatagttttagattctcgtccggcaaggatacattatgtactttgggtataaatatgacccgagaccatgtaaacatcaaatgacatttcaataacactttcggcgcattgccatcctttttttcattgtttcgacgagttcttacgttcgggttgagctgcatcggtttcaatctttaacaagaggtaaaaaacttgttatggcagcttgcattctcgagattagtgtttacatctttatgacactctaatcttggttatgtaaaccgttgagttatcatatatgctacataatctctatcggtattactcggaagcagcagatagagttagatatcgttattgatctagattatataacatatctaccatctcatatagattttcatcaactggcctagatcttgtgtttatcgttgtgcttaatgctacatcgtttaagttcgatctattaattagtatccataaatacaatatctaacctgttttatgattatcgattgggatagtatcggggttttacccgatcttacctgatttagctacattattccctacatgtttacttgatatgctaaacctgccctttatattaagatcttatcacattaaagtatattcggcttactatttagtatattttgcttgttttaatatcttgatatagagtggtaacagagtattagccaatgcatgttagagctgtttgatcagctatgctatgaacatatctatataatcttcatctcaaagtttttttgatgggaaacaacaggagagactcctactgtgctatattataataataaataatttacaggggtatgtacaaaatcttcatctcaaagtacttttaagcataagtgatttatactgtctcgactagctgttcgatctatcccaatcagttggtttaagtatatcttgagaagaaaattatatatcattgatatctacagccgatcgagcagatttaactttattttgttttactcttcattgctgatctaatgccaataacatcggctaagcggttaacgatatgtcatcggcctttagtcgatcggctatcgtttgtggattttactttgtttttcttgttttcctttcttgttgattgcaggatcaaatcaactagcatgcctttgaacccaaaagcaagatttagggcctgcactagagtgaagtagatctcccaggccagtgtgtgtttttcgcatcaacaatatggtgttgttttaggaaaagaatggaaacggtcttgcgaaagaaaatggacacggctcgctatgcaaaacaaaaccgcggatagagaggggagtgaattgggcacgattcatgatcaaaggtgtgagagaaaaaaattaattagttcaactctcgacaaattaatttaaaaacattaactccgatgctctgaaaattctgctttaagtcctgttagcgattttagagcaaagaaaatttgaaaaaaaattctccctgacaattcctattattaaatgcattgttaatttgggttttctcctaattaaccaaagtaatttctttaaaccaaagtaattgagccgcagaagtagaaaaataaaagaagtaattgattttgaatgtattgttttacctttgtccccctagcggtcacaatacctttggattttttccttcccttatcctctcccttccggcttccccctatcgtcatcttctctcaacggctagggaggtactccctccgtttcaagttataacaaattttaacttttagtcaaagtcaaactactacttcaagtttgactaagtttatagataaatataataatatttttattaccaaattagttttattaaattagtaattagatatattttttataataaatttatctttggtcgaagatattactattttttataaacttgtcaaacttgaagcggtttgattttgaccaaagccaaaacatcttataacctcagaacggagggagtagcagagaggagcgacgacggagaagtgagggttagaagcgacagcagcagcccgcccaagcgatggcggcggcaccgcactaggaggaagctacagcggcggctcagtgtggggtagaggcgatggtggtgacggctctgcgcgaggaggctgtgaggggaagaagcgatggcagcagcccagctaggcaatggcggcagcacagcagctccgcgcgaggaaacgacagcagcggctcggggtggaggcgatggcggcgacggctcggcgcgaggaggaggcgatggcggcggtggctcggtcaggggaaggagcggcggcgcggcggctctacgcgaggaggaagcgacagcggtgactcgttggggcgacggcggtggctcggtgctgaggcgatggctggcagcggctccgcacgaggatgggtcggaggtagcttgccacgggttggagatgacagtgacgagcgggccaagaggcgatgacggtaacaacacactaagggtacaaatgtcttttcgtcaaatgtttaacacctttagcctgtccatccaaagtagttgtaatatttagcttcgttttaaaaaagtaggggaaaaaataaaaaccctaaaatacaagggtaaaatcaatattaaatatgaaagtaggggtaagaacgaaattgcctcaaaaaatttcgaatcccggtcggtcaggaactcactgccatccaaaaaatttctactttgtaaatatttgtaacaatttgtaacccttatttatatattttaatatattgcattagaggctctcctcctgtttcccgtaaaaaaaaaagggaattcactgccatcgttattatttggacacaatcggcgtgaggaacaagccgcccacgagaaggtccaggaaattgctcagcgtagagcgtcctattaggtggataaaaatttgactgtacactactgtacgcatgcaagtatagcacagactagtttattggagaatgctgtgtttagttcacgctaaaattggaagtgtggttgaaattagaacgatgtgatgaaaaagtttgaagtttatgtgtgttggaaagttttgatgtgatagaaaaatttgaagtttgaagaaaaagttgggtgtccgcccgcctcttctagcgtgtactggtggtctgattggttcttctctactaatctgagtgcacgtctggtgcccgcccgcctcgcttcacctcttctagcgtgtactagttcattgcttattcacatatttttttcttctttcaatattttcctttagaataattatacaatttacgattcaattgcaccgtcatatttcttgaattaaatatttataacaagacctcacacgtttctatttcgatgaaaaaattgtttcacccgttaaaaaaaattatttcagttcacactataaaatgttttagagatatgcgacatttagaaaatactaaatgtcgcatatctctgaacgagtgagacattaaaaaaaagttgaaaaatacaatttatttgcaaatacttaacattattgtaatatttgtgtatcacatacttttcaaatattataaaacattaggtgaacaatgcaaacaacaacattgcaatatttacaaattaattagtagctaaaatactagttgaaacatttaaaaaaactatgtgcaacatttaaaaacactcactagtagctaaatttatttttcatcataatataatcatatgcggtcctgttataaaaatttatttataacagatttaatggtataatcggattgtaaattggatatgtaatttaagagaaaaaatagtttaaaattaccaaaaaggacttgaaccaacctaagcaaccctgctttattcttatactcagtgcatgcatgtagagtttttaactagcatgagtgttggttttgatgtgcacctgaccacctataccgacagaggcctgggtgtggtgctcgatccatagtagcttcgggatagagcgcccaataaaaatcagattgtacactacatgcatgcaagtataccatattttttctcctaaactacttattcaatctacgaaccgatcatcccgttgtatttgtcacaattaaatctttacaacaatatattatatgattatattctaataaaataaaaacatatgtttcaaatcattaaggctgtatttagatggtggaaaagttgggaagttgggagaaagttggtagtttggagaaaaagttggtagtttatgtctgtagaaaagttttcgatgtgatgtgatgtgatggaaagttgggaattagggggaactaaacacggcctaaaactcaatgtttcaatgtgttttattcggtgtgttctatgaaattcactgaactacctgccactactctctgtctcctctcttcactctatgcatgcattttagcgatttttaaaatgaattttctcccaaactatttatccaatctaagatccgatcaaaccgttgtattcgctgtaattaaatctttacaataaaatatcacatgactatattttggcgaaagaaaaacataagtttcaatcctttaacactcggtatttaatacatgatagtgatatatttcaacgtgtatcttcgtcatgtttcataaaatttgtaaatgtctcagttgctattttttttatttcaccatactttatgtttcatgtatttgtcaactgcaacatttgaccatccgatatttttttaaggaatcgggcgaccgatccgtagtttccttctttctagagaatgattgctaaccgaattcccagaaattaccatgaaactgcaggctatatatcataaatagcaaaagcttaaagcattatttatgtcataaatggcaaaagctaaaagcattatttacctatctcagctatccctggggaaattaaaaaaataaagagaagaaataaaagagtggccggtggtcttactatatatgcaaagatatggagtatataccaggaatcctgccgctcgggcgaccgacgcaaaaaatgtttcacctaggtactcacaatatttcactatgtatagatctagtgttacagtgaattaaaatattcttttgcaacaaattacccacatattttggaaaccctctattaacggaattcgtttcatttctagttccataaaaaatgtttcacttagtgtactcacaatgtttcagtatgtatagatctaatgttgcagtgaattaaaatattcttttacaacaaatcacctacatattttataaaccctctattaagggaattcgtttcaatttttattccaccaaaaatgtttcacctagcgtacttacaatgtttcagatgtatggatcaaatgttacagtgaactgaaacattctttcgctatttgctgaaacattattttatataaggtgaaacaacacccgatttaacgattgaaacgttttcaatctacttagtgaaacaattttgatatacttggtggaacatcgtgcaacatttaaaaataattcaataataagctacattttttttcattggaatataaccttgtgtgatcttgttttaaagattaagttgcaatgagtttaatggtgtaatcggatcatgatttggataaataatttaagagaaaaattgtttaaagtggttttgcacgcatgcgtcatgccctcaaatattttttaagaagaaaacgttcaaattatatgcttattaatatttgttgtttcaagatgtttacagtataaataatagtgagatatgcactagacacaagtatattcgaactttgattagatctaagatcgatcataaataaaaaaattgtgcaaagtataaaacaagcatagtaaattctataaattagtaacaataaaatgtgcaacttatgggtgatggaattaaaaattccgcatctgattaaaattttaatattgataatattttaacattatcatgactttaaatcgtattgataatttttttaaataaaaatggaattagaaatacggtgaactttttagtttcagtttctctatgttgtaataatcacaaagatgaatttgtgcccatctgactctctctctctctctctctcggggatcccatctgactctcagtttagtattttattgttctatttccaaaattcaaaattaacaatttggaattaatgaggactatttttttgaagtaggctagtattaaaacacccgtgaaatggaggggttggtgactagtataaattaatagtaagccctaacaataaacatcggacaacaaaatgagtgcgaaatacatagatgtaaataatgctgacttcctcggagttgtggtatggtactataggaatctggttatgaccctttgtttcaaaataagatcattttcccttctctttatccaagataaatttgttttttaagtagtctaacaaatatacgcattgatgttagtatgacgcatatatgttggcatgtatatcgttgtttcctgtggcccaatctccttatatctctcctggttctgtttctatagatcgattgagtagatttaggaaggttgtgtgcctatatgtactccgcatcggaatcaatatgattatcgcgttgagtcctatcatctcacatggtatcaaactcctcgatccaccgcttccgctcctaaaccctaaacttctcgccgcggccatgtcgaccgccagctcctctctctctcatgatgcgctcgtcgacaccatcaccacggcagtggccgatgccatccgcatctcctaccagtctcctcccggcctcacggtggacgacgcagttaccaagtccatcgccgactctgctgctgacaaggcctccgctgccgtgcgcgatgcactctccaaggatttgccatcgccaatagccgtatctgatctcccagcaacggaaaccgcttccgttgcgccccaggattccccgcccatcctcccagagatcgcggcgctactcgcccgtctctgtgtcggtcttccggctccaacttcagccaatggcaccactgccgacaacaccaacagcttgccgcctccgcaagtcttggacgccgaagttcgcaacgtccttcacacccaagctgttgctgtcctcaacgtgaaggcactcgtcccgctgacgctcaacctcgccgctgcaaaccattctcgatggcgcggcttgtttctcgtgattctcggcaaatatgccttgacggatcatgtcacctccgatgtgcctctccttgatcaagccgactggacgcagatgaagtgcgtggtgctcgcctggttgtacggaataatctcccaggacctgcttcaagaagtcatgtcgccgacggcctccgctcgcatggtgtggcgtgatctcgagttccaattcctcagcaaccgcgaactccatgccgtcaacctctccgccgagttccacacgttatagcaaggtgacctctctgtcacggagtattgccgccggctctgaaccatggtggacaacctcacggatctcgggcgaaccacagagcgactgcacgcttgttctcaccctcatcaatggattgagccctaagtatggaaatatgtaatctctcgttcccatgcaagtcccatttcctagttttctccaagctaggtcgcagcttctgctcgaagaaatcacgagaggacaccacccggtgtcagacacggcaatggcattcgttgcatccactgttagtgcttgcatcgtacccaacacctcctccaacacccaaggcggcggcggcaactccgacaacaactcccgcaatcgccgctgcggtcgcggtagcaatgaaggacaaggcggcggctcgtaggtaggacacgccacaggaggtgagcaggccggtcagcaagctgatgccactcgcccggcctagcagtggcccaccccattcaatccatgggctggcaccatccagatgttgccaggccacccggcctcccttcgcggggcctatcttcaacgggctccctctccaatacaatggtgggcagggccaatacagtgcgggtcagcccatcaacttccctccgcagactggactgccctctcttcaactgcctgggccggcggcatattctgccccccctccccttcggtggtccctccagcccatcttgcgcttccaacactgcaatggcccgatccgtctcagtggaacccacaatcgcttgcaagctccttaaacaccaccacactgactacaccgacttcaaatgagtggtacatggattcaggtgcatcttcccacatgagtgctcatcccggtattcttactgcatcccatcaaccatcccactcactgccctcccacattgttgtcggtaacggttctcttatacccatcacagccactggcaccgcttatttacattaccccaatcactcctttgagctcaacgatgtcctagtttctccacatatcattaaggatcttatctccgctcgccgttttgctcgtgatcattggtgtgctgttttgcttgacccttttggcctctctgtcaaggattaccaacccaggattgaaatcgccaggtgcaataactccagagacctttacccctctctgcggacaccctaccattggcaacctccgctcaagcatttgtcgccatgccctctaacaccgatctttggcattgctggctcggccaccttggtcacgaggccctcactcgcttatctcaggcttctgttatttctcctccgaagagcgccacctctctttgtcacggttgttagcttggccggcacgtccgccttccttttactatgagttttactggtgctagagcaaagtttaagcttattcattgtgatctgtggacctctcccattgttagtgtgtcaagttttaaatactatttggttatctctgatgacttctctcattatgtgtggaccttccctttaaaatttaaatccgacaccttttctaccttgtctcaattttttggatttgcgaaaacccagttctccaccaccatccaaagcatccagtgcgacaatggtcgtgagtttgacaactctagcgcccaaagtattttttctcaccaacggtgtctctctccgtttgttctgcccccacacctccccccaaaacggtatggttgagcgcatgctatgttccctcaataacatagttcgctccctcctgtttcaggctagcctcccaccgcccttttgggtggaagccctccacacagctacccatctcattaaccgccatcccaccaagactctccacacaccacacaccgtttttctccctttatggtgcacacccctcctatacacacctcagagttttcgactgcaagtgctatcccaacctatccgccaccacaccccacaagcttgccccccgctctatcatgtgagtatttttaggatatcctaaggatcacaaagggtacaggagttttggtccttcctccaataggatctacatttcgtgtcatgtggggtttgatgagcactcgtttccatatgctgagataattaataatgcagatgctactaaccttgattttctcgaggatatttctgcaacaataccaagtccgatcgggcgtcgccgcataactgcacaaccagggtca

SEQ ID NO: 94429 - DNA, 1501 bp, Oryza sativa
gatttttcggcacaagattcaggtggatggttctctcgaccgctgtaaggcacgatgcattctttgcagctgtactaagtgccccaacattgacatcgacgagaccatcagtccggttgtcaagccagccaccgtccgcacagttctgagcttggcagtttctcgggactggcctattcatcagcttgatgtcaagaatgccttcttacatgggactctacaggagacagtgttttgctctcagctagctgggttcgtcgatgccttcaaacctgacttagtgtaccatttgaacaagtcactttatggtttgaagcaagcaccccacgcttggtacaatcggttcgccaacttcctcctatcctttggatggtacagtcagttcgccaacttcctccaatccactggattcaaagaggctaagtccgacacctcgctgttcatctatcgtcacgggcccgctgtggtttatctttttctatatgttgatgatattgttctcactgcttccacttgcgatctcctctgcttcttggaaccctgcaccactttcttggagttcgtgtcagccgcattccgtctggactcgttctcagtcagcgtcagtatagtattgagattcttgagcgggctgggatggctaactgtaagccttgctccagccttgctccactccagttgacaccaacgccaaactgtcttcccctcatggcactcatgttgccgacccgactgattttcacagtcttgcaggtgctctctagtatctcaccttcactcgaccggacatttcatatgatgttcagcaggtctgtcttcacatgcatgacccacaggagccacaccttgctactctcaagcgcatcattcattatgttcatggaaccctggattacagtcttcatattcatcgctgtcccactattgacctggtgtcttaatctgatgtcaattgggccggttgtccagacccgcggtggtctacctcaggctatgcagtgttcttaggtgataacctcatctcctggtcctccgagcgttagaacacagtttcatgctccagtgcgaggctaagtacagggttgttgccaatgctgttgccgagacctgctggcttcgccaacttcttcatgagtttcacactcctcaaaggaaggctactcttgtctattgtgacaatgtcagcgttgtgtatctctctatcaacctggtatagcatcaacggaccaagcatgttgagatcgatctttacttcattcgtgatcgtgtcgccacagggctgttcgtgttcgacacgtacctaccacatcgcagtttgctgatattttcaccaagggtttgccctcgactgtgttttcggaattccgatccagtcttaacgtttggccagccgacgctaagactgctctcccggggggggggggcggttagcatgacgcatatatgttggcatgtagatcgtttgtttccttgtggcccaatctccttatatctctcttgg

SEQ ID NO: 94430 - DNA, 662 bp, Oryza sativa
attttttcataaatttgcaatttttcagatatacgtgcccccctaattttacaatgtcaaaagctttgataaaattataaaactactaagggcgatataatcatatcggccattgtacatcggcaaaccacaaccgattacaatatgaaaacaactaagggcgatataaccatatcagccattgtacatcgacaagccacaaccgattacaataggaaaacaactaagggcgatataaccatatcggccatctcaaggcgatgtaaatacatcggctatcatgtatcggcaatatcagccgatcatgcattaacccaaacacttgggtaatatttcttcaagtacttaccatttagtgctcgtccataaatttctccatcgagtccttgcaacatgtaagctcccttagacacaaccttatagatttggaacggtcctttccaattcggcgaccacttgctgaatttgttatcccaagtcccaatcagcaaaatcaacttccatacatgttcaccgtccgaaaaagtcttgggcaccactttcttattgtaatgtcgagcaactcgttccttatccttggtaacctttgcaagggctcttaatctagattgaaccaagtcttccctttcatcggccatgagattataatattcattggctgt

SEQ ID NO: 94431 - DNA, 735 bp, Oryza sativa
cgatgaatatccaatgccagtagctgatcagctggttgatgctgcctcagggcattagatattgagttttatggatggaaatgcggggtacaatcagatttttatggctgaagaagatatccataaaattgcctttaggtgtcctggtgcgatcggcttgtttgaatgggttgtaatgacttttggtttgaaaagtgttggagcaacatatcaaagagccatgaattatatctaccatgatttgatcggctggttggttgaggtctacattgatgatgtggttgttaagtctaaagagatagaggaccacatagccgatttgaggaaggtttttgagaaaaccaggaaatatggcctgaagatgaatccaacgaaatgtgctttcggtgtatcggctggccaatttttgggattttttgttcatgagagggggattgaagtaacccaaaggagtgttaatgcaatcaagaaaattcagcctccagagaacaaggcagagttacaggagatgatcggcaaaataaattttgttagaaaggttatttctaatttgtctggaagattagtacctttcacaccattgttaagattgaaagccgatcaaaagtttacttgggggcagagcaacagaaagctttggatagtactaaggaatatctcagctctccttcagttttgattcctccacagaaaggggtaccggttagattatatctatcggccggtgagaagtca

SEQ ID NO: 94432 - DNA, 584 bp, Oryza sativa
ggctgcagtgaatctgatgccttatgctacatttaggaagctgggcagaaatgctgaggatctcatcaagacaaaaatggtgctcaaagattttggtggcaagccatcggaaaccaaaggagttttgaatgtagaactaacagtcagcaacaaaactatccctacaacattctttgtcatcgatgggaagggttcttacagattgttgcttggaagggattggattcgtactaattgttgtattccttcaaccatgcatcaatgcttgattcagtggcaaggcgacaaggttgaaattgtgccaaccgacaagccagtcaatgttgccagtgccgatttaactctttgggagatggatggtcttgattgcttatctgaaaaagtttgggatggagattttttaaaagtgtccgattctgatatacagccaattgaagacagagagcccaagctattattttgagggcgtcgtggagggttcaaacgtctacaccaagaacacagcagatgatctcgatgacaagcaaggacagggtttcatgttggccgatgatttggaagaaaatgacataggtctaggtgat

SEQ ID NO: 94433 - DNA, 1186 bp, Oryza sativa
cctccccggcgttccgccccgcccacccgccgccgcgtcctccttggcactccgcccccgcccgcacgcagccgctgcatcctccccggcgctccgccaccacccgcacgccgctgccgcgtcctcccccgcacgccgccgccgacccgtttgagagagagaggaagagtgagagagtgaagagagaggaagagatgatgaggagatgataggtgggtcctatttttttaaaaaaatggagtgctgactggattgccacgcgtacgccacgtggaccaaatccatagcggattgggtccaggggggtaatttgtccggtttgcatagttgagggtgaagaagaatacccggttttgtggttcgggggggggtaattcagacgaccgcgatagtttgcgggggtaattcgtacgttttcctttctagtcccatattctatacccaggtagcaaatttcaaatgcttccttggtccaattttctcaaattttcttactctgggccgacatatgtatatagaggaacaaattttactaatagcccactgaatcatcatgccaaactagacatagaatcattctatgggatagcaaacataatttttactatataattgtcttcctacggttccaatataataaatgctatgttggtaaaattaatttcaggttacatattacctactagctaataatagttttgcaatatctgtttgcttttataaacaaggctttcgcaactcattccactatacctaatttttgtaaggttattgttagacggatatctattttctatttgtacaaggggttttctacatatatacctatatatatttgggtctagtgcttcttagatgaatacaagtgctaattcttaagccagaactaggttagacttctcatctccctagaaacgatttttttcctctctccaataattacctgcttgaactttgtgtggaacactcctgcctcttcatctttgaagccatgaggttcctgttgatttagcaaaacatagttctcacccgtcttcgctccgagtatgagtcgatttgtgcacagttgcttgctcggcaccccccgtgttactctcatggaagctctcaaggagatttgttctgaggagattcatcttcgagaagcgggtattctagcacatccttcttcagtattagcttttcg

SEQ ID NO: 94434 - DNA, 771 bp, Oryza sativa
ggcgaattcgagctcggtacccggcggtgaagtcgtagacgcccaacagcagcggcataataggccagccgggtaggcggaggcaccactcggcggcgacggaggcaggccggtggtgaagacgtagacgcccaacagcagcggcataataggccagccgtgtaggcggaggcaccagtcggcggcgacggaggcaggccggcggtgaagacgtagacgcccaacagcagcggcataataggccagccgtgtaggcggaggcaccactcggcggcgacggaggcaggccggcggtgaagtcgtagacgcccaacagcggcggcataataggccagccgtgtaggcggaggcaccagtcggcggcgacggaggcaggccggtggtgaagacgtagacgcccaacagcagcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagttgtagacgcccaacagcggcggcataataggccagccgtgtaggcggaggcaccactcggtggcgacggaagcaggccggcggtgtaaatgacgatgcccatcaacggtggtgtgaccaaccgaccgtgtaggcggggacaccagtcggcgttgatggaggcaggccggcggtgtaaatgacaatgcccatcaacggtggtgtg

SEQ ID NO: 94435 - DNA, 1552 bp, Oryza sativa
gccgctccggggctgggcgccgtactttctgccaaatgggtcgggcacccggccgcacagcgaggcggtgctcgatcacctccctaggaccccgggcatatctgacggcttccatgcgaagacgtcggagttcacccgcaggaaggagacgagcgtgcttttctatttggcgtccaaggtaccgtcaatcttggcggttttggacggatcatcgccaagggaaatatccttgacggggacctcgtcggccgaagcgaggcgcttcttcgaggcgcgggacgctgaggactccgagggctgcggctcggtggctgccaccaagttgtcggcgcgctgctccgcgcaggccagggcgaccttcacatcgtcaaagacagtgatggggtcactggggcccggcatcttcatctggaggtaggcggccatgaacttcaccaacgagggcctgcccaggaccgcattgtatggcagattgaggtccgccacgtcgaagtcgatccgctcggtgcggaagttggtggagtcaccaaaggtcaacgggagctcaacgtgacccagaggccacctatgtcccggggtcacgccaatgattggcaatgacggctggagcttcattcccggagccttgagagcgtcaaaggtagctggggagatgatgctgaggctggctccctcgtcgaccaggacacgcttcatcttgacgttgtggatggtgggggagaccacgagggccaacttccctccccgagtgagcactgtcggatggtcgctctggtcgaaggtgagtttcacctccgaccagcgcgccttccgtgccgcctcgtgagttgggacggcggccagaagctcacgcctcatggtcttgaagccgcggcgggaggtgtgagcgcaagcccccccgtcgagagtggcgacggttccctgatgtatctggaattccagatccttgctgtcatcgccgtcatcagcgggggccttcttcttggcctcccctcgccggtcattggcgggggtcgcgggggctttgccctcccatcgactctgccgcttctcctcatcggccttccggaaccgctcggccaagttcttgaccgagcggcagtcggcgaggctgtgccgataggtgttgtgcaccgagcaccacttgtctgccgaccgaccctcgccggagggagcagtggagctcggcttgtcgccggtggctttttccttgcgcgggagccgtgagggcccatcggccgcaaggacgtggccctcgtcatcggagcgggccggcttcctttttcccctcctatctcgtcgcttaggacgtggccctcgtcatcggtgctgggcgagtttcaggcccatgcctcctccttccgcgccaccttgtctgccagctcgaagagctcggcagtggtcatgggctccttggaggcaatcttctctagcatgcggttgtgccgcacgccattccgaaatgcataaacgaccgcgtgggccggaatgcatggaatagtgttgcggacctggcagaagcgttgtatgtacgagcggagggactcatcgt

SEQ ID NO: 94436 - DNA, 1467 bp, Oryza sativa
taggtggcctctgggtcacgttgagctcccgttgacctttggtgactccaccaacttccgcaccgagcggatcgacttcgacgtggcggacctcaatctgccatacaatgcggtcctgggcaggccctcgttggtgaagttcatggccgcctacctccagatgaagatgccgggccccagtgaccccatcactgtctttgacgatgtgaaggtcgccctggcctgcgcggagcagcgcgccgacaacttggtggcagccaccgagccgcagccctcggagtcctcagcgtcccgcgcctcgaagaagcgcctcgcttcggccgacgaggtccccgtcaaggatatttcccttggcgatgatccgtccaaaaccgccaagattgacggtaccttggacgccaaatagaaaagcacgctcgtctccttcctgcgggtgaactccgacgtcttcgcatggaagccgtcagatatgcccggggtcctagggaggtgatcgagcaccgcctcgctgtgcggccgggtgcgcgacccatttggcagaaagtacggcgccaagccccggagcggcaagccttcatccgagaggaggtgacgcagctcctggaggccggcttcatccgagaagtcatccacccagagtggttggcaaacccggtggtcgtcccgaaggccaacggcaagctccgaatgtgcatcgactacacggacctcaacaaggcatgcccaaaggatccctgccctttaccacgcatagattagatagtcgactccactgcggggtgcgaccttttgtctttcttagatgcctactctgggtatcaccagatccgcatgaggaaaaaactgctttcattactcctgtaggcaccttttgttatacaactatgccttttggactcaagaatgtaggtcctacttttcagcgcatgactcgcattactttgagtaatcaaatagggcgcaatgtagaagcgtatgtcgatgacctggtggtaaagacgcaccaccaggacacattgttgcagtacttggccgagactttcgacagtcttaggtccacgcgcatgaaactgaaccccgaaaagtgtgtgttcggtgtgccggtgggcaaactcctcggttttctggtctcctcccaaggcatagaagctaatcccgagaaaatacgcgcgatagagagatgcgcccccccagcaagcttagggatgtgcagtgcgtcacgggatgcatggccgctctaagtcgattcatatcgaggctgggagagagggcgctgcccctaatcaagctcctcaaacgccctgggccgtttgtatggacggaggaagcggagcaagctctcaattagctgaaagcttacctcacttcccccccatcctggtagccctggggccagaggaaccgttgctgctctacttggctgcgacaccccacgcggtgagtgccgcccttgtagttgagcgcgac

SEQ ID NO: 94437 - DNA, 1084 bp, Oryza sativa
agaaaatacgcgcgatagagaggatgcgcccccccagcaagcttagggatgtgcagtgcgtcacgggatgcatggccgctctaagtcgattcatatcgaggctgggagagagggcgctgcccctaatcaagctcctcaaacgccctgggccgtttgtatggacggaggaagcggagcaagctctcaattagctgaaagcttacctcacttcccccccatcctggtagccctggggccagaggaaccgttgctgctctacttggctgcgacaccccacgcggtgagtgccgcccttgtagttgagcgcgacgaaggcaacacgcgtcgcgagcccggccatcagaagggaccaggggccccctttactggcgatggcccctcgtcccccgacgacattccgagacgcgaaaacccgatacccacaggcccagtagatgctttacgcagtcttaatagcctcaaggaaattgcgccactacttccaagcgcatcgggttttcgtcgtgacgtcttaccctctcggcctaatcttgcacaaccaagagggtactggtcgggtcgtaaagtgggccatcgagctcgcttaggttgacctgcacttcgaaccacagcatgcgatcaaaagctaggttatggctgacttcatcgcggagtggacctcggcggacgaccctgttccgtccaaagttccctccctccttggagatggaggagacccaaacgccgacatttgcgcggtgcactaggttatgcactttgacggctccctcaaccttcaaggtgcaggggccggagtcacgctgacttcgccgagcggggatgtcctcaagtacgtcgttcggctcgatttccgagccacgaacaatatggtggaatatgaaggactcctagtgggattaagggcggtggccagagtgggcatccgccgcctcatagtcctaggcgattcccagctggtcgtaaatcaagtctccaaggagtaccagtgcaccgacccgcaaatggacgcttacgtccgcgaagtgcgacgcatggaacgccactttgacggactcgagctccggcacataccccgacgcgacaa

SEQ ID NO: 94438 - DNA, 1920 bp, Oryza sativa
  unsure (1)..(1920): unsure at all n locations
tgccacgacccatccgctttcttcaccagcagcaccggcgaggagaatgccgacgtgctccggcggattaagccgttctcctccatcacacggcattggcgctccaactcatccttgtggcgagccgggtaacagtatgggtgtattgccactagcgccgacccgggtagtaactggatgcggtgtgtgcggtcccggaccggtgaaaggcccgtgggctcggcgaaaacgtccgtgaactcctctagcagcgagtccaagtgcgccgagggaccgcacgctagggcgcgtggccgctggtgccccggcagtccgtggagggtgacgcagtggtcgcggtgccagaacgacattgtcagtgccgtgaagtcccaaaggatcgggcccagtgtcgcgagccactgtgttcccagtaccagatcatagccgcccagagttaggacgtacacgtccgtggcgaattcctcgccggcgatctggaacggcatgtcggggaagacgccggggcacgccaccttgtcgccgttcgccaccgtgacgttgaggcccgaacgaggttgaggatcccggccgacacgcgccgccgcatcctgagacaggaacgtaggcgtggaaccggagtcgatgagggcatagaggtcagtgtcgccgaggtggaccatgatgtgcatcgcgtcggacacgcgaactccggtcgccacatgcagagaaatccggagggttgcgggtgcggccgccgggtcatcggtggagtcagtgtcggcgtcgtcctcccccatctcaaggaagaagaggcggcggcacacgcggttgtgaccgcgggagtacggctcgtcgcaattgaaacacaggccttggcggcgggcgctcgtccatctccaacggcgatagacggcggatggcgcggttaaccgccgggggcgtgcctgctggtttgacagcgacggccggctctgaagccggtgccggcgggttggccgctggtggcagcggcaagaggccgcggccggcgtgccgcggtgggcgaggtgnacgcgcagcgtggtcgcggcgttcgaacgagcgggcgaggctcattgccgcttccaatgtcgtcggattttgcatctgcacatctaaactcattggctcttgtaatccaatcgtaaacagttgtacctgctgatcttcggagaggtagcccgcgcgagccagcaggtcgaggaagtggtcggtgtagtcgtccaccgtagacgtgcgccggtaggccgcgagctcgcccagcggtgctgaacggagtagggggccgtagcgcatgttgaggagctccgaaaaacggtgccacgagggcggcccatggtcacgctccagacacgtataccactgctgcgctccgtcgagcaagtggtaggaggccagccacaccttgtcatcttccggcgtgcgttgtccccagattaattgctcacaccggttgagaaaaggaagtggatcgtcgcggccgtcgtacttggggaagtcgagcttgtggtagcgtgggggtcgctcgccatcaccatcatagcggtgaccgaatcgaccgtggaagccgctccgaccgccgtccgggccaaagccatcaccgccgcgagcaaagggatcgccgcggccgaagtagttgccgccacggcctccgccgaggccgccaccgccacttacgtcgtcgaaatgaggggactgtgcgcgagccccacgctccagacgattgatgaccatgttctgatcgcgctgctgctgatcgagatcagtgatttggccgctgagcgcgtcgaggcgttccaggacttcctcgaaacgccggcgccaaacgtcgtcgttgttggcaccgtctgccatcggagccgcagaaacgcgaaggatcgaaaggaatctgataccgagcacatgggtagccgagccatg

SEQ ID NO: 94439 - DNA, 546 bp, Oryza sativa
actataggcgaattcgagctcggtacccagatttacaagataaattgacagccgatgattattacaatcttatggtagatgaaacggaagatctggtccaatctagattacgtgctttggaaaaagtaacgagggataaggaacgagttgctctccattacaataagaaagttgtgcctaagtcattttcagaaggtgagctggtttggaaattgattctgctgataggaactcgtgacaacaaattcggcaagtggtctccgaattgggaaggaccgattcgagtatacaaggttgtgttgaagggagctgatatgttgcaagggcttgatggagaagtttttggacgagctctcaatgggaaatacttgaagaaatattatccaagtgtttggattaatgcgtgaccggctgagttttgtcgatacatgttagccgatgtgttaacatcgcctttagatggccgatataagttatatcacccttagcattgtttttatcatagttggttgtgttttaccaatgtatgatggccgatataagtta

SEQ ID NO: 94440 - DNA, 1276 bp, Oryza sativa
tccgcctacacggctggcctattatgccacggttgttgggggtctacgacttcaccgccggcctgcctcagtcgccgccgactggtgtcctcgcctatacggttggttggtcacaccaccgttcatgggcgtctacgacttcaccgccggcctgcctccgtcgccgccgactggtgtcctcgcctatacggttggttggtcacaccaccgttcatgggcgtctacgacttcaccgccggcctgcctccgtcgccgccgactggtgcctccgcctacacggctggcctattatgccgccgctgttgggcgtctacgacttcaccgccggcctgcctccgtcgccgccgactggtgcctccgcctacacggctggcctattatgccgccgctgttattatgccgccgttgttggatgtctacgtcctcaccgttggctcaccttcgttgccgtcgactggtgtttccgcttacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccgttgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagataagataatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagtcgggcagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccaga

SEQ ID NO: 94441 - DNA, 595 bp, Oryza sativa
aagttttgagccatttaaatgaatttctataattaaactcgatgtattgcgcaattattaattatttttacaaaggaaaaaggatctcgctgacgtcagcaaggggcagccggcgccgacacgcgggccccacacgtcagcgggtcaaggagctcggtgcaccgtggaccgggaccacaaggacggtccaccgccggtccacgggatggacggcccagatcgggccaagccgatcgggcagctgaggggagtggtggcagggcacgggcacagccagggctggcccgaccgaccacagagggcggcggcgcgcagacggccggacaaccggcggcggcggcggcgcaacgcggcgctggcacgggaggcggccggcaaagaggaaaaggaggagggaggcggctcaccgagaggcgcggcgacggagggagcgtccgcggagggaggcggcggcgctccttgggtcgacgacgcggagggacgcacggcggtggatggcgagggcgaggagccagacgaggtgcaacacacgccgacgaagccgacaaaggtgacggcaagcggcgaccgcggctatggcggtgatgattgccgg

SEQ ID NO: 94442 - DNA, 507 bp, Oryza sativa
catcaaacttcttgtcctgatactcctccacaaaatggagtagctgagaggaaaaaccgtcatcttttggagacagctcgatcattgatgtatactatgaatgtacctaaattcttgtggagtgaggcagtaatgacagcaacttatcttatcaaccgcacaccatcaaggatactcggaatgaagacaccatgtgagatgatatttggaaagaataaatttggtgttccaccaaaagtgtttggttgcacttgttttgttagagatcatagaccttccattggaaaacttgatcctcgggctgtcaaatgcatctttgtaggctattcatcttgccagaaggggtataagtgttggagtccattagaacgacgaacctttgtaagtatggatgttacttttagagaatatgtcccattctatggtgagaagacagatttaagttctttattcattgatcttgatgattcaactagtggttatgatggtcaacaaatggaaggtgaa

SEQ ID NO: 94443 - DNA, 597 bp, Oryza sativa
cagtccagccagtcctcatctgtcgccccttgccgattgcctcagcaaccagcaggagaatgctcgacgcatatgcctcccaactcgcgtgtggtcgcgtcgttgtcggccggctcatcacgccgaccgcgtccatcggcggcggcggcgcctccaccgctcgcgccgctcctccgccttcaacgcagccgccgtcgcaagtgcaggagaagccaccgccggatgccgccatcttcgaggggatgccgacgcgagtcgcggtggcgagacgcaagcggcccttacgcgttcgtgggcgcggcgggagaacggcggaggcgggtgcgtcgtggccggcagagagggcgtggagcatagaggtggatagtacagtcacggggctgagggtggcgaggacgcggccattctcgtggcccgttttcttccttccgacagccaaccttccacggcagtctcatatctccgccgccgccgctccggacctcacccgcacgccgctgtaaccagtccaatgccactcccatgtctagacgccgatggccaccgtcccacactcgcggagagaaagagagaggggaggatatgatttatgtgggc

SEQ ID NO: 94444 - DNA, 686 bp, Oryza sativa
tcataccctccccgcctcgatcgcagccccgcgatgacgggcctcgtagtacgcctccaaggctgggtaagtcggcggttgtccctcctcggccatcctacatgaaaaagtaataaattcaccgttagttaccaatgtgacatatattaaaagaaaatgaatgcgagaacatgagtaggaaaacaaaatatttacctccctaacacttaaattttttttggacttcttcttttttggacgcttaggacacttagttttcttgtgaccctcctggtgacacaacgagcatctattttgcaccggcgcagcatcaagttgaacgcatgaaggtggtttccttccaaaaccacccagacctgagtccatttcgttcttgaatcgtttcgatctcctcttccctcttgttttaatcttcaaatttgggtcagcaacaaattcttcaccatcgtacgatggccactgtgtggggtcgaggtatggctcaaagcgacttgcccatgtgttcacaacggctcttgaagagaactgatacgggattcggttgggagattccttatcaattgcatgaatcagataaacgtgtataagatgtgagcaaggcatatggtagagcaatggcctttggcaagaacatgagttcccctcaccttcaactttgaaggctcttgcgccggatctaacaccac

SEQ ID NO: 94445 - DNA, 649 bp, Oryza sativa
gttttcacatttaacagtgtacctcctatttgcggcagaattgacaacacggtatggacgatggtgcacgatggcgtactcctggagccatagcttcaatgcgaccatggatgggaactctaaaccctttctgagaccatccaactggaatggttctggcaactgatctaggttgatgccgccatctactagtgcaccatgggcatgtgttaggtccctaaactcaggaatgtccggcttcctcccaaacaccttctcaaacgcacgacattcctctaatgctaacttgtcattattagtaagtggagggaatggacggtcatcatcagagtcttcagcaaattcaacatcatattgctcaacacttgcctcctcgtcaacatcatctctattgacttctactgagacagaatcgtgaccaccactcaattcgacataaaagtaatcatctggattcacatattggcctgctacttctgtcgggtattcagggttgactccgtacgacgaccaatgaacactcgccgacaaatgttcacttagatcaagcccctcttgtactaactcccttttcatcaccctcgctgcatccacatcatcagtaccgcaatgtctctttgatggtcctgcctcccataaatcatttcca

SEQ ID NO: 94446 - DNA, 3349 bp, Oryza sativa
gggattagtttaaaccaggctgctggtgaagaacaagaggtagcagtggagaaaaccactaagaaactagaggatattcctatagtcagagagtatccagaggtttttccggatgatctgacaacaatgccaccaaaaagggatatcgagttccggatagacttgtaactggaactgcaccgatccacaagaggccttacagaatgggagccagcgagttggcggaagtcaagaagcaagtcgatgaacagttacagaagggatacatccgtccgagcacgtcgccttggggtgctccggttatctttgtggagaagaaagacaaaaccaagaggatgtgcgttgactaccgcgcactcaatgaggtcactattaagaacaagtaccctttgccaaggattgatgatctgttcgatcagctgaaaggagctactgtgttctctaagatagacctgcgatcaggttatcaccagttgaggatccgcgaagaggatattccaaagacagcattcatcactcggtacgggttgttcgaatgcacagttatgtctttcggactcactaatgcacctgccttcttcatgaatttgatgaacaaggtgtttatggaatttctagacaagtttgttgtggttttcatcgatgacatacttatctactccaagtccgaggaagaacatgagcagcatcttcggctggtacttgaaagttaaaagagcaccagctatatgccaagttcagcaagtgcgacttctggcttaagaaagttcagtttctcggtcacatcgtgaatgctcaaggagtagctgtggatccagcaaatgtggagtcagttaccaaatggaccccaccaaggacagtcactcaggttcggagtttcttaggacttgcgggttattaccgccggttcattgagaacttctctaaaattgctaagccaatgacacagctattgaagaaggaagaaaagtttatctggtctgctgaatgcaataggagttttgaagaactcaaacgacggttggtgtctgcaccagtcttaatcctgcctgatcagacgaaagatttccaggtctattgtgatgcatctcgccaggggctaggatgtgtgttgatgcaggatggcaaagtggtttcttatgcttcacggcagttgcgtccccatgaaggcaactacccgacgcacgatctggaattggccgcagtcgttcatgctttaaagatttggcggcactatctcatcagtaaccgttgtgaggtatatacagatcacaaaagtctaaagtacatcttcacccaacctgatctgaatccccgacagcgaagatggttggagctaattaaagattatgatatgggaatacactatcatcccggcaaggctaatgtggtagcagatgccttgagcaggaagagttactgcaacgtcgcatgggtagaggaactatgctgtgaggtacaacgtgatttggaacatttgaaccttggtatagttgagcacggattcgtggctgccctagaggcacagcccacactggtggagcaagttcgcatagctcaagcaagtgatcctgaaatagcagagctcaaaaagaacatgagagttggaaaagcccgaggttttgttgaggatgaacaacgaacaatctggatgggagaaagattgtgtgtacccgaaaacaaggaattaaaagacctgatactaacccgaggctcatcaaactcaatattccattcatcccggcagtaccaagatgtaccaagaactcaaagaaaagttctggtgggtcagcatgagaagggaaaatagctgaattcgtagcactctgtgacgtctgtcaacgagtaaaggcagaacaccaaggccagcaggattgctacagccacttcagattccagaatggaagtgggaagaaatcggaatggatttcatcaccggtttgcacaggacgtcatcggggcatgattctatttgggtagtcgttgaccgactcaccaaagtggctcacttcattccggtgcacactacctactcagggaagaaattagcagaactctatctggcaagaattatgtgtttacatggtgtacctaagaagatcgtgtctgatcgaggaagccaattcacttcaaagttctggcagaaattacaagaagaattaggaacccggttgaatttcagcactgcttaccatccacaaacagatggccagactgagcgagtcaatcaaatactagaggatatgttgagagcatgtgcgcttgactttggtggagcatgggacaaaagcttaccgtatgctgagttctcgtacaacaacagttaccaagctagtctgcagatggcaccatttgaagcactgtatggacgaaggtgtcgtactccgctcttctgggatcagacaggggaacgccagttgtttggtacagaagttttaaatgaggcagaagagaaagtcagagctgtcagggaaagattgagaatcgcgcagtctcggcagaaaagctatgcagacaaccgccgaagggagctcgctttcgaaacaggggattatgtgtatcttcgtgtcactccgctcagaggagtacaccgtttccaaaccaaagggaagttggcaccacgctttgtgggaccatacaggatcttggaacgtagaggtgaagttgcttaccagctcgagcttccctccaacatgcttggcatccacaacgtgttccacgtctctcagttgaagaaatgtttgagagttcctgaggaacaggcaatttccggatcaaatcataatccaggaagacttgacgtatatggagaagccgactcgtatcctcgaaaccagcgagagaaggaccagaaacaaagtaataagattctgcaaggttcagtggagccaccactcagaggaagaggccacttgggaaagagaagatgagttgaaggcccccacccgcacctcttcgccagctcttccgaatctcggggtcgagattccgtttaaggggggtaggtttgtcacgccctgaagttttcccccctttgcttgctttaaaaattggttaaataaatcgtccgaagaaattatcttaattaacctagagctaattccctaattaataaatgcaaataataatcggaatcggcatgtggaatttttcttggattctacatgtcaaataatgctaacaggatttttagtggaattttcagagccttggaaataatttttaccaattaaaaatcaccaaagtgcaatttttaatcccaggaaaatcctttcttctttttgtttttccttattcctcctttttcctcttcttgggccgtcggcccagtccacccgtcgcccgcgct

SEQ ID NO: 94447 - DNA, 1597 bp, Oryza sativa
aatgttgaataagtctttgtggtccttggtcgtgattcttctttttgcttttgggtagtttcacctttttcaggacagcatctaccctttagcatatttttcagttgctaggacagctgcggttagtaggacagcagcagttagcatctcctttatgcctcctttatgctttatttagtttggatgccctctaggacagcatctcattcaaatttcaaattttagactaggagggtgcaacaataggctagcagccagctatggctatatatatgcatccaacctccctcggataggtatggcttttgtgttttgtgaatgaagaaaaccagaaaattgccccatctcgagtgccatcctcttctcaatgagagtaaccattgaaattctaacataaaaatgcaataaattgattaagggaaaaatagagtataacataacacaattgtgaaacagaacatcgaaggaagaacatttacacaagcagaatggagctattatactcataaaaagaggagaagaagcaaggataaaaacatgtggcggacctggttagcaacaactgacatgacaaacggtgtccgcaactcatagcaaagttctagcatctctcctccttgagttaagatcttcactgtctttcccctagaaatttgtagatagcaacataaaattccattacagagcattgttgaacagtcattagtttattctttcattctagaccaaacactaatcagctgaaaggtgtaggaaccaaacacacctgttttcagtgaatttcccttccagtgtatgcaagggggatatctggaatcttttagcacaatgtctcttaaaaacctccttgctaacctcaatgatagagtctagaagttcactgttatcacttttacaagtggattttttactgccttcaagctggcattgagttttggcaatcagcctttcctcatcaaatattgtagatataactcggtcataaacatatgtgtcttctggcgtctgtatcattctaagtacatctgcataaaaatgcacaaaagcagtggtgcaaattagacaaacagattgaagtgacacttcagatctattcagttgaagtagatgcgatatttattagatcatagctctttcaactagaaatgaagtaatattccagaaaactaataaacttaccagttaaccactcatcttccatccgaggaggtagatcattttgcagaagttcaacagcagatggacggtcagatggacttggagacagtaggcgcctcaataggtttgactggccagggaactgtgttgcccatgacaatggagaatcgcctttttgtttgagatcagaaagaacaagatgcctttccattgctgttgaaaatggataccaaagctcaaagaatataacttctaagctgtacatgtcaacctgaaaaccaacatagataagctccagatagaatttgttgatactcaatattaacttgcaatcttattaagagagagaatatgaaagttcttttgttcattttagtactatgaagagttaaaatatcattctgaccttctcgtttatatgtggccatttctgttctac

SEQ ID NO: 94448 - DNA, 4734 bp, Oryza sativa
  unsure (1)..(4734): unsure at all n locations
cccccccccccccccccacagaaaccgatcttattgattatcttaatattggcataacttacgacattcccccaattcaaaagtttctttgcattctggaacaggatgaataaatttccttgagaattggccaattcattattacaaggttacaacatcattacaacaactcagttcattggtggcgcacatctgctagtacgcgctacttccatagaacaacacaagagttacagatatcgatatagagttatatacaggatgaactagatgatgatgagcgaggcttcaaggataccgtcagttgattaaaaaaattgggaatgacctgaggttttttagccatagcacatgatgagttgagaaaatctaatttgcataggcaacagttctctgctaatacctcctcacgccagctccactgttcattgaaaacttcaactttgcatatgttctttaccaccaggtttgaaccagaggtttctcaaccaatggagtcgagatctaaaaccatagctatgtaatgctatcgatgctggttgttacaagcctggcagtttctggcagatctggggttagcatatgtgcactggtcacacgtccaaatgttgctttcatcgacaccacggctcgagccacctgttttggagctggtactggatgctctgctcttgctactcttacttttactgccaagactcttcgaagttgcgctcttgctgcatgtaccatggctagtggaaggacctacatcatttaatccagtctccaaagcccggacaaggttctcgaaataattgcgagtcacactgtcaaataaagagagaacttcagatgaagatatagtacaaacaaacgaaatttaaatgatcatctttttacaattaggagtgatcatgtcgtcaaaacaatcaaagaaaaccttccaaaggacacaagcatccgagtaataaggataggaaacatgaaaaacagaatgatctgtagtacctagttaatccagccaactttgtacggaagtcattgaaatcttttgagggagattctgcttcaaggtatacttgaagttctttctctgcacattgatgcagccgctccaaacctgattccgcctcacctagataaataagcaacaagaataaaccagataagtaactgatacttgcgtatgctatttagtattacagcaaaactacgaaccttgcagatattcaaagaactgtcttttggcatgttcatgctctgggaggtaaaaaccataagcataagtccacttcaataccctcctacattcgacaatctgcgtattgaaattattaaactcgcccatgagagatctaggaggcttatgagagaactaaacttggcaatgaaaactaacctgtaaccaagcctctatgatgaacttgagctgtgactctggttggctttgtatatcacttaacttttcaagctgaaaaatgatttgtgaatgtcgctgttagcatatgttctggacaggctggagtagctgtattataaatgattaatacatgaacctaacatggcttcagtacttttgggtgaaattggatataaagaggataaaggagagataaatataaagtatcatatttatataccttgtcggtttgcaaactcagcagatctcctaatgccttttgcctcgactgcataacgagaagatattaagaaaccagaaaagttcttcttgagtattgattggaaatcttttttactacttatgtaaaacacaatgctttgttcaagtaacttttcttgtacccaataacttaccgactgattggctgcccaccgttcataatagtgtgtatatctctcaagcgagttctttgccatttctcttctcctttcagattcatcatactggaaccagtgcgaagcagcacaaattaaccacaatattaaataaaaataataaagtattaagaaaatatctcagattagaactgtaccgctccttcctgccttgctgcctcataacggttacaggcataaaatccaccagtccgttctccatgctccgaccatggaccaagacacagcctgcgttatatagaacaagtacatacaagccatatgagactgcaagtgctatgaagagcataaacagagagattatgattacataccagcaaaactcaaatttgcatggaggtgtgcatgtaatgtgcatgcatccctggtttttttcaatgggccgcttgcacttaggacaaggctttgaattagctagaatcctgaaaccataaccaacagaaagttcaacatagttgacacaagaaataacttgcagtaaaaacataagaactactactaatatgacaaaaaaataaagtcaaaatattggtgtttcagaaaatcaccaaacaataaaatagcaaaagttttcagaaccaaaaggaggaatgagattaggacaaagttttcagaagaaagatcaaatgcaattaaaggaacaaaacttacaataagaaaaatgtcagtagtaatgaaaaagaaagctgtgttattctgacaataccagttcatattttcagactccgcactgttcttgaggatccactttgaaacagtggcacagtctaccggacgatgagcttcctcagtgcactgcaaattttatttcaaatggtttatgccctgctgatcacaatgaaatgaaatggcaggtccagtactcacgttccaacaaaagccgtatgaacagttgcagttcacatcatagctaccactgcccatgacaaattctacagcatattcacatccaggagcaggacaccattttgtctgttccaaataggaatgaacttaatgaacatatgcttaaaaaaatagatacataaataccaaaacttgagaattggccaaatatagcacttgatcatttcctatgaaggcattcacactaattacaaactgtcagcaccatttcaaaaatatattatgattgccacattaactgtaagaacatcaaggtttattcaaaatacagagagttcactccatttttaggaaaaacaagatgcaaaggcaggagaatggctggtttacataaaacatataataattcacagtagcagccatacagattttcatttattcatttgtattatgatcaacctaccttcctattatcttcaatgtaagatctgcgaagatatcgcccatacttttccctatcctcgtcatcagccagtgaattgatcatatcttgaccaacagcagctgtgcaggacggatcaggacatcttaacatcaagcatcctggaccatcatttatagaagtgctaatataacctgtcaatgtgcactatgtaagtggtgatcccacacaaaacagaatccggggttgataaagagaaatatctcaaggttagattgtcaaacctctccaacatgcactacagaacggatggccacatgcagcagcactcattgacgtacgaggacaattttcgaaacaaattccacatgtcaactgtcaagtgaacaaaatgtattagtattgaacagctgatgatattcatgtgttctaagtaatgacaggtaaaaaccatcacaaacaggcaagagaaaaaatgagatatgaaatgtttgatgcacattcttcccacaactcacaagtcacaatgtatagcactatagtacaggcaaaactgagtgccaatacatgtgtactgcatgacacaagcatactatccatttttttctcaaaaaatcctggctcgcaggcatacaactgctagaacttcaaattgtttgtacatcccccaaagtttttaattgtttaactagtaaggcaaaggcatacttctctgtcatttggcatttcaatgagcttttccggaaaaccaacaaccttacgaacatgttcttcatcagcaaaccattcatcatgcaccttactgacactcctgcaggggggcaaaaccaaataatagatgcatcattctttgtgctctgcttcantatggcaataacagatgaagtacttccttcgtccacaaatctaagggattctaggttgtttcgcagagttcaaggttgaggtgaaattactttgatgcagggaagtttatttgattgggaaagatcacgcctagcaatgcaactaccaaaagcaaaaaatgcagtagttggatagattaggaaagtagtactccaaaatcccttatgtttgtggacggagggaatagcacatttgggctagattacatggtgtactgcattaatgagccaatgcagcatgaaataatatcccacgaccacgattaagccctcaatacaataaattttgataattcacaaccatgtaagtttaaatcagtttgtttattaatagcatgtccacgagtaaacaaatatgacatggacatggatgaattatcaggtatgagaatcaaagacataacaaacttgatacagatagagcaccaaaaaagacaaaaaaaaaaggagtatgaggcagcaatgtgaaggcaggtaatggccattaccagttataattacgaagaagaacacatgcttctgactttgaaattgaaagaacagttgaaaccctatttatatcatcctcttggcgctgttgtatatcggcttcacttaatatactgtaattttgctggggcataaaaagttcatataatgttaaaatcacacataacagaatagcgctggacaatcagttcatataatgttaaaatcacacat

SEQ ID NO: 94449 - DNA, 1387 bp, Oryza sativa
atgttgttgtactgacatccaggtggtttaggctctctttgcagagtagatccaatggaagagtgccggtaagcgcgttacccgataagtccagcattgtgatctggggaagaatgttgccaatgccagaaggaatggagccactgagtctgttgttagacaaaagaaggccttgaaggcttgccaatggtacaggccatggaaggacaggtccacccaatgcattgaagatagatcaatggttgttatgtttctcagctcagcaggttccacaggtatagtgccccttaacaagttgtcttgcaggtgtagctctaccagtatcgaacaattgttgattgctctcgggatgtgaccagtcattctgttccgcgacagatcaatcaatccaatgtgttgcacgtactccaattcagaatgggactcgcgcgagaaagccacgcatagctcagaagggatagcgcctgacagccgattccgggacaggaccaaggtgttgagctttgtcaagtgaaatatggccttggggatgtgccctgtcagattgttacagctcaagtccaatgtgacaaggtttctgcagttgaagagctgtattggaatgtcctcaaaaagcatgttgccactgagagacagtgctgtcacattccttatagccccgatcgatcgagggagaggtccttgcaagtagtttcctgtcgatgctcaacgattgcaagctcaagagcttaccaatgctctctgtgatcatgccagttagctggttatcactgaaagagatgtccaagatggttgatgattcccataacctgtcagggatcatccctgtgaaattgttatgtgacaaatcaagtgacaccagtggtagcaaagctaagtattctggtatctctccgtggagatggttatctagcaagcttagctcagtaaggttcttgcatcccttaaatgtctcatcgatactcccggtcagattgttatcattcaatctaagtatctgcagaaaggtgccttgacatatcttggcagggatagatcctgacagccggttggattctgcagagaaactaaccagatgtaatggaagacccggtagaggtccgtcgaacatgttctgcgcaagcgatatagatgaaacattactccagttctgaatccaatcaggaatgtggcctgagagtctgtttccttccacatcaaacaagacaacggcaactaaatctgcaagttcttcaggtatagtgccagtgaagttattgccggacagaactagagtagtaagcttcttgcaattgccgagttctttcggtatgctcccagtgaaccctgcactcttcgcaatcagctgcctcagattgcgtagctcaccaacagatgctggaagctc

SEQ ID NO: 94450 - DNA, 1225 bp, Oryza sativa
atttaaggttttcgtaatttcccatttttaactttagttttgggccgctaagaatctatactccttataaaagagagcaatgttgccacctcaccaagtttttttttatttaccgactaccccatcatgttttcttccaattactctacatgctttaatgttataaaataatccttctacatatgattctatcttatttcatctagaatgaaattgtcccaaaaaccttaatttgttttaatccgtataaaagcatgattatttagctagtagaaatataaggtccatactctatagtctatagttatttatcgccgcttgtacacatgtctttgtcttataagccgctactcgcattaaacgagagatatattaaaaaactactaaccgaaacgtaattacttgtccgatagtagaattgacttgcgcttactaattacgtttcggatagtagtacaactactccaactttaaagtttaataaactccaaaactgcacgcttgtactgctatggtcgtagtagagcaagtataatagtagactataagccggttaaatattgaggtggaggagaaaagagaggagagagaggagaagcgggctataaacttacagccggcttagacacaggaaccaagaaactctacgagagagacatgtgagccctgtattaattgtaaggagctaactattatatgggtaggctgagagaatgctacacagaaccttataaccaacaagtcggctgtattattaggcttgctcgtagtagaagtaaatgtacgtgacccgaggccgcacgaccgaatcgaaaccaatcaaccaaacgagcgggtcggaattcgggggagaaagaaatggatcgtgcttaccaaaaccgcgtcccggtctcgcggcggcgccggcagccggacgtagcagccgcagcagcctaccgcagcagggggatcccgcggcgcctgcgtgggctcgccggagcgaacgcgcaggaacaggacgacacagatcgatgcgcgattacgatccgtacctgatttggtttgatccccccacccccaccccacaatgcggttgccggcgaacggagcacgaagaccggtggcgcgggcggaggcgcgaggtgcaatcaacgccggcgagggcgagcgggaggcgaacgagagcatgggagccatggcgatcgacgagaggggaggatttatagtggggagagggagagagaga

SEQ ID NO: 94451 - DNA, 1035 bp, Oryza sativa
tctcaaccaagaattgcacggaaagcaagccgcaacaactgaatttcaagaacacgaagccctccttatcccctcggacagatcactccctccgagtccgatgactagtcaaccactaaccactgagccagtgattcttggggagaagaggagtagaaatcggcgcccttttcgtgggcggataagaaaaaagggggcaagaaatacgcatcaatcatcgggtaggatgagagcgacggcttgtgggatttcttgcacccaaaaagcagcaacgacaaggagcgacatgaaagccaagccaccattgaagcatccatccgtccattcgagatccagcaaatccatgtccggccatccccgtgacactagcagtgagcgccgcttgcttgcacgccggagctaccgctcgtcgtcgaattacgacgccggcattgtccctgtcaaaatcgcagcaacgaaagctggccgcggcgaggggcgtgtgcacttcacacaggcatttttcaaaaaattttttcttcgaacttccaacttttccatcacatcaaaactttcctacacacataaacttccaacttttctattacatcgttccaatttcaacaaaacttccaattttgacgtaaactaaacacaccctcagtcgtcgctgatcattttggatgtgtttcccaacaaacctccgtcccataaaaaatcagcctaatactagatgtgatatattctaatactatgaatctatatattcatctgattcattgtagtgttctagatttctttttttatggagggagtacaatttgtagagtaccattaatttacaatatagatttaaaaatatgtattataaaataatagatttaacaccatttaaggtagttttcatgtttgaaatatatatttcattttataaaattgaagctaaatttatagttttgtgatacacatatttcaatatgtacgtagttttacaataatttgatcaaatgtagttttataaaatttactcattaggagtcattaggaggttgtcac

SEQ ID NO: 94452 - DNA, 1202 bp, Oryza sativa
aattagaaggacaggctaatgcgactgcatgtctgcatgctcgcagcttgctcaataatgtggcatcagagtgcggaaggagtccaagattcaacattaattgcagggcaatcagactgaaattcccttctttttttcacggaagtttcaacattgaataataagaactttggtttccactctaaattagaaaaatgtgtatttctgtgcatgccaagcaagtaatgtcacctgtgttaatgcatcaacaagttctccatctatgttgagtgcttctgtacagctacttatagcctccttgcctcttccgagtttaaccagaaccttacatagcccaagataaagatgtacattgtaagaagtatgatctggatccattgctagggatgccttgtagtcctcagcagacacacgtagcttacccttggcagcattatcttcagcctgcatgcacaccatttgatcctattactatgatgcagtaagcccctaatttgttgatacaaagaaatcatactcacactcttagtcttcttcacaagatttttcaacccaaaatatgctttcttcagttctgaatgttcagggtctagacgaaggcctttctggtagtgcctaaacaattaatattgtcatcactgtacaaatatttaaagctagcacatttatctagtactgcatttgtgtgtgcaggcacaaacaagcatgcacttgtccaaacctaaaataccagacacgctttacctggatgcaacatcatgatcagcaaggtagtaatatgctcggccacgaagcaacaaggcatccaggttatcttcatcttccttcagaataaatcctgtttctgagataacagttgagtagtctttaagtgctagcaatgctttagccttgagaagcttcgcctgaaaaatccatttttagtactgcagcttactgagacaaaattagatgaaatatttatctgtccatggttcctactatcctctgaaatatacctttaagcagtctggagaaaaaacaagcacaattttgttgatgtaatccaggacttttgagaagtcatgagactcaaactggccataagcagactctaatgcattttgagcctgaagcagttgagataattccttttccactgaagaactcccaggttttagctccaggtatttgctatagtcaccctccgcttccttgaacct

SEQ ID NO: 94453 - DNA, 717 bp, Oryza sativa
agcgtttagctgatactctgagtactgagaatgaggaatcttgcacaacctacaacatgctcaaggttcacaatatcaaaccactctcctgaacattcaatctctctctctctctctctctcaatgggttcaatgcaatctactgcaggtttctcgcaacctattcagatggacaaaggaattatcatatgcagactattatgaaagggcactgataaatggtgttttaagcatccaaagagggactgatcccggggtgatgatttacatgctacctcaggcccctggacggtctaaagcggtttcctatcatggttggggaacaaagtatgactccttctggtgttgttatgggacaggtaaataaaatgcttctgagttctgcttatttaacactgctgcttttacatgaaaatattgcggtaacagtttgtcaaattaataccgtgattttagtattactttgcttgtgttttcattcgaagttgtgaaaatttgaattgaaaggcaatttatcaggtggcctgtttctttatggatcttctatttcatttacagggatagaatccttttcgaaacttggcgattccatttacttcgaggagaaaggagatagaccggtgcttaacatcattcagtacataccaagtgcttataactggaaagcagctgggcttactgttaatcaacaactaaagccaatcagctctttggaca

SEQ ID NO: 94454 - DNA, 817 bp, Oryza sativa
ttaagccaggcagccactttttttgcaaattctgaacctgacatgcctgctgcccctgtacctgcagcccaggttcatgattggatctcacagaatatatctgcttcactggaattctctaccgagaagtccatatcaaaggaagttagccagcaggttacttccgatataaaagatacacaatggctgatgccaatgctagtaatgcaaggaacagcacaccgactggtacaaatcctgcatactacagaaacacaacatttgtggaaggcttctccaaaacttctgttgtcaagcacgcgtctgatgtcaaaggacattcagtgaaggtatggatcatagctgcttaccataaactatttttggatgctgaaaagactacaaagatatgtcacttttcacatttctacatgtttgcattgtccactaaatcccccgggggggggggggggttaatgttgataaaaagaaccatttatgcgaatctagtttaaaacagtttcaagtgttttcatatgcttacatatcttgaatgtaataatttattctagtgctactcttagtacaataaagaatatgttttaatctctggatttccagtggagtattagtttgaaagggaaaaacattgttagccacatctgggtgattaaggagatgatggcttaaactggcattatttgggccaggatatgtaaaatgttaaacgaagcgaaaaatttagatagctatattttgggacgcggggaaataggctgctaagtagaattgggatgagaaaacaaatatgacaactgttctcatgatgaaaattttt

SEQ ID NO: 94455 - DNA, 638 bp, Oryza sativa
gattatgtacagaagtaagaacactatccaatataacatggaaaactagtgagcactgaccgttcttatggcactgacaaattggcttagcctggctaatccgcagtggctgaggtagggcatgagctgagcatcgagcaaaatatttgtcgctttaatatttccatgaacaactggaggagagcacgtcgaatgcatgaatctgcataagcttcaaaatttcaggaaagcttccagtatatgtctaaaaattgacatcagttcagcagaacaattaacagaaagccattaacactatgaggatgtgtataccctgcagtacaaacaaacagctagatgatttggtaggaatctaagtccacaaaaatgtacttactccaaagcataggcaactccaagagcaatcttcatccgagctttccatgacaaagccctggaccttgtggctgctgaaaacaaaatatcatcaagagagccattttctgcatattcatattgaagtgcacagtgcccaaactcgacacagtagcccacaagcgctgagatattggggtgcttcaaattgggcattttcccaagcatgtctatgagctcatcttgttccgataatgacagatctaccatgttgatcttcttga

SEQ ID NO: 94456 - DNA, 659 bp, Oryza sativa
ttttaccctaaatacagagtaacgatgatttaaacttttctccccgtgcaatctgtagacaatgcccagtgctccagtaattggatttgggaaagcatagaagatacgtttgaatctttgatgtacaagtgccatcgcacaccttcgataagaacaagaaatatgtgagcaactgaacagaaagcaaaagcatgatgccatacttcagtaataacttacattgagcaaggttcccagactaggtaaatgtcaaatcctgtacaaaggtatggtctggtttctgacaagtcatcgcagattgcttcatgtgcaatttttttgtcgtcctgaagttcaattctgactttagccaaaacgaggagaaacaatactgataaaggcaacattgaaaaggtagaaaataggagtaacaaagctcacatttctatccaccgttagtcgttttgctgattcattaacagaataatactccatatttccatctgaatttggtttggttgatgatataattgaagggaacatcactttatccctctccgcagcattttcaatcgcaactatggcagcatgtctcagagggtgccatggaaaaccaccttcacagggcaatgacttctgctcagacggccttggtttcatccatccccaagggtttaaac

SEQ ID NO: 94457 - DNA, 1289 bp, Oryza sativa
taaaatggcacatttcataccatgtcataaaactgatgatgcttctcatatcgctgatttgttctttcgagaaattgttctcttgcatggtgtgccaaacacaattgtttctgatcgtgacacaaaatttcttagccatttttggagaactttgtgggctaaattggggactaaacttttgttttctactacttgtcatccccaaactgatggacaaactgaagtggtgaatagaaccttgtctactatgcttaggcctgttttgaagaaaaatatcaagatgtgggaagaatgcttgcctcatattgaatttgcttataatcgttccttgcattctactacaaaaatgtgcccatttcagattgtgtatggtttgttgcctcgtgctccaattgatttgatgcctttaccatcttctgaaaaactgaattttgatgctaagcaacgtgctgagttgatgttaaaactgcatgagacaactaaagaaaacatagagcgcatgaatgctaagtataagtttgctagtgacaaaggtagaagggaattgaattttgaacctggagatttggtttggttgcatttgcgaaaagaacgatttcctgatttgagaaagtctaaattgatgcctagagctgatggaccatttaaagtgttagcaaagattaatgagaatgcatataagattgatttgcctgcagatttcggggttagtcccacatttaacgttgcagatttgcagccgtatttgggagaagaagatgagcttgagtcgaggacgactcaaatgcaagaaggggaggatgatgaggacatcaacaccatcgatacatccacgtccccccatatacagcatgatggtcctattacccgcgctcgtgcacgtcaactaaattatcaggtgagttctttcttgagttcatattcctcgtctttatacctcggagacgcgtgcactcgtgttttactcaggaacgatggagaggatccaaagggaagaggattcgcgcggggtggattcggactgcagggcagcgccaacttctaacggccgccacgacttcatgcgaactccgatttgggcgtgcaagtacttcatggaaagcttatcaagtctactttcaaatggatccagccacatgtccatatctgttctggagcggccgcaattgtcattttactcccgactattttctgtccatggtgctgcgtcacctcttttggcccaatgggctgtgtatccatgttgggcccattaggggcgcgtcctagggttggagcacgaccctatg

SEQ ID NO: 94458 - DNA, 1097 bp, Oryza sativa
ccgcacatcctcaaatacaaagcacttccctagttagatgtaggttagacttcccgttcgagaaattttaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaagatggccaaat

SEQ ID NO: 94459 - DNA, 8022 bp, Oryza sativa
cctatttcatattaacaaagatcaatcaaccagatggatacttgtaacctcaacatttaacaaaacataaaaaggtgcttgaacaggccaagtgtaccacacatatggcaagcaaccaacagcataatccaaatgataaaaatagacgtaacattcaagaattagttgaaaagaagggaggcgagggtggaggagggggctaaacaccacctacctttcctttggagcactttcatcagactgtcctactgcattggagcggggtttcagattcaatcgtggtcgctccactgcccggccctcagcatctgcccctgctactcctgctttaggtgctacaacattctggtgcacatcatgaataacgtcaacctgcacagtattcgcgaccactggaacctgatgcacctatacaatagttgtccaaaagggagaagattaaggtttcaccatgccattgcatacataccatatatcaaatcaagcaaactaagagcaacttaataagcacaaagcaacacaacacaatcatgtatcactttgcatggagatttgcaaacatcatttgatgttaccgctggaaaacaagacaattcaattttcaatccgatcaacacacatgggagcaagagtaataacctgcttctcttcaacatagacaggagatggttctgaagcctcgattggcttggagcgaggaagcagcttcaacttaggtctctctggcagcacatcaccaaccctaggtctctctggcacatcacccaccctaggtctctcttgcacctccaagcctctagcctccccaaccctgccttcatgcgacgcaggcctcactggcgccacgctcctctctatgccaccatccagctctctcaccccgactgactttggcctctccatctccggcggtgcaacatgagtctccaccaccactgggaccgacacaggcgccgccggtggagaggagggtttcgacgagttccacctcccggagatcaccttctccacggcgctcgcctgcgcaatgcgcgtcgccgaccagatctgaccaccgccgccgccgctggcggcaggactcaccggcgccgcggtcggagccgcctccctcctcggcccccaggcgttcccgggcccggatctggtgggccccgcagccggggatggggcgaacgacgggggcgacggggccgggcggcgcggcgtggaggcggcctctaagggcgtgcgctcgtcctcgtcgaagtggcggccgatgcgggaagggttggtgaggaacgacgggaccgcggccgccgccgccgcggcagcggcggcggaggtcgccggggcgcgggggcgagcggacgccgcgggagcggccgcctgggaggccacggggcggtccgccgggcgcgcggagctgcgacaaacgagagttaacatcactccatcacctacacgggtacaccgaacgacgaatcgcgagatggggctagggtttgggggtggaaacttacacgccgggggcggaggggagggggagctcggaggggatggagccgccgtggaagtccttgagcgtcatcgtcgtcaccgccttcttcttcgacatggcggcggtggccggcgcgttcgccgtcgttgcccgaggaggacctcgtcggcgtcggcggcccgccgatgcttcgcccctctcgacgacgcgacgcacggggttaggttaggccgcgccgcttgatcgggggggttccaggtgtctcgtccgcgcggcgctctctgctctctcgccttcgcaaatcgcaagggggagggggaagaggagggggaggagggtttgtgccgcgttggatggggaggaattttttacgagttagcccctgtggaattttgtggcgttgcacacgaggcggcggtttagattcggcgagagtttagggggatttttcgctaatccagtttctttagttgggctgggccgagtttgggtgtgttgggctgttgcctgttggaaatggaacgaggtagtgataatttataatattaattattattattattattacaaaataaagtgcttgatacaaaattattttataaagctgcaatcatgcggtatgccttgtctaatagacggaggaataatgttaggttaaaggttgccgagaaaaataagtgataaattctggtgaaatctgtcaaaaagaaacggcaaatcaagatggttgatttgagtatctcctgagatccatcttgggtagatgttactcttactcttatcttcttatgtaccagatttctatatttggtttcggtatggggaaaacttggtaaataagtaaatcaatcaaagcttacgagggaatggcatcatcatcatcatatatgtagcaaataaacatggaacatgctattgttctttattcagacaccgaacaattaactaatcatgtataatatagaagtttgctaaattaacatagacactctataagggaatctctcagtcagcagagcccaacacttccaagctccaaacccagaaacatacaaaagcttcttctgacttctgcaacttccctggtaagagtaatatgcagcagcacaagaacagagtcttcaggatcattctttccagccacaacatcgcagtccttacttcagcttgtggatggtctccatgtccacggcctcgttgagggtgcctttctcgacgtgatcccaccagcccatgaggaagttgtcaacaaccagccggaaccagggagacagcttcaggccttcctctccggcgtccgctttgcggatgagctccttcagctgctcacggctcacgtatttcacatcggccacttcgtccgggttcgggactaccttcacgtcgcggacgatgaacagcaggtagtcaactgcagatgagaggtaagaaacaggtttcagtgcagggcggcataatgttcgttcttacacttctggtgaagtatcccgaacagtcgtatctatttgtgtaataatcgtaatgatcatataattggcttatagaaatgagaataacactaaaggttgagcttcaatgaataaaaataagtgtgcaggtaattaagtaaggtattaaaactaaaacttacgctcgtgttcaccccattttccatcagatggggccttgtaaagcatccgaccaagaggggtgaattggtcaactggcacatcttcagctgggatgcccagctcatccaagagcttcctctgagcagcatttctaacacctggagaatgataatatgttactaacatcattgaaacagagcagaaacggaagaatagttggcctcaactagccttttttttggcacataccaaggtagttttcctgtataagctcagactcacggtacagaggatggctgcagcaagtgttggtccaaactagaggaaatgtaacctttgttgcagatcgttgctggaaaagtagaacagataatcagcagatgttttgaagaataagatggcagtgctagaaatgagatatgaaaaataacttccagttgagcatttgaagaatatgaatatgcgggtaatttgtaaacagaagacattttgaaaactagttacgcaaagagctatgtcgtaaatgtcatcacagacacaacatctacaagtctcagaaaattgcgcgcgtctgaatcatgagcgcaaaacctaaataccatttgtttttctcaagagtgatttaaggcacaaacctaacttccaactggagatcctgtgttactaactgctatggtaacttgacatgggagcacagtgaatagttgtatagaatatgtgccaggtgcaatgtaatacaagattaaaaaaaatggaagtgcagaattagtaaattctccaaacctggagtaggagttcatattttgagttgaacaggaatacactgaaagccctatgaagtagattttcagattcgattttttccatcagatggcctgtgtcaaatgaatcaagtcaagtatcgttccaataactaattcaaaagaatgttgggcacaggatttgaatagagatgcagataacaacacttacagttatattttgattcatggccaacaacattgtcttgttcatccaccaaaatgcatctgtgaaataacaagaatgttacttacttgaatatcttgaaactaatacttataaaaaaaacatagtcgtatttactgaattctaaatcattaaaaatgtttacatggtttacaaaaaaaaaatagaccaattaagcaactagacatatatcgtacatcgcttatggaacttgcattatacggccatcacactcaagctaacattggcaaagacaggatagcaaacctgaaattatttgttgacataatttgggaaaagaatattgaatagaactaaagcaaaaggtgccatcagagattattgaatacagtaggtacatgtgtttaccataatatttacatataaaagggcattcttttgaaccacaggaggaatctcttttcaaataaatctttcattataagaaagggaaaagaaaagcatcgcattcgctccttccatatgatctttaatagctgttgctaagtcaaattaaaagcgatagggaacatcatgcatagtcattcaaacagtacttttgctgatccagtacacctttcgctgatccagtacaccgtaaattgaatgaggcggctaaaccattagcttttcctacaaccatctgaagctctgaactcatagaacaataattgcacaagtgacaaacaaagccaagagagaccgttgagttgaacacatcaaaccaaaccaagtcatgactaggttgccatataatgagaaattacaaatccacacacaagcaaagccttatctttgacctgcagtatccagtcacatcttgcacagtattttttttaacaaaaagagtatttagcgcgtatagcatttgctaaaacaacaaaaggaacagtgttctagccaaacattgcccacaagtgccctcccatcccatggccaacccagaaactcccacggcataggccccgagatctaataacactgcgaacaagtgagactaagcaagtgaagttcaaacccaaccaaaaatataacccgcaagtgaattttggccaccgtgaattttggcgttcgtttatgcgaaacaactaaatttcaaatcccaaatcccccccccccccaatcaccacgagatccgatggggggtggggggcgcaccgaccaccagaaacccagactcgcgcatctcatcaatcaaaatttctaaagccaataacggcgcaggagggaggggggaggggggggggttcggggcgcgcttactcgtcgtcgaacatgagccgcttctggacctcgtccatcccggcgtcctccacggcggcggcggcgccggccatgcctcgcggcggagaaggcgcggccgcctctgcgcgaggcaaagggagagtgtgtgcgcgacgcgaactgcgaagaagtgtctctgcagccagcggcggaggcggaggcggggtgataaataacgggtgggccggccgggccgggcctcgcggacggcgtggtggtggtgggcccacctgtcagcgagcattgtacatttgtacaagtagatctctgtccgggtcagccacgtgcgtgccactaccatacgtggtgtttttttttttttggctcgcctcctctcacggtcgctgaaaggtggggccaggagtgtgatctgggccatctggctgagctcgtattcctcgcgcctcttatattattttcgggaataataactttttttaaataaaatgtgttctcttgtctctttatgtcagaagaatcacatggttacgatgactcgtgttggatccgatctgtgaaaaaaaaaatccaaaaaacaataactactagcgtggagcttaaaacattgccaatttttgtatttccgggcaaacaatttgccataattttgataacagaccacataatcgcaaaaccggcaggcgctgccaattatttcgcgtcgggccacagattagtaaggagtaaaggaccacaaaaatgcttactgaaattgtcacaacagactaaacggctgcaagaactggctagcgctgctaattttggtgtaggataagcccatctaattaacagctaccaaaagttccctcgttaaaaagcatacataatcgaagatgcttctagagttgagtatttttcttcctcatttatgtcgggaacgttaatttgtggtgctagttttttctctcttttttttttcatataattgtggtgctgatcctgatggaacacgagaggctgcgaggagactagaagcagctgggctagcaaccggggtgcattagcaaaccatcgccgccatgaaattggtgagtatattatctaaaaataaaatattgaaattggtgagtgactggagcttcagctaggaaatcttcagaattttcatttttgtcgtgtccgtcgcgtcgtcgctttctcccaagtttatggatggcattctacactggactactgagtactccacagatgcagctactcgacccttgcggtaaaagattgacgctacttgacgctgtgcccgaataactaaaaaaactttattagaaaaaagagaaagaaaaaccaactgtcaggttgtagatttgcacacttctcaacagaattgaggaacacaacacagaaacaaggggaaatggtcattacactggtgttccaaatacccattggagaatcacatcttacttgtttggagcatcacaatgctttccattaactaaaccagtatctagttagtaactgtattgagtccactgttcatttgcctacaaagcagtacaatctaaccatgctttcacataagaggaacgacagaaatctttgtacagcctcaggaaagacagtaatcacaaaggaccagggtcagtaactgctaaatacattgaaggtgtgtccttctaggtcgtctcatcattacatggttcaaggcttcaagcgttgacattgggagaatgcttactatgtcaaaggtcctccccttcgcacccgaacgcgctcaccattgaaatgcatgtacttgtacttcttcaagtatttctcgaggacaatcttttctttatcttcctggcctaaagtcacaaatgctcttccgatccttcttgttgtatcctcgtctggatgcacccctagctcctccatgtcagcatatatctaaaattggaagtagttattagggaaaacaacccccaagcaaccctttagggaaaaaagaagaacctacatttcagcactaaagcatagattgactcacaatgatatgatcctttaaaaaatgtacatatgcaaatgaatataacaaactcaattagtagaaatgaaaacacaaattaaaacatcaagaaaaggttaaaaaggtaaatgtcacctaaatctacaggaaaaatataaaaaagtcagataccacctccaaaaccttgtctggacaatggcgggtgtcatatatcaggatcatccgggaaaacaacctcttgggtactgaacgtgtatgagtttgtatgatattattccaaatcgactcagcctcatctatccttccatccataaaaagagccaacagtagtgtatcatacgttgtccatgtcagcacctggcctttgctcatcaaccacttggctacctgataacagcaacaaaattgaaaggtaagtgagaaaatgagcttgacatcaaaagctgcgattactgtactctcaacagactaacaaggagatataatctataataaccttacctggatgattctcagccattgtctccgccttttcaacatttccaaagcttttgctgctgcaatagtagggaattcgggctcaaaggcagtccacttatccaatgcaccataaccagcttctttctcatttggtaactttgaaacctaacagatagtattccagactgatttgagacaatttcagtttcttaagcttgagtattctatagtgtcac

SEQ ID NO: 94460 - DNA, 2816 bp, Oryza sativa
gagagaatcgctaacagatgcgacattagttcatcaaaatactatatataaaaatatttaaattcaaatttgaatcggatatataaacttttacttaaaaactttgggtctataaactttaggtgtgtaaactttagatatatagaaataatatatatataaaatatttaaatttaaattcaaatttgaatcgggcattttgacttataaactttgggtctctaaactttaggtgtataaactttagatgtgtaaacttgaggtgtataaactttagatgcataaatttactaaaatagaaaagtaatgcggtgccaaaaaaggaaatcacgtgaggaggggtgatcacgcggggcgatcaatcgcccattagaaatttcgcaaaccacacgcattgctattgcaagtctcatatttatataaggacaaaattctctatgttaaatggcagaaatttatgacccctccaatttatgacacaaatttaacatacactatacactggtggagaaaccctttgtagtcccggttcgtaaccccctttagtcccggtttccaaaccgggagtaccaatccgggactaaagatcgctatctttagtcccgggtgaaataaccgggagtaaagatcgatctttagtcccggttggtaacaccaactgtttaagatcttcgaccagtggtcttaggtacacgtcgatgtcgttaccaggttgcttggggccttgaataataatcggcatcattatgtacttcctcttcatgcatagccaggggggaggttgtagatacacatcgtaacgggccaagtgctatggccgctgctcatctctccaaaaggattcatgccatccgtactcaaaccaaaccgtatgtttcgtgcgttctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgacttagccgtggtattataggaaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctcgatttgtatgtaatcaccaaaataaattcaatagaaattttggcatgacctcacctcttttttgaagaaattttgaagcttgctcgggcagctggaggaggaagaagacatatatataggggtgggactttagtcccggttggtagcaccaaccggggctaaagatcaccgggatcattagtcccggttggtattaccaaccgggactaaagttaagatctttagtctcggttggtagcaccaaccggggctaaagatcaccgggatctttagccccggttggtgctccaaccgagactatagatctaatctctagtcccggtcggtaataccaaccgggacgaatgatcccggtgatctttagccccggttggtgctaccaaccgggactaaagtcccccccctatatatatgtcctcttcctcctccagcatgccgagcaagcttaaaaatttcttcaaaaaggaggtgaaggggcctctcctccccaacaaagaggtttttttttctttttttcttt

SEQ ID NO: 94461 - DNA, 537 bp, Oryza sativa
tcctagtaatgctaagttgcgtttgtatccataaatcctaatatgtaaaaggcaatatctgctagaaacagattaatctggctgtacaaaacatgaagacagtgagaacccaaatcatcaagtctgacaaagctattctaaaataactgtgatctttaaatgtgagaggaacatactgtgacgacaaggcaacactcttagcttttctccaaaactgtagtcttccaagcaaatggcacaagatgatgatgtactattgtcttcttgcacttttgtaaaaataagacttggcattgctttaaccaattgactgctcattccatgaaattcccgggttacaggaatccttcccctgtcccgccttatctggtgtctcctcacaaagaaacaagtagctagaacagcagccatagcaagcagtgatgtgaaagaaattgccatgatagaccaagctgagttttcatatactggtagtatccacacctctacatcactttgacctgaatatttcttcaaaacctctcctgaagccttaga

SEQ ID NO: 94462 - DNA, 1265 bp, Oryza sativa
agaagagattcgccggctgccatgctgacatgacatgaggctcccagcattgtacgggggctgtgtatcgtagacaacgaatttggtgccaagaaaatttgacctgtttgtgtttgcagtgtcagatttcaatgcatatttctatgccaaactcaagttaatgaagttaggcaggaacacttagtgaaggatggtgcatcacctcatttttccaacataaccattacttgaccgtgagatgtttttagaatccacagaaattatgtattccgtagaagttgcccgacgattcctcttagctgcaagaaggaattttccattctcgctgagcacagctacatgatcgaaatcatattattagcattgcatccatctatgtttctaaaccaatgttaatggaaaaaagaataaccatgcgtgacaactttcatgtatactgagaaaatgttcggtaggtatttaaatattaataagagatgcggttacatatacttaccagggctaagacacaggtagagataataagttaattttgatttgtcccttttgataaaacactggattaaaccatctcgaggcccaggctgtacatgaaaaatcaaagttagacaggtgcagacataacttgactgagatcaataaagcttccattatctaataaaagacaggtgcagacattcataagaggacacatctatttgcagaatctagtctttaatttcaattgcctacaagaatttcagtgttacctgataaacatagcatctgctatgatttgaaacacaaccatttgttcgttttggttgttctacactacaagtgtggcaaaagaaatataagctatacaattctttacacttttaaaaggagttggggtgatgatgtgccccacacccatccccagtccagaatatccttttggctggctatccatagactacatgtgttgttcacaagaactttggtaagactttacattcttagcatatatctaggtgcttgattgatctcatgtaatcatttacagttttacacaaaggtaccatacatataattgaacatgattttacctgttttagagacacaggaaaagtgagctttccacagatttccgggctttgcactatatccttacatatctctctccatgttcggcagactgctgcacaggcaacaacatctttgcgggacggccaattgctctctccttcctccagtcttttcatcacatcacggagtaattcaggaggaagaccaacccatct

SEQ ID NO: 94463 - DNA, 2692 bp, Oryza sativa
catcatgattcaacaagttctacaagttttactcatattttataaaatttcacttggatattaattattagacataacatagtgcaaagtaaaacttatgtcaacatatatgcttatataaactaaaagtattcgctaaaccttacacaaagtgaaatatgcaagttgcattgcccgttgcaaattgtaaccaattcctaataagtaggagtaatattgattctagtgttggatcggagcttgatgtgatataaagctttcttgatatacgtactgagatgatatgtatgatcccattaaaacaggagcatgaatgtagatatgtactaggatcacctatatatttatcgtctaaaaatttaccagatgtatttatagtacaatcataatataattacactataactttacatgtaaccttgtatataacttttaagaatctctccgtaacatgctatttcggtgaaatggagatcatgggaaaaaatcctctcatatttgtgcgcgcagtgacttttttccttcttcacttgcacaaatcttgaaacaaatatacagttcaaaattatgtgaaagttacatgcaagttacagtataattacactacagttgtactataattgtgctgtaattacatctgtcaaaattttagaagaaaatttgtcgataaatatatagcatggtctaattagatatatagtttgtacagcagggttcgtgtccatgagattgttttcgtatgccttgacaaacccaagctccttagtcaggtaacacacgtacggttcatttactaattaatctggctagctagtatgttatgcatcattttctctttttttttcttttgcggagaattatcatgcatgcatggttttagttaattagttgcatttatattgtgcaaacattatgcagttaactattattgagtacaatataatatgcagctatctgcgttggtgtctgaggttggactgaatatccgtgaagcccatgtgtactccacactcgatgccttttctctcagcgtatttctcgttgatggttggaacaaagaggtaccccatgtcctaaattacaggacgctatcttttaaggaaaattagattcgataacttttaactaataattttactgattatatatgttaagtattatgtatgttatatcattatatttatattttaaagtatttttattgatgttaattttatatcggttgagaacataacacgtacttaaaataacgatcaaagtatgttatttaagatcgtatgaaataaatatatattatacttttgactgatcaaccaaccatgaaagactactactctactaattagtactctaattattaagctagtacgtgttgtccgcaatatttggccattaattaattagctaattcatcgtctaataactgcaattatataaaacttaatttcaggaagcgggtggattgcttaaggcaatcaaggagaaggtcatagtatggcttgcagatcagatgctgagagccacggactgagaaaagttactaatattaacgatcaacctacgaattgataggttggtcgagctgcacattgtatcatcttcgtggagctagggctcgacagacagatcgagatcctcgtcaattaatttgcactgcgcctgtatatgtaataatcttccagagagacttgcaataacacggttgctggtaccgtagtatgtcagctagtatgcctgatgacaaaacaaattagtttgctatctgttaattgtaatactaatacttatttaattagtttgcaatcttgcagaatatatggtggcctatctgtagatagtccatgtttgatagagatccaacttctaaatttagcttcaggagttaggtctgaagtggagttgtggagctgcctaaacccagctccacctcaccagaatgtgacaatttaagagaaccactttaccaataaggagattggtaaagtaatgccatgaacccagaggacattaattgtcacatgggcacctcaccaataaggagaacctccaatgtgacaatttaagaaagttgcaaaatctagaatataatatcgccgtagctatttcggacatccgaaacaagttttcgcctggagaatccaccagagacatgggttagagagagagagagaatgtaactaatattcgtaatgcccaaaataccaaaaaaagagagaagagaatgtaactaatattcgtaatgcccaaaataccctcagaaaccctatccatccaccgtgcaactctctctctctctctcgtgcaacacacattctctctcgtgcgactcgtgtagcggcggtgatctgagggtgtggcggcggcggcgctccgagtgcgcgcggtggagctctgagggggtgttggggaggcgtcagcgagggggcggcggcggcgtgatgcggagccccgccggcgtccgctcgtggaggtagaaggcggcggcggcagtggggtccctctctcttgcctctccgccgctgccccaagcccgatccaccgcctgtaccacgtgtcgttgccggatccaccgcctgtgccccgagccgccttcggatccgctgcccacgcctcgagctccgccgccagacccgctgcccgcgcctcgagccgtcgctggatctgtcgcctgcatcccaaatacaaaatgatt

SEQ ID NO: 94464 - DNA, 641 bp, Oryza sativa
taccatggatattattaacctagttttggctctgatacacaaaaaccatataacagtattttccagtcgagtctcatctttactctgtttcacaggtatcgaggaacttacaatggtcttgatgttgctgtaaagattctcagagattctcatttcaacaatccgtcagaagttgagttcttacaggaaatacttattctaaggcaagttcttttataaactgctgaaattagcgtgtttcattttattctgacttactcaagatattttcctccaggagtgttaatcatgaaaatgttcttcaattttatggggcatgcacaaggcctcaaaagtattgcattgtaacaggtagcatttatatcttttttttccttaatatttgattggaatcacctccataaccactggtgctgaattgcataaacaatgctgttgttgccacgtgtgcatgtgcgcacataggcttaaagcagaagctagtatttaggtattgacacaaacatacattcattttatagccatctatctgatgttgttcttcaggtagactatttaattttgaaggtcccatactatcaaaaaaattgtgttatatatagcagagaaattttaattatgcatcaaataggccttagact

SEQ ID NO: 94465 - DNA, 939 bp, Oryza sativa
tatagggcgaattcgagctcggtaccccatatatatatatatatatatcgcacctggctctgcaatgcaagcccattatatccaccataagctacctagctacctgcatctctctttttgctaattccatgcatgctgcttctcaacaagcattccaccacagatgatgcatataaacatgaattcatgccttcaagcatctgatatttacacaccacatcacatttgccgcccggagttctgcagtttccacacgactatttacacaaccactttcctctactataaacacttgtgaatcttaaactgaatactgatccacattggggtacaactagcaaggacgcagtgtacatcttcacaagtgcaaccgaatatttacagacccccccatatatagggtcagtttggagctagcgctcatatgggcttccacgcagttatgacctcttggaacatttccagcatcagctcacgatctgcgtgctggaagaagctattgatctcctccctcacatcgtatatcttcccaaaaacaaacaggtaggtcaggcaccctttcttcagcttttgcagctggtacagccacgcgacgtgaagcctctcgaggacattgctagagtttatatcctccaggaggctctcctcgcagcagtccttgatatcagaaatgctgtacttgttcgctgcggcgagcagcgagaggcggtgcttccagaactggtctagctttatggtcccgtagatgaagccaatcagagcagagcaagactcaaggcacatgtcatttatgttgattgtggaggactccttttccttgagatcatggaggaacatgctttcaaacacaggagaacatgatgcaaggatggccttatgggccttgaggacaccatcagtcgtatttatggtgacgtctgcatgtatcgactccgtgag

SEQ ID NO: 94466 - DNA, 656 bp, Oryza sativa
cccagtggcgcatcgacaccttgggcccctcctcctaccgccgctccgattccttcaagatcggcatctggaactggttcccttcccaatcccaatcccccactactcagagatcaccgatttgccctatcaaatcaaatcatccgccaattcgatccgaatccgtgcaggtacctatcggtggagaaggctcgatatgtatacgtgaggctgttcccggagcccgggcgggtggccaaggaacggcccccgctcgcccgcttccttctccgagcttgctggtccggcccgccacgccgctcctgcgtctcccctggtacatatactcctctactttcttctttcttcttgccaccaccaccatatttagctttaggctatggaccatccccgttttagtgcatgtcttgtcttcactctccatgccatcttcagactttgaacacctgacctgacctgaccacttaacatgctatctgcaaattgtctaatagagcacttcttcacttcccttaccagctatctactctagtagtaccattcaccattcaggtatggtggctagttgaagatgctcccaaagagtcagaccctccctatgcatatggtcatcatatttctctatgaaatactcgtagggcatattggggggaaaa

SEQ ID NO: 94467 - DNA, 1154 bp, Oryza sativa
ccacattggggtacaactagcaaggacgcagtgtacatcttcacaagtgcaaccgaatatttacagacccccccatatatagggtcagtttggagctagcgctcatatgggcttccacgcagttatgacctcttggaacatttccagcatcagctcacgatctgcgtgctggaagaagctattgatctcctccctcacatcgtatatcttcccaaaaacaaacaggtaggtcaggcaccctttcttcagcttttgcagctggtacagccacgcgacgtgaagcctctcgaggacattgctagagtttatatcctccaggaggctctcctcgcagcagtccttgatatcagaaatgctgtacttgttcgctgcggcgagcagcgagaggcggtgcttccagaactggtctagctttatggtcccgtagatgaagccaatcagagcagagcaagactcaaggcacatgtcatttatgttgattgtggaggactccttttccttgagatcatggaggaacatgctttcaaacacaggagaacatgatgcaaggatggccttatgggccttgaggacaccatcagtcgtatttatggtgacgtctgcatgtatcgactccgtgagcatgcgcgaaaggcatccgagactgctcttactagcaatgttctgcaccgctatgctttcatttggccaaatcgaggtagatgattctgcagcctgtaaccatatcacattacattagcatattattattatcagtaggcatctgtttgaacagtaggacttgtcataacctccaagccacatacatacatacatacatatatatatatatgtatacacacacacacacacacacacacacatatatatatataaactaccgtgtaaagaaagagaagtgtgagatgttctgaaaaagaagcggaattattttggaaccaattttgaggacaagaggtggatacttgcattgtagaggctatcttcaggtccaaaaactcaacatcaatagtgaaacgcccagcgtacatcgtatcaagttgccagaaaaagtcttcgctgcttcggaggagatgctcatgcactgtcaggaaaaattggacaatacttatgaagatcaatgaggctggccgtaacatcagtaaaacatcact

SEQ ID NO: 94468 - DNA, 569 bp, Oryza sativa
attcatgagaagcttgatgtgcaaagcgcacattgaaaatatgtagatgcacaggatggctgctgaagatacaaaacagaagaagtagcgataattgcgctgcaaaggggaaataaaagcatattaactgagatggtttcatatgaacagctgtcagggtgtagaaactaaagccacccatagctggattattttattttgaaaagaaattaaacataacagacctgtccaatgcactgcccaacccaaggacagtggtgatcaaagcgctcgacacagttatcacatttggaacagtgagagcagcgcggaggtcgatatatcatgcaagtgtcacagtattttactttcacgggtacaccattgaccaaaatctccttgacccgtggaaactgaagagtgtgtggagctgaagcatcatgagaaaactcttccacaggtggatgtgagttccgtggtacaatacctggatcttgagatgaggtcaagaagagcagtaacagtacctaacaatcaggttttgcagagaaggatcctatgattttggcggtgtctgtaaaaagtactgt

SEQ ID NO: 94469 - DNA, 950 bp, Oryza sativa
actagcgagttggttgttctggtcagctaatggattttgtaaccccaaaaccacaccatgactctatgaccaaagcataaaaacattttttttctggctaaagttttattagtattgacggagcttggggctcctcaccgggagaccgcgcaggcctccctttgccggttcggccgggggctctgggtgaggttctaagctcctagcctgtggaaagttcgcgagagtggaaacacacaagacacgagcgatgtatacaggttcgggccgctgagaagcgtaataccctactcctgtgttttggtggatctgtgtatgaagaagctacaaaagagctggagaaccagagagctcttactctctccctctctgatcgttctggatccgaaaatttccccttctaagtgggcaaggtcctccttttatacctcaaggggataccacatgcaccatctctatcttttttgtggggacttatcctatcttttcataaacagacggagacttgtatggttgccgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccacgcgtcagtttatcaatctgcatgttcgcccctcttcatacaatgtcttgtttgtaatggttaggatgaagcctggtatatatctgaccgggaccaacgtgccatctccaggagctaacacgccggctccggctagggacgagtgcttggaggctctcatcctgacgggatggggcgaggcgtgcgtcagaccgcctgtcgccacctaacccacgatctgatcggtctgtgactggtcactgaccggataaacgagcgcgctgcactgcgttacatgcggcgtgacgcgctcgt

SEQ ID NO: 94470 - DNA, 3240 bp, Oryza sativa
atgtgtttaattcctaagttttccattgtcaaaggttctaagtgctatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatggggttgcttggcgaaagtcaatgtaccaataacaaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgatgacatactgatatttgggacaaaccttgaggtgataaatgaggttaaatcattcttgtctcaaaattttgatatgaaagatttgggagtagctgatgttatcttaaacattaagctaattagaggtgagaatgggattacactcttgcagtcccattatgtggagaaaatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttgaattacatccaaacagcgagaaacctggcagatcccttcacgaagggactatcacgaaatgtgataaacaatgcatcgaaggagatgggtttgagacccatgtgagttatactatggtggtaacccagtctatgtgatcggagatcccgtgaattagatcctgggaagaacaaaccattagtaaactagaggagagtatcaatatatataccctctccaagtgaagatgcatgtactctcgtgagctgcaaggcaggttggctatgccttaatgagttctgttggctttaattagcgaagatgttgtcctgcagagcattcttgaaagaactcacctttgtgagcttgactgttggtcgcagtctatgaagattttgggtgaatcttctaggaagcttactaaagacctaggagtatgacctatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccatcttgcttattctaggagaggggga

SEQ ID NO: 94471 - DNA, 866 bp, Oryza sativa
cagagagggagagagtaagagctctctggttctccagctcttttgtagcttcttcatacacagatccaccaaaacacaggagtagggtattacgcttctcagcggcccgaacctgtatacatcgctcgtgtcttgtgtgtttccactctcgcgaactttccacaggctaggagcttagaacctcacccagagcccccggccgaaccggcaaagggaggcctgcgcggtctcccggtgaggagccccaagctccgtcaatactaataaaactttagccagaaaaaaaatgtttttatgctttggtcatagagtcatggtgtggttttggggttacaaaatccattagctgaccagaacaaccaactcgctagtgttcgtgtagataggtacaagttgacgaactgacgagcgtttagatgtgtggtaggccggggcaagccatctgatctgctgattctctaataatctctactgtattgcctaatcaaggtctccggtatttgaccggcccggcacgtatcgtttattaatgcgcctcgtggagtggagaacggtgcgtgaccgcgcaggccacgacgacgacttgtgtgagaaacaacgtatcgcccggggcctcttgaccttgggtaatgggttccagcgagaggagagaaaaaaaaaaacgaaattccggcagcgagaatcacgcctgcacgccgccgggatggctcgccgtacgtcgccggcggcccccgccgcaaaatatatgacccgtttcgatctgggccgttcagatgagatcgagcggtccacactgggcgtcgtcgctgggcaagacgtgcggggctgtgggccccagtttttatgtgcagcgagggggtgcgtgg

SEQ ID NO: 94472 - DNA, 603 bp, Oryza sativa
tccgcctcatcaaggagggctcctccgagggccaggagaccgccgccctcgccatcggcctcctcggccgcgaccccgagtgcgtcgagctcatggtcctcgccggcgtctgcaccgccttcgccaagatcctcaaggacgcacccatgaaggtgcaagggatggtcgcctgggccgtctccgagctcgccaccaaccaccccaaatgccaggacgccttcctccagagcaacgtcatccgcctcctcgtctcccacctcgccttcgagaccgtccaggagcactccaagtacgccgtcgcctccaagatgtccatacacaccgtcctcatggacaagaagaacaacggctccacctcctcctcgcaccaccacgacgcgctagacgccgtcgaccacgccgccgccaccaccaccaccaccaccgccatggcggccaagcccaccggaggcggcgccgccagctcgagcggcgcaggcgcaggatcagcaggaaccgggacgacctcgagcagcagcgtcagcgtcggcggcaccgtcgccgggacgaagcagcacaacgcgtcgctgtccgggacgagcaccaaggcgcgggagttcgagg

SEQ ID NO: 94473 - DNA, 709 bp, Oryza sativa
tcaatttggtacgtagttcgtacatatatgtacaaaatttatatatataataaaatgattttatatatcagaagaagtaggagtatattttttagataatgagaatttataaaacccggcttctacaccaacgggggtgtatacagccacagaaaatccgagcaaacaagctcagttcatacacacaagttcacaaacaaaaggagcacaaaggttcaagcaccttacataaaaccaaaagagcacaaagactcccaacgcctttcaaagtgaaaagaccttccaaacaaactaacgaccacattcctcctttaaccgctttctcatgttccatccatctttaccaaagaagtgcatgacagatgtctctaacagtttgcatccttccttcatcacatcacactcatcttctttaagcagcaaggaccattgtcgagcccaatacgtccccctgaaaataacctgcaagtaagagttaaaattggagtcattgaagaccacatcatttctacaaatccacattgcccacaacaacgccgcaatccctataaagatttggtgctttagcctagattgtaaaccctttagccaaatcccaaacatattagcaacattgttaggcggatttatcccaaatgttataaaaaggatactccaaacaaatctagccacatgacaatcaaagaagagatgttgtatcgtttcattg

SEQ ID NO: 94474 - DNA, 637 bp, Oryza sativa
cacccctgaactagcctaagcaacaatccagtaaagttccagcaaaactactgctaatgaacagagatgacgcaatctattgcaaattgcatcagaaacagccctacagaagcgaaactcgaaatatctacacagcccaagtataatcaagaaaagaaacctttaggcaccgccagtaaccacagaccaaagatcagttcagtcagactcacggtcgcaccgcagctacttagctaattaagacgatacacgcataacatagtaacacatagagatggagattccgttagcagtagggttgtttggtctgctggtggcagccacggcgccggcagatccaccgctcccacacccggcagtgatggaaacggaggtcggcgcggcaagcggcgaggggcgagcaagccggcgcggtgagcggcgacggagaagaccgccgctgcaggccgtcgacgctgccgcacggtgtcgccgagccgcccgaggactgccgccgctggccgtcgacgcagccgcacgccgtcgcaagccgcccgaggaccgccgccgcgcgatctggccgccctagtgtcgaaaccagatttcggcaatattaaaaggggtggctatcaaactgaaaaaatagatgggtttagag

SEQ ID NO: 94475 - DNA, 541 bp, Oryza sativa
agaaacagccctacagaagcgaaactcgaaatatctacacagcccaagtataatcaagaaaagaaacctttaggcaccgccagtaaccacagaccaaagatcagttcagtcagactcacggtcgcaccgcagctacttagctaattaagacgatacacgcataacatagtaacacatagagatggagattccgttagcagtagggttgtttggtctgctggtggcagccacggcgccggcagatccaccgttcccacacccggcagtgatggaaacggaggtcggcgcggcaagcggcgaggggcgagcaagccggcgcggtgagcggcgacggataagaccgccgctgcaggccgtcgacgctgtcgcacggtgtcgccgagccacccgaggactggcgccgctggccgtcgacgccaccccacgccgtcgcaagccgccgaggactggcgaagcgcgatctggcccacctagtgtcgaaaccagatgtccgcaagtattaaaaggggtggttatcaaactgaaaaaatagatgggttta

SEQ ID NO: 94476 - DNA, 711 bp, Oryza sativa
taagtaattcttcttgcctttcgagagattgtactttactatccaaagctctcattaacttagccaaatgttgcatagcgggtttgctaaagctcttaagcacatcatctaattcattatcactttcctcatcactagaatcaacatcaagagaggtgtgagagggcttttgagtcatcaccttgcggccttgggccatgaaacaagagtagtggtaggagtcgtcgtcgtcatcactcaaattgttgaagagacgctccttgcttgaagaagatgacttgaaggcaacggtagcaacaccaccttctccttcaaccttgtcttttagcttgggcttgggcttgacctcgggatcttcctcatctccggagtaccacacctccgccatgtgtgcctctgccacatgagcacgctccggcttcttcttgcctcccttagccttagcttcatttgacttagaacaatcggcaatgaagtggccatattcaccacaattgaagcaagctctctttgattgccgctttcccttgtcatcatccttcctccgtttgccatagccactcttgcgaagaaagtgcttgaatctcttgacaataaaagccatctcttcatcttcactttcttcacaacttgactcttcttcttgttttgccttcaaagcaacttcttgatttttgatcatggcagcattcttcaccatttgcctcactt

SEQ ID NO: 94477 - DNA, 1559 bp, Oryza sativa
cacctaaacccaaattccatagtccatattgccaacttcatacatgcctgcgaagcttttttgggcgtcaggccacattttgccctattccgccgcatcttcttcctcaagccccaaccgaacaagagcaaaccatgtgttgttgggggggggcggtttccaacttaggggaaccttgagccagaaatatttttccatgcccttcaaaacctcgaacaagggctggcatgcaaactggttctatgtacaaaaccccgagcctgcacttcctgagtactcctgtcttcctccagtttatcaggacacttggaactcacttccaatgggagaagaagccgctcaggcgcttgccctgatggaccgtatgctgaaactaaaggagcaaggtctgcaaggagaacagatcacccggcattttatcaagagccggctagccccaatcaaagaaagatctcgtacggcctttgaatttgacggcaaacatgaccccaaccgtgaagatctagactctcttgattttaaggtcatgaaggagagaatgtacaaaatcttctcaaatgctatcgtggtcagttattcgcacttgctaccagcggtgccatacaaccccttcaatcctcctccaccgatatgtattcaaacatttcagccttcctcaaaagcatgctttcatcttctgttaagctaattgaaagttcgaaatatcatgcccaggaattagccttgatgaagtcggatcctccaattgctcaacgctgatcaccccgccggcaaactagtcaggtgagtggaggaccaaaaattcggtctgatactcaaccaaacacctcgaaatcaactagccagtcagactctcgcaagaggaaattggttctgagtgatgatgagggcgatgatgctaaaaaaactggcaacaaagaagtgactggaaaacaaccaagacaaactaatccgaagaagaaaacatccagtcgtcccatgtcgaaaatcagaaaatcttccaggtacaaatcatttggccatcttccttgtattgctgcttacccactattgaaatagcattgatagcataactcaaatttgtaggaagccatctgacatagatccttctggaaaagactttgagccgactgacatggagataggcccttcaaaagaaactgggccgactgcagaagatcacccgagtgacaatcaaccggcaaccgacaatgtagaacccagcaacaagcccccgactgggaaccagtcggccgaagctggagttggcgctaatcaggatcccccaactagaaaccagtcgggtacagagccagataaagatatcccagaagtagaagctcaagctaacagccctcccaagatagacaccggtgctagcccaggaactagttctcctgttagggtgcaaggacctgctcgtccccgaccggaaatcaaaacaggtaagcaaatccttcaaacctgttttgatccaacagactttcttcaattgtttcaccattatttatgaatgcctaaggcttgatgatcggcgacgaagaagaggtcctccggat

SEQ ID NO: 94478 - DNA, 3263 bp, Oryza sativa
aagaagaggtcctccggatacagtcagctgaagattctcgcccacctattttagtcaagtgggggatgacgacatgcaacctcagggaattgtgataaagaagcaaaaggaagacgaggaagtatgcctgctgaaaaaaggcactcggccaagccactcgtctcgtaaatgtaagttttcatatatatatatatatatatataacttcaaccaccctgtcaatcaccttacttgaacaaagacaaactcgcgatgcagagaatccatctcaggaatgaggcgaagactgcaacccttgaaaaattagttcctcatcttggaacccttgaagctaccagaaaccagctgcatgaagctaaagagcttgccaggaagactgaacatgatctgagagaccggatcgctgagctccaagattccaactttgagctgagtggttcgtcaaaaggtaattctcatccctgtctcacttatttatgctgctatctgtgatatcagccaacaagaagcgatacagtgcaagccgccaagatatctgaactggaaaaacggatccaagctctggagaaagacaaggccgaattggcaaaacaaagagactcggctctgaaagatgtcgaaggtactggtaactaatacttcaaaacaccactctcatcttcatgcctagtcattgatatagacttattcgtgtagaccgcaagatcaaatcccaaactcaattcgatgtcttagttaacaaaatcaagaagcttgaaggagccagagatgaaatcgccaatgccgctacaccacttgtccaagccatgttcttcaataacaatggtccgagtgcatttgatgctaccgaaatcttcgacaagctgagaattgctccggatacatattttaagaatatcaaggaagctggaagtatgggagcgagcttagcgttggcaatgaccaagtccttgtacccgaagattgacattgacgctggtgatggttttgcagacgggacaagcgaagaagccgctctcgacctcatcaatgatgcgcagaaagctgctgataagatagccgttgatgtagttgagggattctaggacaacgacctctggccgactagatctaataactctgatgatgaaaaaactgataccgattgatgtttattataacaatgatgatgatgatgatggaggcacaatttgtacaatactgatgaatttatgatgtgcttgatctttaaacttaacttctgatttcttaaaagcttttggcaaaccttattgaaccttaaaacccgcaaaagttgttgaaaaactttcaggtcttattaaccaagccaaaaaatcaaacagggcaatgataaatcaataagcaaattgaattgataaaaatcacactccattattattttagtagcccccgactgataactcaaggaaaagcttgacattagcagtcaaagagggaaatacaaaagtaatgcctaagcataaaaacgacgaagatgttcaatattccaagagttgtcgatatgagtaccgtcttcacgcttgagtcggtaagaacctggccgagtgacttcggaaattatgaacggtcttcccacaagggagataacttgtgccgatcccgtgtagtctgatttttctcagaaccaggtcgccgactaaaaaagctcgtgatcgaacattgcgattgtgataacggcgcatcccatgcaaataccgagctgactgaattaaggctgcttcacaggcttcttccagtcggttgaggtcatctactcggtcttctctctagcactcctcgctgaagttacgaaatcgtaaagattcaaattccacctcacttggcaacattgcttccgctccatagaccaggaaaaacggtgattggcccgtagcccgactgggagtggtgcgcagggatcaaagtacacatggtagctgttctacccacttgccggcatagggatgcagtcggtcgaaaactcgcgcttttattccttgaagtaccataccattggcacgttcgacttgtccattgctcatagggtgcgctacggatgcataacaaattttgatgctgaagtcttcacaaaagtctttaaatactctgccggtgaattgagtgacgttatcagtgatgatccgattaggtaccccaaaccggtgcacaatgttgattaaaaaatctctagccttgtctgcgtgattgtaatgactggtttggcttcgatccacttggaaaatttgtcaacagctacaaaaagatgagtataaccaccgacagcctttttaaacgggccaaccatgtcgagcccccaaaccgtgaacggccaagacagcgggatggtttgcagctcctgagccggtagatgagtttgtcgggcaaaaaattgacaaccctcacatgttcgcacaattttgtcagcgtcggacacagctgtgggccagaaaaaaccctgccgataagccttgccaacgatggttcgtgcagcagcatgattaccacagatgcctgaatgtatatcctttagcaattgtcttccctcctccaaagaaacacagtgttgcaggattcccgatggatttctcttatacagctcagtctcatgaatgacataaagtctgctgcgcctggaaatccgctcggcttcatctttatcttgaggaagttcttgttttgtcaaaaatcttatgaggggctctctccagtcggcttcaatcatgcttacgtcttgagtgtccgtggcattgattgtttccttccttggtacggttggctcgtagagatgttcaacaaatacatcagaaggggctgcttctcgttttgaaccaaacttagccaatttgtcggctgcctcattgttgtgtcgaagaacatgggtgagctcaagtccatcgaatttatcttccaacttgcgtacctcctgtcggtaagcggtcatgttattatcaaggcaggaccactctttcataacttgattaacaaccaactgagaatctccacgaactatcaaacgccgaatccctaaagagattgcaatccttagtccgtgaagaagcgcctcgtattctgccacgttgtgagatgcagaaaaatgtatccacaatacgtagctcagcctctccccagtcggggagattagaacaactcctgctctagtgcctgaaagcctttttgacccgtcaaaatgcatagtccaatactccatcttctctgcaggcgtgtcttcttggcactcggtccactcggcgatgaagtcggct

SEQ ID NO: 94479 - DNA, 1308 bp, Oryza sativa
accccttgtgggtttggcgccacgtgtgtgggttaggtgagcacagcggcgctcacctaaccgcgtttattgcgggttggacgagcgccccacgccacatttaatgcagcgcagcacactcgttcggtccgtgacaggtcacagtgtgtgaccggtcacagaccggtcagatcgcgggttaggtggcaacaggcggcctgacacacgcctcgccccgtcccgtcggaatgatgagagcctccaggcactcgtccctagccggagccggcgtgggaactcctggagttggcacgtcagccccggccagatacattccaggcttcatcgcaaccattgcaaggaagtcattgtatgaagaagggcagacgtgtagcatgctgaactgacacgtggtggacaagaatgaccggtctgtgactggtctgacgccgtgtaacaccctgaaaattcgaccgacaaaaccaaaactctaaaaatacggattttcaaaaacttttttaaactaattgcatcatgccgatcttattggtctattttatctggagttgatctcgaagattattaatcgtgagtaaagaatagttaattagaaataaaccttaaaaacaaattggtaaaataaatataaattaaaaataaagattaggtgtggatagtaataaataaaatattatcgcgaccatatttggatcaattaaatttcattgcgatggaataagaattaaccctaattaaaactcaaataaattatataaaaataaaatatgagtaatattaatctagggtgaattcattagttaagataacacgaatattgagtaaaatgcatatatgtaaaattaggaattgtggaatcaaatttagatggaaaatacactaaaatcgggataaataggaaaagtcactgttcattgcgcctaaggtgttcgatgtggtccctaaccttccccctcctctcccacctctgcccctagccgccccgagcccgtccatcgcgtagccgctgccgcgccgcgtcgccgtcgcgtcgccgtcatcacgcgccgcgcgccatcgccgtcgccatcgtcaccgtcggcctcgcgccccgtgccgccgcctcgagccccgtgccgccgccttgcgccccgcgccgccgctgccacgctgtcgccgcgccgcacgcccgcctaccgccgtgcaaccgtcccgtcgccgcgccgcgcgcccgtcccgtcgcgccgctgtcccgccgccccgcgcgccctcgcgcccgtcaccgaccgttccgtcaccgcgccgcgcgcccgtcgtgtcgccgctgccgcc

SEQ ID NO: 94480 - DNA, 888 bp, Oryza sativa
actaaatttggctaccacgacctcgtaaaggccaaacagcggggatcccgtgattagccgacttccaaagcatggcctcctccgccattgctttcgccacttcggtccaagacctttgttgttgattgaagatttggttgttccgttctttccaaattgtccaagccatcagtgtcacgacggtgtcgaagcctcgacgatgccgctccccaatcttcattcggctctcacaaagccaattgtggaaggatggctcattgacaagtaagcagttcggactccttattgcctgaagcgtccaccaccataattgtctcgattcagggcatgctaccaagatgtgatcaatgctttcctcgtactgatcgcaaagaacacagcgatccgggtgtggcaaccctcgactgcgcagacggtcagcggtccagcatctgttaattgcgaccaaccacaagaagaagcagcatcgaggcggagcgagcgacttccaaattggggtggaaaggaaggtgacacgaccagaaaacaaggccttataggcggattttgagctgtattggcccgaactctcccatttccagatgattgaatcaggagtagtaggatcaagatccaccatttggacaagcgaccaaagctttagatattctagaataggctagatcccaagtgctcctcggatgtctttgatccattggcgacctgttagtgcctcaaccaccgttcgacgccagcgcacgcgtggtggaattttatcatagatgttcggagcaatggaccgaatgcaaccctcttgcaaccagctatcttcccagaagagaatagtttgtccgtctcttaattaacagacggtagaggctgcaacgaaattcgtttccttttgcgacc

SEQ ID NO: 94481 - DNA, 1430 bp, Oryza sativa
  unsure (1)..(1430): unsure at all n locations
ttttcttttttctaaggccttcgggcctcttttttgtatagatcaacttaatctgtaatcaaaaatgaagaaatttttgtgttaatttcatcttgctgtgagtatgagatgaggatgatctgtgccgtggtccttttgtgtcttaacttgattaagggttcgtgcccaggtcccagtcctcaaaaggcgcgggtcggggctagtgcctggggagatccacatgtcgagactggccaggccgggaacgtggtgaccgaaggttatgggtaacccgattgtgggtttttgccgattcccccccggagttcaccacgccccggggcacggctcggttctgggccccgtttggcgattttagccgacccgagcccccgagggcaggattgagcacgagtgacctatttcaagtcaagattcttcaaaaggaaaaaacagcacagacacagcctttatgaaattgaaactgtctttattgaaatatttgaataagagaaataagaaagtgcatgtgtggcagnccccggccaaccctgcacgcccgagggggtgcggggttggcccgagcccgaaccctgacacccgaccccccctcaggggtagaagcgccgaaagtgttcgatgttccacgggttagccagctcagtgccgtcgcccgtggcaagccgtattgagccccgccgggggacgccgaccactcgatacggaccttcccacattggtgagagcttgctcaatccagcacgcgtttggacgcggcgtagnacgaggtcgtcgacgcagagtgatcgggcccggacgtgacgctgatggtagcgccgcaggctctgctggtagcgcgcggctcggagggccgcgcgccgccttcgctcttccaagtagtcgaggtcatctctacgaagctgatcttgatcagcctcgcagtacatggtggcccgaggagacctcagggtgagctcggatgggagaaccgcttccgcgccgtagacgaggaagaaaggcgtttccccggttgctcggcttggtgtagttcggtttgcccagagcactgctggcaactcctcgatccatgaatcgccgtgcttcttgagtatgttgaaggtcttggttttaaggcctttgaggatttccgcattggcgcgctccacttggccattgcttttggggtgggcaggtgaggcgaagcagagcttgatgcccatgtcttcgcagtagtcgccgaagagttcactagtgaattgggtgccattatccgtaataatacggttaggcactccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacggtcccaggatattgag

SEQ ID NO: 94482 - DNA, 710 bp, Oryza sativa
aacccgttctacttcgaggtgctcatcgagttcgaggacggcgacggcgacctcaacgccgtcgacctgatggaggccggctgcggctggacgccgatggtgcagaactggggcgcgctctggcggtacaactccaacaccggcaaggccctgaaggcgccattctcgctccgcctcacctccgactccggcaaggtgctcgtcgcaaacaacgtcatcccggcgagctggaagcccggcgtgacgtaccgctccctggtgaactactcctaaattaattacagctctctccacatctcctgcaagaagctgcagtgcagagttgcggtaaattggtaattacagatttataattagcctcgggttaattatatggcgggaaatgtgcgtccgggtgttgcgagaggcggtgtcagaagaggaggaaaggaggtttaagaatcgtgttcttccctccacggtctctgcattcccctagtgatgtgactgtgtcgtcgtcgatttgtctgtaaaattttatttttcttagttatatcttcctctgttattgtcatgttgagggagaagcttgagctgcaactaatgttgcatgccgatgtatcaagtttgtgtgtgtgtgttttttttgtaccacgcaaatctttcagataaatggattagtactgtcagaagatttctgtacttcactggaactcatgcattgttggggt

SEQ ID NO: 94483 - DNA, 1348 bp, Oryza sativa
tgcttgtcacgacgcacgcaaaccacggggcccgtgcatgcatggcagccgtcgtgaaccggtcgaccaactgtgtgatctcttcctctcgatcgtccgtgatcgatctacatgcatgctaccgtgtgtgcagggtgccgtgcaaatggcagggggtggacatcgcgttccgggtggacgccggctccaaccagtactacctcgccgtgctggtcgaggacgaggacggcgacggcgacctgtcggcggtggacctcatgcagagcggcggcagcggcggcggcggatcttgggcggcgatgcaacagtcgtggggcgcggtgtggaagtacaactccgggccggcgccgctgcaggcgccgatgtccatccgcctcacgtccggttccggccggacgctcgtcgccagcaacgtcatccccgccgggtggcagcccggcggcacgtaccggtccaccgtgaacttcaggagggaggattgatgagatgatatgtaggggatatgtagggtggtggtcgcacgcgcgcgcatgcacggtccaacggccgccggcgtacgtggcgctagcttagtttaattatgcttggagctatgtatatcagggcccaagtggtttgtgtgcgccattgttgcgcgtggagtgatggagctctctgtcagctcgatcgactgtggtagaagaataaacagatccttcagctaagctatttgccacagttgggcacttgggcgttggctccggtccatgtaccgatcagccagcgtggtccggggctccgggccgtcgcgggggataacgcgacttgtgctggcttccgcggttccacctacgcacttcgttcggtggaaaaagtcctttttatttttctcaactaaagttttagtttgattcgcatccatggacagcaaaatcagatagagaggctaccttaacaatcaaaattgactcattttatcttttcgagtgatttaggtaacggttttttcctacatgacacattgaactagagaaatttaaaatgatctatgaaggaaatcatgacggccatggtggcagcgccacggcaatcgagctcgagataggagaaatgatgccacgggtggattgagtgtccaatggctgcgagtatgatacacgtcgaattattgtctttgttggagacctctagagagcgagctccgccccctcctagccgttggtcatctcgacgcttgagctcatccccctcgccatcagccagcctccccaactctttccttcccttcatgccgtagtagacttcgaggagcgctgctgtaggattgagcttgacaagaaggcagcggggttatgggacatgcggatct

SEQ ID NO: 94484 - DNA, 1162 bp, Oryza sativa
ccacgcgcgatgccgtcgacaccgctcgcggtgcctctccccgcgacggcgatggcacagcgcacacaatgcaacctcgcgaggatgccgcggccgcagcagccaaactgcggcggccgtcccggctcgagcagaggcggcgccgtcggcttgtcagcagccggtcgaatgctggagacgccggggcagccgcacgtggcgcccaacggctggcctgcggggcacggtcacccggcgtctgggactctcgccgccgccatggcatgctcttctcgtccggtggcgcggcagcagggcaaccggagagagcaagggtgggacgcacatcaggctcaggttggtgctcaacaccaaaatctcccgcgatttccaccgcagcaaggcggtggcaacatcggcgagaggcaggggcagggtcagttcaggccgggtacgccgtcctatgtgcaggagcagcgaccgccgccgcagtcgtcgtcgtcgcacgaggcgctgcatgcgggagagcggcaacaagccaacaacaacagcagcggcagcagccggcagcaaaggcaaacagacacagcaacggtggcaagcaggcgcgaacccatgagtaagtgagcatggcttgctcgaagaggttactgcctttactggcgtgagaccgtgagtgaccaagcagggtttctctgctcctcatgcctaggagaataggagggttactgggaaaactgaaggattgctatttcttgtgttagaattaacgaactgagtttgattaatctgttctcataggttgacttgaaagcaaagcattttcacatttcgtttcttttcttctatttctagtgtataggacttttacaatctttagctgacactagcacttcacgtcgcaccaccttcgaactacaatgcggcaagacagaccacacaaaattcatcaggaatacaatgctacaaactgtcaaaagtgccacgactgatggctcccgtcacctcccataattttacagttcaattttccaagcataatgccgcattgagaattcaaatgctgaattgagacaacatccaagacactgtgagtcaaggataattcaaacatcaaacagatgacatattcggccaaactatggttcagtcaccactggagtgtccttgactcctgaacctc

SEQ ID NO: 94485 - DNA, 1730 bp, Oryza sativa
ctcaagcttggaccacatcaaaggcagtcaaagggtgacacaaaggatcaaaatgagaatatttagaaaacttatccaccacatccaatatagagttatacctgccagacttaggcaatccttcaataaagtccattgttagaacttgccaagcaccatccggaacagggagtggttgcaaaaggccaggataccgagagcgatcaggtttggactgcaaacagacagaacaaccagcaatagcgtccttaatcccttgtttcatcttaggccaagcaaacaaagccttgatccttctgtaagttactggaaaacccgaatgacctcccataggactactgtgcaaggcatcaatgatcttgtgctgcaaggacagatgattgccaagccaaacacggcccttatacttgataatgccagtacacagagaaaacaatggtctggcagtagggcagagggccagatcagacaataactgagcagagtaagggtctgaaaggtagccatcacttacttttgggagccaaacaggggtacaactgtagacagcattcagtttagaggagtcctcagaatacttcctagaaagagcatcagcagtcgcattagtactgcccttgcggtaacaaattttaaattgaagccccaacaacttggtaaacgctttgtgctaccaaggtgtgtgtatcctctgctcattcaagtgcataaggctgtgatggtctgtcaaaataatgaatttagcctgctggagataagagcgccaatggtcaactgccaataaaatggcgaggtattccttttcataggtagagaggcctctatttttcaaactcaatgctttgctaatgtaagcaatagggtggccttgctgggaaagaacagctccaatgccaacatcacaagcatttgtctccactataaaaggttgagaaaagtcaggaagggccaatactggtgctgatactaatgccatttttaaggattgaaaggcctgatctgcttcagatgaccaaacaaagggaacatcctttttgagcaagagagtgagaggtcggctgataataccaaaattcctgacaaatttttgataatagccagcaagacccaaaaaacctctcaacttcttaagagttgtaggtactttccaattaacaacttcttccactttagactgatcagtggtaacccctttatcagaaatgatgtgaccaaaataagaaagttgtgtctgtgcaaaagaacatttggacatcttaactttccactgctgttcagagagaagtgtcaaaacttgtctaagatgatcaagatgggaagtcagatcaggactataaataaggatatcaaaaaaagacaagtgcaaacttaaaacagaagctaaagtggcattcatagccccctgaaatgtggcaggtgcacccgtgaggccaaaagacatgaccctgtattagtaatgaccagtatgcgtttgaaaggctgttttatactcctcaccctccaccaaacgaatctgatgatacccagctcgaaggtccaacttagaaaagaaacgggctcctgagagttcatcaagcaattcatcaatgacaggcataggaaacttccatttaactgtgatagcatttaattacctgtaatcgatgcacaaacgccatgtaccatcttttttcttaaccaatagtgcaggtgaagagaaaacactggaactaggctgaatcaccccagca

SEQ ID NO: 94486 - DNA, 1042 bp, Oryza sativa
agcggggagagggcctgctccggtcgtcgggggccttgggccaccgtccggctcgggggcctctcctccctgctctctcccgggccaagccagcacagggtgggggtgcacggaatgaagattgtcctcatcgcgctccacgatcaacgccgcactaaccacttgcggggtcgccgctaagtagagtagcaagggttcatttggctccggggcgaccagaactgggggagagctgagatacgccttcaactgagtgagggcacgttcagcttcctccgtccaagtaaacggcccggagtgtttgaggagcttaaataagggtagcgccttctctcccagccttgatatgaagcgacttagggcggccatgcaactggtgacgcattgcacatccctaagcttgctgggggggcgcatccgctctatagctcgtatcttctcggggttggcctcgatgcctcgggcagagaccaagaacccgagaagcttgcccgcaggtacaccgaacacgcatttatcggggttcagttttatgcgggcggagcggaggctctcaaaagtttccgctagatctgaaagtaacgtttcctggttgcgcgtctttacaaccaagtcatcgacataagcctcaacattacgtctaattggctacccaaagaaattcgagtagtacgttgaaaagtaggacctgcattctttaacccgaagggcattgttgtataacaataagtttctatgggggtaatgaacgcagttttttcctcatcctccctagccatgcgaatctgatggtaaccagagtatgcatctagaaaacacaaaaggtcgcaccccgctatggagtcgacaatctgatctatgcgaggcagggggtaaggatccttaggacatgccttgttaaggtcggtgtagtcgatgcacatccgaagcttgccgttcgccttggggacgaccaccgggttcgccagccactccggatggatgacctcgcggatgaatccggcctccagaagtcgcgccacctcctcgcggataaaggctt

SEQ ID NO: 94487 - DNA, 2433 bp, Oryza sativa
ccatgcaaacaggaaaagtctaggaaaaaattgcaaatgccataggaaaattacgtagattgtattaaatatctcacagacaaatagacttgggcaaacagccaactattacgcaaaacatgtaaaatgatgttactttattccatcatgttgcccctcaacataggcagctaagattctagcttaaaaaacataacgctagtcttgattacaatttgacatgttaaggcactcattctcgatgattgtgaaccaaaacagcaagctcctggtaaaatctttcaagaactagcaagtcatgtgcctgcagaaaccagatgtcttactcaattgacctcaattcatcaaaaaaaaaaagaaaacttaacaagcgaatctactcctgtgttttggaggattcgtgtgtgaaagagctacaaagtatgaaccagcctcttccttgttctgggctgctaatctggaaaggttcagtccaagaaaaagaaaaaccccctctctcggtgggcaaggtcctccttttatatcttaagaggataccacatgcaccatttccctcttttttgtggggacctcccccaccttttcataaatggacggagatttgtatagttgccatccgagtcaccttctgatgggacggcccacaactacccccactttcgccgggagcagatgcgacgtggaatcgtggccgcctgctgacgacatgaccggagtcagaccagtcacgtcggtcattcttgtccaccacgtgtcagcttagcaatctacatgtccgcccttcttcacacaacatcttgcttgtaatggttaggatgaagcctggcatatatctgatcagggctaacgtgccatctctgggaggtaacacgctagctccagctggggacgagcgcctagaagccctcgtcctgacgggatggggtgaggcgtgtgtcagatcgcctgtggccacctaacccgcgatctgaccggtctgtgaaaacccggcagtccgcgaggtcataaagggaagtgttgtggccggtgcaccacttgccggttgggcgctccctgctgggagcgccggcctctttctttttgtcacccgcaggcctcccctttcgggtggcccgcggagcgccctcgacggcgaggacatgaccctcgtcgtcggtatgggctgacctcttcttcctcctcctatcacgccgccctgtctgagcggcggatccgggggcggccgaagctgccacaccggaaccggaggggttccaggtccatgcctcctccttacgagccactcggtccgcgagctgaaaaagctccgcggtagtctggggctctttggaggcgatcttttcgagcatgcggttgtgccgcacaccccccctgaacgcgtaaatcaccgcgtgtgcagggatgcatggtatggtattacggacttgacagaaccgctgaatgtacgagcgaagtgactcatcatcccttcgctcgtactgagtgcaagtccgcttcctcaccggggcgcggatatgcgccttggaagttcatggtgaactgttggcacaaatcctcccaagagtggacagacgcgggtggcaagttcattagccaaccccgcgcctgttctttcagggccatgggaaagaaattcgccatgaccctgtcgtcacccccggcggcatcgatcccggttgtgtagacctggagaaactcggcggggttgacgctcccgtcatatttttccgcgatggtgggccggagccttgggggccagcgaacattccgaagactcgccacaaaggctctacagccgacaccaccaaccgggggcacggagggctgattcccgcgtccgtgttgaggtgacactctggacgagaaagcgccctccgttgcgtgggcagcacgtcggtcaatacaccggcgctcgatgctggtgcgggcgtccggccccccacgcagatcttcccgggtcgaaggagtcgacgaaggagtggcggccgaatgcagaacaacggctcccgctcgtcgtgccaaccgtcttgacgacgcgaagccggtggtagcagcaccaaaggcattggtggtggaggaccgcccaccagcatttaggcgctgccgtgcagtcatgaccaatttggccacatcgtccagccaacgttgggatggagactccgggtcatggacgacggccgggtaacgtaggagcgcgcctgcagcttggagcgcgccctggggcgtgctgccgtcgccgtagacgaggaggcgacgctccccatctcgccgcccttctccacctcctgtggatgtcgaagtcgcggatccttcagccctctcgagcgccttctcccgcctaggactttggcgtggagggggcggtggagtacgagctctacggcgtgggtttggctccccgtagtcaccgctcatactcggggagaggtcgtg

SEQ ID NO: 94488 - DNA, 1258 bp, Oryza sativa
tattagcaaatgtttcttgtaacatcacattgtcaaatcatagagcaattagtctcaaaagattcgtctcgtaaattagtcgcaatatgtgtaattagttattttttttatgtatatttaatattttacgtaggtgttaaaatgttcgatgcgatacgatataaaatttttgggtgagaaataaacagggcccaactagtagcaccacgtggagttctagagtcaatcagtgtcactgtgcacgcggggttgaaagcgcgcgccgcaggtaggttgttcactggcgtagtggcacaccagcggaagcaagcggccggagacattaattccagatcatgttcagagaaatacaggatggtgcgaagacacgcatgctttcatatacatgcacatgccatatatagtctgaatcactgtgctgttgaataatctccaagtgcacgtcatcaccgaaaacgtaattaattacacgaacgccgaactgcaagaattaacatccatctgcatcgcattaaaacggcggctaatgaacacaacagcgatgttttcagatgagcagtctttttcagagaagccgaaatttgcaggatcacggcaatggtaacatcatctccggtgaaaatgcaggagttactacaagtgcaccagctcccgatgcagcgccaagaagcacgtcgagaagtccaccgatgacccggagatgctcatcgtcacgtacgaggggtcgcaccatcacggcccgcagccgctcttcccgccgcacatcgcccagccaccgccgccgacgtcggtagtgggcttctccgccgcctccggcgctggcccgccgccgtcgtcgcccgcggcggcggcaaggaagaggaagaactatgtcagggcggccttctcgccgacgacgtccgaggacgacggcgacggcgccggccggctacggccagagtggccacaagacgatgggacgtcgtgtgacgtcgccgagttacgacgacgtggcgacgcggagcacgccgcgccgcgtcgtgtcgcgacggatcgctcgtgcgacgatggcggcggcggcggctcgacctcggcctcgtcgtccgtggcgcgcgctgacgccgctacggcgctgtcctctgactcgccgccgaccatatggtcgtgcctggactggccgtggtcccaggaaacactgtttctgtagctgaagtgagtggggagttgacttgggaagatgactcgatagtacagtactggatatctacttgcaaggtgt

SEQ ID NO: 94489 - DNA, 520 bp, Oryza sativa
ttgataaactttcccaagccaggttacactggttttccaagccctgggcaagaccactaatatctacagaggtgctcttgctccaaatacaatcccataaaagcaacaagaatactctcatcttatatatatcaaataaaaatgtactggatgaagcatgtttgtgtacctctataacaagcaaagttgccaaacgatccttaataaacttaagaatcagggctttatacttctttccctttggttgtcttctcaagtattccaacaaccagtaacgtaagttgaggctatggagtctcctggcaactttaacatgcatgcttgcaataaaggtcattccttctagctcaacagctgaatagggtggagattcacctctaagaaaagccttcatctgcaatttaatacatcttccatcagcactcgattttaagtagaccataagtaggacgatcggatcaagatacaatgagcctagactgcactcataacataaaacacaaggtgggtaattgataat

SEQ ID NO: 94490 - DNA, 716 bp, Oryza sativa
gttctaacagagcttcagcgagtacagaagatgctaaagaatttaaggaattgtcaacaaccaacaaacgaaacctgagctgctgtcaaaatggtttcttgactatctctggcaatgattttgcaaaaacgggttttattattgttacacagagcagaccctggctgtttcgcgacaaagggaaagcacaagacaaaataaatctgacaatccaatgaggaatactcttattcagctataatgacgttctaacactataattttttttcgttgttgttttgtacacacctgtggcttctacaatctgaattttctaactgtaaattcacaaagtgcagcgagcaatgtattcttctacagagtgtcgctcatcttttgtacaccttggttagaagagatgggagaatgattggtggaccttctgtactcagtacaaagcttcaattctggaattcttctccaccggttttgtttgatcttgttgtggtttaatcgtgatactttgagaaaaagctcatcagctcagaaagacacttcagctcatctgtcctacttcatcagattgatgtcagttcctacaaggcaatggtaaaacaattatgcacacttcttccatgttcaaatcaattaataaaaggacccaactaccaacatggatcagataaaccaggtagaatttgtagactggctatgaaaagtataatgcatctcaattg

SEQ ID NO: 94491 - DNA, 1458 bp, Oryza sativa
tgtttctcaactgttttcgtgagagccattctttttgaccttgcccggtattgtggtgaaacatcaaagctctttacagaaccatcaagagaacccaatgacaaaaaagatgtagttttgaatgactctggtgtagctgtagcaggttccatccccatgggagtgtaaaatctatcagtatttgatccactgatcttcatctcactagctgaaacaggtgttgatttatcccgttttcttctttttaatattgaaggagtacctggaaaactgttagcagcactcttcaaaattgaatcaacactaagctggcttgttaattttccctttgttggagggggagtagtgcagccagcaggtgacaatatatcatccccacaatgttcagatgtatggttcccagtaagatggtcagaaaagagtgaggaactcacagggactacatcttccatgttagggatctggtaacaaagtggaccaagagagcgtgcctcattcttcaaagataattctgcttcacctttggatggtgcagcttctagttgaatggtccaagagttcccggtatgatcaggtgccgagttaacctcaagacctttctcatgaacagaatcaatttccaagcccttaccacggacagaatcactttccagagcttgcgccactaaagtgacagcggaaccatcaactacagatgcctcacgggaagtaagtggctgagcagttggtaatgaggaacgagatagaaaccctgagcaattagaccgatgagctgttccaggttggtcttttgaattgataatgggtgccttgttcaaatcaagatgaccctccatagccatcagctttggtttatccttgaacttatcatgaacaagcagtttcggaactaccatattattgctggtattgtacatatcttgcttctttctgagagaactattccaatgatcctttatagaaataatcagtcctggaaaagcaaccatacgaagcactgtgaaggtgatgtaaagtgtgtcttttcaaaataataacacaactcataattctgatttacgaacaaccaaccaatattaaatagtttaagaccatcgcacaggtatataagcagttgaaagtagaacttgaaccaaaaatcaaccaaattaaattgcacaagcgcgttaaaagatcaaggccagcgtgattttgacctagctcgatgaattaatgaaagcaaaaaattccaagggaagtaagctttataaaggtaccttccaggaagaacttttgctatctcggcccatttattcccataaatccgatgagcatttatgagggcttgttcctcctcagtagtccaagcatctttccttatttggggatttagatgattgtgccacctaagattgtatgacttcatacttagctccgtataatgtattgtatcatgccaaacttaagcacttttttcat

SEQ ID NO: 94492 - DNA, 888 bp, Oryza sativa
caatacttatctgacgatcaaatcttcctggtcttagcaaagccttatccaggatgtcaggcctattggtaccagcaagaacaacaacaccagatgtagttccaaacccatccatctctacaagtaactggttcaatgtgctttcacgctcatcatgtccaccagaaaaacctccacggcctctagcacggccgattgcatcaatttcatcaatgaatacaatactaggtgaacactgccgagcttcttgaaataagttccgcaccctggatggtccaacaccaacaaacatttccatgaagtctgaaccagaaatagacaagaagggcacaccagactctcctgcagtagctttagcaaggagagtctttcctgtgcctgggggaccaacaagaagagcaccctttggtatttttgctcccagttcttcatatttcttgggatttttcaggaaatgaacaaattccataatttcttgtttggcttcatcacagccagctacatccttaaagaacacctgtagcacacaagaaacaaggttacttcagtagaattatatgaatatgttattgtatgttctttgtcaatggtgaataaagctacagaacaaacatttacaaaaaaggatatgaatttcatgttttgttcaaaatagcaagagatggaaatagcaaataaaaactaaccttatttttggagtttttatccaattttgtcacttgaacttttccaatactgaaaatgctacggcctcctttcccaggaccacccccaacagtaaatccattttgtatccttttcccaagcaaatatattaatccaataattagaacggttgggacatacttcattacttcctcaaaccattttgcttcagtagtgtaagtg

SEQ ID NO: 94493 - DNA, 665 bp, Oryza sativa
catttcgcccggttaaccacaaattaataaccttttttttttgtttccaagaaaaaaaacagagacaaacgttaccgtgcacgagtactgtgcttcctcctgcatcttttttggcgcgtgagagaattcggctccggaggttggtaacagatcaaatcaccaaaggtggacggagaagattccgtgttcctttctcgtaacggagatgcatgggattgtgcatttgttgctccgaattaatgcggtgtgtcactgtcgtgggatctgagcgtggtactcgacctaacatttttggtccattggaaaagcaaactctgttattgggtccggctggtgtcacgtaaacaaaatcttagttgcgacatagctaggggagctaggtgcgctttccattcatgcacgtcgccgtcgaagaatttagctggtgattagtgaatattgaaacgtgctgactctggttaccgttggcatgcgtgcgtgcgcgtggatgcagacacgttcaagctgaaggtgaaacccgggaaaacgtacatgctgcgcctcatcaacgccgcgctcaacgaggagctcttcttcgccgtcgccaaccacacgctcaccgtcgtcgaggtcgacgccgtatacgtcaagccgttcaccgtcgacaccctggtgatctcgccggg

SEQ ID NO: 94494 - DNA, 664 bp, Oryza sativa
ctgaatcaaatgtgctcacagactgaaaataacaaaggcatgtttagtacttacctgactacgacgccactgtgcacgaagggaagcagcttcttgaagaattctcagttcttcctcttcttccaggttcatatacagtagttcagttgcactctcatatgttaacatgtaggtaggttttatgattgaattctctatactatattctgcaatactatgaacaacacaaatatagttctcaacaattttgctataacaagcaagagaaaagcaatattaagatagtaggataccttccatctggctgcaaaatcacagatacagtaacagatttacaacccctgccttgttgcaggctcatagcattcatagcaagcctctctgggaacattggaaaggtagcagttggtaaaaagatcgaggttcctctgtgcattgcttccctgtaggaaaaaaagtaatgttctcttatacataccaatactgatagaaacactagaagaaggagaagaacaagaacctgtcaatgatgctccggggttgaaccaagcttgttgggtcagcaacatgtatccagacctttatcctaccatcaggtaatctagcagcacttagtgcatcatcaagctgagtcaccaaaaaaaagtgtttaatggatctgtca

SEQ ID NO: 94495 - DNA, 718 bp, Oryza sativa
cacccctgcgccgtgaacgggacgtgccaaggtcccaacgggagccggttcgcggcggccgtgaacaacgtatccttcgtgctcccctacacggcgctggtgcagtcgcactacaccggcaggtccaacggggtgtacgcctccaactttccggccatgccgctgtctccgttcaactacaccgggacgccgccgaacaacaccaacgtgtccaacgggacgaggctggtcgtgctcccgtacggcgcgtcggtcgagctggtgatgcagggcaccagcgtccttggcgccgagagccacccgttccacctgcacggcttcaacttcttcgtcgtcggccaagggttcggcaacttagacaccgtgaacgacccggccaagtacaacctcgtcgaccccgtcgagcgcaacaccgtcggcgtgccggcgaccggctgggttgccattcgcttcctcgtggacaatccaggtgagaatcattgcattattgcaacattttattgattttttttattcttacattgcatttctgatcaataagcgagaaaacagatttggctgcgcacacatgagttgaaatttgcaactaattcgctacttttgcttgaacgtgtgcaggggtatggttcatgcattgccacttggaggtgcacgtcagctggggcctgaagatggcatgggtggtgcagatacgggagcctacccaaccagaagatcc

SEQ ID NO: 94496 - DNA, 549 bp, Oryza sativa
ggcgaattcgagctcggtacccagtctaacacagctgtgtcagcatttactcatctccctgaagggcctgccaggagttttgccaacatcagtgtgctccgtgctgcagaaatggatttccaaaaacctgtaccacatggtgtcctcggtattcctggttatgtacagttcacctcccctattcgaagatatgttgatctgctagctcattatcaggtaaatatgcctctgttattcctgctaatagggagaactttaacagtttccaggaacatgatggttacaatttacaaagagctttcctattatcaatttcccaccttgtgttttatgttatgagtgcagtctagtttcattgtatcttgatccgagcgtcgtacttatggtctacttaaatttgagtgctgatggaagatgtattaaattgcagataaaggcttttcttagaggtgaatctccaccctattcagctggtgacctagaaggaatgacctttattgcaagcatgcatgttaaagttgccaggagactccatagcaacaacttacg

SEQ ID NO: 94497 - DNA, 725 bp, Oryza sativa
cgaaattggaaaggatttccatataaaattttggggatttcttggggaaaaggaagaggagaataagaggaatatttcccctcaactaatttggaaagaggagcaacgaggaggccggatttggtggaagaaggcggcactgtgcacaggctcggctggctcgggctctgtccagagctggaagatgaacagtgccagggaggcaaactagacttttttcggttggctgagaacagaacagagcacttgacttgggccggcttgggctgcacagcacgcgcgcaagggagagagaagaggaaggaatgggccgaaaatggcccaagcggaggaggaggatttttattactttcccaattaaaataatcacttaaatgatctttgaattgttaaaaatacttccaatgctcaaataatttcaagaaaaatcatgaaaatacttggacactcaaagtatttaacaatattaaaaccagaccatttaatgattaatttaatatgtggattattactgaaatgttctttgtatgattaaaaattaggaattgagctccgaaaaatttgagaagatttcagagagttgacttaatcatggagaatttaataaaaattaaatccatccatgctttatattagggaaaatttatttcccacatttaacttcacttggaaattaaagaacatttaatataaattctattaataatttattaaaaaatttataa

SEQ ID NO: 94498 - DNA, 746 bp, Oryza sativa
ttcccctcaccttcaactttgaaggctcttgcgccgaatctaacaccaccacgcgttataccacccctctctgtgacctcgtatgtctttttctgcttatcgaaacaccttgcagtgtgtttgttcgccttactttcttgcaccttcatcttactgtcaaccttggtggaccaacgctgccctaactggactcgcttcaaagcttcatcatgtctgttcacaaagtagtcattacacttcatgaacgtaaatgatacgatggccgtcactggaagcttacgaacaccaactagcacgctattgaactgttcggccatgttggttgtcatgtaaccccaccggcggtcatttctatcgtatgcacgagaccacttatctttatccaacaactcatcttcaagccatttacgaggaccttcgggaatacgctgccttagtgcctcaacatccctctcaaatatccacttctcgtcaatctgacatatccttaggagctcttttgtctgatgcttgtccgcaccggccttgtggaaattagcactgaagtgcctcatgtaccaccggtggtgaaccgatggcaatcctggaacaggagtcatcatggcattcattataccagcatgtcgatctgagataatacaaacctccctatgcggcccaaccacaacccgtcggacaagatcgataaaccagcaccagtctcgtgaattctctttctccaccaaggcaaagctaaaggtacaagt

SEQ ID NO: 94499 - DNA, 1991 bp, Oryza sativa
ctgcccgagtggatcgcaagttgtattgcgtgggttgcgtcccctgaggcgcgtcgggaagctgtgacatgtctatctcctcggcatctggtgcgacgtagtcctcatcctcctcgtcctcatcgtcatcgtcgtcgctaggtggagccggcgccttcccctttcccctcccttgcttaatgcgtgacgacgacgagccaccaactccttcacgctcttctatcctgatggagtgtcgagcagtacttggacgcgcggattgaggtagtggtggtggtagtctccccggttggtacacgtcgtccaatccaaccgacctgcaacctaatcttgctgcaagtttccggcacctttgacgaactttctgcatttcaaaaaaaaaagaagtttgttaggcataactcaagtaatgcaaagtgctaaataaattttacctctaaaacattgcggagcgtgttctccgtgtcctcaccacccctcggagcttggagggcatgccccatttcattcacactcctgaggagctctctcgactgaaagcgtgaaaagatatatgttagggtctagggtgcaaatgtaagtaactttgacaaatgcaagaaaacttacgactttgtctctaagtggggcgtgctccatttgatatccaactctagtccggacatcatagggattccgcccctcatcggagtcgcggtcatcctctatgtcggcttccgtccaagtagggcggaggaacagtctatatgtcctatgcagccaacgaaggtactctgagaaaagatgattttggtgtatagtttcgatgtacctatcgttccttccggctgttcttcattcatcaatgtatctattatgctctaacccccaatctttcaccttctttgttctcaccctgtcatacctagacaagtagaaggtgatgaaatagtagtgagcatcgacaagggttaaatggtacaaaattgaacattgacaatgaaagcaaacaaagataagaaatatttacttgtgtaattcaactccagttgagatgtcatcaaccggccaatcttgtttcttcccgaactgtcgcatgacaccgtgcggaaggtggtactcaactgccccaaaacaaatcaatgggcactggtacatgaaatagtcagagtctcgattgcacatctagttcacggtcaagcttgaaacctcatttgtgtggtatggtaaccactcaatctgcaaaagttgaagagatgtccttggttagtatctcaattaaagaagtaaatgtctaactagaagtgatattggaagtactaacatgttgaggcttgaagcagtccatctcattgacataatgcttgtatcccacatcccggtgagcatgtgcagtgccagtactctcaaaaaggtaggccactgttttctccatgtctggctcattgtagggccaaggagtgaagctttgcctccacttaggctttccatccggtagtcttaaccacatccacatctgaatcaatagcacacaaccactcatgttggatgatggtgcctgacgacaacaggcctcacagagctgtctatatgtccacactaacactgctgacccccaactgaaacggcccagatcaccaaggttggcgaccaaaggaatccatatcgccgaagcaatgtcacccccagcatcaggaaacagaacccctcccaacaagtgcaagatgtatgcacgggcataacactcaacacgccatggctcagcatcgtcgtcaagatgtgagaagttctgactcagccaagacaggggtattccattctgcttcttcttccccccttgcccctgctcaatgttcagtggaatgccaaacagctgctgcacttgtgcatgccatccaggagtatctgtcttgcccgtcacggcatgcccccgtaatgggagggccaaaatcatagccacatcctgtagagtgatggtcatctcaccaccggggaggtggaagctgtgtgtc

SEQ ID NO: 94500 - DNA, 559 bp, Oryza sativa
gctcggtacccgacttttgacattgtttcatgtgtggaatataggatggactttttgcattgtttgatgtgtgggacatgtgacggacttttggcattgtttaatgtgtggaatatgtgatggactatgtgatggacttttggcattgtgatttgtgcaattggaacttgttttagtctgtacgaatctgtgaattgtgatttgaattgcgaactgtgaattggtacatttgtgcaatatggatctacaatttgcagggaggcagagggcggcgccaaccaccctggcgccgaggttgagaagggcagcgccagccagtgccgcgtggcagaagggtttcgggctgggggagggcggcgccagctacccaggcgccgtggtccatgagggcggcgccagccgaggcccggaggcagaagggcttcgatgggtggaggaggggggcgccagccaccctggcgccgcggtcggggggggcgccagccgttgcctggaggcagaacagacttggcgaaaatttgggggggggagaaagttggtggggcccgtagaggagggg

SEQ ID NO: 94501 - DNA, 1417 bp, Oryza sativa
cccaggggtctatttataaaataagttttcaaaaaggaccaaattgtaaaaatttcaggtagaggcggcgacgtcggttttcaccacgctatggcccgcaagacatgtaaagttgtcaacacgcttgtgcggttttgggccgaattgaaggcgacctgctggttgggcgcccaagctacagaataaggaataagttcacttgatgaccctcaaaagtgatcggaatataatccatgagcctaaaccgcaaaatcggatatctcgaccctcaaactattaaaaccggtgcaatttgactcccttggcggttttagagggcggtttcgctgacgtgacggtattgacctagtctgtgtgctgacgtggcgcttagatagcatttcaattaaaaagatatacgtgggacccgtttgtcattcacacacacaattgtggattccactgacatgtgggccccacatgccatcttatccgtttcttcttcctcccctcctcccttctctatttctctccctctcccctacagccgtccgcggggagcgagcggcggcggccgggggctgaagcagcgggggacggcgggagctgaagtggcggcggcggaggtaggctggagtccatgtcgtgccgctgccaccaccaaccgcaccacccgacggcacacatcgagatgtcgtcggcggccgagctcccctcagaacccgagagattctgcgggtgtcgcggcggctggcggagactgcggcgagcggctgcggctgcacggagtcccaagcgcggaggcgcaggtgtggagccgtggcctacgagcagcgcaacggagacgcgggtgtggcggtggcgacctgcaggtcgagcagggcgcggccgagctcgccgtaccccgccgcgtgtgcctcccgccgccgccgctgtggtctcctccatcttcaccgtggtggagctcagcccgggcgccgccgccgcccgcaggcgatcagctacaccgtccgctccggccgcctcgacgcgctcgcgctgctcctccttctcgcagcggatataccccatggtgaacgaagacgcgcagtatggcgacgagctccgggccgtgtgcccgccggacgcggaggagacggcgtgggtgcacctagaccacggcacgccgggggagctcgacagccagtgctacgtacaggaacgtgctcgccgggaaggtggtggctattcaactcggatcactggacgctgatcagcgaagcggcgacgaggcagatggtcgaggacaacgcggtgaacctgtcagccctttgcttgttggcttgccgcttgatgttagtacacacatgcactgcctgttgctaccgcttgtgcttgctagccgcagtccagccagtcctcatctgtcgccccttgccgattgcctcagcaaccagca

SEQ ID NO: 94502 - DNA, 585 bp, Oryza sativa
tttgcattgtcgactagggcatatatcttttgaaactatgagtaagatgttcccaccagaactaagtagagtggataaacataagttagtatgtgatgcatgcgagtatggaaaacatccaagaacatcatatgtgagtagaggactccgaagtatgttaccatttatgctaattcacttagatgtttggacttcacctgtggtctctatgagtggaatgaagtattttgttacctttattgattgctactctcgcatgacatggttatatcttatgaggcataaggatgaggtgcttaaatgcttccaggatttctatgcatacattaaaaatcattttaatgctcgggttcagtttattagaactgataatggaggggagtatatgaacaatgaatttagtagctttctttcatcagaaggaatattgcatcaaacttcttgtcctgatactcctccacaaaatggagtagctgagaggaaaaaccgtcatcttttggagacagctcgatcattgatgtatactatgaatgtacctaaattcttgtggagtgaggcagtaatgacagcaacttatcttatcaa

SEQ ID NO: 94503 - DNA, 682 bp, Oryza sativa
ccatcaatgtatatattgtaggggagagagaacagattaagtcagactaggttgtaaaattgaacattctaggggaaaataaatcttcgatgcatatgcaaagaacttgaccgttagccttttacgcaataatgtatgcataaacataggaaaaaaaaaggacctgcactactgattgttactgtatctgatctgcaaagtggcaacagagccatgttaatattgtgctgagaaatggacgaagttgatataggttcgtgctaataaatattcttacaatctgctatcttcctgtctgcaggaaaagtcacttaaaaaccagaataatgttctgcaaaaggtaaatttcattcttgtttacaacaatgttttatatcagatcactacaaaagctgtattggaggtcaaacccttttgtctacattcttcggagcagctcatggagacagaaaaggagaaaaacaatgtataataaacactacccgggaggagcaaaatggagcaacaccaagcacatcatcaccaacaccagtgacggctccagatcccatcccgacaacaaataacaggtaccgcttttacttccatatattttgcccccgcactccccataaataaaacaaaaaaatttttgttcttcagcaaatttttattatatatttttggggatcctctagagtcg

SEQ ID NO: 94504 - DNA, 661 bp, Oryza sativa
ggcgaattcgagctcggtacccgatccttcaataaagttctacaattaagtgagaagcagcactgagaggatgcccgtttcgtttacccgagtaattaagggggtgtttgggagacttcagcccctctctcaaaaacataagtttctaggatatggacttatggttttgagtttagccccatgtgaggctgctagggaaagtagcacacgaattgtggtcaatctagcaacaggtgagtaagtatcaaagaaatcttcgccttctttctgagtatagcccttagcaacaagtcgagccttgtacttttcaatagtaccgtcaggcctaagcttcttcttgaacacccacttgcaccccacaggtttacacccatagggtcgctctgttacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttgg

SEQ ID NO: 94505 - DNA, 645 bp, Oryza sativa
ttttgagagaactaggaaatatgacttgaagatgaacccgacaaagtgtgctttcggtgtatcggctggccagtttttgggatttcttgttcatgagagggggattgaggtaactcaaaggagtgttaatgcaatcaagaaaattcagcctccagagaataagacagaattgtaggagatgatcggcaagataaattttgttagaaggtttatttctaatttatctggaaggttagaaccttttacaccattgttaagattgaaagctgatcaaaagtttacttggggagcagagcaacagaaggctttggatagtattaaggaatatcttagatctcctccagttttgatccctccccaaaaggggataccttttaggttatatttatcagccggtgagaagttaatcggctcagttttaattcacgagcttgaaggaaaagagagggttgtgttttatttaagtcgtcggctcttggatgcagaaacaagatattcccctgtggagaagttgtgcttgtgcttatatttttcttgtacaaggttaaggcattatctattgtccaacgaatgcactgtcatatgcaaagccgatgtcggtaagtacatgttatcggctccatttttgaaaggaaggtttgaaaa

SEQ ID NO: 94506 - DNA, 661 bp, Oryza sativa
catactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacagcacacccatgctgtacaggcccaaccatcctgaacaaccatactcggctgtacagatctaactccaaaccaggagctaagcaaattattatcaggtattaacatccataattattgtgagaggtgtgagactaatcacgaaaaacattgctcaacccgcccataaccgcgggcacggctattcgaatagttttactctggccagaggtgtaccactgtacccacaagacacaaccccacatcatgtcaccatgtgcctcaataccaccacggtacctcggaaaggagttgtgacaataccccttgcacaacataatccattacagcgcacctttcctggatcataatcaccccctcaaaaaccagaggcatggactccccagcgacccccgtggacttctcgccacttctcagtctggcgcactataatgaatcacgctatacaaaagataaagccgttgcccacgcttggcttgtggttggcacgataaatgtctcccaacagta

SEQ ID NO: 94507 - DNA, 747 bp, Oryza sativa
aaataagggtaacgccttctctcccagcctcgatatgaaccgacttagggcggccatgcaatcggtgacgcattgcacatccctaagtttgctggggggggcgcatccgctctatagcccgtatcttctcggggttggcctcaatgcctcgggcagagaccaagaacccgagaagcttgcccgcatgtacaccgaacacacacttatcggggtttagttttatgcgggcggagcggagactctcaaaagtttccgctagatctgagagtaacatttcctggttgcgcgtctttacaaccaagtcatcgacataagcctcaacattacgtcctaattggctacccaaagaaattcgagtagtacgttgaaaagtaggacctgcattctttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgccagccactctggatggatgacctcacggatgaatccggcctccagaagtcgtgccacctcctcgcggatgaaggcttgacgttccggggcct

SEQ ID NO: 94508 - DNA, 6706 bp, Oryza sativa
cttgaatccgttaagacatcgttgaaaaatagtttttcaatgaaggacttaggggaagcaacatatattctgggcataaggatctatagagatagatcaaagaggctaattggattaagccagagtacatacattgaaaggtgttgaagatgttcaacatgcaagattctaagaaaggtttcttaccgatgtcacatggcattaatcttggcaagaatcagtgtgctcaaacgactgatgagcgaaacaagatgagtgtgattccatatgccttggcaatcagattcatcatgtatgctatgctatgtacacgtccagatgtttcatattcacttagtgcaacaagccgataccaatcagatccatgtgagagtcactggatagctgtaaagaatatcctgaagtacttgagaagaactaaggatatgttcctagtcaatggaggacaggaagagctcgttgtaaatggttacaccgacgcaagcttccaaactgacaaagatgattttagatcacagtctggatttgtgttctgcctgaatggaggcgctgtgagttggaagagttccaagcaagatacagtgtctaattatacaacagaagccgaatacattgcctcttctgaagcagcaaaggaggctgtttggataaagaaattcatttctcgactaggtgtggtgactagtgcttctagcccaatggacctctattgcgataatagtggtgccattgcgcaagccaaggagcctagatcgcatcaaaagtccaaacacattttacggcggtatcacctcattcgcgagatagtgggtagaggagatgtgaagatatgcaaaatacatacggatttgaatgttgcagatccgttgacaaagccactccctcagcctaagcatgaggcacacactagggcaatgggtatatgatacgttcatgattgactctagtgcaagtgagagactgttagtgatatgccctagaggcaattatagagatgattgtatcacatactttgtttacatatttatccaacattgttccttgaaatagataactccttattggttaatgaatatgtgattctttcatgagaatcattatgttgtttgttactatttctaaaggatccctgatcaaatatcatatgtggaacaaatatgtttatatgatcagcacatatattaattgatgatcatgtctcatggatcatggtatagagataccaaattaataatatggacacatgttggtgaacatgttgttggatagacccaacatgagacactgcaagagccatatgtgttgtgtcatcagtgatctcatttagtgttggtgttgaatccttagacctgagattatcatgcttctcaacatgtgtagtagcttacttagggactgctaaacgctactccgtaaatgggtagctataaaagtagttttcgggtatgctatgaaacatgttgtgggatatgaataatcaagatgggatttgcccctcctatggagagatatctctgggtccctcaatgttatagattatggaagtgcatggccatggcaaaggtgattgaggagtcaatcacaagttatataatctatcaagtggtaacgatctatgatctaatacttgcatggttcctggtttacgcgatagaaatttttgatttatgctatcttagcctacgcgtatcccaacatgcacatagtcaaggagacggaattacttgctgccaagcttgacctcctcatgaagcgcttagacgaccacgacaaacggcctcaagacactgtcaaggctctggactcacacgttacatgtgaggtctgcggcaacacgggtcactctaggaacgactgccgggaaacccgtgaggaggcgatgtatatgggcaacaacaacaacaacgggtatcgtccacaaggaggccaggggtggaaccaaccacgcctatattatcaagggggtaacaacaatggtaacttttctaaccaaccctccttgaaggatctcgtcattgcacaagctaaaaccactgatgcgctaaacaaaaagctcgctgccaatgacaagatccttgaaaatataaatgttaagctagatggtttgcttccgcttttcaaaaccaactgagctttaataaaatgatagaaacccacctagctcagttggcatctttagtccctgcaaaagaaactgggaggattccggggcaacccgactcctcccttgaaaatgttaaggcgatcacgacgatgggaggtaagtccactcgtgatccaccatatcctaaccctgcacgaactaacgggattacaaaagaagcgctatctagtgactcagctgacaaagaggtttagcaagaaaagaccatgccgcaggagtactacgacgcacggttgctgtcgtttcttcaacggagtaggaaaccgttagtagacgagcaattcgctcgttttgttgaagtaatccagaaaatccacataaacgtgctgttgttggatgctatgcaagtactaacatatgcccgttatctcaaggacatactcaacaacaagagaccactcccaacaacggaggtggttaagctgacggagcaatgcagcaacgtgatactccacaagctcccaaagaagaagaaagatccggggtgtcctgctcgatcggggtacagcagttcgaccaggccttatgcgatcttggagccagtgtcagcgtcatgccaaaagacgtctttgacaagctcaacttcacggtgttggcaccaacactgatgcgcctacaactagctgactcgttagtccgttacccagcagggatggcggtggatgtgccagtcaagatacgggatttcttcatcccggttgactttgtggtgctagacatggacacgggaaaagagatgtcgctcatcctggggcgcccattccttagcactacggaagccaacattgacgtgggagcgggaagtatccgttttcatattaacgggaaggaggaaaagtttgagtttcaaccaagggtcgaacaatgctccatggtcaggataaagtacgggccgaacccgcagaatattcaagtggtcgaagtggagccacccaagacggatagcctggtgaagttcatgcagaatttcctagagaaggaaacaacgatgcctaggaaccgttattggaggacgttgataaaaccaactataccggccaagaagtcagagcagtcggctgagaagaagccgccttctgcaccaaagccatggaaggtgtggagggaaaagccaaacacgcccgctccatcacctccagagacgggtggaaaatccacgaactgaatcagaaggaggtacagtcttgcacgtcggattttaaatgacgcgaccttcgccataggaaattggtatgtatctgcatttttgctttcaacaatttgaatttatgcatcaacacatgtttgaatttcaaaatttccatttaggattctttgagttttgaggaaaatcttcaaatgaatttttcagagcaaaccaaaataaaattttcaacgaaaattcactgtgccacgactgcactaaccgttggaatccaacggccgaaagtggtgccggttgggcccacgaggggttcgaccgaaccggccaggcaacagttacctaccatttttggctgggcaacggctattgggtcccacatgtcttttctgacagttgtgggtaccctataaaaaccagccggccgagagggaattccaccccatttcaatacattttcattccctctccaaagtttgttctcaagttcattcaagcttttatagttttcctcaaattcaaacactagttgcatatatacaagttgctttggtggaactaaccggtgggtgaaactcttgctattctaacccccgtcgggttagtctgttcttgctccattgtgcagaatgaggagccgattgtctcatctgtccaaggggtccggctcttcatcaagtcatcatgatgagtctagtactcattcatcagctgatgtctcgttggaagacgccgaagctccgcgacgactcctgaacgacaccgacctcgaccttgtctgtgatcgggagagaaaagcctactacatgctgagcaaccgggagtatgctcatacacgagaatactctccggagctgctgaaaaagatagatatggatgttgaatttcgtgctatttggaaagctgttggttggcagagatttgctgtggtagatgagcctggttctcgtttgcttactttgcaatttctatgcactttgaaagaaatagaagatggattttcctttcgctttttccgtaaggagtttacccttacatggaaaagcttaagcacacttcttggttttcacgattgctgtaaaatcgatctctagaaaggaatttctgggttcgagaaaaataggttttgggaagatatttctggtgctccaatttgcaagaaacctatgatgaatgatatccataatcctacacttaggctcatgcacaaatggattgctatgactttgtttcctagaggtgatcttagaccattaggggggatgaattgattatcatgtttgccatggttagaaagatcaaaattgctcctgtgaaatgtatgataagacaatggttagaaagtataaagttctctgctcctgttgagtgcacttctctgattactcagatagcaaaaggggtaggtgtcgttagcaacaaaattgcttttatctcagccgctcgtccgtgtatggatgagacctatctagtgcaagggcatattctgaagtatggagtggatggatctttgatttactttttccccggttgtacaaataaaatcccgttgccaaatgcagggtatcatttgtataactgacatgaactaaccattcccctgtagagcatagaagaatctcgtgcaagtggagcatacagggagacacgcaacatgacaaggaatgaacgggaaagttcatcatcctcaacactcgtgcagatgtatgaggcaggttgggaaccaactggggatgcacccggatggacccaagttccacgccacagcattagagtctcaagctgggcaagtgccagtgaggaccggtggcgtgtgcctcatgatatccaatggggggacaaccaacgtcttagatcaagtggtatgcctccatctccaagtgaatggcgctcgagttcttctcgatgggacttgggtgaaatcactaggagaatggatacccttgatgtgcagacgggggagatccagtacaacctcacggaacacatagctcaaacgtaagaatggcaacaatctgctgatgctcagtttgccaacatcaacaacatgatgcagcaacagcacgatgatgttcaagcgtacttccgctttcaggggttcaatccttatcaaggaccctgagggaaagccaagcttggggggagatatctctccccccactgaggtaacttgtatcacattgcatatttccctttccaattgcatatttccctttccaattacatatttgctttccaattgcatcttataaacttgaagacaacataaaaatttgcaaaatagaaaataccaaaaaaaaagataggataggtttgagttatgctaggtaagacaagctagttctctttgttgaaatgatgaagagttgctctgttttatatctcttatatataggttcataggtaagtgctctctcaaaggttaaatataaatagcaaacaattatctgggaacctgaggtaaatgagctgcaaaggttcaagcttggggggttttgttgacagtcgttatcgatcagtttcgaccatcaatattgccaaaatagaggagaactaataatgcttgcaatgcatatacatgttagaataataatattccactagtattaggttcactaaccttttgcagagaataacaataaagtggaggagaatcgacatcaacacagacaataaatcaattaggcgatgtcgagaattagacttatgtatgagtgggccaagaactcagaattgacacgacaaaccgggccaaaattcacaagtctgcagagaagaacaacggaggaggccgccagccaaaaatgggctggattgggccggccccaggttcggccgaatcctcctcagcgccatccgatccagggctttgcctggacggtgtggattagcccccaatgacggttggagggtatttccgaccattccaaccgtcacaaccgtcattgggaggctataaaaggagttgctcttctcacttcagtcacacatgtcaagcaagagctctcatattctctcaagttagtttagtagtctcaagctagtggaataggaatagagtagaaatcaggagtccggaagtcttcggaagagtttgggtatggctctagtaattttcctttcctcttttgtaagctttgtacttttattagagtattcttctttatatatttatggtatcgaaatactttccgagtatatgaatgccaacttttcattatgttcatgttatactgaatatgttgctaggttatctgggagatgctttggtgcgggtataatgtttgcgtatgcaattatactctatgtcatgacgatgatattagagtagtatctggtagtttagacgtggtgtctagattatgggatatcattatttggggttatatgctgcggatgag

SEQ ID NO: 94509 - DNA, 2105 bp, Oryza sativa
ttgcttatactattaaaccttatgcaactaacaatcaggctgagtatgaggcagttctcaaagggttgcagttactcaaggaagttgaagccaatgctattgaaattatgggagattctttgctagtgatcagtcaattggtaggggagtatgagtgcaaaaatgatatattaatgatttataatgagaagtgccgagaactgatgaaagagtttcggttggtgactttgagacatgtatctcgagaacataatattgaagctaatgatttggcccaaggggcgtcgggatataagccgatgatcaaagatgtcaaaatagaggttgccgcattaacattcgatgattggagatatgatgtgcatcattatttgcagaatccatctcaatcggcttctcagaaattgcgatataaagcgttgaagtatactttattggacgacgagctctattatcgtacgattgatggggtgttgcttaaatgtttgagtgccgatcaggctaaggttgcaatcagtgaggttcatgaagaaatttgtggcactcatcaatcagctcataagatgaagtggttacttcgacgtgcaggatatttttggccgacaattgtcacaccctgaagttctttcccaagcctaaattgaagttactagccgtcaacccgtgccttacacaggttattggtagtggtagtataaagatcaaaattttaaccatacgttcactacgttggccatattcgaattgtagcatgttagattgaaataatagttaactactcccttcgtcccagaatataagcatttttagagttagacaacggttattaagaaagttggtacaattaaataggggagtgttgtggctgaaggagaagtggagatagctggaaaaattgaatggtggaggattgtgattcgttaagaagagaatgttggtggtaaattgttatattttgggacaaattctaaaggctagaagttgttatattttggtacagaatgaatactacttgttaattattaatttcgaatcaaacaaatgctaaatttgtgatacatccaacttttttatttgatattgtggaattctggaattaattaagtatttagttgtgtctgtggtcgagtttaaatttaagtacaccctgtaatttaataattttgaaattaaaaaaaaatagttatactcagtatggaccctagaagatataagatatatgtaattagcttttttgttttatcattcccaaaactcataataataattagtgatctatggtctcttgtctatttgtaccggttaagtacaaattaaagagtctacgatattgccaattgcatgttttattttttcacaaaccccaaataaaacctaatgttgtgattttgcgattttgccaccatacatgctatttaaggtgaatttggtcacgtctatcagatcaagcctagattgtttactcttgctgcaagtaattctcatatgaacctacgtagtacatgataaatatttgtttacgtgcatgattatttgcttagtaggtttctagctagttcaaatggataaaccgtgtgtatgattaattctgaatttcgttctctttacgtcgcatgatttattatcgagaagaatatttatcccaaagagtcaggattgctaaaattatgggggtcttagtttcagtcacgtcatgtatcctatatgatactctagtaagtatgcttctctctctctctctcatttcctcttccaagtagataataattaaattaattttactcctaattcttataaactgtgtactaaaaaacaaaaggtaaatattgaaacttataatgtaattatagtttatgttttgaaatttagcgtgtaattaactacaatgcaagtgtatgcaatatattgtagttacccttcggttttcataaaagaaaatgtatctccaaattaggctgctaaattatacttgtaaatgaagctctatatattaactgaaatacttgttaggaaaaattgatataaggactaacccaaacgaatgaacatgaacactgaacagtaagctgcaaactacatgtacatatgcattgcatacgggatat

SEQ ID NO: 94510 - DNA, 3014 bp, Oryza sativa
cgcattctttcatttcaaagaaatttgtggggatgcatgggttaagaaaagaagagcttagtacaccaatgagggttcataccccgggaaatagttcaacctcggtcagttatagccctttagtgctaatagaaatacacctatcacaatttctagccaacctcatccttctcgaatccaaagacctagatgtcattcttgggctggattggctgaccaagttcaagggagtcattgattgtgcgaatcgcacagtcaccttgaccaatgagaagggagaaaccatggtgtacaagtcaccagtctcaccgaagcagagaatctccttaaatcaaattgaggtggaaaaccctgtgaccaccgaggagaagagttcgcggaaattggaggatatccccatagtctgcgagtacccagaagtgttccccgaagacctcactaccatgccacctaagagagagattgaattccggattgatttggcaccgggaaatgccccaatttacaagagaccgtacagaatggtagccaatgagctagcagaggtcaagaagcaggttgatgagcagttgcagaaagggtacattcgactaagtacttcaccttggggtgctccggtcatttttgtggataagaaggacaagacgaagagaatgtgcgtcgattatcgcgcactcaatgaggtcacaatcaagaacaaatatcctttgccgcgaattgatgatttgtttgatcaactgaatggagctaaagtgttttctaaaatagacctgcgatcaggctatcaccagttgagaattcgggaagaggatattcccaagacagccttcaccactcggtatgggttgtatgagtgcacggttatgtcttttggacttaccaatgcacccgcattcttcatgaacttgatgaacaaaatgttcatggaatttctggataagtttgtggtggtattcatcgatgacattcttatctattccaaattggaagaagaacatgagcgacatctccgtctggtactcgagaagttggaggagcaccagttatatgccaagttcagtaaatgcgacttttggctatcggaggtcaaattcttgggtcacgtcattacagctcagggcgtggcagttgatccgtcgaatgtggagtcagttaccaagtggaccccacctaagaccgtgtcacaaattcggagttttcttggacttgcgggttattaccgtcggttcattgaaaatttctccaggatcgccagacctatgactcagttgcttaagaaagatgagaaatttaaatggacagctgagtgtgacaagagttttgaggagttcaataagaaattagtatccactccagttctgattttgcccgaccagacgaaagacttccaagtctattgcaacgcgtcccgtcatgggcttggatgtgttctaatgcaagagggcagagtggtcgcttatgcctcgcggcagttgcgtccgcatgaagggaactatccgacacatgacttggagttggcagcggtggtttatgctttaaaaatctggacgcgttatctgattggcaaccgctgcgaagtatatacggaccataagagtctaaaatatatcttcacccaacctgatgtaaatctccgacagcgaagatggttggagttaatcaaggattacgacatgagcattcactatcatccgggcaaagccaatgtggtggcagatgcattaagcaggaagagctattgcaataccttatgcactgaaggcatgtgtaaggaattgcagcaggagcttgaacacctcaacttggggcttgtagaatacgggtacgtggctgccctagaggcacgacctacgctcgtggatcaagtcagagcagctcaagtaaatgatcctgaaatagcggatatgaaaaagaatatgagggtcggaaaagcccgggatttccacgaagatgaacatggcacaatctggttgggagaaagattgtgcgtacctgacgacaaggaactaaaggatctgatactcaccgaggctcatcagactcagtactccattcatccaggcaacaccaaaatgtaacaagacctcaaagaaaagttttggtgagtcagcatgagaagagaaatagctgaatttgtcgcactctgcgacgtttgccaacgagtgaaggcagagcaccaaaggccagcaggttttctacaacctcttcagatcccgaaatggaaatgggaggagattggaatggacttcataacaggactgccccggacatcatctggccacgattcaatctgggtagtcgtgaatcgactcactaaagttgcccatttcattccagtgcataccacgtatacggggaagaaattggcagagctgtacttggcaaggatcatgtgtctgcatggagtacccaagaagattgtatctgatcgagggagtcagttcacctcaaaattttggcagaagctgcaggaagaattggggacccgtttgaatttcagcacaacctaccatccgcagacagatggccaaaccgaaagggtcaatcagatcttggaagatatgctacgtgcatgtgtgctcgattttggtggagcatgggataaaagtctgccttatgcggaattctcgtacaacaacagctatcaggccagtctacagatggcaccgttcgaagcgttgtatggccggaagtgccgcacacctctctactgggatcaaacaggtgaacgtcaactgttcgcaacagaagtgttaacgaaagcagaagagaaagtcagaaccgtcagagagaggctgagaattgcccagtctcgacagaagagctacgcggacaaccgccgaagggagctcacttttgaagcaggggattatatgtatctccgtgttactccgctccggggagtgcatcgtttccagacgaagggcaagttggcaccacgcttcgtgggaccatacaaaatcttggaacaaagaggagaagtcgcctatcagctagaacttccatccaacatg

SEQ ID NO: 94511 - DNA, 938 bp, Oryza sativa
aattggggacccgtttgaatttcagcacaacctaccatccgcagacagatggccaaaccgaaagggtcaatcagatcttggaagatatgctacgtgcatgtgtgctcgattttggtggagcatgggataaaagtttgccttatgcggaattctcgtacaacaccagctatcaggccagtctacagatggcaccgttcgaagcgttgtatggccggaagtgccgcacacctctctactgggatcaaacaggtgaacgtcaactgttcgcaacagaagtgttaacgaaagcagaagagaaagtcagaaccgtcagagagaggctgagaattgcccagtctcggcagaagagctacgcggacaaccgccgaagggagctcacttttgaagcaggggattatatgtatctccgtgttactccgctccggggagtgcatcgtttccagacgaagggcaagttggcaccacgcttcgtgggaccatacaaaatcttggaacaaagaggagaagtcgcctatcagctagaacttccatccaacatgatcggcatccatgtcatgttccatgtatcccagttaaagaagtgcttgagggtacccgaagaacaagccgattcggagcacattgacatccaagaagatctgacctatgtggagaagccagttcgtatccttgagaccagtgaaaggaggacaagaaacaaggtcaccaggttctgcagggttcagtggagccaccacttagaagaataagcaacctgggaaagggaaaatgggttaaaggccgcccatccgcacctcttcaccagctcttccgaatctcggggtcgagattccgtttaaggggggtaggtttgtcacaccctgaagttctttcccaagcctaaattgaagttataaatggtctcaagaaaatacaggtgtaaagcaagagtaaaccct

SEQ ID NO: 94512 - DNA, 1173 bp, Oryza sativa
ctagaaagaaaaaggcataggtaaactacagtctatcttttattccacaactccaataattattctaaggttttaaagaaagctactgctgctttggaactgatggctgagctgtatcccttgagacgcaaccggcactgcatttgctcctgtgaggacaatgttgttgacttggccttgtggctgttgacgcttcggcttcggacactcttttacgaagtgacctggctcataacaattgaaacacacccgatgctcccttccattactgttatcttcttgagactgatcctgctgaaatgacactgattgagtagcttgctcatcattgtcttcattgcttgcattagtctctgagttgatctcaccactgatgcccaactgttgtgactgttcttgacctgcagaaaaagattcaccaatttggagtggcttgatacgctgcctctggctactaccttgtgcctcctgggatacagtcattttccttttacggttatccatcttgttcttcttgtcttccagtcgaattgctttatcaaccaactcctgaaaatcctcatagtcatgagagatcaacataactgacagttcatccttcggaccttccaagaatttctcttgcctttcctcgtcagtacgcacatcttctggagcatagcgagccagacgattgaactcatgaagatactctgccacggtacgatccttttgcttcaaagccctaaactcacgcttcttcaaagcaacaactcctacaggtacgtgtgtcttcttgaatccttcggtaaactcttcccaagtgattggttgtcgttctgctctgttcatccggaaatgatcccaccattctgatgcagattagaaaaggtagaaggagaggggttacactaaagacaagaccttaaccaggttaacactgatctgatgtgtgtagaccattatattgttcaagttgattaagcaagcaacctagtatagttacacactcatcaatgaactactccaatgatgggaatgcaaccatacctacacacaaagcaaacaacaagcgttctaccctactaactattcttcaaagacactttggcggcataggttctaagataggttccaaacttcactctatctgaacacttaagattcgactatcatcttcttattcctcgatcc

SEQ ID NO: 94513 - DNA, 620 bp, Oryza sativa
tgggtgccccgtggtaaggggaagctcggccacccttccttttcggtcgccggtcatcggaagctccgccgccccgtgcaacccaagccgccgccgtcgcctcctggtcgccggccgtcgtcggtcgtcgtttggcacgagggtgagtatcgttgggttcgtctcgtcgtcctctacgtgttcatgtcctccaaatccgcagccggtcgctctatctccggcgaggtcgccatcttggtccggccattgatgatgtcatcatgacgtcatcatcttctccttttccagttttttctaatagattaaatcttcggaaattcataactaaatcatcgtaactcggttttgagtggttcaagttgctaaattcatctaaaatcatgatctacatgtttgtttactttatatgtactgtttatttggttttattagtctttttcttcgttttgcgtgttagcttgtcgtttccgtcgttgcgaaggttcgtgagtgcgtccgaagtgatcaagaagattacttgaagaccgattattgcaaggcaagtcacacagatcctaaacacaatcctttgagcatgttgatcctatatttaaattctctttcaactgtgcatttatttt

SEQ ID NO: 94514 - DNA, 1258 bp, Oryza sativa
cttagcctgatcggcactcaaacatttaagcaaccccccatcaatcgtacgataatagagctcgtcgtccaataaagtatacttcaacgctttatatcgcaatttctgagaagccgattaagatggattctgcaaataatgatgcacatcatatctccaatcatcgaatgttaatgcggcaacctctattttgacatctttgatcatcggcttatatcccgacgccccttgggccaaatcattagcttcaatattatgttctcgagatacatgtctcaaagtcaccaaccgaaactctttcatcagttctcggcacttctcattataaatcattaatatatcatttttgcactcatactcccctaccaattgactgatcactagcaaagaatctcccataatttcaatagcattggcttcaacttccttgagtaactgcaaccctttgagaactgcctcatactcagcctgattgttagttgcataaggtttaatagtataagcaaactcaaaacttgccccccgaggagaaattataaccaagccgataccacaaccatgagtgcatactgatccatcaaaaaacaatgtccacagcacaacctcaaccgagccgattgaatcatcacgatgatcaacgataaaatcggctatagcttgccccctgactgccttcggtgactcataccgaagatcaaattccgttaaggaaaatatccacttttcaacccttcctttcaaaaatggagccgataacatgtacttaacgacatcggctttgcatatgacagtgcattcgttggacaatagataatgccttaaccttgtacaagaaaaatataagcacaagcacaacttctccacaggggaatatcttgtttctgcatccaagagccgacgacttaaataaaacacaaccctctcttttccttcaagctcctgaattaaaactgagccgattaacttctcaccggctgataaatataacctaaaaggtatccccttttggggagggatcaaaactggaggagatctaagatattccttaatactatccaaagccttctgttgctctgctccccaagtaaacttttgatcagctttcaatcttaacaatggtgtaaaaggttctaaccttccagataaattagaaataaaccttctaacaaaatttatcttgccgatcatctcctacaattctgtcttattctctggaggctgaattttcttgattgcattaacactcctttgagttacc

SEQ ID NO: 94515 - DNA, 581 bp, Oryza sativa
tcttgctaagctcctacttcttttcagcccctgcaacgatttgcatatgtgagcaactgacccggtatcaaatacctaagaatcagtagaggaagtagcaagattaatttctataacattaatacctgaggtggaactctttccatcctgctgcttctgcttgaactgctctaggtatttcttacagtttctcttccaatgacctgtctccttgcaaaagaagcactctgcatccttagcgggccctgtcttttgaaccttggtcttagagttgctagtactcgtgatctcatcagagtttagctttctcttttgacaacttttcttgttgttgggcttgcgcttatgcacaactatcacatggttggagtttttcttaatgctttcctcagcagtctttagcatcccatgcaattctgccaaggtcctgttcaggttgttcatattgaaattcattatgaacggctcaaagctgggaggtagcgactggagaatcaaatcagtaaccaactctcggctaaggggaaaaccaagcttattcagactctcggcgaacccatcattttgatcacatgtgggct

SEQ ID NO: 94516 - DNA, 3308 bp, Oryza sativa
gtgattagtttcaccctagtctagtctaatggaattgaatagtataggtggatggttgggcctgttgcaatgtggtgtagcgttggacagtggatgtttaatattgattaattattacaaatgttttactgtttccaactactgtttataaatgctcgctttatgcaaatgaaccactatagctatccctcgatacttccctgcatcatacccctattccggtatgacgtgctgagtacagtgggtagtactcagtcttgctctatttttcccaaaccccagagtttgagtatgcgtcagatggtggcttctccgaggagtaggcttcgtccgtgccgtcgaggatgcctgtggagtggggatcccgctgcggtgcaagtcaaggcttagccccatttatcttttaattttccactgcatttatgtaagacttttataatgtttgtaagacgtggatctgtatgtcaactttgttgtttctgttccccggccggtcctggacgagaattttaatgcacattctgcttggaattctattcgagaatttctgggcgtgacaacaatgctggaggattgtttcaaatattacaagggatgtcaagattgtcaaaaatttggagcgattcaaagggcacaggcatcggctatgaatcctattattaaaccatggccatttagaggttggggaattgatatgatcggtatgattaatccgccatcaagcaaagggcataagtttatattggtggcaaccgattattttaccaagtgggtagaagcgattcctttgaagaaggttgattctggggatgctatacaatttgttcaagagcatataatttatcgatttggtattccccaagccattacaaccgatcaaggttcaatcttcgtgtccgatgagtttgttcagtttgccgaaagcatgagtatcaaattgttgaattcttcaccatattatgcacaagctaatgggcaagccgaggcatctaacaagagtttgatcaaattgattaagagaaagatttttgattatcctcggcagtggcatactcgattggccgaagccgtgtggtcttatcggatggcttgtcgtggattgatccaaggtcctccttataagcttgttatggacatgaggcttgtttaccatgggaagttagaatcggctcaagaagaacgagttgcaaatgatttgacagccgatgaatattatattctcatagccgatgaaagggaagacttggttcaatctagattgcgagcccttgcaaaggttaccaaggataaggaacgagttgctcaacattacaacaagaagggggtgcccaagactttttcggatggtgaacttgtatagaagttgattttgccgattgggactcaagatagtaaatttggcaagtggtcaccgaattgggaaggaccgttccaaatctataaggttgtatctaggggatcttacatgttgcaaggactcgatggagaagtttatggacgagcgctaaatgtaaaatatttgaagaaatattactcaagtgtttgggttaatgcatgatcggctggtgttgccgatacattatagccgatgtattcacatcgccttgagatggccgatgttatatcgcccttagttgttttcatattgtaatcggttatggtttgccgatgtacaatggctgatattgttatatcgcccttagtacaaattataattttatcaatgcttttgacattgtaaaattaggggggcacatatatgaaaaattgcaaatttttgagcaaaaaatatggagttatattgaatcggcataaaggttatcaagatgagttagataaagagctagagtttcttagccgattacaaaatttcctaagatctattacacaagatatcactgagacaagtagcgctggatagccgatatagctctttgcctaatttgttctacttcttcaatggcttgggcatcttgagcatcggtttcagagatgaatcttagggacttggtcatatcagcgacattcttgatagccgatttcagccttgccttttgttcttcgacagattgtgggagatcgactagcttcttgtgttccagatccagatcggcattgcattcttggagttgtgccaagagctcaatcttccgagcttcaagccgatcaatattagacctgatcgggccttcagatagttgatcaagtttggacttttcttcatgcacgagttgccgattggcttggatggtagcttcaatctctttgcgttctcggcgttcggctagtttctgcttggctttctccagcttgaattgatgctgttcaagataagtagctggagtaaggacattggctagttcttcaggaattagagcttgaacttcgtgtagccgggtcctaattgatccacagtcgaccaccaagctgcctagagaagatgcctctagccgatgagagatatcttcaagagttttcttcacatcatcggataagggggctaaggctttgcttgtggtatcctcttctgtctcatcaaagtagtccttgatgtcaatagagaatagatcggctaagacccgtaagaacaatttcaagagagttaggagctaaatagacatagccgatctaagttcttgtatcaaagggaaacttactgggatagcaggagcggctggttgttcttcttcctcaacgcggtgactccctatagccgatggagtttggtcactggatgattgctgtacagggggagaaggaggaggaggctaaaaagagacaagtattagataagatcggatgagatcaactgctgaaagaattaagaacatcttattggtggagccggtttgagagttggtgctgccgatttcttcttaacagcaattctctttttctgcaaagacaagattaataagtaatcggctgaagataaaatggttataaaagggaatcagggaatggtacttaccctcgagaaatgagctggggcagaaggagttgaaggggtttgattgggtgaagccgatggtgttttatctgtatcacttacttcggctgcggcttgatcaacatcttctccgatttcctcttcatccaaagcttgttcaatggatggatcaagggcaggcagatcatcggttggcttgggtttcagttttttggccttcttcttgagagccagaaccgatggatcaattgctggcactttgggtttccttttcctgcctgcatcggctggttctctcatctgcccttggagcagacttacggtcttaggggcatgatagccgataactggaggggtt

SEQ ID NO: 94517 - DNA, 2837 bp, Oryza sativa
catgaggcacacgccacgggtcctcatgggcacttgccaaacttgagactctaatgctgtggcgtggaacttgggtccatccgggtgcatccccagttggttcccaacctgcctcatacatctgcacgagtgttgaggatgatgaactttcccgttcattccttgtcatgttgcgtgtctccctgtatgctccacttgcacgagattcttctatgctctacaggggaatggttagttcatgtcagttatacaaatgataccctgcatttggcaacgggattttatttgtacaaccggggaaaaagtaaatcaaagatccatccactccatacttcagaatatgcccttgcactagataggtctcatccatacacggacgagcggctgagataaaagcaattttgttgctaacgacacctaccccttttgctatctgagtaatcagagaagtgcactcaacaggagcagagaactttatactttctaaccattgtcttatcatacatttcacaggagcaattttgatctttctaaccatggcaaacatgataatcaattcatcccccctaatggtctaagatcacctctaggaaacaaagtcatagcaatccatttgtgcatgagcctaagtgtaggattatggatatcattcatcataggtttcttgcaaattggagcaccagaaatatcttcccaaaacctatttttctcgaacccagaaattcctttctagagatcgattttacagcaatcgtgaaaaccaagaagtgtgcttaagcttttccatgtaagtgtaaactccttacggaaaaagcgaaaggaaaatccatcttctatttctttcaaagtgcatagaaattgcaaagtaagcaaacgagaaccaggctcatctaccacagcaaatctctgccaaccaacagctttccaaatagcacgaaattcaacatccatatctatctttttcagcagctccggagagtattctcgtgtatgagcatactcccggttgctcagcatgtagtaggcttttctctcccgatcacagacaaggtcgaggtcggtgtcgttcaggagtcgtcgcggagcttcggcgtcttccaacgagacatcagctgatgaatgagtactagactcatcatgatgacttgatgaagagccggaccccttggacagatgagacaatcggctcctcattctgcacaatggagcaagaacagactaacccgacgggggttagaatagcaagagtttcacccaccggttagttccaccaaagcaacttgtatatatgcaactagtgtttgaatttgaggaaaactataaaagcttgaatgaacttgagaacaaactttggagagggaatgaaaatgtattgaaatggggtggaattccctctcggccggctggtttttatagggtacccacaactgtcagaaaagacatgtgggacccaatagccgttgcccagccaaaaatggtaggtaactgttgcctggccggttcggtcgaacccctcgtgggcccaaccggcaccactttcggccgttggattccaacggttagtgcagtcgtggcacagtgaattttcgttgaaaattttattttggtttgctctgaaaaattcatttgaagattttcctcaaaactcaaagaatcctaaatggaaattttgaaattcaaacatgtgttgatgcataaattcaaattgttaaagcaaaaatgcagatacataccaatttcctatggcgaaggtcgcgtcatttaaaatccgacgtgcaagactgtaccttcttctgattcagttcgtggattttccacccgtctctgaaggtgatggagcgggcgtgtttggcttttccctccacaccttccatggctttggtgcagaaggcggcttcttctcagccgactgctctgacttcttggccggtatagttggttttatcaacgtcctccaataacggttcctaggcatcgttgtttccttctctaggaaattctgcatgaacttcaccaggctatccgtcttgggtggctccacttcgaccacttgaatattctgcgggttcggcccgtactttatcctgaccatggagcattgttcgacccttggttgaaactcaaacttttcctccttcccgttaatatgaaaacggatacttcccgctcccacgtcaatgttggcttccgtagtgctaaggaatgggcgccccaggatgagcgacatctcttttcccgtgtccatgtctagcaccacaaagtcaaccgggatgaagaaatcccgtatcttgactggcacatccaccgccatccctgctgggtaacggactaacgagtcagctagttgtaggcgcatcagtgttggtgccaacaccgtgaagttgagcttgtcaaagacgtcttttggcatgacgctgacactggctccaagatcgcataaggcctggtcgaactgctgtaccccgatcgagcaggacaccccggatctttcttcttctttgggagcttgtggagtatcacgttgctgcattgctccgtcagcttaaccacctccgttgttgggagtggtctcttgttgttgagtatgtccttgagataacgggcatatgttagtacttgcatagcatccaacaacagcacgtttatgtggattttctggattacttcaacaaaacgagcgaattgctcgtctactaacggtttcctactccgttgaagaaacgacagcaaccgtgcgtcgtagtactcctgcggcatggtcttttcttgctaaacctctttgtcagctgagtcactagatagcgcttcttttgtaatcccgttagttcgtgcagggg

SEQ ID NO: 94518 - DNA, 1205 bp, Oryza sativa
tatgggctgacctcttcttcctcctcctgtcacgccgccctgtctgagcagcggatccgggggcggccgaagctgccacaccggaaccggaggggttccaggtccatgcctcctccttacgagccactcggtccgcgagctgaaaaagctccgcggtagtctggggctctttggaggcgatcttttcgagcatgcggttgtgccgcacaccccccctgaacgcgtagatcaccgcgtgtgcagggatgcatggtatggtgttgcggacttgacagaaccgctgaatgtacgagcgaagtgactcatcatcccttcgctgtactgcgtgcaggtccgcttcttcacctgggcgcggatatgtgccttgaaagttcatggtgaactgttggcacaaatcctcccaagagtggacggacgcgggtggcaagttcattagccaaccccgtgtctgtcccttcagggccatgggaaagaaattcgccatgaccctgtcgtcacccccggcggcctcgatcccggtcgtgtagacctggagaaactcggcggggttgacgctcccgtcatatttttcggcgatggtgggccagaaccttgggggccaacggacgttccgaaggctcgccacaaatgctctacagccgacaccaccaaccgggggcacggagggctgatccccgcgtccgtgttgatgtgacactccggacgaggaggcgccctccgttgcgtgggcagcacgtcggccattacgccggcgctcgatactgatgcgggcatccggccccccacgcagatcttcctgggtcgaaggcgctgacgaaggagtggcggccgaatggcgagcaacagccgccgctcgccgcgccctccgccttgacgacacggagccggtggtagcagcgcgagaggtcttggtggcggaggaccgcccaccatcacctaggcgctgccgtgccgtcatgaccaagttggccacgtcgtccagccaacgttgggctggagactccgggtcagggacaacgggcgggtgacgtaggagcacgcccgcatcttggagcgcgccctggggcgtgctgccgtcgccgtagacgaggaggcgacactccccatctcgccgcccttccccatcacccgtggacgtcgaagtcgcggatccttctaccctttcgagcgcctcctcccggctaagaccttggcgtggagggggc

SEQ ID NO: 94519 - DNA, 594 bp, Oryza sativa
tgcatcccacacatcatacaccgggacatgaagtcgagcaatgtgcttcttgacaacaacctcgatgcccgtgtatcggatttcgggatggcaaggctgatgaatgcgcttgatacgcatctgagtgtgagcacacttgcaggtacacctgggtatgtgccacctgagtactaccaaagcttcaggtgcacgaccaaaggcgacgtctacagctatggtgttgtgctcttggagctcctctcaggtaagaagccaattgatccgactgagtttggagacaacaaccttgttggttgggtgaagcagatggttaaagagaacagaagcagtgagatctttgatcctacattgactgatagaaaatcaggggaagcagagctctatcagtacctgaagattgcatgcgagtgcttggatgatcgacccaaccgaaggccaaccatgattcaggtcatggcaatgttcaaaagctgcagcttgactcggacagtgatatcctcgatggcttttcgatcaattcgtcaactatagatgagtcaggagagaaatcaatgtaatgctgtctagttcttgcagattttgattatccgaagt

SEQ ID NO: 94520 - DNA, 4149 bp, Oryza sativa
gtgagcacacttgcaggtccacctgggtatgtgccacttgagtactaccaaagcttcaggtgcacgacaaaaggcgacgtctacagctatggtgttgtgctcttgaagctcctctcaggtaagaagccaattgatccgactgagtttggagacaacaaccttgttggttgggtgaagcagatggttaaagagaacagaagcagtgagatctttgatcctacattgactgatagaaaatcaggggaagcagagctctatcagtacctgaagattgcatgcgagtgcttggatgatcgacccaaccgaaggccaaccatgattcaggtcatggcaatgttcaaagagctgcagcttgactcggacagtgatatcctcgatggcttttcgatcaattcgtcaactatagatgagtcaggagagaaatcaatgtaatgctgtctagttcttgcagattttgattatccgaagtggtaaaatatcagactagctcaaccattttggctccatggtagaaaaaaaggtagtatcctccaattcagtaggaaaagttgtaattttggttcaaatcactgtacataatacatcaaagtatgaaggagaacacggtggtaggatttaatttcagaaaaaaaaggcagttctctttacctggagagactagtatgtaccaatcaaatttcttgcttttgagcatcaatattgtcaagaatgtaatacatattagctttccttacacttgcatgtgttttgactttgtgaaaattgagcttcttgtatctgtcagtttctggttgatatcttgcagaaaagaactggacaaaagagaatttctgatgtttaatcttctggcaagtccctttcccctttttgtattgcacagttgactaaaactgcaattgtatttattatttcccagcatggctatgtttgtttgaccaaactgtaaaagatgttgccgatgttgccagttaccacatcatatttgcttaggggtgttagacaatggcttaggggtgtaagacaatgtgtgaaaaaaaatccagccactggattttgtgggcagtcagtacctgaatcatgttgatagtacaggggttttccttgtctgcttcttgaatgattgctgtcatgacaaaactgtacagcataaagaagttttcagttctgctgacactgtctgaaatggatcttgtggacatggcagtacactttcccaacaggtagttatggacaaactgagcagcacaaagataatgcatggattatgtactctttttcttttttcttcttttagaaaaatgagaagattacatgaattttgctctcattctgtgtttgtgataatattaccagcttgggagatcagttctgtttttgaaactttagtagatgctacatatatatacttgcaacttgctattcttttaaagtcaggtaagaagatttttttactcttgcctttttatgctgtgagtgtgatggaaatgtagtttatactgtcaacatggtcatacctgctgaagtttggaagcatctgtgtgcccaaaaagaaaaggaaaggtgcatctttcattcattcatacctgaagcactccctctttttccacccaggaacattcgcttttctgctgtcaaaagtggtgcaatttcggttggatttatactctttctgactttgaaaaatactcatgttgctcactgactacctctgattgtagattaggaccaaatggtactactgtcttgataaacttatattatctttgatgtggtcgtgccgttttcgagtgtataactttatccatcagggtttaaatactggcgagcgtaattaaatgcattagaaattattactttcattattaaaattaagctagtatttttttcccagtaatcattatttttctttgcctgactaattaattttccaagagagattagatgagcaagcaaggtaccaacgctatcacatcatcacaaatattttcaaaaggatttggtaattaggtagctgacctgcacagcaggataagaagatgttgcacgcgtgcgtacgcccgcacgtgtgcatgccgctgccgttggattctaaaattagggctccgtttctgctgatttgtacaggattaggcaggaggattacgactttagggacaacgactaccctttagttttcatcttctttgggggtcccctgtatatatatatgggttcagatcctttgtggttatggtcttgtgttgtgtatccgcataatttcgatgaggtaaaattgtctactagacattctagatttattttagataatggacatcatcctggcctctacactccaaccggacactgtggtattgtgagggatgtcacagtgagagtcattacgatccgatgttattttgacggatcatagtattgttggttaaacgccatttttttttagatccgcaatgtctagtagtcaattttttttgtctaccaacgatagcactgttgatatagttgtaggtatatggctctacatggtatctatattcacgcacataattattattctaaaaggaatttagtgaggttcttcgatttattgatgcctcaatctcttaaccatgtgttaataggaacactcacaggtgtgtcagtgcggtttacatgtgtggtgctgtaggtacattttccatgtagttgaattattttgcgtagtgttgggaaaaatatatagaggctatttatgttttgtcggcaaaaatgagcagtaatggtcggcaaaaaatacagcaagatgctaatgcggtgcttactctggcacaaacaattccccttaataatggtcccttggattggcgtcccgtttgcacttttgatgtcatcaactctttgcatctcacaaaggggatctctttgcacactaccccttaattttggtggctgtgtggaaaaggtagagctaatcacctaattagatgacctggttgttgttgttgcaaaaatggtcaaacataatttgcgtgttcctttgggttttggatcttttttagctgagagatcagagatggagaaatttttgtagttaggtagaagtatgatgtatattttttttcagaaacaaagacaacttcagatagtgatataggaatcttatcttattaacatgaagtaaaactgtttagtaaaagtagaggtcatatgtgttcaacaacaacaaaaaaagatcaatgaaaatgaaataataagataaatttgaactccaccctgatgctgaactagcaatgtttatgtgattgtccattcatttcttcataggatgcttgaaaccatcatgatgaacagttgattaaaaaaaaataattatgtgtatttacatggtagacaaagaggagtgccatggaaggggaatgaattattgctacacaaggagtggctcaactggtgccaatgactgctgctctgcagcctggcaatcccatctgtagacagctacaggtgccagtataatcatcttgcaggccaggagtatatatacatatactactacaggtatatatacaaatgtcacagcctttttcccctacatagtggctacaggtataccaaataaaggactcaacattgtttatttataaacaaaggggagagaggaagaaagagtttagccttcaaagctccatcgtttgcttgtggactccacaattaaaattcgaattttcaaacttgactttcatgttttttatcgtagtttatttttcaggctttaaatctctaggaatacgcatatataaaagttttactcataaattatttttagttgcttcatttattattccagcaaacaatgggacacaattcaccttaaatccttaaattgtatattgtgaagtcttaactgatctctagtctaatcttcttttcctcttgtgctatcacattcgtacttgctgacaagctatgtgtatcaggtattgatgtactgaagaactgataagaccaaacaggctggtaggtcatcactgcaaaaattgtctgttcctcacaaagaaaggaagtgcaggcagtggctttctacttcttctgcagaagaaagctaagagaggcttgacaccaaaaagcagctctgtacaagagtcaagaagcatgggcacacacatctttaga

SEQ ID NO: 94521 - DNA, 520 bp, Oryza sativa
ctggttgtgcacaaactagtgaccagtggattcttgatactacatgcacctatcacatgtgcccgaatagggattggtttgccacctatgaagctatccaaggtggtactgttttgatgggtgataatacaccatgcaaggtagcaggtattggaacagttcagatcaagatgtttgatggctgtatcagaacattgtcagatgtgcggcatattccaaatttgaagagaagtctcatatctttatgtactcttgatcgcaaagggtacaaatattccggtggagacggaattttgaaggtaactaaaggctctcttgttgtgatgaaagctgatattaaatctgccaacctgtactatctgcggggtacaactatattaggtaatgttgcagcagtttctgattcattatctaattccgatgctactaatctttggcatatgcgttttgggcatatgagcgaaaatggtttggcagaattgagcaagcgaggattgctagatggacaaagcatcgggaa

SEQ ID NO: 94522 - DNA, 600 bp, Oryza sativa
acacgtggtggacaagaatgaccgatttgagaccggtctgacaatggtcatgtcgtcagcagacagccatgttcccacgtcgcgcctgcttccggcggaagtggaggtaggtatgggccgtcccatcagaaggtcattcggacggcagccatacaaatctccgtccattaatgaagagaagtcaagttggagggaagagaggatgagtccccacacaaaagaaagagagggagagatggtgcatgtggtatccccttgagatataaaaggaggaccttgcccacttagagaggggggaggaaaaaggatcccagaacaatcgggggctggctcacactttgtagcttcttcatacacagatccaccaaaacacaggagtagggtattacgcttctcagcggcccgaacctgtatacatcgcccgtgtcttttttgtttccactctcgcgaacttttcacagaccaggagcttagaatctcacccaagggcccccggccgaacccgccaaggggggcctgcgcggtctccccgtgaggagccccaagctccgtcatctggcgcgccaggtagggggctctgcgagtgatcttctgagctct

SEQ ID NO: 94523 - DNA, 1154 bp, Oryza sativa
tatatatatatatatatatatatatgaacaaaatatatttacattatagaaaatgtgtacacatgcatatagaaacatatgtagtcatgtattaattacaatccattatatgtcctagctagttacgatttcgacgtagtagtagtcgttagctcagaagctaaggacctatgaattgtgtttccgtcgtagtagaattcacccttgggatcaaggatttgttcgttgatgaatcccatgagttgttcttaaaccgccgcgataaattccttgtgtgtggtcaggttatccctcatgcaaataaactatatgaatgtatgaaattgattagtaattaaacaagaaatcgatacgtaatgaaattttgaatttatttgtacgtacatcgagctctcttgtggtgatgatttggtctgcaaggcaatggcaatacttgcacacgtaatagccacacaagttagttcccttcttttgctttgcgcactacaaataaataacaaacaacgagagatctaattaatatacacttgtatgtatttgaatcggagaaatataaatatagagcatgtgtactcacaggaaatttgaacttccgcctaagtctttttctccatttgccgcggaccaaatgacggaactgataccaagccctaaatggagtttaaagctatgattagtagcaattaacataataagattttcttaattaacagaggaacttatgacggtacctgtctataagttcgaaaaccttgtcaaacgtagactcttttttatccattgagtcatacacgttgacggtgcaggccgacaggtcaaagagtaaaagcacccagtggaatctgcaatgtgcgtgggatgcattacatatgaaacacttagcaagttcgtacgggaatgaaatttggtataggaagacagtaaaattaaactaactctgtgttgtacggcaacagtatgaacgtcttgtaatgctgcgccttcaggagatggacgagattgtcctctgtggcttgcggatattggtcgagcattgcgacgtttactttccgagggtcgatgaatccattatcgaaaacccccgccgtcgggccctttgaatctccattctacaacgataaaagggagtatattattttctatagtctactggg

SEQ ID NO: 94524 - DNA, 2124 bp, Oryza sativa
ggaacaggttcacaccacccaatgacattcgaaaataaatacacagttgaaataaatagagaatttaaatataggatcaacatgctcaaaggaattgtgtttgggatctatgtgacttgacttgcaataaagggtcttcaattaatcttctgaaccacttccgacgctctcacgaaccttcacaacgacggaaacgacaagctaacacgcaaaacaaagaaaaagactaatacaaaccaaataaacagtacatataaagtaaacaaacatgtagatcatgattttagatgaatttagagacttgaacggcctcattctgatttcatatgaattagttatgaattttacaagatttaattccaattaaacctattaaagaaaagactattccaaattaattaaataatttacaaatgatttataactgagataaaagattaaaacaacctctagaaaatattagattatatttagtagatgacatataataatataccactaaaaagagagaacggatttatatggctgagattaatctcgacagagtcgaccaagatcggatggcttggtttgatctggcaagcgagcctcacgagataccgactaaatgagtcaattctacgtgacacgggattacccaaatgatcaaccgaaaccggcgaacggaaccggcggctctgaacggctctaaactataggacgactccacaaggatgaacgaaacacggggaacacctcgtttgaacgaacgagcgaacgactcaacaacagctgcggctaaaccggtgggctagacacgattcacggtaaagccccggtatggcaaacgataggcctgtaggaatttagggatgcacctacggctagacaacttggctaccgagcaacggctaaagcggcggctaggttaaagcggcacacagctacgagacggcggcactaaggcgacttggctaagctaggcggcggcttggcggaaacacacagctagggttagggtgacggcacagccggtagcgatgcatgatagcggcgcggcggctgcagtacgtgcactagggcagcggctacgcggcggctagcagcggacaacagcgggtgcggtgcatggcaatgaccggctcgacgctagggcggcgacgcggtggtagcaagcggctgcggcacgcggtatagcagctgcttggcagagccagcgcagcgagcagcggcatgatggcagcaagcgacggcgcaaggcggtggcttggacagcagcggcgatgcaactagggcagcgacggcgcatgggtcggctgcggtggctaggcacacacggctacgcacgggctaaggctgcacaacagcgactacacgaagacacgattgcagctacacaaaagattaaacctagggaacggaaaggaggcctcactggggaagaccgaagaggaagaggcaacggcaacgccggcgacaacgcacggagacgacgacgacgacgctagggccaaacaagattagattaaattggattaagtccctagggataaactacaccggtaaacgacatgggagcggcggttgccggcgaaccacggcacaatatgcacacggagggcaccgggaggaagagcgcgagacgacggtccttaccaacacttacgcgacgacggacggcgacggaagatggccggcgacgagcttcgaagggcggtgaggtactgtccacggcggcgacgactttccggcgatgtgcggcgacaacggaggggtggccaggcttcgtcttggtgctgcgatgccgaaggagggagcagctctgaccagggacagccggaacgacggcgaacggcggctgtagatcaaaagacggcggcaacccactggttcacgacgaggacggcttccggcgagatttcggtgcaagggaaccggctgccgggcttctcctcctccttgcgaatccaacggcggcggcggcgcgaccgaaggagacgatggacgacgacgaacggcgtggctggagcggcggccggcgcttggagagagaaagcgagctcggggaggggcggctagggcacttcgaaggacgggacttgaggggataggtagaggacgactagggggtcctttatataggca

SEQ ID NO: 94525 - DNA, 4095 bp, Oryza sativa
ccagagtgagtttttattgtcgttcgaacaaatttcattcccatacatatagcatgtacattttcatatatatctcatctcacgcatattccagattccactggtcctgttattctttgacttggacgcatgcagagtcactgtgtatgactcaatgaataaagaggagaagatttttgacaaggtcttccaaccgatagacaggtaatataatgccatctattccaaagtcgcggggattctattgctattatgttgatctcgggtaataattaattaatcatagcttgtagctgcatatgtagggcttgggatcgattccgtcaattggtccgcgggacttggaaagaaaaacttggacggaggtttcattttccagtgagtacatgcatgatccaaaattatattgaattgaatctctaattacagttaatataaagagtatattaaatctcccatcatttctcatgtagtgtgcaaagcaggacaagggaactaacttatgcggctactacgtatgcgagtatgccaactgcctatcaaaccaaatatgcaccagacaagagctcgatgtacgtatacataaaccattcaaaatttcattgcgtatcgatttgttaagttgtttattaatttcatatattgatatttcattatttttcgaatgatagcgtattcacatgaggaataatctcccacacaaggattttatcacagctgttcaagaacaactaatgggattgatcaacgaagaagtccttaatcccgatggtgaattctactacgacagatcgacaattcataacgtcggtccttcctcttctgacataacgccggcatcgaagtcatagctatagctagcgagcaaatgaattgtactatatatatgcatatgtacacatttactttagtgttaatatatgtatttatacatatacacatatgcacatatatatatgtattatatatatatatacatatatatatatatatgagttggataatatgaacctaggttcatttgcaccctagtttgttgaatgacacgtgtgctattcaggttagtagatgatggactattgtttctaaacttggtagtaaatgtacctactcaattcaatctcttataggggaaaaatgagggaggtacaccatcggtcatgtcttttcacacatccataaattgtgaccatgtcttttcaccatgtgaccattgtacattagaaagagagagaggtcattctattttaatctattcccttgcagtattcacattaatccacatggaggcctactatttgctatcaggttagacataagtacgttgatttctttaattaatctagttgtttgtgtcaagttttatttgtccattcaccacccaaatatgatgttcacaaaaatgacatttcagaaatatcgttttgcaactgtgatgtccaaaaaatgctattgcaaaatgatatatcatttttagtagaataaaaaaaccacatgattgttacttttacagatatatgccatattctaaaatataattttgttataatcgacatagatatatatcaagatgaatgtccactcagctccccaaacatgatatttgcaaaaaaaaaaagatgacactttgcaaagtaatgtccaaaaaatgatatagctaattggtataccacttagcatttattaaaataaaaaaatcatatgaatgatattctaccgatttatgctatatcgcaaaaatctaattttgttataaactacataataaatagtgtctgggagacataatatcatgtgggccatcaactaaagtatccaaattttggtgacttaatgacggttggtcaattgtagtatgatactagtatccattgccaaatcaatttgagcagtaagtgcatatgtcttgctagccgaacaaccatgtgtatgctaattgtaattaagagaattgataacaactctcgacatgcaaaatcaattagaacagctaactagcagtgttaagtcactcaaatatacaaatatatttgtaaattatgatgttaatttgctctctctggaaggagcagagagttgttgagtctttcagaataaatactacatgcatgtcccaatcagtgctacagcgtattgtgtacctccctattcttttcctctacagtaatcattcatttgatgaatgattggtatatttggtcaacacgaatcttgacacacatgtatggctcagattctaggtacatatgaaccttggttcatatatgatttatatatataatcaatcttgcagcaaacaaggccatgcaaataaaaaaaatggtacaccgatctttagtcccgattggtaacacaaaccgggactaaagatggttcgtccggccacgtggctgaccgatctttagtcccggttggtaacacgaaccgggactaaagattgatctttagtcccggttatttcacccgggaataaagatagctatctttagtctcggaaccggattcgtagtcccggttggacaaccgggactacaaacggtttctcaaccagtgaatgatgattatacctctccgcacatatcttttttttttataattctccttcatgtttctctactacgctaactagcatagtacttagggcgagaaaaaaaatatcatgattaattttatttaaaatagtaagaaatgtttaactttagcacaccgttgagcacaaactactgttaggtgatagttgaatagcaaccaaaatacggtaaaaaaaatcatcgcgtacttacttctctagtttataatatctaatatgtctcctaaaaataaaaaaaaatatatatagtgccttcatcaaccaaaacaattgtgccgtagtcccgtagagatagtaattactatgaacatctcgcaatataagtaataataactcacaaagctgttcactcaatctcctatctcagccaatcaactcttgtagtttagaacaaaaggaaattagcacagttctccgtcttatttatgtttaagatgcgctattaaccatagatggctataggatgagattgattacagaagtttatggtgtttgcataaaaaaatggtaaatatccaacactctatagtgaaaggtaccctacaaaagatatttaagtattgataaaggcatttagatagaaagggtaaaaagataatttgctaatagataaacaatggtaggattgtcttttgttattagttgcacgtacatcggtaccagtaattattccccatcttcattctcagtacacttttatgtcattctcatatttacatggttctttcaaatttatatttttttaaagaaaacatgaagtgttaaaatatatgaatgaatttttgtatggtcattctaaaatttacatcgtttaaaatatgaccgaatcctacttggccgggccttgccttgctgccgccggttgcctgctagatgccgccgcgcccaacccagctgcatcgatcttgccgtcgccatgcccaacccagatgcttgctgccgctgcgcctagctgtttgctgccgtcgaggcaccgacgctccggtcgcgcagcctagtttcctgccagctgccgtcgcccgcccatgcctccttggagcttgctgccgctggccgtcgcacgccgccacaccgagattgtcccgattgttgccctcgacatgagtcctgaccatagatggggaaaggggaattggggagctagggttttcagcctaaaaccagtcaacattttgatccaaatcaacatgactaaatcactgatttaaatatttgcgtatatagagcaggtacttttttatgatgagtttactagttaattatttcattcccattggatacaataattttctttggtatcttgcctctatcttaatcaatagtctatattgttcatctctcgctacctccacgtaccatataagcaccgtaaaatgttaaatatatgatccgaattttgggcccataatatattcggattagtttcctagtacgacttcttttctatcctattaggtgtctttcttttatcgatcctatagagtcgacctgtaagcatgcacggg

SEQ ID NO: 94526 - DNA, 616 bp, Oryza sativa
gagataaaagttcaagtaggtaccatggcagatcaaagtccagaggcaggtataagtcatccaatatgcaagagagatggacatgatatttctgagtgttggaagctacaggacaaagacaaaagaaccggaaagtatataccaaaaggtaaagccgcagttgttattgatgagaagtctgatgtagaattgcttgttgcttatgctggttgtgcacaaactagtgaccagtggattcttgatactacatgcacctatcacatgtgcccgaatagggattggtttgccacctatgaagctatccaaggtggtactgttttgatgggtgataatacaccatgcaaggtagcaggtattggaacagttcagatcaagatgtttgatggctgtatcagaacattgtcagatgtgcggcatattccaaatttgaagagaagtctcatatctttatgtactcttgatcgcaaagggtacaaatattccggtggagacggaattttgaaggtaactaaaggctctcttgttgtgatgaaagctgatattaaatctgccaacctgtactatctgcggggtacaactatattaggtaatgttgcagcagtttctgattcattat

SEQ ID NO: 94527 - DNA, 981 bp, Oryza sativa
gtcaagaacattctccgaagggaaacaattgcaaaagacaacgtcgaggttaagaaaatagtttgcccgctagacttagaagttcaaaagattcacgcatgtccgaatgattgtatcttatatcgcggtgaggagtatgagaacctagaagcatgccttgtttgcaaaacactatgataaaagattagccgagcgatccaggagaagttgacggacagctacaaagaagagaattcctgctaaggtgatgtggtatttccctataataccacggataaggcgtttgttcaggaacaagcggaatgctagaatgatgcgatggcacgctgaagagcgtcaacaggacgggatgctgagacaccccgccgatggttcgcagtggcaaaacatagacaaaaaatttaaagaatttggaaaggactcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgatgtgtacctaagaccactggtcgaagatcttaagctgttatggaagaaggaaggtgtccccgtgtgggacgaggacaaacaggaggagtttaacatacgagcgctgctgttcgtaaccatcaacgattggcctgcacttagcaacctatccggacagtccaacaaggggtacaaggcttgcactcactgtatggatgaaacagaaagtacatatcttaagcactgtaggaaggttgtatacatgggtcatcgtcgattcattgcagcaaaccacccggtacggaagaaaggcaagcacttcgaacataagcctaaacatcgcaacgggaaaacagtgtttgctatggttaaagatcttaaagtagtgttcgt

SEQ ID NO: 94528 - DNA, 744 bp, Oryza sativa
ctctcgccattattccccttgtcttcgccgcttgcgccctaactccttgtttcctatgccctaccttcgccacacgcgctcgctctcaaacatctcttcttccggcgtcatggcacggggctccgctccgcttgacggtagcgtgctgccgccttcccgcatcgtgagcgagagacaggccgggctgccgtgccgcttcatgccggaatctgccaccggccgggaaatagtctcgctgggcgagggatgcccggcgccacgctacccggggcggtccgtcttcttcctcccttttgctatggcagggctggttccgccattttcttctttcttcatggatgttctggagttttacgatctccagatggcgcacctcacccccaacgcggtaatgacattggccatcttcgcgcacctgtgcgagatgttcatcggggtgcgcccatcccttcggctgttccggtggttcttcaccgtacagccggtgtcgccgccgtcggtggttggtggttgctacttccagccgcgggggccggtgctgaaccgctacattccctgcgtcctccgcaagaagtgggatgactggaagagcgactggttctacacccccctcgccgacgaagcgcgcctccgacttccgagccagcctccagcgcaggcctccaactggcgggcgccggtagatctgggagatggcttcgacgccgtcctcgaccgcctggcgggcctgcgatcccaggggct

SEQ ID NO: 94529 - DNA, 3206 bp, Oryza sativa
gtaattatttatcatcctggaacagctgccaccacatgcatgccaccacaacatgactacccccaatctgtgtttacccgtcatgatctcatatcatgttacccgtcttgttaggtgtgacatcctagcctaattagaatgaggcctgtgtagcccatgcgagctgtgcgtgcatatttactaccacctttctagtttagcaagtatggaactaacttataaggcctcagtccctccaaccatgccactcccgagttaacccttttacacgaagcgaggacgtaatgtgtagtaagtgggctcgtccgtcggatgggctggctacgcggttctggatggagggctattacattaggttattaagatgaaacaagttgagatgagataaacagtactattattattcttgtggaaacactaaaaagttgcgtgcagaataaaagtgtcatcgtcctgattcgattttcttcagtacagaactgaactacatattctgcacctcaaattatcagtgcatcttcaattcctacctactggttttcatctctgtatcatcttggttgatagtagggctggagattagattggtttctttgacatcacctcttttctataaagctaatgtgctaaatcatcattctcaaatcattttcatgatattttcaatccaatcatttcatcatttagttattactacacacgtccaaaaaaggatgagataaaacaaaggaccaatgtgatgtgcaggtttgttccatgcatggcatctttatctatctattatatactaaaagtccattaaatttcctacaaacactctcaagctgtcacgtggcgctcttacaaacgctcctagaccgccatgtgccacaatctaatctcaccgtcgattttcgcttaaattggtggacccgttattaaaaaataataacctcctcatgtttataacatataggcgtactactgctgatctttccatacgtacaaacttacattatctttcctaatcttgctggaaaaaaaacgtacacatgaatataaaaaaagatagaaaaaacatatatccataaaaatcaatggtttttaaaatatgattttagataaaatatattagttcacaaatataaacatatttagttaaatatatataaatatccaatcaatgttctttaaaccatattctaaatctatctaataaatattaaaagtacattaaatttctacaaatgcttttacaccactacgtggatctcaaataaattagagaaatcctagaaatctattatatactaaaactctattaaacttcctgaacgctcctacgttatcacgtgacgctctaatttagagttgttgtagaaatttagagtaaaaaaaagaaaagcatccaaccttcaattttcacttagatttgtggaaaattattttaaacattagattagagttcttaaaagtcccatgttgctaatctctatcccggaaaaaacataacgtgcttacgtcagtaccattgtctccctaccgggaaaaaaaactttaataccgacaccatatatgataaaaaaataaagccaaaaaataaaaaagaaaacatgcacacatacatagtagaatcgaaaagaaatactaacaagaaaaaatcatcgatgttggcacatatttgttgtcaacagcctttaatctatgattttaagatcttcctccccaatctaatattatagtcccggtgtagatagaaatttctttatggtctaattccgagtggtagtaaataccatgagttagcaatattttcattgataataatttggtatattccatttattataaaggttgctaaggaattcctatcaattatagggatgcttccaatagaaatggtttgcttatgcacatcgaaaccaaaaattaatcgtgcggatatgtagaattttaaagaataggtgagtgattcatacacagcatccctttcttttatcgaaggttctagcaattgatatcgggattttttacttaaatctaagatccattcttatcacattagtagtatattaaaatccaccatctattttacggtaaatatatttctttttttattgtaggataatctaaatttccttagtcatgtatgattcttttagcattttttaatatcaaataagatgcttgtgcatcggtgcgaaattcctttctaatttatattccggaaatgttctccagtttatattatattgttatagtgtttgaaacacaaactatacatgcccacgcattttacttcctagttcctaattaatacttctatctatcgtaactatcaattaactacaaatcgctaggacaagcatatgagtgatgacgggtaggttggagtgtaccgtttcgtgatgtaaaaatgagaaacagttttctttgttcaactattctaataaaaaactacagttacttggacaaaaatgttcacagcctaatttcttttccatcaattcataataactactctatatatacctcgccgttcttttgtacagcccaaacgttaaccatcacaaattctcaatgcatccaacctacaaagattaattcacttgtaattttgaggaagaaattgccataggaaccagaggcttcaggaagaaaaacaggactggatcgacaatatcccgtaatgggtagaaaacctcttgaacagcaatgattttagcctggagattcaaaacaacaaatcgaggctgactctgccatatgccaagtttccttctgttcacaagttgattacctggagttgtggtagaacagttctaagtgcagcacttcatttacaactaggaaataagagacttcgtttaataaacaatttgaagattgatcgagcttgcaacaccaacaggaggaatactctgtctgggagagctagggtccagtcttgctgtgaaactgcttggtgaactccacgaaatgtttgtcttccatccatgaaacacaatttagtttcgtattatcgcgaggagaacaaaaaccatgattctcaatttttaataatggaaaattgttgaccttttctccattctctgcagtgtgtgcatactgtctgattattttgactagaaaataaagtggaatgaaatctataacagggcaaaccattgaacattaactaaaggaaaatagtattgatctttctgataggagctatattacctgta

SEQ ID NO: 94530 - DNA, 1534 bp, Oryza sativa
catctacgagacacaagccatgtcattattctatggtgcaggcggtacatcatcctccctgggcgacaagcggcgtctcgtgcaccatctcctccggctccgccatctcctccttaggatcctgcaccgtctcctcctcaggatcctgcaccgtctcctcctcatgctccagcaccgtctccacctcaggctcctgcaccgactcctcctcaggctcctgcaccgactcctcctcggtctcctacaccgactcctccgcaagctcctcttccggcaccttcaaagtcaagggccccccaagctccaccgcctgcccacagaagggcaacgaagaaggcgaaaattgacgctgccaagaacaaggacccggggtacgattgcacgcaagaggagcttgacgcttacgtggcatcagaagtcaagagataattcaagcctcgaagtccagaaaagaagattcctatagacccgagtgtcatgaacttcttcaggggtatgtctgcacctgccaaggaggccattaagctatcggactatgagcgaacgctgaagaaagcatcttctggaaagtccaaaccagtccctcagcttggagagcaaccaaaccaggagatcgagccgttgatgaccggtaaagaaatgacgatagaagaatttattactgacatcggtttaactacggatcaattgctaggagtcgcaccaatcgaaaaggcggaagtgaaatacatgtacgaactcggtaaactgcttgtcaagcctgagctactgcagtccctacccacacaaatgtacaagttccatcagctgtacatggagatgagcgccatcggtagagagatgatcggagcgaggatcagggacacggacttcttgcaaggagatgacattctctagatcaatttcaagggaatctacgaactataccagctggacgctctcgacgtctctattatgagttgctggattttgtaagtatatcgttcagttagatttcttactacgtctcctttaattaattaggtccttgtatataagtagactatagaaaataatatactcccttttatcgttgtagaatggagattcaaagggcccgacggcgggggttttcgataatggattcatcgaccctcggaaagtaaacgtcgcaatgctcgaccaatatccgcaagccacagaggacaatctcgtccatctcctgaaggcgcagcattacaagacgttcatactgttgccgtacaacacagagttagtttaattttactgtcttcctataccaaatttcattcccgtacgaacttgctaagtgtttcatatgtaatgcatcccacgcacattgcagattccactgggtgctttcactctttgacgcgtcggcatgcaccgtcaaagtgtatgactggcaagaatccagagtatgcgtttacacaggttttctcacatataatcaggtccagtcataagtccctctgttcattaagccaatcatataatgttaattgctgttaatcatacctgtagactccaatta

SEQ ID NO: 94531 - DNA, 6637 bp, Oryza sativa
gcctttgacgctatcaaggccccggggatggtgctccggccgtcccagccgattatcggtgtgacgccgggtcacacttggccgctaggtcatatcgacctcccggtcaccttcggtggatccgccaacttccgcacggagcgggtgaactttgatgtggcggacctcagtcttccctacaacgcggtcctagggaggcccgcgttggtgaagttcatggcggcagtccactacgcctacctccagatgaagatgccgggccccggtggccccatctctgtccatggcgaccttaaagtcgcgcttgcttgtatggagcagcgcgcggaccacctcaccgccgcgtcaacccgagggaggcgacgagaggcttggcacctccgcccccgcccccccgaggcagcggatagtcacatgcgacgaggtcccggtcaaggaggttgccctgggcgacggcccgtccaagaccacacggatcggtggtcttctggatggcaaataggaacacgcgctcgtctctttcctgcgggcaaacgctgacgtcttcgcatggagaccggcggatatgcccggggtccccagggaggtgattgagcaccgtctcgccgtgcggtcgggcgcaaggccggtccggcagaaagtacggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccacagcggggtgcgaccttttgtgttttctagatgcatactctggttaccatcagattcgcatggctagggaggatgaggaaaaaactgcattaattacccccataggaacttattgttatacgacaatgcccttcgggttaaagaatgcaggtcctacttttcaacgtactactcgaatttctttgggtagccaaataggacgtaatgttgaggcttatgtcaatgacttggttgtaaagacgcgcaaccaagagaccttactctcggatctagcggaaacttttgagagtctccgctccgcccgcataaaactgaaccccgataagtgcgtgttcggtgtacctgcgggcaagcttctcgggtttttggtctctgcccgaggcatcgaggccaaccccgagaagatacgagctatagagcggatgcgcccccccagcaagcttagggatgtgcaatgcgtcaccggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctggtcgccccggagccaaatgaacccttgctactctacttagcggcgaccccgcaagtggttagtgcggcgttggttgtggagcgcgatgaggacaatcctcattccgcgcacccccaccctgtgctgacttggcccgggagagagcagggaggagaggcccccgagccgaacggtggcccaaggcccccgacgaccggagcaggccctctgcccgcttgtcagacggtgccaggtgcccccgacccccaggatggcccgagggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcccgcttgtccgacgacaccaggagcccccgacccccaggacagccccgaggccactgtgggaaggccgcccctgtcgtcctccgaccccgaggtcgtcggcacagaagacgagtgcaccctgcgaggccgcttggacaaagagcgccccagggatgtggcccctagcgaagaggatcggccgcaccgaaaggtgcagcggcccgtctactttgttagtgaggccctccgagacgccaagacccgataccctcaggcccagaagatgctttacgctattctaatggcttcgaggaaactgcgccattatttccaggcgcatcgggtcacggtggttacgtcttaccccctcggccaaatcttgcataatcgagagggtactggacgggtggtgaaatgggcaatcgaactttctgagtttgatttgcactttgaaccacgccacgctatcaagagccaggccctcgccgattttgtggcagagtggaccccagctcccgagcccgtctcagtccccaaggccagctcgggcccctcgcagctgcctcacaccgcccactgggtgatgcagttcgacggctccctgtcttttcagggcgccggtgcgggggtcacgttgacctcgccgagcggagacgtcctcagatatttggttcgccttgactttcgggcgaccaataatatggcagagtacgagggactccttgcgggactcagggtgacagctggactgaggatccgccgcctcctggtgttagcagactcccagctggtcgttacccaggtctgtaaggagaaccggtgctctgacccgcagatgaacgcttacgtgcgccaagtacggcgtatggagcgccattttgacgggatagagcttcggcacgtgcccagacgggataacacggttgccgacgaactctcacggctcgcttcctcgtgagcccaaaccccaccgggcgcctttgaagaaaggcttgcccagctgtcggcgcgacccgaccccttaggggagacggacgcacctgacaggccccagatgcccgtcggagtccaggcctcgggacccgaggggagcgctcccagctcccttagattgattgcttggatcgctgagatccaagcatacctcacagataagactctacccgaggaccgcgaagggagtgaacgcgtccagcgcatctccaaacgttacgtgctggtagaagggaccctctatcggcgcacggctaacggaatcctcctgaagtgcattcctcgggaacaaggcgtcgagcttcttgccgatatccatgaaggcgaatgcggagcccactccgcctcgcgcaccttggttggcaaagcctttcgacaaggtttctattggccgacagctctcaatgatgcggtcgacctggtccggcgatgcagagcgtgtcaattccacgccaagcaaatccatcagccggcccaggccctgcagatcataccactttcatggccatttgctgtctgggggctcgatatcctgggaccgtttaggcgggccccgggcggttttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtgaacttttcggcgattactgcgaagacatgggcatcaagctctgcttcgcctcacctgcccaccccagaagcaacggccaagtggagcgcgccaatgcggaaatcctcagaggccttaaaaccaagaccttcaacatcctcaagaagcacggcgattcgtggatcgaggagttgccagcggtgctctgggcgaaccgaaccacgccaagccgagcaaccggggaaacgcctttctttctcgtctacggcgcggaagcggttctcccatccgagttcaccctgaggtcccctcgggccaccatgtactgcgaggctgatcaagatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgatggcacagagctgcctaacccgtggaacatcgaacaccttcgtcgcttctacccctaaagcggatcgggtgtcaggtttcgggctcgggccaaccccgcacccccctcgggcgtgcagggttggccgggggctaccacatatgcatattcttatttctcttatatctgtctcaataaaagcattttcgatttcctaaaggctgtatctgtgctgttgtttccttttgaaggatcttgacttgaaataggtcactcgtgttcaatcctgccctcgggggctcgggtcggctaaaatcgccaaacgaggcccagaaccgagccgtgccccggggcgtggtgaactccgggggggaatcggcaaaaacccacaatcgggtcacccataaccctcggtcaccacgctcccggcctggccagtctcgacatgtggatctccccaggcactagccccgacccaaccatttgaggactaggacctgggcacgagcccttgttcaagccaagacacaaaaggaccgcggcacaggcatcctcgtctcatacacacaacaaatataattgacacaaaaaatttcctctttatttgattgcagattaaattagtctatacaagaagggggcccgaaggcctcggaagaagaaaagaagaaactatttaaagattggcggaggcctgggggctcactccgatgcacccgggtcgccagcctcgtcgccacagtcgcccacaccaccgtcatcgccctcctcgtcggagttgagggcgaacgcgagccgaggggccgaaccctcgaagctgtggacgatatggtcggcggcatcccggacctgcgcgcgcgcgccgtcctcggtcccgggagggaactcgtccagcgccgtccatggggagaagtcggggtccctggccaggtaactcgccagtacgagctccaccgctcctcgggcaaggtccctcgaggatgacttaatcgtcccctcgagctcctcggggagccgctggagagtcccggccatctccgagaggcgctaggcgaggcccccctggttggcggcgtacttcacagtccgctcgccccagagacccgcctgctgccggcgcggtctaaacgggacacggtgtcgcgaagcatgctgggccctatctcgcctgccaggcgaagggcctcgacctccccggtgtacgaatccagcgcgccctgcagatccgcgatggtgtgttcggcagctgcgaggcgggcagctaagtcgctgtcgcctgtggccgccccgccgctacgcgcccttgcatccagttcccttgcctgcgcctcgagttcagcggcccgctggttcagtgcggtcctctcggcgcgggcactttccagattgcgacgcgcttgttcctcttgtgcagcctcgcggagggacaggctgtccgccagcggttgcgccgcggcctcggcctcctcgagagctcgctcccgctcggtgagcgcgtcctcgcggaggcggagcgcggactcttcttcagcacaggcggcttcgtgcaccgccagtgtgacctcccgaatagcaacggcggcctcgcgatccgccaggtccctctccacggcgcaggcacgctcttccagcgccatggcacgggcctcaagggcttcttcgcgccgccgggatgccacctcggtctccgccgcccgctgttctcgggcagcggcagcgtcaaggaccccccgggcggcgtcgagctttttccctagctccgcctcccagctcccgtattgaaggcggagggtgtcctgcgcctcgttcatcacggtggtggcgatgagggcagacccccgctcttcctccacctccttggcgatctcccccagcaccttccgacgggcttcgagctctgagacgtgccggcggtgtgccttgcggcccacctccaccatggcctccaccgagcgtcgcccctcttcgacacgcgcccatgcggcgtcaagctccgcccgctctgcttgcagggcctccacctgggcacttaacccgtccaacaccgtggtgtttgcgacggccaaggcctgcagaaggggttctgcgctcagtggagcaacagaaggcgtggggaagagccgcctcggtgaggatgccgcgcggctcggcccgccgatggacgtgccggactcagggatgtcccccggacctggcttgtcctgagcgtcgctcgagggagtgggcccaagcgatgcgcccgcggcctcgtcgcgagctacctcggaagtcgtcgccgcctcggcctggcgaagtctggcctcctcccgagcggcttcttcagcttggcgagctcggacggccacctgggcggcctcctcggcttcccgtaggcgattcgcggcttctcgccggtcagattcctgcctccgagcctctgtggtcgccgggtccttggcctcagactggccggacttggaatggcgggagggacgcgacgggatct

SEQ ID NO: 94532 - DNA, 849 bp, Oryza sativa
cttgaggatctccaccttggactcacgaacactattcgtgccttcatgcaagttccgaagcatgtcccaaatcactttggcactctcaatgccatccacacggttgaactcacttccactcaaggcgctaagtattgcattagcggcttgagcgttcttgtgcttgttctcgtcgtcctccttggtgggatcttcgggattctgcaacacatagcctttttcgactattctccaaataaatgggttaatagacttcaaatgcatattcatcttatgcttccaagcggcatagtccgtaccattgaagtacggagctttgccgctataggtactcacataagatgtagatataggtggatagtcataaggaaatatagctcccttatcaccatctttgccttcccccgtttggcccgacatgatctctttaagcggttaagcctaattaggagattaggctctgataccaattgaaagtgtcaattaggcctagaggggggtgaataggctaattcaaaaatccaattaaaagcggaagcagtaattttcggatatttccgaaatttttggatatatctgaaaattttcggagtcagcacaagtagcaaagtaaatcctagatctagttgcctacaacaagaatatgctagcacaaacagcaactatacctatagcggctcaagaaagctaagctagtggagagggaggaagtaaagtcaccaaagatgaagctcacaaagatgttcccgaagttttttggacatgtccgaaaattccagctcagcaccaacagcaaagtcaacgagagatttttcggacattccgaaaacttttcggacaagtccgaaa

SEQ ID NO: 94533 - DNA, 1430 bp, Oryza sativa
  unsure (1)..(1430): unsure at all n locations
caaaataatttcccaaggtcaatcaaagggtcttttttggtgcttntgtcacatgcctggcaggatttatatcaagccagggaagaanatnttcccattaaactgcaggccctatttgttcacatgtatgatggtcatcnccatgtaacaaagagccatctgaaggctgcagctgaactcatccaatcagtctctgtttatgggcaactagtattaatttgcacaataatcttgtgaacgatgctaaacaattaattagtaaattaatttggatcggatagggcgcaaatatgttccccatttcaaagtacactactgtcgagtattaggagcttagtgtgacgcccccacactcttccgaggcctcctacatctggcagctttcataggatatagactattcctcacagaccaacactagtcttttctgcacactttgtcctcactcgtgcgcacccgaaaagaatttcccgatcggtcacccatcccgacattgctctagggcaagcacgcttaaccttagagttttttcgagatcggctttcggaaaagaagttgcaacttgttgatagcttaaccttagagttttttcgagatcggctttcggaaaagaagttgcaacttgttgatagcttaacgcttccggaaaagaagttgcaacttgccgatatgagtattttattaatcatattaggatatcacattctcaccccccttaagataccgacgtcctcgtcggtcaacccaggccaggaacgtcccctattagcaccacgtatatacaagacaattttcggcgcacatacgtcatgccatacgaccacttcgtggatcatcccgtatgcaccgtatgcccgcgtacatgttcatatatatacgtatagctgcaagggtcgcgtacatgttcatatatacgtatagctgcaagggtcggctctgataccaacactagtcttttctgcacactttttcctcactcgtgcgcacctgtgaagaatttcccaatcggtcacccatcccgaaattgctccagggcaagcacgcttaaccttagagttcgagatcggcttccgaaaaagaagttacaacttgttgatatgagtattctattaattctattaagccctgagccaggatatcacacttagctagtataaactcatcgacaacagacaatgttctatatatatatataactaattaattaacaggatcatgttagagctcataataatactagtaatcaaagcaaaggactaactaatcaatcatatactccatccataggcacaaccacccttaacaacctaaagatcaagaaataattattactagttaatgacatgcatgtatgcacgccttatattataaataacttaaaaattagttgtgcctagtatgttatggaatggagagagtataagcatgag

SEQ ID NO: 94534 - DNA, 699 bp, Oryza sativa
ctgattgttaattttgtttcgctgccctcgcaaaaaaaaaaaaaatttgtttcgctgcttttgctgctggaaagaagcagtagggccttcttttttgacttcacgggtggagtgaccggtttaccctttgaagccgtgtccttggcgatggagagtgatcgaggttgacaggtggtgaaaatacggggagtgtttgggatgtattaaaaaatggtgttcaatttatggaaagattaaagtatttatcaagtgtattaagtgtgacaagtaagaaaaacacgcaataagttatttagataaatagtacaaactacatgtttaagtatgaactccctccatctcaaaataaaagaaactggatgaggcattttctagtagtacgaatatggatagcttattttttaatcctagattcttatattttgggatggaaaagtatagggttaagaaaatttaagtatgtatccgtttaaattaatacacatttataattataaatgatgaccgaagtgtaaactttttttttgaagcggggagaagatgaatttcactaaatatgtactactatatattacatttatgtagaaccattcgacatcgtgatattaaactttattaaaaaaaaataaaagggggagggggacgaacttcagtaacatgtactaatagtttattacattcgtatagaacaattcaaca

SEQ ID NO: 94535 - DNA, 2443 bp, Oryza sativa
aaaaccagtgattgaatccacaaattcatttccagccgaaaattttcgtgctggaaggaagtgccactcccaaagtaccattttttggatgagggccctgtccaacaggtaaaagtaagtattttgcctctcccaattaatccttaaataacctttggagaagagtttcctttattcaaaagtaataaaaagccgagagttgttagtcgtaaaaaaataagcatttcaattgctttctgtagattccatttgttttctacatcttttcacatggtaatacagatagtttcagatccatctgaataaagttcttacattagtgctgcatatctttctgtttactctgcaggaggatggtctgttgcacactacctgtggaactcctaattatgttgctcccgaggtaccttcttacactcatacattaaactagtatatagttattatcatcgttggattgaatatttgttttcatgttacttatctaaaaaaatatttgttctcatgtttcaataatattgtctgtgcaggttatcaacaacaaaggatatgatggagccaaggctgatctgtggtcatgtggagtgattctctttgtcctcatggcaggctaccttccatttgaagactcaaacctcatgtcactttacaagaaggttggtccctcttaaccatgtcaaaggattgttggtttatgaaccctaaacaaagtttttgtttggaagattaatgtgattattgctcatccagatcttcaaagcagacttcagttgcccgtcttggttctctacaagtgcgaagaagctcatcaagaaaatactagatcctaatcctagcaccggtatgttttgcagcattttacccttcatttctttgaagcattcttatacataagtagcttatcccatcgttatctccttgtgcagaggattaccatcgcagagcttatcaacaatgagtggttcaagaagggatatcagcctccaaggtttgagacagcagatgttaacctggatgatatcaactctatttttaatgaatctggggtaagctctcacaccattcagctcatagcattacattcttcataatgcactggatgggcttggtaacatctattctaactaacgcaggaccaaacacagcttgttgtcgagaggcgagaagagaggccatcagtgatgaatgcttttgagttgatctctacatctcagggtctcaatcttggcacactctttgaaaagcaatcggtacgatcacattcttaaattggtcattctgaagtctgaactaaacatgttcaagtacacttacagtcatgagttataatctaaaatgctaaaccaattttctttctacttttagcagggttctgtgaagcgagaaacaagatttgcatcaaggctgcctgcaaacgagatattgtcgaaaattgaagcagctgctggacccatgggctttaatgtacagaagcgcaactacaaggtaactaatccaaaattccacaacttgtttctaccatttttatctgaaacaattaacattctgatgacacttttatggattggaatcagctgaagttgcaaggagagaatccaggaaggaaaggtcagcttgcaattgcaacagaggtacaccaatgatacaacatcactatttactatgttctgtcattctatatgctgtgcagcttgtgctactactctttcctgggtttatagactgaaatcagttcatccatttctaaaggtttttgaagtcacgccctcgctgtacatggttgagctccgcaaatctaacggcgacactcttgaattccataaggtacacataacagtaaaattactgcaggacctcacagttcatacttcagactgggattcggctaactcatggtgtaattttttacgcgtttcgcagttctaccacaacatctccaatggcctgaaagatgtgatgtggaagccggagagtagcataatcgcaggcgatgagatccagcatcggaggtcaccgtgattggcagtttggcaccaaaagttcagtgatagtataaagtagataaccagccaggaaaacctactaaggaatggcctgtggctgtttttttttttttggttctttttaccttttaagttgagttactatctaatctagacatggttgtaaacaaagtttgtatggagatggaatgtgaatgaagaatgtgcatagttttgcttccttgacttattttaaaagcagtaacctgtgaaatccgatgaatgaaattgaaatctgcagcaggatgcctgacgatcgtagaagacttgcagcagatatgagattacatatatcctctttatttcagttttgatgcaattcgtaaatcgcaaggctcccatcggatggcctattcagccaaagaaaaagccaaaatttaaattttcaaacttaattttga

SEQ ID NO: 94536 - DNA, 1350 bp, Oryza sativa
  unsure (1)..(1350): unsure at all n locations
agggtacaggcttgcaccnctgtatggataacaaaaagtacgtatcttagcactgtcgaaaggtgtgtacatgggtcatcatcgattcctgcaagcaanacacccaagtacggaagaaaggcaagcactttgaacatacggcggaccaccgtacgaagccaaaacatcgcagcggtaaaacagtgtttgctatggtgaaagatcttaaagtggtgtttggaaaggggcctggcagccagcctatagaacctttgtaagtttttaaagtatacgaacacgtagactaataataaaacaaattacaattacagattccacgttgtaaactgcgagatgaatttattaagcctaattaatctgtcattagtaaatgtttactagagcatcatattatcaaatcatggtgtgattaggcttaaaagattcgtctctcaatttacacatacaaactgtgcaattagttttttttttccacatttaataccctatgcatgtgtccaaacatttgatgtgacgtttttgcctaaaattttttaagatctaaagaagggatacactcaacttctaccctcacctcacttttatacctcccacgttagttttaaacaaaacggtacatttttctttcaacaaaatatttacataaaatttgattttaaaaaaatcacaccaacctatttttaagttttctttacagataatacttcttccatccaaattcaaatggaacttatcctaataggttttaacattttggaacggaaagaatactaaattaattatgcgccaacgagccacccagttttgtgggtgtggctcctaaattcacccttggtatttttacaaacatggatacatctatatatataataataaaaataaatattttttttaaagaaaatagtactaacagaaagaagaaaaagattaaggtttgaaatataaagcaggaattcgatcgatacgacaatagcacatcttccctccgtcccgtcccaaaaatatatcaagtgtattagtttacgtacgatctttgtttgttgtactttgaccaatttctcaccttccattaattatacttataacattaatataacatcacttgaaggtattctctaatatatgaatttaatgtccttacttactcgtgtgtcactacacacttgcctcaaggagtcaagggctcctttagaaccaacaaaaagaataggaattatgaatgcgctagaaaatattccagaatggctcattggaacaaaggaagactaggataacctatgaaatggcttattccaatgaaattttggagggcaactaacatggctcctttagatcgatctcatgtttttt

SEQ ID NO: 94537 - DNA, 601 bp, Oryza sativa
ccagatcttatctctatacctggtatgaacatttgaaatctacattttttttaaatgatatactatttaccacttttaaagcctaatgggcacaagatgatgcccacttatttttgcttcaatactcggtacttatattcttatattgcaattaacttcttgtgccggcgaaattggaagaacatatgaagccaatgttgatgatgtaggttatagacttgttatcatttatacaccctgtgagagaggatggagttgagggacaacctatctctgcttcaacggagccaattgcagttggtatagtccattcacctatcttgtcgcctactaacatttattattatcatcatctcagttttttatccttttggtgatccggcagcggttagctaaacagtttcttctagcctcagtttactttctgcgatagttatattgattcactattaagtttaatcttcagagcattacttaaggttgtcagcctggtctattaactgcttggttttttcttatgcagagcctgcaatttacaacgaggtgaagcagaaacttgatgatggttctgccacgttgaggtaatactcgtttcaagtcg

SEQ ID NO: 94538 - DNA, 1252 bp, Oryza sativa
aaagatccccccctttataaaagccttcttcctccctccagcccgagagcaaggcttcaaaatttctcaaaaaaagaggggaaggtcatgcaaaaatatgttgtgaaattctttttagtgattatatacaaatcggaggtgtctaaaaggttagtaacttcatcatccaagatttttttttgttgttatataacttttggagctatgtttcacacattttttttctccaaaactttgttgtaagttgatgagagagaaaatttgtgtggggaagaagaatatatagaaattttattctcatagtttaaaatatgatgaaaattacttaaaaaatagaaaacaaactaaattgaaaattaagagaagtacaacattaatattagtttagaacttcaaaaattgttaataagaattgcttgtcgaaagagtttttaattattttatcattactgtttgactgtcattattgtacgaaaatttatttatgtacaattttttttcatttcatgtagatggatcggcaatggatgtacgttgaccggcggtccaaagagtttatcgagggcgtgcattattttttgagagtggccgaagctaacaagcgtaacggttttatttgttgtccatgcaataagtgtaagaaccagaaggaatattctgcatccaggactattcatttccacttgtttgagttggggttcatgccaagctataattgttggacatcccacagtgagcaagaggttgaaatggaagaaggtgaagcggaggacgagaacattcccgactgggctcagtacgctggatttgaagaaaatcaaacggacgaggtggacagggatgctggcgataatgacgctgcagatgatcttggtcagatgttgcaggacgcaaaggaggactgtgaaagtgaaaaggggtcccataaattggagcggatgttagaggaccacagaacgtcgttgtacccaggttgcgagcaggggcacaaaaagttggataccactctgaagttcttacaatagaaggcaaaagatggtgttagtgacaaggcatttggcgatttattgaaactcgtcaagaacattcttccggaggaaaacaaattacccgggacaacgtacgaggctaagaagatagtctgccctctaggactggaagttcagaagattcacgcatgtccgaatgattgtatcctatatcgcggtgaggagtacgagagcctagaagcatgccctatttgtaaagcact

SEQ ID NO: 94539 - DNA, 780 bp, Oryza sativa
  unsure (1)..(780): unsure at all n locations
atgatgccatgagaggcncgtttatttggccacctttccggccagagccacactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaagaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacggttcatgttgcgctcttcctcttcattgggcacgggcacatccaaggctacatccgtatctgaaagatggagggaatccaaatagagaataagatgatgctgggcgataaggtacgaccttaaatggaatttagatagcaacaaatgcttcaaagcaaccgaacccgccgccagccatttacc

SEQ ID NO: 94540 - DNA, 623 bp, Oryza sativa
agccttgttgagtttcctgtaatcgatacacatcctccatccggttacggttcgttgcgaaattagttcattttgagcatttgcaatgaccgtcattcctcccttctttggcacaacctggactgggctaacccactcactgtatggtacgggatagataatcctggcatgcaggagtttcaagacttctgtctttacaacctatcgcattgcattattgagccgtcgttgaggttccatagagggagtaccctcggggtcaataggaacacgatgggtgcaaagcgcgggattaatccccctaaggtcctgaagcgagtagccaagaacagaacgatgcttctctaacacggtgagaagacgttgagtctcgtcttcagagagcttatcactgatgatgacaggggcttctctgtcattgtgtaggaaggcatatcgtaggcctagaggtagaggtttaagctcaagcggaggtcgaggtggcggttccatgattggcaggtcgagagtctcaccgggatctgcttcttccttgatgaattccgggacctcatcttccagaagggccctcgggagactcatgaggaaaaaatgcagtaacctctttcactgactcaatttct

SEQ ID NO: 94541 - DNA, 941 bp, Oryza sativa
taaaggggctaggaggcggcggcgaaggaccacggcgaccggcgacgcgaaggaaacctcggggttcggaggaaagagaccgatccgattcgacctcgaatccacgaacttccaaaacgattaagccgatgattccaaaagagaaaaggtggaggagatcccggagattgttccccctcaaaagatttcaccggagaaggaaaggagcggccggatttggaaggggacggcggcgcggctcggctagggtttcgggcgccgccggccggaggtagacgatgggtccgacaggtgcgccccacctgtcagcgaccgaacgcgcgcgctcggcggttgcggtctgggccgacttgggccggggagagagaaaaagggttttgggccgactttcggcccaaagccaaaagaggattttaaaaaacctttttcaatttaaattattcatgaaatgcaattccatttattaaaaatactttctttgctcaaataaatcccagaaaaatctaggaattatagaattaagcaaagtatttaatgaaattttatctggccccattttatattggaatttattaattaaaattagatcttctcttctaggctttttttaaaatcatttctaaaaattccaattaagcaacaatttatatattttgaattttcagggtgtgacaaacctaccccccttaaacagaatctcgtcctcgagattcggaagaactggcgaacaaatgcggatgagctgacttcaattcatcttctcgttcccaagttgattcttcttccgagtgattactccattggactttgcaaaagcggataactcgatttctggttcttctctcatctatttccaagatacggattggtttctcaacataggtcagatcctcttggacttctatctgttcaagattagcttcttcggtaggtacccttaa

SEQ ID NO: 94542 - DNA, 515 bp, Oryza sativa
gtctacgtcttcaccgaccggcttgccttcgcccccaccgactggtgctttccgcctgcacggctgacttattatgccgccgttgttgggcgtctacgtcttcaccgaccggcttgccttcgccgccgccgactggtgtttccgcctgcacggctggcctttatgccgccgttgttgggcgtctacgtctttaccgaccggcttgccttcgccgctgccgactggtgcttccgcctgcacggctgacttattatgccgccgttgttgggcgtctacgtcttcaccgaccggcttgccttcgccgccgccgactggtgtttccgcctgcacggctggcctttatgccgccgttgttgggcgtctacgtctttaccgaccggcttgccttcgccgctgccgactggtgtttccgcctgcacggctggcctttatgccgccgttgtcgggcgtctacgttttcaccgccggccgcctcgtccgccgccgactggtgcttccgcctgcacggttggcct

SEQ ID NO: 94543 - DNA, 2206 bp, Oryza sativa
acatttcttgatgaccatatgattggatcctaaaatctttgtagtcgaaaaactacaacactccccttcttgcaaaccaacctgtaactcatttaaacaactagaggaactagatagataattacttatattcatgcggtcctctagacaatacatttcatcatgaaaacgaggtatagtcaaattcgaacaaatatatactcgatgcactttatattctcctttactatcataattgccaataatatgaaaaatcacatcagaagggcatggcaattccaatctagcaaatagtttcttctctaaatagttgagtgaacaaagaacatcaaattgaatataaccccaagtatttaaagaagatagcaatttaaactcttcattctctctagcaatgtgaataacatgtttaaactcaacacatagtggttctactatagaattaacatgttcattcactagttggggcatggatataagtgaagcatcacacaactcttctttatcacaagaaatatgaagcaaattattttgtgacaaaggtatttcaacaattgtttccactataggttgctctaacgtagcataagtagtagacataggtggcacatcataactatgcataccttgagtagttgtagcaccattatcattacctttattattctcatcttcataaattataggtgcttttccaattgaacattcttcaagcatgcatggagctatagataggtcttttttctcttcgtctttcttctcttcctcctcattaccttggttgttctcagatgcctgcaaaatattagtatccaaagcaataggcacaacaaaacattcattttgtaataactcacacttagctgaatgcatcgcaatattagtatctttcctgggatctttgaaaatctcatcgattctaattttttgtcctttcaatactatctttgaaattttcctcgattccattttttatcctttcaagattatcttcgaaaatttcagtaaaactcatgggtaccagttttattttccgaccattatgtctaaatgtgtatgtattagcaacaaaattatgcgaaccattattattatatacccatggttgaccaaacaacaaagaacatacttgcatagggacaagatcaaaattggcagtatcatggtaatttccaatcgaaaagtttattctcacaattctatttatcttgaacttaccacgagagttgaaccatttgatgtaatatggatgaggatgcggttgtgtaggcaactcaagtttctcaaccaaatctgaactcaccaagttattgcaactctcagccctacccgtcagcgagggtggcgagcgggcccgcccgtcagcggcgcgcgcgcggggaggaggccgaatgggccgcggggagaggagagggagggggaaggagatgggccgagccggcccaagggggagaggggggaaaaggactttttttagagcttttctttttataaaaccattttaactttgtttatttcttaatatttattatttgggctctgaaaattccactaaaatttatttacgcattttagacttttaggaaatatacaaaaatcctccaagccttatttgacttttaactttgcacattttaattgttggaggctttcacacggattttaattattctaggcataatttcgaggatgtattttagagtcgttttgggacgtgacaaacctaccccccataaacggaatctcgaccccgagattcggaagaactggcgaagagatcgggatgggctgccttcagctcgtcttcacgctcccaagtagcttcttcctcggcgtggttgctccactggaccttgcaaaaacggattacccggttcctggtcctgcgctccatggtgtccaggattttcactggcctctccacgtaggtcaagtcttcgcgaacttcaatttgctctgagtcggcctgctcggatggcactcgaagacatttcttgagttgcgacacatggaacacatcatgcacgttgcccaaggaggcgggcagctccagctggtaagcgacttctccgcgccgggcaatgatacggaaaggacccacgaaccaaggtgcgagcttcccttttgtctgaaacctgtgtacacctcgcaatggcgtgacccgaagatacacaaagtcatccactgcgaattccaggtcacggcg

SEQ ID NO: 94544 - DNA, 567 bp, Oryza sativa
ggcgtgacacgaagatacacataatctccttcttcaaaactcaaatctctgcggcgattgtcggcataactcttatgacgagactgagccactcgcaatccttcttgaatgatctttaccttttcttctgcttcccttaggatatccatcccgaaaacctgacgttctcccgtttgatcccacaaaagcggagtgcggcacttccgaccatacagtgcttcgtaaggagccatctgaagactagcttgataactgttgttgtacaaaaattctgcataaggtagattcttatcccaacttccaccgaagtctaaagcacaagctcttaacatgtcttccaaaatctgattcaccctttcggtttgtccgtctgtctccggatgataagcagtactaaagttcagcttagaacccatctcttcctgaagcttcttccaaaaatttgaagtaaactgactgcctcgatcagacactattttcttagggacgccatgcaaacacacaatccttgccatatacaattccgctaactgacttccggaataggttgtctttactggaatgaaa

SEQ ID NO: 94545 - DNA, 737 bp, Oryza sativa
  unsure (1)..(737): unsure at all n locations
aggtgctcttgcggccggtgatcttctggctgcgccagacgcgncgacgcttgggcggcaagacctctccctgggcgatcttgagctgatgcagctgcgcctccaccgcgtctaagtccttcttgagctgcaggttctcctgacgcagctccaggatcttcagattgttctcgaccatcccacggcacaccatctgatggaagtcgatacgagccgcgtcgtacgcctccaccatgcgcgccaggtgtacgatggtagcgtcatcctccgagctagcatctcggaaggtggcgtagtcgcgggctcctccgcgacgagggtggtagcggtagggcgagtgctgcaactcgtccgggtagcgctggtgaagagtgccgatggcgaggagagcggcgctctggcaagcggcggggaaggaatctccacccgcggtgactgccagcgaagtccgctcgggagagccagcgaggatcactgcagtgacctcccaaccagcgtggggctctgcgtcgtcaccctcctgctccggaagcggcctggcctggtagtccactccatgtggataccccaggacaacgcacataccccgcagctccaagacgaagccagtcatgtccaaaccacgacgggtgacgctgccgaccatctacaaacaaaaccaaaaaggaaaacaacattttaaagatcagattttggcgataaatgaagcagcaagacagagagagactagacagttt

SEQ ID NO: 94546 - DNA, 786 bp, Oryza sativa
aactgggattcaatatgttcaaggatgatgtgacttgccttgctcgctttcccaaacgtcggcttcaacttccacgaagagcggatcttccgaagctgcagcgtctacacgaccaacggaaaagaaacggcttttactctactaaactccatataacaagcagaaacaaagcacaaaaatgcgttcttgacttcttaaggaaaaattagagacttgaacggtccaattccgagttcaaatggccaagttatggccatttgaagtttatatgctctttaaatggatatttgcgaatttcttcatttaaattttaatttaaaatcggatttattgcgtcagccgaggggaggaacgcgcggaccgggtccacgggagtggggcccacgcggcagcctcatggtccacggtggaccgggcgcacgcggcttgcgctggccggcgccgtgggtcccacgcgtcagccgcacccgaaggcgcgggcggctgacggccgggccccacatggcagccgcggggcgcgcccgaaggcggccttgccggcacggtcgacgggaggcggcgcgccagcgcccctatggtcgccggcggcggccataagcacggcggagcggcggccgaaagaagggagggaagggggaaacgaaatgggcggtccacggctcaccccgggtcgacgacgacgacgggaacggcgactggagcggaagaaagcggcggcgcggcaccggtcgactgggacggcggcgttccggcggtcggcgggcgaaacggaggggtggacgaggt

SEQ ID NO: 94547 - DNA, 652 bp, Oryza sativa
cagttgtaaacttggtttattatactctcacagaagtagacaaactgcataccattctgctgtcccgtaacataattattactttggtacaagaaaccaatgcttctaaacatagaagcgctacaaacacaaccgcgatctgctacgtgtatcgtatgctgatcgcggattgttatggaactggagatacagattacagaccggctacaataacacttaagatgcccccgtgcccacatcaactctgcaccttacgggaggaaacgacgcctggtgccgcagaagcgtgcctatctgccatggatattaccttcagcaatttgaccgggcacttatctatgcaaatatgcaccaggatttacccatgcatctatcgactacttaggctcatcttgatttattaatctccaaataaagtagtgagcagcaggtcttgcacaaatgttgctctgacactcgcttgcttccgtttctgttccctttcttcccttgtgagggatgagtcaatactgcaaatgaaaaaaaaaaattagcagatcattcaactgccaaaatttgaaatttataatgtatacctcccaaatagtcctaacatgcaggaagccatacagcagcttgttgctacacgctactcatcagtcaaacaacttgc

SEQ ID NO: 94548 - DNA, 6932 bp, Oryza sativa
tccccgtcaaaaccagaggcaatggacttcccagcgactcccacggacttctcgccgcttctctattttcatctaatacagaaaattattacgaattaaataaaagatttatgatgtcacgatgacatcatcgccggccatggcacgggacgacgcgaccaccggcgatagagggctcggttgggctatccgagaacacccacgcgaagaggacgacgacgtgaactcaccggcgcaagaaactacgacggacgacgacgaacgacggccggcgacgaggtccgacggcggctcggctcgggtcgacatcgacgacggcgctctgacggtcttcagcggttgcgaaggggcggacggggtgctcctcttcctcacgaacccggtggtggcgacggaaggcggcggcgacggctacagcggcggcgcggcgcgactggaatggcgtcggtagcggcggtgctagggcaacgtggcggcggcgctacgagcaacggtggagcttgggacttgagggcaaacgtagaggacgacttggggatgctttatataggcttggattagagagatcggactccaatcgagaggatttgagctggaaaaatctagggttagtttggagagataaactaaaaacgaattcgattcggtttatccgggcaaaattgatctccgaaactttaggggaaagggagaggataaggaggagatgatttcctttcaagcaatcgaactcggagatggccggctggggcggaatcgaaggggaggcggcggcgctcgggctcggctcggccggccggaggtggaagatgaccccgacatgtgggccccacatgtcagcggcttgaaaggagagggtggggcggcggctcggcttgggccggcttgggccgcacggccgcgcgcgaagaggagagttgagccggaaacggcccaacggcctaggggagggttttaaagactttttcaattaaaataattcgtgaaatgatgtttcatttattaaaaatacttcccttgctcaaataactcccagaaaaatctagaaaatagataaacaagcaaagtatttaatggaattttatctagctcaattttatgttgaaatttttcctagattattagagtttaacttgtaggcttttaaaaataatttctaaaaatgcattaaaaattgaattattaaattaggcgattttgagggcgtgacattctttttcctaaatgttgataaaatcatgttctatcatgttattgtgttcttactgctattattttggccatcttttcttttgactttgttttatgaattaaaaagttgaatttcaaaaaatggcaacttcaaataatattttgaagcagtaaataatttcatctaaaaaagtaataaacataaatgtcgtagaactcatcaagatgtacaacttttatttggtcatttcttcatccgacaaagtgatagtaacattgttaacaaaatttacatatttctcttatagtttataaaaccatatgagagagatgtaaaattcgtaaacaatgttactatcaatttgttggatgaagaaatgaccaaaataaaagttatagatcttgatgagttatacaactttgttgttgattgatttttcttatttgaaaatgttgtttgaagttgtcatattttgaaattcaaattcaaactgttcaaacaaagtcataaagaaaaattaccaaaacaaagttgtagatcatgcgttatacaactttgttgttgataatttttctatttgaaatcaattacaacccaaaaaattatttgaatttcaaattgttgatgggtgatacccgtagaccggatgaataggatattggggtacgttggtatgaggatctacgtgatatgacatcaagcaaacaaggagacaaggattttactggttcagtccccttatatggtattgatatggaaaaccacagagatgggaacagatgaattcgacaatcacacaagtcttttctgcacactttgtcctcactcgtgggaagaatttcccggtcggtcacttatcccaaaattgctctaggccaagcatgcttaattcttcccggtcacacttcacgtgctctagctttgtaaactatggtgggtgtgttggcagtgagattcgatgatctgaatccctcagggggtgtcccttttataccgtggatcaccttgttctccaagtagaactcggagacatcggactccacactacatagaaaagaccccatcctctccgagtagtactctgctaatctctttacccgtgagaatattttctacaatatccagtaaatttccttaacgcatacgaaaacaaatcgtatgcgcaaaggtataccgtactcgtatattccgtaagtcattggatagaaggtatgccttattcgtacccatgacagttatattttaaaattcaaattttatatagttcaatcaaactcgatggagaaaagaccaaaagaaaaatggtagatctcaatgagttctacaactttgtttttgacaactttttcatatgagttgatttagtaccataaaattcgatttgaagtttaaagagccacatgcaaaaaatcgatttttgcatgcggacctcttaaggatcagcctatattaggtgatctatactaggtgatttgtctataaatgaaacgagtaaggagacatgcatattagataagatcgattgaaacccgatgctacccctattggcaatcaacaagtaggctagagattatggttctaaggacggcttagtagatcaaacttaactgatgaagcactaagtatgaaaagaaacataatatctagacaattaagcctttgactgatttttttacgtgacctttgactgatttttagggtggtagatgttgtcggactcggctgcggaacgaggagatcgaaacagactcggtgccacatcttggttggattcgtaatctaaaagtgcatcggctagaatcacattggttgaaggtgaagattcgaggtcagaaaagccagagtcaaattaagccgatacatcacaaccagggctcgtgtgggccaaactcggaatatccatcattgccaattagagataaaagctcgtttgtaggcaattgtatctattaattaggatagttaagtcggtgtgttcagttttggcaagaggcggccatatatggtcttgtttgtatcttagagttttagaatgttttgagtcatgtcggtaagggccatgttgttttttgagtctgacaagcaagaccgtacctcctttcgtttagctcatagatttcctacccgtctccggaggttatggagcgggcgtcttctgcttaacttgccacaccttcttcctcttaggtgtggttggcggcatctttggagccgtcttctatggttttttggccggtgtaatggattgtaccgatgtcttccaataacgggtcctgggaacagatgatcccttttccaggaagttttgcataaactttaccaggctatccatcttgggttgctccacttagaccacttgaatgttctgtgggtttgccctgtattttatcctcaccatggagcattgctctgtcctcggctgaaactcaaacttctcctccttcctgttgataggagacagatacttcccgcccccacatcaaagttggcgttcgcggtgctaaggaacggatgccccaagataagtggcgtctccttgtctgaatccatatccaacaccacgaagtcaaccgggatgaagaaatcccgtatcttaaccggtacgtcttccgctatcccagctggaaaatagaccgaagaatcgactagctgtaggcgcatcggtgttggtgccaacaccgtgaagttgagcatgtcgaaaacgtctttgggcatgacgcttatgcttgctcctaggtcggaaaggtcttggtcaaatctttgtgtcccgatcgagcaagtgattgtgggacaccccggatccttcttcttttcagggagtttgtcgagtatcgcattgctgcattcctccattagtttaaccacttcggtcgtcggaagtggtctcttgttattgagtatgtccttgaggtaacgcgcgtaggtgggcacttgcatggcgtccaacagtggcacgtgaatatggattttctggatcacctcaacaaaacaagcgaactgctagtccaccaatggcttgttgtatctctgggggaatggcagcagccttgtgtcgcagtactcctgcggcatggtcttctcttgctaaaccttttcttcagccgcatcgctagatggtgcttccctattgttgttgccagctcctacaaggttaggatatgtcagatcgcaagtggacttacctcccctcgtcgtgattgccttaacatttttaacggagggttcggttgtccaagaatcctcccagattcattagcaggtactaaagcagctaattgtgcctgctaggtttcgatcattttattaaaactaagctagttttggaatgcataagcaaaaccatctagcttaacatttatattttccagggtcttgtcattagcagctagctttttgctaagagcgtttgtagttttggcttgcgcaaaaacaagatccttcaaggaaggctggttagaaaagttgccgttattgttgcctccttggaaatatgggcgtggctggttccacccctgagcctggcgaacggaacccgttgttgttgttattgcccatgtacatcgcctcttcacgggtttctaggcaatcgttcccagaatgacccgtgcctccgtagacttcgcacgtaacgtgggagtccaaggccttgacggtgccttggggttttttctcgtggtcgttcaaacgattcatgaggaggtccagttttgcagcgagcaactccatctccttgacggtgtgcattcctcgctgatgggtctatagtcgttcctcgctccagcccatgttggagaccatcttttctaaaagatcgacgactcctctgaccgtcttagaaatgaaggctcctctagctaccgcgtcaaggtgatcatgtgacgtgggagtgagtccattatagaagttttgcaggattaactagtcgtccattccatgatgaggacaggcggccacgtactcctgcagtcgttcccacgcctcgggaatagactcgtctctcgtctgctggaaacttgaaattttgccgcgtagggcgttggttttgcccatcggaaagaactttgataggaatgttgttcagcatttgtcccaggtgttgatcgtagcgcggttggcatagaaccactgcttcgctttcccaatgagagaaaatggaaacaatcagagcctgacgccgtcaggactgatgcccttcatcgtgtacgtgctacagatctccaagaactgttgcaaatgtgagttggcatccttgtttggcttgccacagaacgggctagcctgtgcttggtctagcaatgctagcaggctaggaaattgaagtttcaatttgatcaggatgagaggttgatgctccaatttcaacaggctgggaactggaagctacaatgttgttagctcctcccttcatcaatgttgctagccggctctaagcaatggttgttcaataaattagtaaatgccccatatccaaagtatagtgagggttttttagatgatcaccttcttgtgattcttcttgggctttattcaagtattgtctgcatagctagtcttttgggactaggaatatctgaagtagttggcagtgttcctccttggcttcctcttcctgcaaaatactagacaaaataatgcattaaggtcatcaaactgtattattgagaacagtattatggaggtcaagcagacttgcctttttttggttccattaagggaacacttgtagcttgtttgaatgtggcaaaatttccacaacccttacaccttctcttgcctcttaccagcaccctcttccctgaatcattgtcaattgaagcagttttggatttggacttcctaccaccttcaaggcaagttttggtcctaagctttccgtatcttccatttgtcttcttaggtaaaggtgcacctaacacccttggcaattcaacctatggccagtatgggttgtcacccaatggctttataatcccactataggccttcttgaacaaaatcctcaatgttcacatccatattttgttgggaggttatcaaagccaatgcatgctaacatggttttccagtgtgctgccagtactggttgtaagctttcaccacatgcttaccattactgttgttattgttaacaacttctgcacaaaagctatcagatttcactactgagaggtgacccaaacccgtagttcttgccttcagctgctgtgttacagcaggcaagatcttcctactcaccttctctacaattcttctcctcttattccatagaaccataaccaacgctctgtaaatttccgcatggtcacaaattagcaatgccttgtaatccttaatccagttgttaaaactctctgcaagattgttagtaatgtaatcacactttattgttggattgaaaccactcctcatccacttcaatggatgataggtttcaagccaaggaagcacatcactgcaagcttcaataacttctttcatgtgctttttccaaatctccttcctataagccgtttgctgctaagtgcacacatcaccaccaaacctcttcacaaagttcttcattagatggcagaagcattccgtctactcagcatgctcaaacacagtatgtgcaaccttttctaatccttacatgcataggtacaaacagctagtgggttaacatctcctatagctttatgaagttgtctcataaaccactctcaattatcctcagtttcagcatttatgaacccaaaag

SEQ ID NO: 94549 - DNA, 2272 bp, Oryza sativa
tcagagtataatctattcgaatagccgcgccctcggttatggccaagccgagcaatgtacccaagttagtgttttaaattcttaaaacctgcttaacacctaaaatgtgaaatggttggcctgggttggcttaggacgagctgggacccagggtcgggttgccagttcggtctgaatcatcgtaggccttgggttaaggcaggttcgtgtgggttcacggccttgattaataatattgtatagttctaggatcgcgtttacaaaatagctttgagcaactaaatgtctttaaatgctgtttactgcaaccctaaccctttatattataattcccttgtactcccttgcatttattctgcatttgtgggtgtgtcttgttgagtacggtggttgtactcagtcttgctcaatttttcccaagcccagaagaggagctccttgaagatgaaggctttggtgtctagctcgtgcctgccgtcaagcgcctgtggtcgtcgccctagtcttccgctgtttctcgtttgtctttgtgtgtgctgggccttcgctgcccatgtaataaattaactatttacgcttccgcttgttatactctgaattgtatcaacttttggtgtaccttgcctcctgggacaaggattaatgcacgcacgtaaggaatgcccgttgggttatttccggtcgtgacacaacccaagacggtttcagagattcgtagtttccttggtcttgtggggtactaccgcaggtttattgagaacttctccaagatcgctagaccaatgactcgactgcttcagaaggatgtgaagtataagtggacggaagagtgtgagtagagttttcaagaattgaagaaaaggctagtgactgcgccagtgttagtcttgcctgatccaaggaaaggttttcaggtgtattgtgatgcgtctagacttggtttgggttgtgttttgatgtaagatgggaaggtggttgcctatgcatctaggcagttgcgccctcatgagaataactatccaacacatgatctagagttggcagctgtggttcatgcattgaagatttggcgccattacctttttggtacccgtacggagatgtatacggatcataaaagtttaaagtacattttcactcaacctgatctgaacatgcgtcaacgaagatggttagagttgatcaaggattatgatatggaaattcattatcatccaggtaaagcaaatgttgtagcagatgctctcagcaggaaaagctactgtaatatgtcagaaggtcgacatctaccttgggagttatgccaggaattggaaaagttcaacttgggaatagtcaacaaaggttttgttgccgctttagaagctcaacctactctttttgatcaagttagagaggctcaagtgaatgatcccgatatccaagaaatcaaaaagaacatgagaagaggaaaagccatcggttatatagaagatgagaaaggaactgtgtggctaggagaaagaatttgcgtgcccgacaataaggagttgaagcatactatcatgaaagaagctcatgaaactttgtattccatccatcctgggagcactaagatgtatcaagacctgaagcaacaattctggtgggccagcatgcgacgagagatagcggaatatgtggctctatgtgatgtgtgtcagcgagtcaaggcggagcatcagaagccagccggtctgctacaaccgttgaagataccagagtggaaatgggaggaaataggaatggattttatcaccgatctacccagaacatcagaagggcatgattctatttgggtagtggttgacaggcttactaaagttgctcatttcatacctgtcaaaacaacctacacgggaaataagctcgcagagctatatatggcaagagttgtatgtttacatggcgttcccaagaaaatagtgtcagacagaggtagtcagtttacttcgaagttttggcagaagttacaagaagagatgggtactcatttgaatttcagtactgcctatcaccctcaaactgatggtcagacagaaagagtaaatcaaattttagaagacatgttgagagcctgtgttctagatttcggtggaagttgggataagaatctgccgtacgctgaattcttttataacaacagttatcaagctagtcttcaaatggctccatacaaagcattgtatggtcggaagtgtcgtacaccgctcctttgggatcaaactggtgagcgtcaagtttttgggataga

SEQ ID NO: 94550 - DNA, 1884 bp, Oryza sativa
taagggagagcaagctctaccttcttgcgtcaaaaaaaagatcaaaatgtagatgtgaaattgaaagaaacaatcatcaacatcttacacatatgcggtgctcagtcctgcatctagctttgactagttcagatgaacatcggccggataagtcgatcttaggcagccggcaattcattcagattcattgtaaaccaaggaatcatcattgtcattactgcatctaaacaattgcaatttgatctgttgtattcttgtttgtaataataaatagaagagggagggaagaaccccaaatccccaatagcgtacaatgttaataaattgtgacccagtagcgtatacaaaaatcgtacaattgaagaatacagagctgcctggtacatgcaggataagaattgaatttggagtccaacttcgtatctgctctgcgcagggggaaaagaaaaagagaaacagggtatgcatatgctaatctctgtctgaatgatctccttgtaagagaggtttggtttcatctgtgcctccccacttgtgcacacgagctgaagcttgcgcagcctgaaattatatgtacattaatcggcaacagcaatggtatatcatgatgagcaactctctttatttttccatttaaaatgaaaacgaaaatgtaataatactatatattacctctgccttccagtctgttctccagactacaaagagtagaatgagtgtttgaagtgcaactccacagagcatgccaccccaaaccccctgcagccaatttaattttaatttttttctgtgatcaattatatataatttcgcagtacatatgcatagtactccattatattagtggaaaaaagaaaagagaaggaaggtaggtaggaataggaataggaatgggtaccccgactccgaggttgaagtagtaaccgagaaggtagccgacggggaggccaaagaggtagtagcaggcgaggttgatgtaggcgacgaggccctgccatccgccgccgacggccacaccggacagcaccggctgcacgctgttgagcaccatggtgaccccgagcaggccagcgatcctggagacggcgcggagcaggtgggcgtcgctggtgtagacgagcgccagcttgtcgctgaaggcgagcacgagcgccatgcagaggaggccgatgagcagcgactccgccaccaccaccaccacggcgtgcatggccgccctgggcctcccggagcccagctcgttggacacccggacgctgatggccgcgttgaggccgatgaagatcatgccctcgtagccgttgatgttcatgcagatccccagcgagtcgaccgccatctgggcgtcgtccaggtcccccgtgaggacggtgatgaggcccaggtaccatatctcgaggcacagcatcaccgccgactcgatggacaggcggaggaaggcggccaggtcgtggaacgccgccatggaccacccgcgccacccctccctgcaccaccccattatgtaggccacctgcgccagcgacgacgcccactgcgacacgtcgtacgccgccgccgcgcccgggagcccccaccccagcaccgacaccgcgaggtaggtgatgcccacgtggaacgccagccccgccacgccgatccatgccagcacccccaccttgctctgcgcctggaggaacttgcccgacgggaagttcacggcgaaggcgaaggcgcccgggaggatgtaaagcgtgaaccgccccgccgcgcgcgccacctccgggtcctgccccaccagcaggagcagcggctcggccagcacgtacacggggaccatcaggaccgtggcgccgagaaggatgatccaggatcgctggaagtagacgcccagcatggacacct

SEQ ID NO: 94551 - DNA, 2752 bp, Oryza sativa
cacgtcttcacgtattataggctcctactgggctttctttctttctgttgggcttgaatcctccctccaacacgaatcgcaatcgcgcgaggcattgtacatcggaataagtccatttttactcccttaaaattgacccaatcaatcttgacacataaactgttaaaaccggtgcaatttgactccctcgacggttttggtgagcggtttcgctgacgtggcatgttatgtggcgatgttgacccgtcttcgtcctatgaggcgttgacgtggcgcttacttgtaattagaattaaaaaaaatatgtgggctcacttatcattcacaaacacacaaaattgtgggacccactgacaggtgggacctacatgtcagtctatcccttcatcatcctcccgacctccccgttccatgccccatgccgccgtcgtcagagcagccagctctctagcatcgagaacaccggcgcgggcccggcgccaccggtggccatcttgctcgtctccgtcgagccctccagcgtctgggcaattgccgtggcggcggtggcggctgtcgtcaccgctctggctcgcgctctggctcgccgacggggacgccgcgccctcgccggagcactgtagctgatgctgcatcgtcgccatcgtggaggtcgaccccaacgcctcggggcctcgcgagcgccgcgcactaggagtggcagacgcggcgtgagtggaggcgatcgatctcgcacgggatccggcggtagtgctcgcgcaagactttgtctgggagttgcgcccatccccgaggccgttgatcagccgccattggaggagacgggaaaggattggatggagattggaggttagcagcgtactctggggcgaattgaaagggaaatggcatgacaggtcgatgtgagaagacaatgtgctactgtatattttttttagataatggaatataatattccggcctttactcaaaagagctacagccaattattacatagtagttttcataaacatagtgtaaatctaaataaatagaacacaccgaagatcactattattgaaaccagcctaacgtaaggagatcacaattattgaagtctatttgtaaatctccaaccataattggcaaatagttgtataaccgtggtctccaactttcggcatgcaaccttcagaaactcttcatcttcatcacacctttgtagttgtgcccaaaaccggagccaatgagttgccctgaaaataacctacatataggaaaatgatggtgatttgtcaaaaaccatatcgttcctactcagccatattgcccaacaaatagcagaagctccaacaagtatcagtttactcattttcttatcaactcccaaaagccacccattaaaaatatgagatatgctaactgaaagattaaaaccaaaagagaactgaactgctctccatagaaatttcgcaaaatgaactgctctccatagaaatttcgcaaaatgataatccataaagagatgttgaatagactcattcttcaaacaaaaagaacacctcaagctgccattccagttacgccttgccaaattatccttagttaacacaacccctttaagcaggtaccacatgaaaattttaatcttaagtggcaacttaagcttccaaatacacttgtttctttcgatatagccattattaattaaagctaggtacatagacctcaccgagaacaagccattctgatggaaattccatctaaaactatcagacgaatcattcaactgaatatgtactatagaggcacacaactgatgccaacaaacaagattctgaccaactaaagctctcctgaaagaaacattaagcggaacatatcccataacagtggcaatagaagatgttttcctcggaacaattgcgtacaaagatggatatttatccttaaaagccaagttaccaatccatctatcttcccaaaatctgatttgttccccattattgacaatccaagaacccatatttaagaaagtacttttgacattcataagaccagaccaaaaatgagaatcaccttgtttcctgtcaacttaggttatagatttattataaagatatttcctcttcaataaatcatgccaaaccccatcctcattaattaacttaaacaaccatttacttaaaagacatttattttgtatctccaaattatgaatcccaagacccccctggtccttgggttgacaaacaacatcccacctagtgagcctgtattttttcttatggtcatccccttgccaaaaaaaaccgcgatctataataatcaattttacaaagaacccctttcggcacctcaaaaaaagatatcataaacagggtaaacttgagagaacagaattaatcaacactagtctaccaccaacagataaatgcttgcctttccaactactaagctttttctcaattctctcttcaataagtttccaatctttattagaaagcttcctaaaatgcatcggaattccaaggtatttaaaaaggaaaggtacctaacttacaacccaaaatatcagaatagtgttcataacattccttggcctgaccaaagcaaaataattactcttggggaaatttattttttaggccagataacttttcaaatatcgataaaatcagtttcaaattctttgcctgttgcaagtcatgctccaaaaagataatagtatcatctgcgtattgcaagataaacacaccatcatcaacaagat

SEQ ID NO: 94552 - DNA, 1470 bp, Oryza sativa
ttatgttccatttggaaaatagcatccttaacctcattttcagaaaattccttagttaaggcttcattctctaaatatgaaacttgaggaatgtcagcaacataattctcatcaaattgaaggtcagactcatcaggagggccaaaaagacctttataataagtggtaatatgcgactttaaattggcatcaccacttattaaatgatcaccctcctgtaattgataaattctagttttcctatgttttccatttgccactaaatgaaaatactttgtattagagtcaccctctaaaatatccttagtcttagcccgctgataccatttaatttcttcttcccttagaatgacagataacctactcctgaaaaaccatctaatatcaacttcctcttgagacaggagaacagtctctgcctttttatccagcgcctccaacttatctaaaatatgctttttctcttttttgtataaaccactggtatgtttagcccatcccctaagatgctgtcttaggcggcgaattttcgcttgccaacgctccataggagtattgccctcatcaaccccagaccaaacttcttttaccatatcaacaaatccatcacgtaataaccaaccaagttcaaacttaaaactatgttgagcgttactaaaagaggaagattttgtatttaggagcaaaggagtatggtctgaaatatctctattgagagcaacaacagaggataaagggtatttttgctcccattccgtcgacactaaaactctatccagtttctcataggttgggtgtgccagattatttgcccaagtaaaattcctaccagtcatttgtatctccctaaggcacaacccatcaataatagcattgaataagaagggccatctatcatcataattatcattatttttttcattaggactacgaataatgttaaaatcaccaccaataagaattggtaagttctcatgactgcacatgttaactaattctgcaagaaattggtccttaaactcattttgtgcaggtccatacaccaacactaaggcccacttaaaattatcagctttatttcgcaaatgaaacttaatataaaaaaccccctcatcaatcaaaccaatgtcagaatttaataaattaatacccaacagaagaccaccagatctgcctctaggaggtttacaatgccataaaaaatctttaccagcacaaagattattaagagcagctgtagaaaattctttcttaacggtctcagataaagcaataaaatcaagttgatgttctttggttaaatcagaaacaaacttatgttttttcgggtccttgaacccatcacaattccaaaagattcctttcatttaaaactaattttattattcttcttcttttttttacccttcttaccattagaaatactattagtagaaggtaccatggaatccaaagtggactgaatattat

SEQ ID NO: 94553 - DNA, 885 bp, Oryza sativa
agttcatctgctgcctcgacgcaccgccccatctgacggagcgtggggctcctcaccgggagaccgcgctggcccccctttgccggttcggccggggaccctgggtgagactctaagctcccaatctgtggaaggttcgcgagacaggaagcacacaagacgccggcgatgtatacaggttcgggccgctgagaagcgtaataccctactcctgtgttttgggagatctgtgtatgaaggagctacaaagtatgagccagcctctccctcgttctaggttcccaatctagaaaagtccaaaaaaatctcttctctcagtgggcaaggtcccccttttatatcttaaggggataccacatgcaccatttccctcttttttgtggggacttcccccaccttttcataaatggacggagatttgtatcgttgccgtccgagtcaccttctgatgggacggcccacaactacctccactttcgccgggagcagatgcgacgtggaattgtggccacctgctgacgacatgaccggagtcagaccagtcacgtcggtcattcttgtccaccacgtgtcagcttagcaatctacatgttcgcccttcttcacacaacatcttgcttgtaatggttaggatgaagcctggcatatatctgatcaggactaacgtgccatctctgggaggtaacacgctagctccagctggggacgagcgcctagaagccctcgtcctgacgggatggggcgaggcgtgcgtcagaccgcctgtcgccacctaacccgcgatctgaccggtctgtgactggtcacagaccggataaatgagtgcactgcactgcgttacatgcggcgtgacacgctcagccaaaccgcaataaatgtggttag

SEQ ID NO: 94554 - DNA, 852 bp, Oryza sativa
atgcgtaacccactgttctgcactgtgcatttgctgtcttgcttgaccgtgtgaaaagtgtatccatttatgtcatatccttgccaggtggtggcactccattcaggaccctgtgacaaccactgaagtgtttcactagggcaattctgcaacctggcaatttcgttcttcaggcactcgttgaaagaagacatgtgcttattcctgacccaactctctgaacggcctgggtactcttgtcggataactgtaaggtgttcatcaacgtacggcaccaccttagtcatatgctgtaataccgtgaaatgagctttatcgtacaccttccgatccaactaatagtctttcttccaacaggaccaacaccgtcaagcctcccttcgtgatgagatcgtggtaatccaattgaagatgtttctgacatgtagtccacacaaaattcgatggcctcttcggtggtgtaactctcgatgatactcccctcggggtgtgaacggttccgtacataacccttaaggatccccaggtacctttcgcaaggatacatctgcgtcatgaatgctggaccacagcactttgtttgcctcacaaggtgcaccggaagatgttccattatgtcaaagaaagttggaggaaagtacatctcaagatgacataggggttctcacaagttctgcctgtagtttatctagtccctcgggatcaatgatcttctggccgattgcatggaagaaggaacacaaccgctggatcgggtgtcgcaccttaggaggcaaaatattccttattgcaacgggcaacagctgtgtgataagaacggggcaatcatgcgacttcattccaaccaactta

SEQ ID NO: 94555 - DNA, 1731 bp, Oryza sativa
ttggcgacttgataactcccatcggctgattccgagatgctgcagtcgataatgattctaagccgataacgtctttgccgattaccaaatttcactgttaacatatttctatatggcctctaagcttttcaatataagatgtacattagctagcaagttgcccttgccgcgaagaaattagacaacaaactaaagcatacttagtaggagtaatactctatatatagtcagttttatctcttctgtacctagcttgcttggaataattatatataagtgattaacaaactcagtataaagtacacaatgaacagatggatatgcattgatccgatctttttcgcgaacgctgcattgatccgatctatgcatgcatatgcgactagagaggcattcagaattaatctgtttaattagcactcatatatagatatgtgaagtaaaccaaacacacaacacagcaattacttggtgatgtttgattaagctattgctgctatactacacacaaatgctaaagaaagagaaatatatatggccctggcacttgaaccactaaaatttacctgtataaacgtacttatatagcttggatcgatcttgcattatattggctcaccttttgttaattaattagctcgagctggctagctatatatagcttgttgatcatatatatcatgtgagtatatatatatgccaattaattaagcaaggatttaattcatgaagcttaattaattaatctagctagagagctagtagggcggcggcggcggagggcgggcatggtgccatgcagcaagcccggcgtcgtgcattcccccgccgaaaagtagtggatcggcggcgccggccatgagtggcggcggcgccatcatgccgcctgccgctgcttcctcctcctcctgatccagcggcagcctctcgtaggtggcgttggcgaaggtggaggcgatcaccatgaccggccccgccgcggtgagcgtccccaccacgctgccgcccaccacctgcccctgcccgccggcgaggtacacggtcagcccggtggagcccggcggcgccggccccggcaggaacgtccccgtcagggacaggatctcgaaccgcccacggagcgccaccacggcgctcggcgcggccggctggcgcagggccacgtcggtcacggtgccggccccgctgagcacgcagacgccgcgctgccgccgccgcgcgaagtgcgcgatggactcggcgacatcggcgccgccggccacctccatgacgtggctgcgcagcgcgttcgggctgtcccgcgtcacgaagatgggcggcttgggcttgttcttggagcccggcggccgtccgcgggggcgccggttgcggccggtcaccaccgcgccgtccttgggctcgccgcccccggcgctggtcccgttcatctcgtggtcgtggtcgccgcttggctccttggacgccatgtcgtcgtcaccggcgccggtggtgtcgttgttgccaaggccgagggatgggtcggcggctgtcaccggcaggctgagccgcccctcgtcccaccaccggctcgccagcttctacctgcggcctatatatccaggctaggctagggtttaacttcttcttcttctttctcggcttccgatcgatcgatagatcccttcaattgattagcttctggctagctagtgcttcttgctcgctgcgccacctcggatatatatcatatgt

SEQ ID NO: 94556 - DNA, 2874 bp, Oryza sativa
accccggacggctctgtcacatttgagaacaaaagtgatgccgtcgtctatcaggaaaccttttgaagagttcactacttaacctaactaatttccgttcgtataaagtacaagttcgtataagcgactatcttcttttctagttgggcttggttactgaacaagcttcacaaagcgaggttgagtccgcgccgaagaggcgcgaagatgacatcctcacaaaggcgctcggaaccaaagaacatcctggccgaactcggggaattggtagcgatgtgccctggaagcatggactccctcagtacagatcccaatacaggaaacggaaagtctccaaggaagagaggtacgctcgtttgaaggccgaacttaaggttgaggtcattcaagaactagaagctagcatgaatgcaagggtggaagaaagggttaacaaggtcctcgccgacatgaatataccccgagtcacaacacctgctgtgcaaccaactcctcgtgtacaacacgacgcgagtccgtcacagcataggagtagttgtgcatccacagaggtgccggcccctggtctcccgatcgcaccactagttgcagtggaccacatcgaggtaattgttgttatccgatccatatctaataaaagacatgtacacattccaatattaaattcaaactttcaccttatgcagggcgcagcacagtgtgtcctactagcgagagtccacccaactttcgctcctgaagtcgctgagggcatggctttcaagccctcggttacagacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacgttcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgcggcaaggggaaggtcggggagttggcgccggagccaaaaaggggcaaggctgcgacgtcgatgccggtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatccggaagttggacactggtcttcttaaatgctactccttgtaagtgcataccttctatacttgtgatatgactggactatatctcctaattaaattagttctaatacgtacatattttaaggttgtgttggatcgagagtcgtcgccatggtaatcaggttgggttccttgatccatccatggtgaatgaggttaatttacgacagagcttcactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacactacataaccactgcgcaggcgacattggattctcctagtcatcgtacctaagtggagtcgggttacctaccttaactccaataagtccaaagattatgatttcagtgaaatcaccaaggccttaaatatggcttggggcccatatgtggaaaagggtggtaggcacaaggagggcaagaatgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctaaattgctattcaaaacgtgctaattaacctcttatttattaaacagaaaggtagagctggcttcaagatctcacccatcaacccccccgctatcagaggcgaattgtgcgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtactattcatctggtttctcctttttttttccttattgacaggttgtgcaggtcgatgacattatggctttaatccatttggtaagtatatatgcggttctatgagcaacgaccgaaattgtggctttaaaggggtgtgaatttgctgtgcaaaattgtggcatttgaactgcatatatgtgttgttggggatctgtgatgttatattgggggggtgatgtatctgtgatggatctgtgactagaatatatctgtgatgtttctattttgcagagggcatggctagcaaatcctgaggctagccaatatttagcatttatttttttttctggaattaactcatcagtgacgggtcggaacaaaaatcg

SEQ ID NO: 94557 - DNA, 3786 bp, Oryza sativa
agtataagtttgattttttatgggacggaggaagtattacataactgcagtttgatcgcagcaattgtactgatgtggtacaaggaggttccatgcatatgagtagggatggcaacggggctgcacccgtcgggtttcactaccccgtccctgcccccgaggtgatgaaattcccccgttcgccatccccatccccgtgctcgggggaaggtttctcaccgtccccgtccccgcagcgggtacggggcacccgcgggtcctagcacccaacaaacaaacaccaatatacatagaacaattgagcaggaacagatgataaagagtttacaaatacagttcacaccaatgaaaggaagcaagggtgaagaacttcaaaatccaatgtagatgtacaatagaaacagaaacttgatgcaccagtgaatacgagtggcgcacacactaaagcaatagataagtactacatgttgatgctttaaaatcagatcgagttaatgccgtgcaggtagcttgcgtctcacgacggcatcatcactcctggtcagcaagagcggagaaaatgagggcgacgccgctgtgagtcactgggggtggaggtggagcaggagagggcgccgccgcggggagccaaggccgccatggctccagtcacaaactgacgacggcgctgcaatagcgatggcaaagaggcgggctagaccggcgaactagtgaaaatagaggaaaggggatcggcgaatctagaaaaatgcgaaggggatcgggacttctctccgtgcgagtgcgaccatgcctgcgagcggcggccaagaggaagtggggacgggattgaaaagttagggtttctctatatatattgcttctaattgggcctaaatggactgtaacctaaggaatttgctgatgggccgtcatatcttggagccccatggggatacggggccggggagtggtggaacggccccgcccccggcccacccgatggggcctgcttttggccatttgttaccccgtgggggatgaatttaccccgatagctcaccctaatagaggaattccccaccggagaacggggaacggggccccattgccatccctagctgtctgtaaacttgcagccgcttctcatctctctcctctcctctctcatccacctcagcattcagccttcttatagccatctattatacttgctcttagtgataaaatatagggtagtactacttctgcaatatagggtaactatagtgagatcaactctaatagagttgctagatagctttattccaagttaaatttcagcaattttgatcaaaatacaagctccaacccagatggcttgtatggctagcctggatactagccaaatttggccatgctatttggttggccattttgtgggccccaccatgaatctctcctcatccccctctctctcccgcatctttcccgttgtggcctccccattcatcgctatcgccgacatctgtcgtcgcctttaccaccatccttcgtgtcttccccatcatcgtcttccccgcccctgaaggggttgtgcccgcgtgtccgagtccatcgacaacggcagtgtgccggtccctacgctaccccctccgacggtagttgaggatcttgtcgccctactgggcttccaagcgctcccctctctttccctatcctcctgaaccacctcccatgcttgcctccattgtcgttgcctcatccgacgctgcccccttggtcgcgcattcaaggccgcgccgatggagcaggcgagacactacacgggactggtgcaatcgctcgtcgcccgcggtggtgaacaacgcactctacaacctcgtgggcacctaccccaagagccgtgcgccttatcaccgtcgacgtcgcttcccgcgcaccgatgggtgggtggggaaaacaagagagaagaagagaggtgctgagaaactgacatgcgaagctagtaaaatttgaagagtggtagatagagagactattggatctaacaacaaatatggagaggattctttttggatagcttcccaaatggacaaatagagagtaagatttgccactatgttggagatgttttgataaagtacatatgtagtactataagtgtagtgtggttgaaatcaaattcgcattaggttcttcttgtcaatttctatggattactgtgtgtactatctattttcttatatacaagttgcattgggtacatcatacattgagtgtctttgaatggtgaatttgtaagcatcaacagtagtccagcagagcttgatatgtgaaaaggatttaagattcataactaaatgaacaaaaagtatgctaagatggacacataaatcacgttgaagctaactaatgccgaaatatctaagaggctacactacttaaaaaagggccaaaggtgtcggttcctaacaggccataggtgccgatttttcatccggcaccaattggtcggcaccaatactagcaaccgacacctatatggaaaatagaaccggcacctttagcattgctcaggccaaaaaaaaaagagccagctcgaatccaagccgaacttacccagtgccgtcaccgcgcatgcgcccatctcaaaatcaaattgatatccccaaacccaaaatcatccacaaatcgtcaccaaaataaactgacatcacaacaaattcacaaaataaaacatcaacaaaaattatagctagatggatccatgtcgatctgaagagaagaaaaagagatcgatggcggtggcggcgagagtagtggaggaggatccagatctagagaagaggggagggcgccgccgcaacctgtcgcccgtcgtctctcctcttgcgccgctacctgctgcgtcccttcccgccggatccagcggaggggatggtgccgccgcagcccgttgcccaccgcctgctgcctcccctcccaccgtatccggtggaggggagggtgccgctgccacccgttgcctaccggctcccctctagccaccgccgcttgcgcgagaagtgagagagccgagtgagaggagagagagagagagagccgagcagagagatggagagagagatagcagataaggttgactcatatagggaaaggccaatgcgtcgccgcgtcgggctagatcggctcggcggctcaactcggttttctataatttattataggtgccggtttttacgtaaccgacacatgtagcatatcaaaggtgccgggtttttttaaaaaaccggcacctatactatatgtgtcggtttttctttagaaccgacacctatagtttcttaaaggtgccggttttttgtattttcagtccgtggaggaggaaaaatcactataggtgctggttttagctgttccagtacctgtagtgccgatctctatgggcttttttatagtagtgctaccagaatttggctctccaaatacccttatagtgagccaattcattgagcaagtttggccaacacatatagtcgattagtcagcctgccaaggacatgatgtatacctaaaattctttttttttacaaaaagttatatgccataggaaaaaggaaggaaaaaagagactgtgttcaacccagaagtcttcctagctacctccctcctccgatgccctaaaacccgatttgataacattttcatcccttcacattttttttgaactttcacagggggagagcttccccacctgaatttcattagcaaaggtttgttaaaggggattagattacattagactaggtgaaaccccgcgcattg

SEQ ID NO: 94558 - DNA, 3524 bp, Oryza sativa
  unsure (1)..(3524): unsure at all n locations
tcaattgtcagaactgacaaagtggtaatcagtgaataccatgtctaagaatatgcatctttctaactgtagggtggcaagcattatgcattgtgggaagaccccctcaaagaaaccaagctacttatttgctttagttgctggtcagttggattgcagggaggactcatttactacatgttctggccgaaaagtaacacttagaatttggactcctggtcaagatttagcaaagacagcgcatgctatgtattctcttaaagcagctatgaagtgggatgaggaggttggtcccgattcattctcctatgtttttgtgcaattcttcgtcgtatcactaacacaatttattaatcagattactaatacaattctacctttggattcgtgccaggtttttggccttgaatatgatcttgatttgttcaatattgttgttgttccagatttcaatatgtaagccttctctcttattacattgtcatgctgcaattttgttcagtctccaagacctaggactttgtgttttgttttgttggtacagttgttcttccagtggtatttatttttctactacagattgttctcactaaatctcctgtgttggttaaatagcagatcagatctaccttatctctctaacaacactcgtactaataaacttttgtgttgttttgcaggggagcaatggagaacaagagcttaaacgtaagaatctctctgtggttacaaaatacttaaaacatgaaacaacactgattcctgttatatcaatgaacagatatttcaatctagacttgtgctggcatcaccagagacagctactgatggggattatgctgcaattttaggtgtcgttggacatgaggtacattatcagaaatgatcgattttcactcactatattctttctgatcatgaattcctgttgatactaacttatctttcactttatttttgcagtatttccacaactggactggtaataggtaaatatcttaacgacttcaccgtactggttacatctaataattaaatttcaacttctaaaacatgatgtgtttggttgatttgttgccaattgcatctttgctcgtgttttttcattagttatactatttttattgatctcacgagcttcagttagtttagaatcctccaaaagaagaggcatcctttcaactgtcctctgtgtcatgagattcgtcatgattagtactagttaggacagaatatatcctgatgaatatcttgtgcaannnnnnnnnnnnnnnnnnnnnnnnnnnnnnnnnnnnnnnnnnnnnnnnnnnnnnnngggantnnnnnnnnnnnnnnncaggtactcatgaaataggcttttagtgatttgctgcaatgtttgggttttatcgtgctctgttaataaattgaatctgcaggaattctcatcagatcttggttgtcgcacagtaaaacgtatagccgatgtttctaaactcaggacctatcaatttccacaggttgtgtttctttaaatttcccttcactagtactggattctaattggtttgatggcagttacatttgttttcttgttttaaatcattactttcctccctgatatccaggatgctggccctatggcgcatcctattcgtccgcattcgtatatcaaggtgacaatacttaactgtcagttattgtaactactttgtgatttttagccaccatacagatctgatattaattcttctaattttactggcagatggacaatttttataccggtgagttgctctgtctgtgaagtatgatgtgcatctaatgagaagtactacatcattagctaattattttcaatcattttatgccctggtgaacctccaaccttattatttgttgaatcttgtgtggtgatttgaacgtgaaaaacctggcagtaacggtatgttttctgttctgttcaattagctttcaataaagttgtatgggaattcttttgtctaaagaaatcctggaacgttctgacattttcttttgctgctttctactttttcatccaatgattatgggatttcatcacaggtttatgaaaaggttcgtttgatccaatgttttcttattcacttttgacccctaaccccagtgggatgtaatttgtggatatgtacttgtagggtgctgaagttgttagaatgtacaagaccatgtttggagcttcagggtttcgaaaggtaaaagttaaatgcagaaagcatgatgatgatttcttttctcccatggtggtgctgtgggcttaaatatatgaaaataaaagaaatgagaaaaccgattgctttgttatcttttggcaaaaaaaaaaggaagcaccaaagaatgagaatcttcatgagatctgtctcttttcttcagttatcaaacgtgtgttatctgctcgttctgtttagttaacagtttgtatctcctgcacagggcatggatctttacttccaaaggcacgacgggcaagctgtgacttgtgaagacttttatgctgcaatgtgtgatgcaaataacacccagctgccaaactttttacaatggtactagacatctatctttcaacgatgcacatgttgcaagcacaatctgatcttaaaacaaccatgcaatagtgtactctcaggcgggtactccaactgttaaagtgagctcttcatacgatgcaagttctcagacattttctctgaaatttaggtgagcttctacactaccaagtttttagttactttcacttaaagagttaacccagtttatgattctttttctgtattgcttgattttccgttcatgtttttaatccacggattatagatattttgcttcttccttttctgccttctatagataatttgtgaaattagaatattttcaactaattccttccgtccttttaaatatcttagtcaagaagtgccacctacccctggccaaccagttaaagagccgatgttcattcctattgctgtcggacttgttgattctaccggaaaggatatgcccctaacttccatttacagtgatgggatgctccaatcactcactagtgatggccagccagtcttcactactgttcttcaatttaataaggtataagaactgattattttccagtcaaaaattcctcttcaatggcaacttcagggccacaagttgatttctttggattatgaaccttgcatgccatgcaattaagtcatttgtgagattatcattttgaactcttgctatactttgatttttatagaaagtactaagaattgtgccttagtcaggatcacgtggttgagatgtgtaaagacatcaacctgcaatttttatattcgcgttcagacattacatgttcttgtctgatcttcaaaatggctgaatgagacatttttttcatctttcagaaggaggaagaattcatatttaacaacatacctgagaaaccagtgccttccttgttgaggggatacagtgctcctgttcgtcttgattctgatctgactgagagtgacttg

SEQ ID NO: 94559 - DNA, 1932 bp, Oryza sativa
cttgtgcaatttgcagatctcagaaggaaaagaagaagaagaagaagaagaaaagacttgcaacctgcagagttcagaaagaagaggaagaagaagacgcgtcgcaaacttcaaatcgagcgaagtggagacttgccgctcgccgccaccgccgttcgctgccacagccgatccggcccccacctgctacaaatgtctgaaggggaagagggcggcccctttcgccgagcgatgaccggcgaccacagcggcaccacgctgcccctctcctccttcccgcctcctcatgaatgaagccaatccccttgactgagctcggagaagacagaatcagtgccgccgctctcccgcccgctgtcgccactccggacgccgccgccgccactggcctccgcttgccaaatggggagggagagagaaggggaggatgaggaagggatagactggccccacttgtcagtggtcccacaaatttcttttgtgtgtgaatgataagtgagcccacatattttttttaattctaatgacacaagcgtcacgtcaataccacgtaggacgaagactaggtcaacattgccacgtaacgtgccacgtcagtaaaaccgctcaccaaaaccgccgaaggagtcaaattgcaccagttttaatagtttaggggtcaagatatctggttttatggttcagggtcatggattagatttaggccactttttaagggactcaaagtggacttattccttatacattccaatccggaaaaagtacaccgaaggtccctcaacttgtcatcgaattacaaaatcgtcccccaaccacaaaaccagatatatgacatccctcaacttacaaaaccgttcactttaggtccctcggtggttttgatcacggttttgtctgacgtggcggctgaatcagcgtggacccatataggcctcaccctatctctttcccctcctctctctctcacttttctcctcttgggcaggccggccggcgggtggcgaagaggtcgccgacagcggggtgcagtggctgtggcgcgtacctggccgtgccgccgggggcgcggtcggtgcgatgcgcgctctgccatgccgtgacgcgcatcccttggccacgccagccacagcgagcttagcactcggagccgcgagaagtagtcgctgatgacgagcagcgcccgcgccgcctgcctcgtggccaggatccggtgcatctgctggagtgtctgctacatcagcagatcagcctacacaaaaaaaatcatcgcatcacgccatggtaataagcaattcagttcgccattgatgtttgaccgaagcttgaggaagttctccagcgtggtgagcatggccatggcgatggccatctgtcccatgtagttagtgacgttgtcgacgaccacggtggtggccgccgatgccattgtgtctcccagcgtctgctgcagagtctccatcccctgcgacagcgcgtcctcggcctgctgcgactactgctgcaggttgcagatgcccatcaactgctgatccgtcagcggctcaagatggctctcaagaacctgcacaaacaacaacatcatcatcattcaacaatagcggtcaatggtagcttcagattctttgcttgttacttaattgggtgggtgatcactcgtgtcaaatcttgaggagctcagaggaacagaagccgccgagccacatgaagaagcgctcagcgtggctcatccacatgctggagaggacatggaatacgtcggcctaggtggcgaagctcttgaggcggaacacctggtcgtagtgcatcatcacggcgtcgacaagcacgcggagctcgtcctcgctcatcagcgcgtttgcgccgccgccgccgttgacgacgtcatcggggtgcgggcggcggcgagctacccgcgcgtctgcggcgagaagc

SEQ ID NO: 94560 - DNA, 618 bp, Oryza sativa
ccataggatccccgtacgtaggattatgtagctggagtgctggacgcctgcactgcactgcacgcatatgatatgatactccggccagctggactggagtatgttatgtacggcggagtcgggacgacattatattggaattagacggcggcggcggtgggcgtgccggcgtcgctcctgggctcggcggggctgtagatcgccgacggccggctgctgttccggggccggacctcctccagctgccgcaccacctccgccatggtgggccttgccgaagccaccggcgcgcagcaccccatcgccagcttcagcgcctgaagcagcccctcctccgcggggctacgcaccccgcgcgccacctccgcgtcgaacacctccatcatcgtcacctcctccagcaccgccgccttcaccaccgccggcagctctcccgacgccttccgccccatcagcagctccagcagcaatatcccgaacgcgtacacgtccgtccgcgggctgcacctccccctcgactgcagctccggcgccctgtacccgtccgccttccccaccgccgccgccaccagcagccggtgcactgcgtactccgccaccctcgccacgaaccactcg

SEQ ID NO: 94561 - DNA, 1282 bp, Oryza sativa
cccctgtggtcgccggtcatcgctcggcgaaaggggccgccctcttccccttcagacatttgtagcaggtgggggccggatcggctgtggcagcgaacggcggtggcggcgagcggcaagtctccacttcgctcgatttgaagtttgcgacgcgtcttcttcttcctcttctttctgaactctgcaggttgcaagtcttttcttcttcttcttcttcttcttttccttctgagatctgcaaattgcacaagtcaagacaagctagctcatctcaccttgatctctacggcttccaaaagcaagatggaatctaacaaacatatatatatatatatatatatatatacagtagcgaatccgtcttgtatatagttccgtattcatgtgatgagagagactggaggcattgggcatttgggcgacgccggctcactttggctccagcttggacggcgttttcttcgaagaaaccttcctccggtcgttctccggttgcggccgaggatctactgaagagcgagacaagaaagctcgtcttcggctacgccatgtggctgaggtcgcggcggcctcggcgttgaggccgaagcctgtgcatgtctcagctgctgctgttgatcatcagaaaaatggaatcggtgagtcttctggttctcgtttttcagttttgcaggctttgcatggtgaggagtcttggccgttggtgtcatcttctctggagtgcgcatcaaagccatggagtgggccgctgccgtcgccgaggaagtctccgccgagaactgttggtgaggctatctattcagcgctgcaagggaaagtatcatccgttttcccggcgaccgtttctggttctaccccggcgagatttcaatctcctccggtggggaagatgcggtttcaaaagtccgatttttctccggtgaagtcttccgattcggtgaggtttccacttcatccgacggtgacgaatttggaatttcccaaacttccggaggttacaaaatctgaatcaattaacgtaagtccacaatgtaccccttatccaaagcccgctatcccctataggcccatacccgggttagttgctctttttgcgaaaactggtaccgtgaggcgcaggtgtttggtgggagatcaatctccttctcgcgctcgctcctacgccagctgtcgctagttcttcgccaatgcccaatggagagaaacaatcgccagggtttcggtgctggcgggcatggcggtggctttgctcggggttttcatccgggttccgtaggtggtt

SEQ ID NO: 94562 - DNA, 661 bp, Oryza sativa
atgtttaggctgacgcaaaaagcatggaatggcaatgcaggttggggagcgcgggctgcagttgtcgggcgggcagaagcagcggatcgccatcgcgcgcgccatgctccggaacccggccatcctgctgctggacgaggccaccagcgcgctggactcggagtcggagaagctggtgcaggaggcgctggaccgcttcatgatcgggcgcaccacgctggtgatcgcgcaccgcctctccaccatccgcaaggccgacctcgtggccgtcctccagggcggggccatctccgaggtgggcacgcacgacgagctcatggcccgcggggatggcacctacgccaggctcatccgaatgcaggagcaggcgcacgaggccgcgctcgtcgccgctcgccggagcagcgcgcgaccatccagcgcccgcaactccgtcagctcgcccatcatcacgcgtaactcctcctacggccgttccccctactcccgccgcctctccgacgccgacttcatcaccggcctcggcctcggagtcgacagcaagcagcagcagcagcagcactacttccgcgtgcaggccagctccttctggcggctggccaagatgaactcgcccgagtgggggtacgcgctcgtcgcgtcgctgggctccatggtgtgc

SEQ ID NO: 94563 - DNA, 584 bp, Oryza sativa
cataaaccaacagctcatagatacagagctccatgtttgcgacgatgatgctgaggctttcggtgctacatcacaagggacagaagggacagtcatcaaatgcacatttactgctgtggctgttagccccagctagaattccatgtttgcatcaacacagatggtaagcttctcaaagcatgatctgtggtatctgcttttattgttcgctgatgttccatgttaaaaatgtgtggcaaagtccaattttgccattgaaggtgcttgtacccgctagctaccctaattgctccccggttctcctagacaagttcccagatgaacaaaggtcagactacaatgtattatcagattctacgccaagtactacatattaggctgtcctgattatctgtacataaataaactaatgatgttgcattgagcttgtgaatctgctatacaaactcagatgacctgtcgaccaaagcgaggtctaagttcagcatattgcttccgggtttagctgagcccatgtcactaaaagaaattgctaggacgtgggacgcgtgtgcccgcaaaagaaattgctgagtatgctcaac

SEQ ID NO: 94564 - DNA, 709 bp, Oryza sativa
tgggccaggtcagtcaatctactaaattaccttcaaaatatcagttgcatctgcaattctgcgcgttgcaaaatcattgcaagaatgagatgtaaattatatgtgatctgaatgtgcaatcgttgttttttgtgatcaggtggaaggcgcattcgtgcaagggatcggcttcttcacgaacgaggagtacacgaccaactccgatgggctggtcatcaacgacggcacgtggacgtacaagatccccaccgtggacaccatccccaagcagttcaacgtcgagctcatcaacagcgcccgcgatcacaagcgcgtcctctcctccaaaggtgaaatcatcgtcttcttcctttgagcactgaaatcgtgaaggaaatcgaaatctgaaactgttttgtgatccatcgtggcagcgtccggtgagccgccgctgctgctggcgtcgtcggtgcactgcgcgatgagggaggcgatcagggcggccaggaaggagttcgccggcgccggcggctcgtcgctgacgttccagatggacgtgccggcgacgatgccgatcgtcaaggagctctgcggcctcgacgtcgtggagagagatctcgagagctttggtgcaaagcctaaagatagtgggttctttggcgtagctttgtataaacaccaacaataatctgtgcctggatttgcggtgatgtgggatatatgtacagaa

SEQ ID NO: 94565 - DNA, 1820 bp, Oryza sativa
agaagttcttaaaggaaaaattggttagtgcaccagtgatacttgaagcagttcgttttttgaaaggtgttgtttcaccagctgaaggcacaacacatcctgaatacagagtcagcttggccgtcagttatctgttcaaattcctgtcttcccttactaatggcttggatgagcctgaaaatgctaatgttcccaatggttcatttactaatggaaccgcaaatggtattgttgattcctcgccagagaagcactcaaatgttgacagctcttatttgccaataaaatcaaggcaagagatggttttctctgatgaatacagacctattggaaaaccgatcgagaaaacgggagctgagctccaagcttctggtacatattctcttatcctaaattcctattctcaatccgagctcacatgttttacttttaattggactttcatagcctgaacatctgaacttgttatgcaggggaggcagtgtatgtcgatgacatctctgctccaaaggattgcctctatggggcatttatctacagcacacaccctcacgctcacataaaaggtgtaaacttcagatcatctttggcttcacagaaggtcatcacagttatcactttaaaggacattcctaccaatggaaaaaatattggatcatgctccccaatgctaggagatgaagcgcttttcgttgatcctgtttctgaatttgctggacagaatattggtgttgtggtacttacatctaaaccaactttcattcaaatgaggcagaactggtaacatgtctgaatattcagaaattttgtgaataaattcgagcttaccatgtcatattgccttgttgtcattcagattgctgaaactcaaaagtatgcctatatggcggcgaagcaatctgtgatcgaatatagtactgaaaatcttcagccaccaattctgacagtagaagacgctgtccagcataacagctacttccaagttcccccatttttagctcctacgccaattggtgagttcaaccaagccatgtctgaagctgatcacaagatcatagatggggaggtatgtacttaacacttttaaaaatagacagagaggttataattgtgtgaacgcatgacttaatatgctagtataatagtagaacaattttgatgcacactatctattgagcagcaggtgctaagaatgaaaggagcaaccaagattattatagttgagagttcctaacaattttaggagaaatacttacacccaatttctatttttttgttacaggtgaaacttgaatcccaatactatttctacatggagacacagacggccttagctatccctgatgaagataactgtataaccctctatgtgtcggcgcaactacctgagattactcaaaatactgttgcgaggtgccttggcattccatatcacaacgtccgtatcatcacgagaagagttggaggaggttttggtggaaaggcaatgaaagcaatacatgtgagcatctgactatgatgatttgcatttgcagaacaattatattcttgaactggtggaatttctcgtctaactctgtagttattcgtactacaatgcatatgcttttgtttaacaattataatagtagtacaatagtatttcataactaaaaatattgtgagaacttaatacatatttcattgttgtgggctattttaaaatgtgaaccaactatcgacggtttaaatgtctgttttgatagcgtcattagcatgaacttagaatttgtttggaatgcagaaagatctagatatgaccagaagtacctgttgtttga

SEQ ID NO: 94566 - DNA, 1024 bp, Oryza sativa
gcgaattcgagctcggtaccccatcgcgtctactctctcagtggacacgaacgccatcaggaggaagaacctccatgacttcgagagcctcaaggtgttttacgggaatagcgccggtgatccttcgacgtacagcctcgtcaccatcttcgacaagctggcgtcgtcgccggagtaccagcagagggccgccgtggtcgagcatttcaacgccggcagcaggtcgactctagcggggcactcttgcgtgccgatcacctacgacgtgaggctccggccatctccggggaaggtgtccatcatgaacgacggctccatcgccgtcgaggtcggcggcgtcgagatcgggcaggggctgtggacgaaagtgaagcagatgacagcgttcgcgctgggccagctctgcgatgatggcggcgagggcctcctcgacaaggtccgtgtcatccaggccgacaccctgagcatgatccagggaggcttcaccggcgggagcacgacctccgagactagctgcgaggctgttcggaagtcgtgcgccgccctcgtggagaggttgaagcccatcaaggagaaggctggcacgctaccatggaaatccttgattgcccaggtgaggatagcaatatagcatccttgtaaattcttgtttgagttttctcgtccttaaaaaaactaataactttttcagtaaactgcaagcatcagtaaagaaaatattgttttctgaaagatcattgtgtctgacagcattgtaaatttacaaatttgtgatggcatttgctcgttctcgctttcaggcaagcatggcgagcgtgaagctgacagagcacgcgtactggacgcctgaccccacgttcactagctacttgaactatggagctgcaattagtgaggtacacactaaagatacccagatacaaattacaacagaagctctgaaaatgcatttgccgaagccaatttgctgagcttgatctccttctcaaagctaatgcattgtccatccaaaatctgcacatga

SEQ ID NO: 94567 - DNA, 1568 bp, Oryza sativa
tcggcagcctgcaccactgcgcggtcaccacaagcgagggcatcggcaactccaggaatggcttccacgctgtgcagcggcggctctccggcttccacgcctcacagtgcggcttctgcacgccgggcatgtgcatgtccatctactccgcgctcgccaaggctgacaaggcatccggtcgccccgcgccgccgacggggttctccaagatcaccgccgccgaggcagagaaggccgtctccggcaacctgtgccgctgcactggctacaggcccatcgtcgacgcctgcaagagcttcgccgcggacgtcgacctcgaggatcttggcctcaacgccttctggaagaaaggcgtcgacgacgagcacgctgacatcaacaagctgcctgcatactccggtggcgccgccgtctgtacgttcccggagttcctcaagtcggagataaggtcgtccatgggtcaagcgaatggtgacacttcggcggtggtggtcaccggcgacggctggttccaccccaagagcgtcgaggagttccacaggttgtttgactctaacctgttcgatgaaaggtctgtgaagattgtggcatcgaacaccggctccggagtgtacaaggatcaagacctccatgacaagtacatcaacatctcgcagattccggaactctcagccatcaatagaagcagcaagggcgtagagatcggagctgtcgtgtctatctcccaagccatcgacatactgtcggatggaggcgcggtgtttagaaagatcgctgatcacctgagcaaagtggcctcgccgttcgtccggaacacggcgaccattggaggcaacatcatcatggcgcagaggttgtctttctcgtcggacatcgcaactgttcttctcgctgcaggatcaactgtcaccatccaggtggccgccaagaggatgtgcatcactctggaggagttcttgaagcagcctccatgtgattccaggacattgctggtcagcatctctatcccggattggggttcagatgatggcatcacctttcagacgtttcgtgcggctcctcgtccacttggcaatgctgtgtcatatgttaattctgcattcttggcaagaagttcagtggatggatcatcagggagccatctcattgaggatgtttgcttggcattcggcccctttggggccgagcacgccatcagagctagggaggttgagaagttcttgaagggaaaattggttagtgcaccagtgatacttgaagcagttcgtcttctgaaaggtgttgtttcaccagctgaaggcacaacacatcctgaatacagagtcagcttggccgtcagttatctgttcagattcctgacttcccttactaatggcttggatgagcctgaaaatgctaatgttcccaatggttcatttactaatggaaccgcaaacggtagcgctaattcctctccggagaagcactcaaatgttgacagctctgatttgccaataaaatcaaggcaagagatggttttctctgatgaatacaaacctgttggaaaaccgatcgagaaaacgggagct

SEQ ID NO: 94568 - DNA, 609 bp, Oryza sativa
ctgagcctgcggaacaactcgctgggcggcgccgtgccggcgtccgtgggtcgcatggagtcgctgaggtcgctggtgctcgcgtcaacaacctgacggggaacctgccggacatgagcggcctcaccaacctccaggtgatcgacgtcggcgacaactggctcggcccggcgttcccggcgctggggcggaaggtggtcacggtggtgctcagccggaacaggttcaccggcggcctccccggcgagatcacctccttctacctgctcgagcggctcgacgtgtcgtggaaccgcttcgtcggcccgttcatgccggcgctgctgtccctgccggccatccgctacctcaacgtcgccggcaacaggttcaccggcgtgctctccgacaaggttgcctgcggcgacaatctccagttcgtcgacctgtcctccaacctcctcaccggcagcgagccggcctgcctgaggcccgacaagaagccggcgacggtggtgctcgtcaatgccaattgcctcgaggccaccggcggagacgcgtcgcagcacccgtcgtcgttctgccagaacccaggccttgccggggggataactcacggcggcaggtgag

SEQ ID NO: 94569 - DNA, 1312 bp, Oryza sativa
ggctgagactattaacactgcttgctatatttcaaattgagttttcttgagatcaaaacttggaaaaacttcttatgaacttcgatttggacatcaacccaaagtttcacatttgcgtgtttttggttgcaagtgctttgtcttgaaatctggaaatttagataagtttgaggcacgttctaccgatggattgtttcttggttaccccacacatactcgtggctatcgtgtacttattttggagactaacaaaatcgttgagacttgcgaagtttcttttgatgaggctagtccaggtactagacccgatattgcaggtacattgtcacaggatcagggggaggatggtcgtatttttgaagacgagagcgacaacaacgacgacgacgaggtcggctcggccggtcagatcaggcgctaggccggtcagactgccggcacacctccggtcagactggcacaggaggtgcggtcagacccgccagggttgtcggctgaaggttctggtgatgctgttcgagatggtcctccagaaactacaacttcgaccaatactgatacagaacgtggatcaacttcagaagtcgcggctcctttgcacattcaacgacgacatccgccggaacaaattattggtaatataggtgagcggactacaaggtctaaggtaacgactcatgatgtttgtgcaaattctatatttgtagcttcttttgaacccaaagatgtgtcacatgcattaaactgatgaatcgtggattaacgccatgtacgaagaacttgaaaattttgatagaaacaaagtttggactttagttgaaccaccttctggacataacattattggaaccaagtgggttttcaaaaataaacaaaatgaggatggtttgattgtgagaaataaagatagacttgttgctcaaggttttacttaagttgagggtttaaattttgatgaaacttttgctactgttgctagaattgaagcaattagagttttgttggcttttgctgcttcaaaaggttttaaattgtatcaaatggatgtgaaaagtgctttctaaatggttttatacaggaggaagtttatgtcaaacaaccacctggttttgaaaatcctgattttcccaatcatgtttttaaattgtctaaagttttgtatggcttgaaacaagctcctagagcatggtatgataggcttaagaactttttgcttgcgaaaggttttacaatcggaaaggttgacaaaacgctttttattcctaagcatggtgataatcaactgttcgttcagatttacgtggatgatatc

SEQ ID NO: 94570 - DNA, 574 bp, Oryza sativa
taagaaggcatcgaggaaggagatcaagaggaggataaagaagcttctgtcatcgctggggcagaaacaccacatctctaaggtgttcttcagatcacgttctgaagctgccaatagcaatgctgtcattgacaacagaggtggtggtcagagtgacatggagacttttgtgtccgcgaagagctccgagttgtgttcattccgtaccgatgatgacgactccgagtcacgatcgtttcgtctcagcccgttgccaatcttcccaaccggaggtattgaattccagccacccgcctctccagtgaagataatcaagaagctcccatttgggtatatcatcggccgtcagctcgacggcgcccccgcagcagcggcgccatcaacgaagctctcattgagcttcaaaaagatgatgcataggttggttgataagtcaaagtcgaagatgatcaagaagaaagtgttacgtgctctcaagggaagatttggaggcggcgagcgacgaggcagggatggacatgtaagggaaggtaaggagagcagcgactatggtgaccgtgatggtgatggagac

SEQ ID NO: 94571 - DNA, 718 bp, Oryza sativa
  unsure (1)..(718): unsure at all n locations
ttattttaggatctccattttcttcgattaattcgaaagatgcttctattttttttaagcacgtataaactgttaattcaggttcaatgctacgaaatgcactagttataacctgtattgaaggaaagatcttctgatactctttccagagatcttcaagtctggccatggaaattgacttggctgcatattctaggtcagtgtttatgatagtttctctattctctctgaatgcggaaaaaaaagcttcattcaacaatgatagtaaatccctgggccggtaaagggtaaattgcaaacatcgcttaaaaccattcctccctttaagatcatccgctgtgcatctatcccaaactcgttgatctttctcaatatctagcttaaatgctactttcattcttttagctgacagcattaggagttgtgcccagtcccaatgcaaccttatgacttgaccctctatatttctcgagtaatcaggatcttcctttgatagcgacctaaatatattaatccttaaaaaaattattggacgaatgcattttgctttttgatttaattcaatagatgcatatgctagacctgcaatgattccaattcctatattatccggttcatacgcctcatctaagctatccattaatatgacaacttttctgtctgagcgttcaagaagtgatactattatattntctatttctgagatattcaaattgaa

SEQ ID NO: 94572 - DNA, 11133 bp, Oryza sativa
atctccaaggaagaagcatccatgatattatttcaatgtccagcagattgccaaatgtctcagtgggaggaaagaaccccatgtcctactcaaattggatatctcaaaggcttttgattcagtttcttggtcttttcatgtggaggtcatgcagcagctgggttttcgtcattgttgttgtaaccttttgtgtttggtcctctctacttctactcgaatactggttaatggtgaagccagggaggtaatctttcatcgtcatatggtctccgacaaggtgaccccctctcccccatgttatacatattggtcatggacgttctagatttattggtgaattgtgcgtcgctgcccaacatttttgctccttctatgaggatgatgcggttatgttcctaatgccggtgaatgttatctctattatcaagcaattgttgaaggtctttggtcatgcatctaggcttgtgaccaacttggaaaagagctcagtgacacctattcagtgccaagaggatgatttggagttcatctctagtatgctttcatgtgagtgaggattttccttgtacctctcttggtctcccgctcaatattcgaaagcctactaaaaactaagttgtgagctctagtggataaggtggctgacaatctcacaggttggaaagcttctctaatgaatcacgctgagcatctcatcatagtaagagtggttttgctgcccatcccaattcatcttatgattgcaattgatacaccaaaatgggtagtttgtcacaagctccaggcaattatagaataggatatgaatgagatgtaggcggccagggcttagggagcttggtagatcgcgacccgtggcgctgacaaatgcaaccggaaggagatgagaaaccaaagaatagtagatgagattgatagattaattcagcttgctttattccttgaatctatgcccttataagagcttacaattgtaactaatttagctgaagaaaagggataatatttgctaacaaacttgagagtaaatcctaactaattgagatgaagccgaagacctgcagcaatccgggatgcgtagctcaactcatgcctgccggcttcacgctcccatcgcttttgcgcgtttgccccttcggtggaacacaattccgaccctaacatctctcccatccttcagaaacagctcatcctcgagccagaatgcagggaaacggtgacgaaaatccgattcaatttcccaagttgcatctgccggtgccttaccttcccactgaacaagggtttcaggaacaccgcaagccaaacgaccctatattgccttggccggaataggaagaacacaaccatgagccatattatgtaccatggtatgccttgagggatagcggtagcggtagggacgaacggcgactgatgtggccccaggcttgaggtggatgcggtagtcgatagcccgtgccgacagcaagccttggggttcggcgaagaggtcctctaattccgccaggagatgctgcaaaatattgtcgatgtcgatcggccactcatcacatcgggccctgatcagcgaggctgtagaacatgacctcgcgtgtgctgcgccatatggccatgcgcatgttcttgaaatcccacagtattggccccaacgtttgcaaccattgcatgcctaggaatgatgtcgacagcacacaagtcaagggcgaagcagtcgaccgagaaggcctcgccatcgatgttgagcgcgaggttgcgacacaggcccgggctgacaaggcgatcaccattggccatgacaaagcgaagtccctagcacgccggctcaagatggaggaggtgatgcaccacctgtgcgtcgagccggagtcgacgagtgccacaagcccacaacacgtatgtcggctattgtaaccggaagcctcatggtgctagctccgtcaatgcctgatagcgtgttcacttgtggcaccgcatcgtcgttggctccgtcatcatccgtggagtcatcatactcaatgtagaacatccgtgcacacttgtgtccgcatacaaacttctcgtcgcaatggtaatagagcccttggagacaacgttccaccaactctgccggagaaaggcgacgaaattgttgttgcggcgcgcatcggctagggtttcggctggctgagccctggttgctggtgcgggcacaggtgacgctgctagcgccacgtcgcagaagtagggctgagctgaggaccttgtgcctgcccatcgtgcttgaccaccttgcactcatgcacgagcaagactcatggcctcctgaagatcgggctttttgagctcgtcgtcgacggcgaggtcgtcgtggagcccggccgtggagaacttaacctgctagctatcggtaagtggttcagtgatgcggctggcaagcgtgagaaatttggattggtacaccgccaccgtggaggtttgcaacaaacgcctgatctcaccgagaggattattgcgtatgggaggaccgaattgaccatgacagagctccttgaacgtgtcccgatccggcgggtccctactgctgctcgtagtggaagtaccagtcctggggcctccccgaagaaatgggtaagttgcccaggcagaaccccgggcccctggtgttcggttcttttggccctggaaagaaactggctccgccaatgggtctttcaagggagttcgttccctggcccatcaaatttgggaaattcaagtttatagaaacgaggaacgttgcccccggcatcaccgtgttggagtcctgcagtgcgccagagctcaatggttgcgggtgtgggttgacgggtgggaagccagggcgcgttgttggacgtagatgtagacgacgcaacctggaactgctcaagtgcagtgatgcgagaagtcgcaacggcgaccgatcgactgagatcaaccatatcaatcttggacgcgagcagcgaaatgctggcgaggacatccaccattgtcctgcagcttgtcgaggggaccagggttccagaagcggttgtttggcagtggaggtttcttccatggtctgatacaaagttgtcacgagctcctggcaatgatcgaataggatatgaatgagatgtaggcagccgacgcttagggagcttggtagatcggcgacccagggcgctgatgaatgcaatcggaaggagacgaggaaatggaaaatagtagatgagattaattcggcttgctttattccttgagtctgcccttacaagaacaaacatttgtaactaatttagctgaagaaaatggataatatttgctaaataacttgagagtgaatcctaactaattgagatgaagctaaagtcctgtagcaatctggcacgcgcaactcgcgcccactggctttgcgttcccatcgccttcgcgcgcttgtgttccccgtcgttccgcatccttcccccttcggtggaacacaattccaaccctaacagtaatcaaggctattgacaagatacgaagaggcctttctttgggcaggtcatgaaaaggctaacggtggcaaattgtttggttgcttgggagcaggtttgttggtcccttatgtacggtggtttgagaatccacaatttggaatataagagttgagctatgcgcatttgatggctttggttggaaaaaactggcaatgcccatgcttgggaagggttacctctacaagttccacataatgctcatactctttttaatatggccgttggatccatagttagaaatgggtagtgtattttgttttggtcaggtggatggttgcaaaacaaaaccgtggtggagataagctcttaatctgatcaagttgatgcctaaaaggattatcgaacgtcgcactatgacacaagccttagaaaaccaaagatgggttgctgatatcaaaggagcactcactgtccaagttattatagagtatgtgcgaatttgggacttagtggccagtgtggcccttcagaacggtgtaccagatcagcaccgttggaagctcccaaagtctgagtcgcatacctccaaatcagtctacgagtcattttttgttggcacaatcggattcgccccttggaaagaaacttggaagagctgggcatccctaaggtgcaagttctttgtgtgtggccataattaataacagcatttggatcactgatcgccttgccaagcgagggccgccacatctcatcgcttgtccgctttttgaccaggctgggggatacatcacctcctagttacttgtgtcttttcccaacaagtatatggtctcttattctcaaaggttagggctgatatccatctctccaaatcaggacaccaagcatttctccaggtggtggtccaaggctgtaagaggcgtcgataaggattccaagaaagggctcaactcgcttatcatgcttgcggcatgggagatttagaagtataggaatgaccacatatttaatggcgtcaatcctagtgtattgactgtcatccaaattgtggttaatgaatgtggtctttggtgcatggctgcagcttctaagctcagcgaattccttagtaggtcggtaacctcgcttaggtaaggtctttttgagtcgggttttcttgtaaatgtaagacttgttttggtgaggggtgtttttgcttcttccgtctcttgatgaaacgatatgcagatctcatgtgtatttaggaaaaaaaaaacttacttacagaaaagcgtagtaccatgcaaggtatagagcaaagtgttttagcaaccaactcgaaacaaagtcacttccattccacaagcaaaactctacccttgattggttgccacatcgcttatgtgatgttctggcttatgcagacaaacaattgatgtgatcacgaaaatgaaaaataacacatatctaactgtgattgacatttaagggtaaaatcgataattttgcagtcagaggtttatttccaaactgtggtaacaaggtttttcatgtatgcatttggggcaactagacttacttacgccaccaagactcaaaataaaatatgactgtactactgatgggatggggttagtgtaaaaagtcatgactgatacagtctacagaatcataacactgtactaggacaaagaaactactccctccgttccaaaatattgcaaccttggactgtataagacaacctagtacaacgaatctggacagggctgtccagacgtctaggttatgtctcatccagtccaaggtatattttgggatggaggtagtaaatttactaagaaaaacatctcaagatattatatcaactcaattgcatatcgagcaggtacaaaatgtaagactatatacagtacaaaagtacacagatgtcaatatattacaacgaagaaagtctatttagccctcgaaagtgggggtttgtctaataaacaagtatgaaactgggcatcagaccccctaaagtatgggggaccttcgtatatttataaatggaagattgaatgacaaagatgaaactattgttgtatattaattaccttagcagtccaatcatctgaacatgaagccagcagagaaccagttggatcccacttgatagcattaacttcactctggaaacaagcttaattgtcacaatcagaagatcacattggttgccaccttttccaatttcgcttacattctttttagaaaatgcaggagagctgtgcttcatttcattaaggaaaaaaaaatcacacatacaaccaagggctcacgagcccttcgcccaaaacacatccacaaatagcatcacacaaggcaacccatgaccaaaaaccaccctacgacagcctagtgcccttgagttattgacctacaaaggaaaacttggagcacaagagctccagccgggcaccaaagcctagcttctgttgacactgcccgcagaatctccatgatgtttggatgttacattgaaacacatgatatttgcatgggcaaacagaaagcatgactcaatgtttgaacacaaataatatcacagcattcaactgaacagtgttcacattcattcaatacatcctgcagcatcaacaattttgcagccaaccaacgtatgactggataatggaagacagtcaactgaatcaaatagaataaatagaaggaactagatagactgaatgcaaggaacttcttgtttgctaactctataataaatttgagttgttgggctaattgggcccagctccaactagagctaaagatctcagccatgaaaagtacagtttactaccttctctctactaatggctggttgatctgatgtgtattatacttagaacttctatgcaagaggatttgttttgtatttttaaaatctagaatcttttatttctgtcaagtgttaactccacttctccccatatccccatctttaacttgcttctgattccagaaatcacctctaaactccaaaataaagggaattcaatgcattttgaaggacagcacatatcgaaaacatgtactgcttggagaacaccaacctgatgaccactgaaggatttaactgggcgctgatccccaatcttgcaaacatagatcatattatcagttgagcatgttgcaaaagaattattgtttctccagtcaacatccagtgttggagctgtatgaaaaatagaggcagtttacagtttattgtgctggatagaaatgcatccaatgcaataaagataattataatgtaaaaatcagcactgttgtggcatgcaagcatacctgaatgaaattcaaattgctgcttacactcccatgtctttgtatcccacacaatagcagttttatcaacacttccacttaggaggaaatctcctttcttattccatttcaaggaaaatataggtcccttgtgtttgaacaaagtctgcttcaactctcctgataaattcaatatcatcagggctgatttttgggaaaagtttaaatgcataataagtcgttctaagctatgcagtacctcccaatttgcaaatctaatacagttaccatgcaaaactatgaactaatatacaaagccacaaaaaaaatgcatagcaagatagtaatttccttaccatcgctattccatattcttgcctgcccatcataggaaccagtagccaatagagttccttccccctagaagagacaacaggcaaaacaaatccaaagatgaacatgtcaaagtggaagaacatagatgcaaaaacaagtattttgcgaaatgtaaaataaacaagtgggctggtacagacgaccgtcaatagcaagcctattataaaactcacattccagtcaagtgtggtgacatccttgctcttctcattagttcgacccttaaaatgtttcaaaacatgaacacctggaggagatgattgtgtgatggaaccacatggtccatctggaattgtccagattctagctgtcgagtctcctgacctagcagcatgtacaaaatagtaatgtgagtcatcaaagaggatagataaggacagaaagcattggtgttaagcacgtatataaatataatttgcaacaatttatagaagggatgcaataggaataactgtataaagagtaaaatatgagcatgaaagttttgacaggctgacatatctctatctctagtactataaaagcgtagtttgtcctgtttgtttgtcccacgcggcgcacagcgcaccacccagacatgcatggaaactgcaccctcttggaaacattgggcttccaagaaaatccagcatgaaaaccaccccacctaaaaaacgaataccacaagaaaaacctggtggacactgcctgaaaaccatcccaccccttgagaaaaccggataccgaaagaaaaccaagcgggctgcatggacttcccctcccaaggaattgcgctgtgcaccccatgtccttgcccgcacacaccatcatggcgaattatggccctatggggctgcctcgccaacctctccctccccaaacttgaaactggaagcatgtgtcactctcagactctcctaattgcatttcttccatcatcatccctcatcatccttgcagaccaaagacatcttctggtcagtgacgaggaccaaattgtggcacagctatgcccttaaagagtgcggcagtatttttgccacgtcctacaggagaggtgctctatagagggattgtggtagttgggtccatctgtttgctcccctctgatctggtggtgtgctcatgaaatacattcccggtgtacccctcgatctccctctagcgcgattgctcaatcctccctgctagtattgtattgttatctgttatggtgaggctacttgatttggtgggttcaatgatgactgcacatactgtccagttgctgatagctatagcgctgcctgttgttgttgctccaatccaactaagagttagttgagttaaatattctcacattgtgcctagaattttcacccaacaagtgtgtaaatgttatttagaacaatattacactaatagtagaaaactcacattatgttgtcaaattaattccagtgttagattatttcctattatgttctttccaaatcaagcatctgtgcgcggggggcagacctacagtgctagaacctgggtcaaatgaccctaatgactgttgctaaaaactatggtcaaaatggctcaagtatgatcgaataatgtataatagaaaattaattttaaaagcttcaaaattgacatgatgtaaaattgtaaaaattatatttccgttgctataagtggacaatttactagtgtgaataataagagagaaaaatccaaaaattttatcttaacaagtctaagttccagccctctaggcatatctcaaaaagtattaaaatatggtgcaacacacctgacaatcgttcacatatacacagactagcagtttgatgtctatgtcaaatacaaaatgagatcataaggctacaggagcacaaacaatatcaatggaagaacacaaacatcgatgcagagataataaggactcacccagacgctagaagggaaccagctggactccatgcacaagcgaacacctaaatacaaagaaatttgaaagaagcagtaagagaacatgctttctagtactaatccatgataggtcaaatagctgtatggcagaaggctatttaaacctctgagctgtgtccttccaaaacagtcacatcagcactagaaatttcatgagcagttgtgcttacatccattggtgtgggacctgtagcaataagatttagtacaccctggcatggtagcgttaaactgatagacacaaaaatatccaaaaaatattatgaaggctccatacaagtgacaactaattccacaaggaggttgctactccaagaagcacactaattctacataaggaaattaaagcacaatatcctaaatcagttccatgaccattcatgtcatttcacttatgtaaatcaaatatcagaaatcaaacaatatattggttcatacaggaggttaaaatcatggttattatcaagcattaatgcacctaagaacacagttttagcgatttattgccatcaggaaacacaatagtaatacacactcacaaatgtaatagaaatgtatgttcgtgttactagaacatatgacacgtaccacaaggatattatggagtttttggcagggataattgatcatacaccacccataagtcacgggctctaggatatgtcactccagagaagctaattgattatttgccacctgttagataaaaatgctttaggaattgccatgttaaaattattttggttttttcgatttctatttcagtgattacatgacctagaccctactttcttttccagttttgcccatggtagcccaatggtttctccagcacgatgcatgactgaacaggagcatggatggctggatggtgagaaggaaaagtcagttggcaaggggagctaagtgatgtctctcctctcctccagcactacaccaggataaactccaccagggtggatctgttgtggaggtctatcctcaaccgccacgttaaaacagcagagcaaggacacaagtgcctgggcattgctgtgtgaaagcactgacaggaatagccatgccgcagccgtgtactgtgttctccaactcctctgcactgcgtgttgcctcccctcactgaccttgtctcccctgcagggcggtattgcatccacttccgtgtgccagtgctgctctggctccatgcgctcttgcttgcccgcctcgcctcccaagggatccatcccctcctccactcaaagctccacaccactagccatcgccaggcacaaagagaccggaggtggagaaatatgagggaaggaagaagagcaaaagggtacaagaaatgtgatctctactatcttaaaagtcgagtagttctccttccatctccttccatcccctcatccaacgcatgcggcatgtccgtatgcgaaaaataaccaccatcacttcctaattatatgggcttggcccattaacatacgggctcccagtttatccctaattatatgggggcctgacccgttacaacatacgggcatgaaactagttggtcaaaagtgggagctcatactaatcacatctgatgacgagcaaaaaaaccgattcaattctgcggagtggcatatcctggaattggaaagcttattgaattgcttccatacaatcaaatccctactgtgacaatatattggattttaactaagaaaatttataagctgaaaatgatacttagtactttgtccacatttctcaagtcgcaattgtcattctccgacttccaaaatacaccaaatgcatgttcaattgtcattctggtgtctgcattctttgcaagcacaagtgttatattaaattgagcaatctcacgcttttagatgcaataagataattctttgatggtcctgtttggtttcgggctaatattggctattacacaaagaaaaccaagtcaaaaaacttgacattaccaaaaaaaaaggtaaccagtttggtaagtatgtcttcataaatgaactggagagcttatgtggcatgttacccaaaactttcgcga

SEQ ID NO: 94573 - DNA, 1224 bp, Oryza sativa
ggcctgatcaacttcgtcttcaattatctcttcatctaaggcttgttcaatagatggatccaaggtgggcagatcatcggccggcttgtcagtcggtttggttttcttgaacttggcctttttctttggagccaagattgaagtgctcacagccgaggatctggttttcctttttgggcctgcatcggctggttctctagttaggccgtgaaggagagttgaggtcttgggggcatagtagccaataacagggggagatagcccacctccatttggaattaagcccgaagcatactcaatgttcttgccactattgctttggtgaggaggggaggactctgttgtctgcaaagcaggagcaaaagattggttaagtaataaatcgattaattgactacgcaatttgatagtaacaatgtttacctagggtatgacgtcgggggacagatctgtcatatacatcgtggctgattgatgaaacagatgtagcttctattcaccccaccatctgtcgaagtttttgcttctgaatccagccaactcaatattttcaatgctgccaagaggaggtcccgatagattgagtagccgatccatcattagagcagacgtgatttgtcctcggcactgaatcttgtcggcaaaaaataagccgattgggagttggcctaatccaagttgcctagccgagctcattgggtgataaaactcgtaggagacttggatgtttctcccttggtgaatgccgacaggaaggatgcaagggctgattgcggctataagaacttctctggatttctggaatttctcatggttaatatcttcgaatctaaaatctgatggaagttcgaggtctgctgattcttcataagggaaccagatccgggtatctttcttaaagccctcatagaagctgcagaaccagtccttaagcagctcagccgataactttgctccagcatcggttggtgtggatgcatattccccatatcatgtgcacctgcgatgagtacattcttctccgtcgtcacccacaatcggctctggcagtgggaactcagcttctgttacagaaggccgattgacaaccttcataaccatcaggtttaaccaagtttgcagtagccaccagggtccacctgctccaactgccgagccgacggctattctagccgatgtgttgttcaacatctggtacagatagccgagaaggattttgcccaa

SEQ ID NO: 94574 - DNA, 989 bp, Oryza sativa
tctctctcctcccccacttctcccacgttggccggcgaaatcccgcctctcccggccacgtccggccctcccctcccctatttaagcttccccgtcactccctctcgctttttccttttctcgccgaactccctcgtgctctccatcgctcccgcgccgtgcaaccacccgccgccgccgtctccgctactccggccgccgctagccgccgctaggctcaccgccgcaccgcgccgtcgccgccgtcgggttcgcgtggccgagatccaccccgtccacccctcctccgtagagattcgccgccggagccccatccccgtcgtgcgctggtgagtgacgccatggccgccgccttcggccggcgccctcgctctctcgcactctcctctctccctctaacccctctccttttgttcgttaggaggttccgaagctcgtcccgccgtcgccatcgtcctccgtcgcccgccgtcgtcgaccgttgtcggtgaggcctctcctcctctttctctctctcccgcactgtttagccgtcgcgccgccgcttagccgcgtagctgccgcttcacctctagccgccgctctccgccgccggtcggtcgccgtcggccgccgtcttgcgccgctgccgcatgtgcgccgcgccgtcgcgcgccatggtcgccgggccggtttgcgccgtgcccgcgcgcaccggccgcgagctcccgccgccgtccgatctacccttgggtagatcggggccatcggttcggccgccgcgtggcgcgccgctcctccccggtccgtggacccgatccgccgtggaccgccctccccgagccgctgaccggtggggcccgcttgtcggcgcccttcctccctccccgagccgctgaccggtggggcccgcatgtcggcgccgcgccccgccttgatgacgtcagccctggaatatattgcgcaataaatgatttaaggtttttcttgtatagtaataaacacagtga

SEQ ID NO: 94575 - DNA, 1135 bp, Oryza sativa
ctagtgtacgtgaactacaaccttcgccttcgaattcagcaagcaaatgcccaaattagggtggaggacgatgatccccttcaaagattagcggacctctcattctatgaaactaacaatcatatcagtgcctggatggacaatgctcgctctaatgcttgccccgaactagatgaagattcagctgagagtgacgctcccctgcctagtcaacttgtgtctgacctagtcaacttggatgacctgcgaaggaccacgggagcttctagtattgctgagtgggctgatacgaatgtaggtgacactcatattgggaaaaggaagactcgaaagccgccaaaagcacgtccatctaaaaaggtaaagggcaagggtccacgatcgactagtgttgatagcgatgaagagacccaaggaagcccagagtaccaagagtccaatgatagtagctcaagaactgaaacagatgacggcgacgacgatggtcaaggaggccaaggcactactaatgtgcctcctaggggtcacacccaacaatcagatcaccacagccccgttcaattcactggtgtgatataattcagttgcaatttcaaccttcatcttccaattcagtactggataattttcttgcaattttttgatttgcaggtgagggcgacttcactcatgctactcaggaccaggatcatggtgctccaagctctcaacgaactaccattgcaccgggagtccgacaacagcaacaattcagtgacatacaacaggatagctctagctcattcagtgcctctagctttgaaagtggctatccaacgtatgtgtacaaccgtccccaagcttctgattatcctgctactacatgggtgtatgaatggcaagagcctcagtggtatgctcaattgtacgctcagtggcaaacaacatcatcatggacaggtcaaagttgggaggaatacaaggcggggttgctacattcacatggcttgatgctcatgtccacagaggagtacaatatggcatataatcagtggaatgcgtagctatgcatgtccttgtttatttcctttcattcgaactagaattgtaatcgtggacattatactgtggactctattgttattgtggactatat

SEQ ID NO: 94576 - DNA, 548 bp, Oryza sativa
caatgcccgcctggttgattttcagtccacactggagcttgctggtcgttggggaggtggagaagtggcatcagctgacggcatgcgctttgtcacaccagtgaagaccatcaactcaggatctaacagaaaatattttggttctggacgaggcatcacctggtataacttcgtatctgatcagtactctgggttccatggcattgtggtacccggtacattacgggattcgatttttgtactggaaggacttcttgagcagcagacagggctgaatccagttgaaatcatgacagacactgcgggtagcagcgatattattttcggtctgttctggctactggggtatcagttttccccccggcttgccgatgcaggtgaggcggtgttctggcgggtgaataaatcggcaaactacggagtactggataagttggcccgaggatatgcagatctgtcaaaagcggagagtcagtgggatgagatgatgcgaaccgctggttcgctgaagttgggtacaattcatgcgtcagaactcattcgctctt

SEQ ID NO: 94577 - DNA, 574 bp, Oryza sativa
atccgagctaagatgaataagttatgaatttttaaagattaaatcggattaaatcatttatatagattttaattgaattatgatgcaataatgaataattttttaaaaggaaaaggggattattgcgtcagtggctcgggttcacggtggaccgggtgcacagcggcggtctacggaaacgaacggccgggatcaaccctatccaaaacagacggccgagatctaatcggtctaccgcggctcacgggaaacgacgacgatgacgtcggcgatgacgtcaccaccggcggcggctcgggcgcgcatgctcgccggcgaacaacggcgcggtggcgcaaacggagggcctctatgcgtagtggacgatgcagcgatccttaccgaggcacgaacggcggcggacggcgacgaggaaaaagcggcggcgacggtcggcttgacaacgacggcggtcttcccgcgatcctcggcgacgacggaggggtggacgaggacggcgacgggttggtgaacccgcgttgtccttcccaagcgacgatgacgacccgagcgacggcgtcgcacggctggactt

SEQ ID NO: 94578 - DNA, 540 bp, Oryza sativa
cgtccaatgaagttccaaagctgtatcaaagaataatatcatttactttagttgtctgtttctagtgataggcttttcactttttgttgaagtggcagggttgtgttgcatgtgcgataaatttttgcatgcttgtcaatgaagttccaaagctgtatcggaaaaaaaaaacatcatctattttagctgactttttcctgatacataactgacatgtgatctgtgtcagtgtccaatgatgtagctgcaactactttatgctgcacccgacttatatatatatttggttatatatgactatgacagttattgctgatggtttctcaacctttccaggtttcattcatgccgcattcacattagggtatgaagcagggatccataagggtgggattgatggaaatctagttccacctggtgctcttatcactatcgtgcagaaaggcctccaatacatagaactagaagcaaatacggatgaagtaagtttgtttgacttctagtgttcattaccttttctgatgcatgctacatcatgct

SEQ ID NO: 94579 - DNA, 676 bp, Oryza sativa
gctgtggtgatctgattgttgggtgtgacccctaggaggcacattagtagtgccttggcctccttgaccatcgtcgtcgccgtcatctgtttcagttcttgagctactatcattggactcttggtactctgggcttccttgggtctcttcatcgctatcaacactagtcgatcgtggacccttgccctttacctttttagatggacgtgcttttggcggctttcgagtcttccttttcccaatatgagtgtcacctacattcgtatcagcccactcagcaatactagaagctcccgtggtccttcgcaggtcatccaagttgactaggtcagacacaagttgactaggcaggggagcgtcactctcagctgaatcttcatctagttcggggcaagcattagagcgagcattgtccatccaggcactgatatgattgttagtttcatagaatgagaggtccgctaatctttgaaggggatcatcgtcctccaccctaatttgggcatttgcttgctgaattcgaaggcgaaggttgtagttcacgtacactagcttgttgagcttcttgtgggtaagtctattacggaccttcgtatgtacgaatgcgaatgtgctccaattcctttcacatccactagaggagcaacattgaccaaccaaacgcaacgcaagcttg

SEQ ID NO: 94580 - DNA, 1969 bp, Oryza sativa
attatctctaacaaactttaagataccataagtcattacggcagacttttgccccacacttatctataaggaatttacataaaatatcctaattaatagatacaattgccttcccaggactctatccatgcgtggcaatcatcttgaagtacattaaattgaacccgatgtcgcgtacaagtcgtattgtcggaatcggctacatcgacttacccaacacgactcatacccagccgatcttatcgtagccgatctggattttagccgattcctgctctgctttcaaacccgatttccgcttccgactttgcttcgatctactcttctctcccgacgctgatgttaccaaattcggttgttaacacatgccccccaagtccggaatatttggtaatgtttcggatttgctgtaaatcgactccgagcaagtttcgcactttaccgttttccgaccgttactgccgtgctttaaatactaaccgtcacccccgagaaacctcacaccgtgacacccgttttcaccgctcaagcagaacttattccccttccttctccggcgactcttccgacgcaaaggcgattcccaggcaacctctccttcgacgagatctccgcccgcggccatgtcatcctccgccagcccgtctggtgcgccaatagccgagtacgccgaggtaagttctcatcggctaaatcccctttccttagcaatagattgattttctctcatctcatacctcccctctcttttcgattgctttggattcgtaacatctttcccaccaagtcgcaattccaagcctttcacaccagaaccactacttccttggcccaatcggcaatctcgaccccaccgatttcatcactggtgagaccaaccggattccctttaggctatccaaccctaacctaggtcattggaagaacacctttaaatcctggccatctctcgaaaaacccacacccgacaggagttggtccacttggtatcaacgtgtatcggctagtaagaaagttcactgggatgagattggaatcggccaagcactagccctcaccatagccaattctgccaaagacgaacctctgatggctgccgccacctacttctggtcaaacaccatcaacgctttcctgttcaaccaagggccgatgactccaaccttaattgacatcactatgatcaccggactagatgtaacttcatcggccaaccccatgagcatgaataccaagaaccaattcgatttcaaaaccaagagcataggttgttggtccggctatgtggcagcatatatgggtcaaggatccgttacccctcgagagcacgtagcctttttgctcatgtggctggaaaagttccttttctgtggatccagttgtggccctacaaccaactggcagttcgtagccgaagccctggagtcaaagaaagaattccctttgggcaaaatccttctcggctatctgtaccagatgttgaacaacacatcggctagaatagccgtcggctcggcagttggagcaggtggaccctggtggctactgcaaacttggttaaacctgatggttatgaaggttgtcaatcggccttctgtaacagaagctgagttcccactgccagagccgattgtgggtgacgacggagaagaatgtactcatcgcaggtgcacatgatatggggaatatgcatccacaccaaccgatgctggagcaaagttatcggctgagctgcttaaggactggttctgcagcttctatgagggctttaagaaagatacccggatctggttcccttatgaagaatcagcagacctcgaacttccatcagattttagattcgaagatattaaccatgagatccagaaatccagagaagttttatagccgcaatcagcccttgcattcttcctgtcggcattcaccaagggagaaacatccaagtctcctacgagttttatcacccaat

SEQ ID NO: 94581 - DNA, 4544 bp, Oryza sativa
acggatacatccgttgctcacatcatggatgaacaacaagatatcaagttcgagtttttcaagtgccaaaatccaattcggccacctgctacactgctgacttcaaacggccgccgaagctccatacgacctccgtttttggcccgtgagtacttgatggaaagctctcggagtcctctttccaatgcatcaagcctcgttgccaaattccatctcagtcggcagcaactgaagaaacaaggtgctgcgacacctgtaatgggcctatgggcttgtaacttcatttgggaccccggcccaggtggggcccatgtggggtgcgccccaagctggtggagcacgaccctaggcacccctaggtcgtcctcccacccctatatatagctagttaccccttcagggtttctggggttttgttagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcaggtggtatcagagctttcgttgctcggtgagtttttatcttcctataaccagaaaatagccatacaaaaaaattcgtatcatttacctagccatattgtgccattgcattgttcttttcagtttttgctttgttgaattttgtgttgcatcgtcacgtcgtgttgctggtcttagcgtctagttcgtttagagtttcgagttctggtcacgtttttgtaccacagtcgtcgctgccaccgtgtctctgttgttgtcgggacctacgaaaacggaatcggctcgctgccacggttctatttttgtagttttcagaagtttctgtcggttagttttggagttattgagttgcatctagagtttgccgatccttgtgtgtgtttgttttggccgtgcctgtgtcgtgcacaagaggaggaaggtgaattaccatatctgattttggaagtagtcaagtttgttttggaaagatatagtagattggattggttaaaaatcagtttccgttttatcccatacaccaaattcggctgccatccactccacctccttgccgagtcccactcgcccctttggccgagtctgaccccctccctcaattccacggttccgagttgtgtcaaacaccttggcgaatttttgtttggtgtcggtttcgagatctgtttggaaaaacggaaccggcataaattcagcattccatttttttgtataattttaattttgggtttagacttttacatttgagtccctataaattttatatttatgtttgagtccctgtaatcttacattaaggtccttaagtcagtttttgttaaaaaaaataaaaaaaaaagtgagaaaaaaaagggcagaaaggtgcaaaaaaaaaagaaaaaaaaagccgcaccaaaaaaaaatcagaaaagaaaaggaaaaaaaaaagaaaagaagaaagaagaaagaaagaaaagagaaaatattgttttgtttgagctgaacttcatacatcagagtgtgcttgagttgtttctggtgctattttgtggtaccgtttgtgtctaggctcgcgtctctagtacgttctagcctaggaccagcacggtacttgactttgaacaattattcaactttgcattatctgatttgagcatttgctattcctttgctacgtatttaagcctacccagagctccacatatttgattacagccgtaccgcaagtgtttgccaaggcatcgatacatccaaccttcattggggtgcttggttgagtcggtgtatgtcaccattccacttgcattggtaagatcttgtaagagcttggttaaaagcttgagtgtgtgcgatttttgagctgccactacctagtagttaataggaacgcgcatatttttgtgtatgtttcttgttttctactaacaatggcagggatacgcaagataattggggatagctgtgctcaacatcgacatcttcgtcgagacatgaggagggatcaacatgaccattatgaggtaagtgatgatgttctaggtaagatcaaatctgcactgccttatttcgagggaaactatgatcctcgtgcttacattaattgggagctagcggttgatagtgaatttcaaaagcatgtcttgtcggagaaacaaaaggttatgtgtgcctctagtgttttaattaaacatgcttctaatgattggaaacatctttgtaggcataacaaaataccacaatcttggaaagacctgaaactatatttcagatatgtttatgttcccatgtattatgctgacattttgttcaacaaactgcaatgtttaaaacaagataccagaactgttacttcatactatcatgatatgcaagcttgtttattacgttgtggtttagatgaatgcgaagaagctaaagaattgaggtttttatgtgggcttaacaaagaaattcaggacatgcttgattgtcaaagatatacatctctttctcatttgttacaacttgcttgcaatgctgaaagtaaaatagaggaggatatgaaaaagaaacacgctatgtctttgcctccaattactaactatttgcaggaagtgcgtaatcacgaaaaggaggagagagacatgaaagagccaccaattccattgttcacacccaagttcgagacacctccatcatctaaagaggacatccaaggtaaagtaaatgatactgaaattaatcaaggtgagtgcattgttaacgaagtaaatttgtccacttttcatgcaaaagtagagcaaccgttagtggaaccaaatgctggaattcctttgtcacaagttgatttactcgctgttccttgtgataaagaagagttgtgtgataatgcttcacttatatccatgccacaactagtgaatgaacatgctattcctagtgtttctttgtgtgctgattttaagcatgctgttcacattgctaatgaagttgaggaacgtaaattgctatcttctttaaatactttgggctatgttcagtttaatgatttttgtgagctcgataatttgaaggagaaattattttctaagtctgatttgccaagtccaactaatgctatttttcatatctttggcaaatataatgatagaggaatatatttggtgcatagagttttcatttgttcggatttagagaaacatgttattgctaatcacactacttcgagtttctctagttttgattggatgaaacaggttattttgaatggactatataaagaacaccatatggaaaaaccgaggacggttttccgtgaagaaggggaggatgatatgaccatggctactacggatacatccgttgctcacatcatggatgaacaacaagatatcaagttcgagtcctccaagtgccaaaatccaattcggccacctgctacactgctgacttcaaacggccgccgaagctccatacgacctccgtttttggcccgtgagtacttgatggaaagctctcggagtcctctttccaatgcatcaagcctcgttgccaaattccatctcagtcggcagcaactgaagaaacaaggtgctgcgacacctgtaatgggcctatgggcttgtaacttcatttgggaccccggcccaggtggggcccatgtggggtgcgccccaagctggtggagcacgaccctaggcacccctaggtcgtcctcccacccctatatatagctagttaccccttcagggtttctggggttttgttagattaaagtttagccattgctacttgcttgcagcgcgcgtgtcggctagaccgtccgtctgcttgttcttcggaaccccaacttatcatttgtattaaattcctatttgcaatatcagattgcttttatcttgttcttgcttgtttcttcgatttgcttgcaggaatagggttgatctgcaccggcaagatcagcaacccacggagaggtgtatcgatcgctaaggtgcaacacaacgtctcgtacggttgtagtcggatcgtcaacgtttctcccaaatcgtagttatcacaactcaccgaaagatcgggccaacaacagccttgagtgtcgagaggaactcagggttcatcatatcggcttcaacctccttgagtaattgcaaccccttaagcactgcttcatattcagcttgattattagtcgcatacggtttgatagtataagcgaactcgaaagatgcccccctaggggaaattataactaagccgatgcccaccatgagtgcacaccgatccatcaaagaatataaagtccatggtactat

SEQ ID NO: 94582 - DNA, 807 bp, Oryza sativa
tggttttccgattgaaagatgaaaatcagattcgatgacaagttaagggacctcagataaacttattcctttccctaccccggcccaaacctagcgcacggcccaagccggcccagctagccaagctgagcagcagccgccgccttctctcctctctgggggtgcgccatgggcgcgcgtggcgcacgcgcatggcgcagccgctgctattgcctacggcctgcgccgccgcccgccgttctccactgtcacgcccagaaattcccgaatagaatttcaagcggaatgtgcattaaaatccccgtccaggaccagccggggtacacaaacgacaatgttgacattcagatccacgtcttacaaacatcataaaagtcttacacaaatgcagcggaagaaaagaaagacacaggagctaagccttgactaaaactgcagcgggaacaccactccacaggcatcctcgacggcacggacgaagcctactcctcggagaaaccttcatctgacacatactcgaactctggggttgggaaaagtagagcaagactgagtactacccactgtactcagcaagtcataccggaataggggtatgatgcacggaatcatcaaagaagagctaaagtggttcatttgcataaagcgagcatttataaacagaagttgaaagatttaaacagttgtaataattaaacaatatcagctatccactgtccaacgctaacccacgttgcgacaggcccaaccatccacctaaactatccaattttaaaagattacactagggtgagacaaatcatggtg

SEQ ID NO: 94583 - DNA, 835 bp, Oryza sativa
tgtattagcacagccttatctaaattatctttaaggtaaagactgattccaattggctttggcagatagaaaggaatgagaggcaccagaatcaaatagaatagtaactggtttagagtttatggtgaacatacccatcaatatattaggatcttgttgagcttcttctgctttaatatgatgtacttgaccacgtccaagattatgtccactcttaattattggaggatttttctttataaaacctgtagtagatggtttctgataagaagtttggcctcccatattttgacgattagggcatagtcttgcaaaatgtccaattttcccacaaacataacaaggagagtcttccatttttaatccaggtcttggtagtattggtggcatgcctggccttgcattgggtagagatgccttaaatggataaggcctccgaacttgtagtgaacctctagttagtgattgtcattgtaaattcattcttctcttagggagtccttccaccattctacgatcattttctagcctaaccactttattgactaggctttgaaaattttcatgatcttgactaatcattggtcctcgaagttcatcacgtagtccttctataaatctttcaatcttttctttttcatcttgaatgtccgaggcggcatatcgagcaagttgtgtaaatttaatcaaatattcttgtactgtcataaaaccttgcctcaatctacgaaattcattctttttcatcctgatcacagctgtaggtataaaagcatctctaaaagttgtagtaaattccatccatgtaataatatgtgtaggatcttctatagaa

SEQ ID NO: 94584 - DNA, 4274 bp, Oryza sativa
catgtgatggaagtagaagagcttagacgtcctttgatggttagtaccccaagtaaccaagcactctcatcacaacgtagcccctctgtcagaatagagatccaaggtgtaccctccctggccaaccttattctgttagaatccaaagatcttgatgtcatcctagggatggactggttagccagatataaaggtgtgatagattgtgccaatagaaaagtgactctcaccagcaatgatgggcgagttgtaactgttcatgcactgccctctgaacctctaaggtcaagtttaaaccgaataactttggaagaaattcctatagtacgggagtaccccgatgtgttccctgatgatttacctggtatgccgcctaaaagggatatagaattctgaatagatttggtaccaggaacaactccgatccataagagaccttatagaatggcagccaatgaattagcagaagtcatgtcgggtcccaaaactaatgattcggaaaccgacatgtttagactgtatcaagccctggatcagtagattgatacaggttcaacaatctagatcttcattgcatacatttgattaaggtttcaaaggagatacaaaataatattaggatatttacaagcttgtggttaactattacagcagaagctatagaatgactcaactctaatgttttgctatagacttaaaccatctatctaatctatacttgagaactaagttaaaatgagattaacttatatgattgaactcccagtttcggcaagactccaaattaactctgaaaaaggggttgaagcaagggtgagtacaatgtactcagcaagctattatattcaataataaatgtatgaaatggtaatatttgagtagagctaggtttaattgcagaaagctgagaataaagaagtagaaatcctgaaatgtttgatatgcaacagtatttaataaagtttgaaattatgtttctaaccaagataccattgtgagtcccaatgctcgataaccgcgagcacggctattcgaatagttttaataatattcatactgcagtagatgtacgctttacccgcaatccatgacgtgccaaacacattagccttgtcatggcaaagcttttcggttactaacatcagtggtacttgttccatgaactctagtccccatgcgctctgaatgtaacgttatcagcagtgagaggagttctggcgttcccgaggtttttggagagaactggttgagagacccccgtcatctcaatcagcttttcataattcacacacacagctcgcgagataatcaagatatttacctgcgcctcggtaaatatcacaatcgccctgctcggcgtaagttgcctcctgcgcgaggacttaagaagaaccactatacataggtaccacctttgctagataacttaatcagctaggtctatacccatacgagaattgaggtcgtactcgtatgttgttcacatgtacttggcaattttatatcggttggaacagtactagccacccggaaatcaaccatttctaccatactgtcccaatctaagttaattaaattttatgcataatctaactaggcagggctaagcaaaagctagcatatctggtttgctatgttcaggttatgcatttgaaatcatgtatgactaatgcatagaacagagatatagaatatagggtatttatgctcaaaggagaggaataataacttgccttgctccaacgccaataaatacgaaataggcaacctgattatctgatgcttgaaataccataggttgccatccatataaaatagactctactaaagaagaggaagaaccaaattcaataaaagccataacatagcaagaaagagataaacggttaggagggctagggtttagggtatagcttatctcttttatggggtatatggattactggctgatattttatatgtggtttctaaagagttggtggctggggtagagagggaattaagcggctaaggtcacctatattttatgtgcagactctgattagttggtggataggagtatagtggataattgaactggttgagcagatatgtgactggtattggctgatagtaggtttgggtaggattatacctagggtttggttatatttaggccgattgaggagtagggcagtatatcggccaggttctacattttatgtataggagctggatagatggagagtaaatggttgagattatagctggtggggagtctggctaataagctgactaaggtttcagttatcaagccgatatcgaggtaagataaatatcggctagggtttgggtgttcgctagtcgttgctaaagcatgacgactaggtttggtatcttctctagccggtgttgatagacaatataacgactagagggaagggagttttgtgcacgtttagcgaggcggaagtgttactccgacaaccgtgagtggcggcggagcggctaggatcacacaggtcccgaaagctaactgtgcggcgtgctgtggaggtcaaggaaatagtgaagctccgaccgctgtacgcatcgaggcgtggggtgccaggagcagcacttcgaccttaggtttggttttgccgggctttacaaccaacggtccgacgtcggggccaatagaccgcaaacatccccatggaaggcgtaaagttccaaccggcggctttttagtggctaatgggtattttggggtaaaagaaaatatttgaaaaaggcaaatataaattcaaatcatatttgaataaattcaaataaaattataaaataacaaattaggcatcaaaatgaagcatttgaatttatatgaatttaagtccaggtttcactgagaacggatctacggtttaggagatatgggcttctaaagattgggatttgaattaaataaagaaaatgggaaatagtactgtgcaggggcccacttgtcagcctttcctttcctttttcttttctctttcttcttcctttgttctcttctttctctgcctctcagtgagccgagagaagagagaggagagggcaagcggggcgtcggctctccggtggtcgaaaggcggcgacgtcggcggcaaaacatgttcccgagcgacgcgcatccggggagggtggtagctagtcaaggtgaagagggagatggccggaacggcggcgacaaaagctcagctccggctataagagaaggtggtggtgtcggtttatctcaaggtggagggagaggggaaaggggaaaaatggaatcacctcgtcgaggcgaagctaatggcgcgaggatttggttagtggagctctggtgagggagatcgggcggtggcggcaatggccggtcatggctggagagagagaggagagcttcaagctttgatgtggagagggaagggtggtcttgccggctatttataggcatcgggatgtcggttcgcagaggaggtcgtcgtcttggtcacggcggcagtggcgtgcaaggaagggcaaccgcggccggctttagtttcttagcggcgacgtttgcggcggctgcctggttgggccgatttgggccggctcagcttagctgggccggcagcccaagaggaaggaggaaaatagaaggaaaaaggattgggccaaaaggaagaaagaacggagtttcggcccgatgacaaaaagaaagaagtctaatttgtatacttgatttgaataactgggttttgcgaagaatttgaatttagagagaattcacaaaggagatttcctaatttatttgagtgcaatgtttagaggtggagtttgagggaatttatttggaagcactcaaataggaaaggaaattaatagtattccttaaaatatttttgggaatgtggtaggaaaataggtggaggcaaaaggataggatttgaaccctaaaatatatggcataagtttcaaggaattgtttgaggctaaaaggaaatttaggtgacaagggtataatttattttcttagcacaagaggaattattcacaatatttgtaataatattattcttgtgccgagaaggaaatcaagccacaggaattaaattagtggctagatcaaaaggaggaatttagatatttggcggcaaataagaataggtttggaatcaagggataggtttaagatcaaaggatgggtcgacaattaaatccaaatggaatcgtttggtttaagttctaggacaatagtggagaatttcttggaccataatctcataccaatagaaaggggtttt

SEQ ID NO: 94585 - DNA, 1922 bp, Oryza sativa
cggtgcagggaggcacggggagcgtttaaatagtgttgggagggggagagaacggccggatgagggggaatcgaccgcggaagatccggccgccattgatgcgccggcgaagtttgcgggagtgtttccaaacgaatccgagggagagagagagggaaaagtggggggaaagggagagggaatcacggggagtgatttccccctctttattgcgcccgggggcgcgctggatccgacggaatcctcggcggcgccggcgctagggcacggtcgagacgccggtttcggcgcgaggtaggggatgacgggtgggccccacccgtcagcgagggtgccgggcgggcccgcgcgtcagcggcgcgcgcgcgggggaaggccggatgggccgcgggggagaggagagagagggagggagctgggccgagccggcccaagagggggaagggggggaaaaagactttttagggtttttttctttttataaaacctttttaactttgtttatttcttcttaattattatttgtgctctgaaaattccactaaaatttatttacgcattttaggcttttaggaaatatacaaaaatcctccaagccttattcgacttttaactttgcacattttaattgttggaggctttcacatggattttacttattctatgcacaattttgaggatgtattttagagtcgttttgggacgcgacaaacctaccccccttaaacggaatctcgaccccgagattcggaagaactggcgaagagatcgggatgggctgccttcagcttgtcttcacgctcccaggtggcttcttcttcggcgtggttgctccactggaccttgcaaaaccggattacccggttcctggtcctgcgctccatggtgtccaggattttcactggcctctccacgtaggtcaagtcttcgcgaacttcaatttgctctgagtcggcctgctcggatggcactcggaggcatttcttgagttgcgacacatggaacacatcatgcacgttgcccaaggaggcgggcagctccaattggtaagcgacttctccgcgtcgggcaatgatacggaaaggacccacataccgaggtgcgagcttcccttttgtctgaaacctgtgtacaccccgcaatggcgtgacccgaagatacacaaaatcatccactgcgaattccaggttacggcgacggttatctgcataacttttctgccgggactgggccacctttagattatcccgaatggttctgactttagcttcagcttctctcaggatatcagtcccgaacacttggctttccccaacttgatcccacaaaagcggtgtccggcatttccgcccatacaacgcttcataaggtgccatttgtatgctggcttggtagctgttattgtaggagaactcggcataggggagactcttatcccaggtcttcccgaaatccaggacacatgcgcgaagcatatcttctaggatctgatttagacgctcggtctgcccatctgtctgcgggtggtatgcggtgctgaagtttaatcgggtacccagctcttctggaagcttcttccaaaagtgagaggtgaattggcttcccctatcggatacgattttcttgggaacgccatggagactcacgatccaagtgaagtagagctcggctagtttgttccctccataggtggtcttcacaggaatgaatcgagctaccttggttaatcgatccaccactacccatatggaatcatacccaccttgggtctttgggagtccggtgatgaaatccatcccaatttcatcccatttccattcaggtacttggagaggttggagaagtccggccggtcgtaggtgctctgccttgacacgctggcacacatcacaaagggccacgaactctgcaatttcccgctt

SEQ ID NO: 94586 - DNA, 2108 bp, Oryza sativa
cgattgatggggtattacttaaatgtttgagtgccgatcaagctaaggttgcgataggagaggtacatgaaggaatttgtggaactcatcaatcggctcataagatgaagtggttgctttggccatttagaggttgattctggggatgctataaaatttgttcaagagcatattatttatcgatttggtattcctcaaaccattacaaccgatcaaggctcgatcttcgtgtccgatgagtttgttcagtttgacgatagcatgggtatcaaattgttgaattcttcaccatattatgcacaagccaacgggcaaccgaggcgtctaacaagagtttaatcaagttaattaagagaaagattttcgattatcctcggcaatggcacacttgattggctgaagcattgtggtcctataggatggcttgtcatggttcgatccaagttcctccttataaacttgtttatgaacatgaggctgttttaccatgggaagttagaattggctcaaggagaacggagttgcaaaatgagttgacagccgatgagtattataatctcatggccgatgaaagggaagacttggttcaatcgagattgagagcccttgcaaaagttaataaggataaggaacgtgttgctcgacattacaacaagaaagtggtgtccaagtcttttttcggaaggtgaacttgtgtggaaattgattttgccgatagagactggagataacaagtttggcaagtggtcaccaaattgggagggactgtttcaaatccataaggttgtatctaaaggggcttacatcctacaaggacttgatggggaagtttatggccaagcgctaaatggcaagtacttgaagaaataatactcaagtgtttgggttaatgcatgatcggctggtgttgccgatacatgatagccgatgtatttacatcgccttgagatggccgatattgctatatcgcccttagttgtttttatgttgtaatcggttgtgatttgccgatgtacaatggccgatattgttatatcgcccatagttcaatttataattttatcaatgccttcgtccttgtaaaattaggggggcacatatatagaaaagttgcaaatttgaatttttgagtttttgaggaaattttttgagcaaattgaaagttatattaatcggcacagcagtacagtgatacaaggagcattaaagtttgctagccgattacaaagataagttatcctattacaagaccaatcatccagacaaataacactggatagccgatacaacccgttgtctaatttgaactacttcttcgatggcttggatgtcttgggcgtcggttccagggatgattttgagggacttggtcatatcagccacattctttatagccgatttaagtatggatttatgttcttcgacagcatttggaagattggctaacttttgcttctccagatccaactcagcattgcattcttcaagttgagctattagatcaatcttgcgggcttcaagccgatctatgttcgattgaatcggaccagcagagagttgatcaagcttggctttctcctcatgcacaagctgccgattggcttggatagtggcttcaatatcttttcgctcccgtcgatcagctattctttgcttagccttctccagcttgaattgatgttgctcgaggtatacagctggagtaatggtgttcgccagatcatccgggattaaggcttggatttcagcaaaccgtgcccggattgagccacaatcggccaccagattatccaatgatgactctagcggaagggatatgtcttcaagtgttttcttgatagtttcatccagagggtctagagccttgctagtggtttcttcctttgtctcatcaaagtaatcctttatatcaaaagagaacaaatcggctaaggcctgcaaaagagaaatccgaagacaattaaataatcaaacaaatttagccgatctaagatcttattatagagagaaacttactaggatggcacgagcggctggttggtcttcttcttcatgatgatgacttcctgtagctgatggggtacagtcacttgacatctgctatacag

SEQ ID NO: 94587 - DNA, 6305 bp, Oryza sativa
agggcctcttgccaccttatataggatgggggccaggattacaagatagaaactttaaccaatgcggtatcggtttcgtaaatctactttacaatattaccaaccaggactttaggctgttccgtaatatataaggaaacgtaatacccgagccatgatctgttacatattccatagatataagttatcccctatgactagtcggataaccatgccgtatgggtatggggtacccataatatccacagtagcccctgagaccttcgcagtcgaaaagataatcttctctcgaaccagattactccaaagccgagtgcttcaatcatcttcgtcatggtctcccgagtacttttaccaaatctgaagactgtggagggctggaaaataaagtcaggtgcaccgactggatgcacctaataggtgtagccctcgactatgcggttaagtgaacaaaccaagcatatagtcaaggaataaataatccaaccaaccgagtggcttcgataattatagttaaccaagcgacttgatattaatatatagcatatgcggtgtgaatccccgaataatatgatccaagtgatataccgactgcttggcaaaatatgatgcgtacaacctaaagttgacaacatctttgaaagttcacatagcaaaacaactataaagaagcttgaatgctgtgaataaagaaatttccaaagtattgggcatacgccatgcgcacactgctttaacagatgtgcttaagtccctaaaagacacatggtttcaccactcctggaaatatatggcatatatggtataacatccgagtaagtaaactcataaaggatctaccaaccgcctgaaaaatgaccataatatataatcagcctaagccataatattggtcaataaaaatgcacacttacatggcaaaaagcaatgatattgtatccaatcaattgcttgataaacccaaacagcaccttgactatataaaaaagtcagcggggcagctatataaagctttactgtttgacaccttttaagatgcatcgtaccaactcctaaaaagtcgagtaactgcggtataaaaggattttaaggtattgggcacttgatcacgcgcactttggcctaagcgaaaagtgcctaagtccctaaaagaacgtgacaggccacacctgaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggcatggagatgaaatgaccaacatgaagacgaaattgctcatcagaagtaacggaagatgtcagtggtagtaaaaacagtgacaccaatcaaaggtaatgaagttgcataaccatggaggcgaagaaaccagtcggcaacagtcaggtcagctagcagtgaagatgtaggcgcccaacaacaacaaaagaacagtcggtggtgacaaaagcaaaccgacgatgaagacgtagacgcgcatcaacggtgatggcgaaatccaccaatcatgaagatgaagaaaataatcggcggcgacaaacgcatccgacggtaatgatgattagcggcaacagagatagccgactatgatgacgaagtttcccatcaacggcagcagagtaggctatgttgaagaggcttaacaagatgttgatgaagatgacgatgtcggtgatccagtcaatagcgatgtagcagccgatgataacgatgagatcctctatcggcagttgcgtagtaggtcaaccgtcaaggtgaaataataagtcggcgaaaacataatcatccattagcaacagcggagatgtcagggtcgatgaagcagaggtgctggagatgatgtcagtgacaataatccatcaaattaatgttatagctgttgtagatgcttcacttggaggagagttgatgatgttgtccaactcgtccaaaccgaaatatttgaagttgttggagtagaatgtctgttccgaagcaaagatgaagataatgactcctggagttgactcattggcttatataaaatttgtcaaattttgagccttatatttgtgtagcccccgactctttggttagttgggaaacaactgaacatagagtcgagaattatagcttcttgtcgtcgagtagtcattgcttgattgaagatatgtgttgaaggtgtccaagtagaaatcctgaatattggagagtcacttgttgtagtaaaatatcatggcattgcatgccgagatgtcgaggttcacaaagacgtcatggttggtgaagtagtaaaacttgcgaagtagcagcaatagagtttgccggtgccgaagataataaagatgaagtcgctccaccatgatgacaaagttgtattgccgtaatgaagtgaacacaagtcggcggcaacagaagcaaaccggtagtgaagacgcgtagttgtgaagataaaagcaccaatcgggggcagcataatcagtcggcgacggaagatgatgatgtccatcagtagtggtagctgtataatccagacgtagaggtaagggcactagtcagcagcagacgagacgaccggcgatgaagatgtagatgcccaacaacagcggcataataggccaatcaacactggcagaatcatgcagccatggaagtgaagaaaccagtcggcagccatggcaaacgtaggcagcttgtgttgaagatactgatgcctattagtagtgacagcgatgtagtcagccgtgaagaagatagcatcagttggcgttataacaggccagccgtgcaggcggtgacaccagtcagcggcggatgcggtggccggtcggtgaagacgtagacgcccaccaacggcagcataataggccagccgtgcaggcggaaacaccagtcggaggcggcgaaggcaagccggtcggtgaagacgtaaacgcccaacaacggcggcataataggccagccgtgcaggcggaaacaccagtcggcggcggacgaggcggccggtcggtgaagacgtagacgcccaacaacggcggcataataggccagccgtgcaggcggaaacaccagtcggcggcggacgaggcggccggtcggtgaagacgtagacacccatgaacggtggtgtgaccaaccaaccgtataggcgaggacaccagtcggcggcgacggaggcaggccggcggtgaagtcgtagacgcccaacagcggtggcataataggccagccgtgtaggcggaggcaccactcggcggcgacggaggcaagccggcggtgaagtcgtagacgcccaacagcggcggcataataggccagccgtgtaggcggaggcaccaatcggcggcgacggaggcaagccggcggtgaagtcgtagacgcccaacagcggcggcataataggccagccgtgtaggcagaaacaccagtcggcggcgacggaggcaggccggcggtgaagtcgtagacgcccatgaacggtggtgtgaccaaccaaccgtataggcgaggacaccagtcggcggcgacggaggcaggccggcggtgaagtcgtagacgcccatgaacggtggtgtgaccaaccaaccgtataggcgaggacaccagtcggcggcgacggaggcaggccggcggtgaagtcgtagacgcccaacagcggtggcataataggccagccgtgtaggcggaggcaccactcggcggcgacggaggcaagccggcggtgaagtcgtagacgcccaacaacggcggcataaaggccagccgtgccggcggaaacaccagtcggcggcggcgaaggtaagccggtcggtgaagacgtagacgcccaacaacggcggcataataggccagccgtgcaggcggaagcaccagtcggcggcggacgaggcggccggtcggtgaagacgtagacgcccaacaacggcggcataataggccagccgtgcaggcggaagcaccagtcggcggcggacgaggcggccggtcggtgaagacatagacgcccaacaacggcggcataaaggccagccgtgcaggcggaaacaccagtcagcagcggcgaaggcaagccggtcggtgaagacgtagacgcccaataacggcggcataaaggccagccgtgcaggcggaaacaccagtcggcagcggcgaaggcaagccggtcggtgacgacgtagacgcccaacaacggcggcataataggccagccgtgcaggcggaaacaccagtcggcggcggacgaggcaagccggtcggtgaagacgtagacgcccaacaacggcggcataaaggccaaccgtgcaggcggaaacaccagtcggcagcggcgaaggcaagccggtcggtgaagacgtagacgcccaacaacggcggcataataggccagccgtgcaggcggaagcaccagtcggtggcggacgaggcggccggtcggtgaagacgtatacgcccaacaacggcggcataaaggccagccgtgcaggcggaaacaccagtcagcagcggcgaaggcaagccggtcggtgaagacgtacacgcccaacaacggcggcataaaggccagccgtgcaggcggaaacaccagtcggcagcggcgaaggcaagccggtcggtgacgacgtagacgcccaacaacggcggcataataggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcatagcccccaagcatcgggagtcggcctaggcatttcccaaacatgcatatgagtgacatgagttcgtcattaatggaacaaagtttcacggatcagaatttactactcaggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagacgcccaacagcggcggcataataggccagccgtgtaggcggaggcaccagtcggcggcgacggaggcaggccggcggtgaagatgacgatgcccatcaacggtggtgtgaccaaccgaccgtataggcggggacaccagtcggcggcgacggaggcaggccggtggtgaagtcgtggacgcccaacagcggcggcataataggccagccgtgtaggcggaggcaccactcggcggcgacggaggcaggccggcggtgaagatgacgatgcccatcaacggtggtgtgaccaaccgaccgtataggcggggacaccagtcggcggcgacggaggcaggccggtggtgaagtcgtagacgcccaacagcggcggcataataggccagccgtgtaggcgatgcatggacgcccatgaacggtggtgtgac

SEQ ID NO: 94588 - DNA, 1412 bp, Oryza sativa
taaaacaagtggaagcgctagcctggaaaagacaggaaggctgcgctgttgacatgcggaccccacatgtcaacctaagggaccacggcagaccgggtacacagagacggtccacgggtcgacggaagcggatcccgtgtgtcaaccgaggcgagtgaccgacaaacggactccactagacaccacacgggttgcacacgtggaaatcacgcggctaccgagcgggcacactaacacggtcaccacacgcacaagcgaacgactaccgacaccggtacacgggtaccggggtcgacaaccgcacaacgggtacggggcgacaccgaaaggacgaggacggggaagcgagaagacggatccttaccaccacgcgacgaggcgtgggaacgacaacgatgaacgggcgcggcgaagacagctcggggacgacggaggcgaacggcgagggaacgacttcagcggcgatccttggacgaaggcgagacgcggctggcacaaggcttgatgacgcggagccgaggacgaagacgaggacggggctgccgcggcttgcttgacggatgcggacgacggacgagaacggctcgacggagggacgaacgccacgacgaccgggaacgacgagaggacgacgacgacgacgaccggggaacgatgccacggtgtcgaaggaggagacggcggcgtcgatcggcgcaccggcgacgccactggacgccggcgggaacgtaactccgggggtctccgcgggaaacggagggcaagccggggaaggggaggtgactgcgatgccgggagaggcgacggcacggccggacggtgcgcgggtgaggtggcacaggcggctggaggcggccggcggcgtgggagagagaggagggcggcggggagaggtggtgaggccacgggagaacgcgggagggggctaaaactggagaacggatcgagggggttccattttatagcggaagggagggagccggccacgggagagacggggaacggcggcggaattcgtggtcggcggccatggaaggtgaccggggttggcgcgggcgttcccgacgattgggggcacgaatcaagggggaaattggggggaattgaccaggaaggaaaggggattaattccccctaatcaatttggaaagagccggctcgaatggggtggatttgcaggaggaacggcgctaggttttgcacgggagagagaagaggccgtgcgggaggaaggagatgaccgggtgttgggacccacgcggtcgcgcggtcagcgcgcgtgacgggcgcgtgcggcgcggcctgggaaggctcggctgggccgggacacggcccaggtgggaggggaagagcagggagctgggccgagggggaaggggaggcccaagagaaggagggagaggaggagaggg

SEQ ID NO: 94589 - DNA, 2099 bp, Oryza sativa
agtttttggtcgtgatgacatagtggactacagtaccatcattgtacagcgggtgctcagcacgcaggtacagcagcatgacaggttgcaacgccataatttgttttagatttttttcgtcatcaacaactgtcgtgcacgtgtgatcattgatggatgtagctgcaacaacttggtgagttctgatttggtcaataagcttggcttgactacatgtacacatccacatccttaccatattcagtggttaaacgattccggaagagcaaaggtaacacaggtttgtagggtttcgttttccattggctcatatgcagattctgttgattgcgatgtggttcctatgcaagcttgttcacttttgctggggcgtccttgggaacatgataatgatgctacacatcatggtaggagtaataaatacacttttatgcataatgggaagaaaattactttgctacctttgacccctgctgaaattgtagaagctgataaagaacgagctgctagtttgaaagttgatgaatctgaaaatcagcaagtggctaaatctgtttttccacctaaaaaggataagctttcacctagttctaaggttgagggaattaagttgaagggtggtgttatgcttgcaacgaaatgtgacattggtgatatttcaaatgatgatatgtgctatttcttgatatgcaaacaagccttggtttctttagatgatattgctagttcgatacctcctgttgttactaaccttttgcaggagtatgaagatgtcttttcagctgagatacccccaggattcccacccatgagagggatagagcatcaaattgatttgattccaggagcatcattgccaaaccgtgctgcttatcgaaccaacccagatgagactaaggaaattcagtggcaagttcaagacctttaggaccgcgggtatgtacgtcaaagccttagtccctgtccagttcctgtaattttggttcctaagaaagatggttcttggcgaatgtgtgttgattgtagagccattaataatattactatccgatattgtcatcctattcctaggttagacgacatgcttgatgagttgtgtggctatattattttcacaaagattgacttgcgtagtggctatcaccaatttagaatgaaacttggagatgaatggaaaacagcttttaaaactaaattcggtttgtatgagtggttagtaatgccttttggtttgactaatgcacctagtactttcatgagcttaatgaatgaggttttaaggccttttattggacgatttgtggtagtgtactttgatgacatattgatttacagcaagtctttggatgaacacatggatcatttacgtgctgtttttaatgctctacgcgatgcacgtttgtttgctaaccttgaaaagtgcatcttttgcatggaacgagtctcttttcttggatatgttgttactccacagggaattgaggtggatgagtcgaaaattgaagccatcaggagttggtcggttccccaaaccatcacacaggtgaggagctttcttggtcttgcaggattctaccaccgtttcgtcaaagattttagtacttttgctgcaccattgaacgagttgacgaagaaaggcgtggtcttccattggggaaagacacaggagaagtcctttgacattttgaaggagaagcttacgcatgcacctttgctacaacttccaaactttggtaagacttttgagttagaatgtgatgctactggagttggcattggaggtgtgttgatgcaagatggtaagcctgttgcatactttagcgagaagttgcatggtcctattttgaattattccacatatgataaggaattgtatgctcttgtacgttccttagaaacgtggcgtcattatttttggcctaaagaatttgttattcactccgatcacgaatcgacttacaatatcttcgctctcaaaataatttgaatcgtagacatgcaaaatgggttgaatttattgaatcttttccttatgttatcaaacacaagaaagggaaagataatgtgattgcagatgctttgtttaggcgctatacttt

SEQ ID NO: 94590 - DNA, 11262 bp, Oryza sativa
cgatctcccgacggccatggatcttgggaagtcgacctccaccgccgcgaccctgaagaaacttcaggaggagggtggcctccctggccacgacaaggcagagagggaagcaggaggtactactccccagcccgtcctaggtcgcatggttgcgattgaggattacattgtctgcgggtttcttcctcccccctctgaattccttttgctggtcttaaacttctatgggctttcacttttgcacttgaatcccaactccatcgcatttctcagcattttcgtgcatctttgtgaggcctacattggagtagagccttttctagatttgtttcgcttttattacgagttgcgttggatggaactcaacaaggtgtctggctgcgttgggttctgacttcgtgatgggatgaagtcgcaatacgtccccttccagtgcccctcttctcgcagcaaatggcagaacaggtggttttatctcgagattaaggactcgaatcctgccctcattgttcctgacgagcagccaaacaagattccggtttggaccgccaagccccctttgaccccctctctccaatcgtttatcgacatcatcgatgatcttcgagaacggggcttatcggggtatgaagtcgttgcagacttcgttggtaggagtatccagccgcttcaggctcgagcccacccggcgtataattattccaggccagatgacgcgacccgggtttctcctcggggtatgtttcttgtattcactttgatatggccgtattcgcgttcgcttttgacttatcggaaaatgattcttctttgatagctctgagcagtgacggcgtggagcgacgcgttggtcaggtgatgatcagcggcgcgacaaccgcgagcgacatccctgtgcccctttgtgaaaagggagaggcggaacgcgacgaggcgatcaatgtaagtctatttagatgtctttttcctccttcatttggaatcagcttgtgatcggacttagcgtaggcccttcccttgactgacgtcatcggaccgctcgcggatcaccaggtggcggcttctctgaaggagaaggtggtcgaggaggcatccgacgccgctgctggtagtggtggcaaggctccgagtaagccaaggaagttctcgtccgtgctcggacaccgtcgcaaggcagagacttcgacggtaacattcgccttgtcgttaagctgagcaactaggaaagttcttgttctcactggcgactttgcaggtttccgacgcatcccctcctcttgcagtcgtcaacgccttgtgacgatcggcgagaagtaagtcgcgaaacttctcagattcttaagtcttctttttgaaccgaactctgatccatcggtgttgacagggaggcacgagcgaaagcggctcgggccaagtctggggggacttctagcgcgtcccctgtaacagcgtcgactgacgtcgctcccgtgatcgggactcgggaggcgacgccaagcgggcccagcggcgaccccgtcagaaaccgtggcgcgccagagtccatcctcacctgggaggagctccaagtcgagatggggcgccttctcgaagccggcgctcgcggcattggtcgcgaggtcacggaggcgagggcggagacagcggcggctaacgcgcgcgcggagcggctgttgcgggagctggccgaagcccgcgaggacctcgtgaaaatgagggaactagtggccggcaacgagtgccaacgcaagggactcgagaaccgcatggcggaactcggagataacctctccgagatccgtggttctctgagggtcacatacaccggcctccaccagcttgccgcggagtgtggggtcaagtcgacgatccccaagaaccccgacgagttctccctcacctcttctctagcggagctggcgacggcgatgggagaaatccctgcgaagcaggcggcctgagttgcggaggagacgtccaacggtatttataccggggcgtgtcacgtcctcgcgtccgtgcggttgtcgcgtcctgaactagatctccgcgagatcctggatcagggggcggcaagcgacgcacgtaagggggtgatggaggaagtcggtgatctgggggagtctgtcctccccctcttcgaagagtaggagcacttgtatttttatttccttctcatgatttgtgaaccccaaactttggttgtcttcatgtatattactaccagctctgttcatctttgatcttgaaaattcatcttatcgattgtagagatgtcgatgatgaggatgtccggcagcgcgggcaacctgaatcgatggcgataaccccggtactcgagttagaaccgagcgcggcgcatatcgtcgatggccaggttgctgatgcagagaccgaagtggcggcaactgacccgagtgagtgatcttgtgcgccttgtcgctttttgttggtttccaagctgtggtaatgaccatcatttttggcagatctcgaggatgcctttgcgactcaagatcgtcgtatccaatactggaagacgaaatgtgaagtggcggaactcgagagggcgatgctagccatgaaaaaggaccaagctgtggaaacactccgaggtcgagaggtgtggttctcctcttatctgaagaattgctgcacctcgatggcgagggtgtgccgagatcttcgggtagcccgcggtgatcctgaagagtcggcggccgggtacatctcgtggctcaatggagcctgcgctcaactcgacggcattggtcagcggatcgacgaggccctgaagcaagagtgtcgtcgagcgagtcgatatgccggggggcatgtgttggcctgtgtgcgagatcaccgcccgcgcctggatctcgaatttcttcgtgagggttttggccgttctcggagaaatccggcagagattgaccatctcgcgagatcaatgtcgccgctggccgagaagattttcgttggccttcttggtagaatttgtaccctgtaacaagatatcttgggaaaagacgtaatttgacataatatttatgtgctaactgtaaggaatattttgtgaataaagaaatatatctttaacaaatgtttcttactctgggtgttgtttgtaagagcgtgttctcagttaacgaccttagttagccgtttgagttgtacactctccctagcccccagccttgtcgtcggagggatgtcctcgggtgacaaggctcttggactcctggcctgtcttggttgaaatagctctgatcctagcccccagccgtgaggttggaaaagtcaatttccgattacacggcttggttaatacgcacggcgagaactcttacacgaccaggtcttacatggtctttcgtctctgaaggatctgacaaggccttatcggctctgggcatccccagccgaagatgtcacgcccggaaattcactagtaatttccgaacttatttgtgcataaaatcctcgtccaggaatcagccgaggtacacaaactgacaattttaatatacaaatccatcttaataataacgttacatacttacaaagaaaagaaaacagcagcggaattaacggtctagcgatggcttcagctccactcccacaggcagctcaactggggtataagccaaatgtcttctccttctggatcctttatcttcaactgaggtttgatgattattgcaagaatgagcatatgacatactcaacaagccacatagcaaatatgcaagtgcacaaggataccaaaggatggcataatataggctcatttgcaaaagcagcatttagcaaaacttttaagagaagtaaaacagtggagtagttaatcagaaattttaatcaacactgaacagcacacccatgctgcacaggcccaaccatcctgaacaaccatacccggctgtacagatctaactccaaaccaggagctaagcaaattattaccagttataacatccataattattgtgagaggtgtgagactaatcacgaaaaacattgctcaactcgcccataaccgcgggcacggctattcgaatagttttactctggccagaggtgtaccactgtacccacaagacacgattccacacatgttgccatgccccgaaataccaccacggcattgcaaagggggaaatcgtgacaataccctttgcacaacacaactcaaaacagtgcaccgttcctggatcataatctccccctcaaaaccagaggcaatggactccccagcgacccccacggacttctcgccgcttcacagtctggcacactataatgaaccatgctatacaaaaggtaaagccgttgcccatgctggcttgtggttggcacggtaaatgtttcacaacagtagctcgcgaaccggtccttaattgtcatgagcacaaccatcaaaaccatatgctcacaacccaccttaaccagattttaattatcaattaattaacatcacacgattaaccatcgtgagcgaccattaaatataaccataataataatataatataatatagtttataattaacccctttagttagctaatgtttctaagcatagctaagcaaacttacatatagcatttagctgaaccaatccaatatataaggttcatgctaatcaaattataacccataggaaaataagatcatcttcggccattaattaatggggaaaggttcaccacccgatgacattaaaaaataatgcatagttgaaataaaataatagctttaaacgggtttaacatgctcaaagggttgtttgggatctgtgtgatttgccttgggcttccgcaaacgcttcggaaccttcctcaacggaaacgctctcctctggaacgtcggaaactaaagcgaaagaataaaaatcaataaaacagtaaaaaaaacaagcataaacagtacatgtgaatatttttaacatgtagatcttgattttagaaaaatttagcaacttgaaccacctgaaacagagttacggttaattagttatgattttccgaagatttaatctattagaaaaacgggaaaaagagaaaccgatgatgtcacgatgacatcatcaaaggtggccggcttcggatgacaagctcgccggagttagagcagccggctgcggatttggaggacacagacacatagagggcgacgagacgaacccaacggtactcaccctcgaaccaaacgacgaacgatgacggccggcgacgaagaggcgacggcggcggctcggcttgcacggggcggcggagctccggtgaccggcaacggaaaaggaagggtggccgagcttcccctcaccacggcgtacccaacggtggtgacggcgaccggcgacgacgatggaggcggcggcgcggcggcaccggagatggccggcggcggcggtttgcttggcggcggtggcgacggagctacggagcacgggaaggctcgggaacaggggcaaacgaaagaggaggactagggggtcctatttatagccttggattgaagagatcggactcctcccgcaagaaatcggctcgggaaaaacaaaactcggtttgggagataaactcgaaaacgagttcgattcggacaagatactcaacgaatagctccgattcttgaggggaaagatagaggaggatgtggggataaaaacccctcaactaatcggactcgagggcgaccggaagaggcgaaattggcggagagaggcggcagctcgggctcggctaggcggccggccggctggaggttagggatgaccccgacaggtgggccccacatgtcggtggctagaggaggagggggcggggcggctcggctgggccgacttgggccggcttggccgcgcgcgggaagagaagagttgggccggaaacggcccaacaactttagggaggggttttggaactttttaattaaaataaatggtgaaatgttgtttcaattattaaaaatacttcccttgctcaaacaattcccagaaaattctagaaaatagaggaacaagcaaagtatttaataaaattttatctagcccaattttatattgagatttagcaaattaaacttagatcttctcttttaagcttttaaaatcatttctaataattccttttaaacaacaatttataatttaaggattttaaacgataaaagcacttaacaattataattagatcattattgatcaaataattactgaactgttctttgtatcatttaggaattgagctccgaaaaatccgagaaaattccagagagtataattaaccatggagaatttaatgaaaattaaatccatccatgctttatatttaggaaattttatttcctacatttaacttcacttgtaaattaatgaacatttaatataaattctaataataatttattaaataatttataaatcctgaaataaaaatcaggatgtgacagaagatcccttgggttcctcggaggccttgtcgagacggcgtaaagggacagtaggataggtttcaacgctaggcgttgtcagagtgaggggttgtcgggtgaagatactttagttgttatatgtgaacaaaaaagtagtctttattgccttacaggtacaatggtattgactcatacatagaatttacgtagttggtcaacattccatgaatttgctaattcgcgaccgtcgcccgtctgcgattttgtatgcgcctggccgcaaggcttgtgtgatcgtgtagggttcttcccatttcagtgagagtttgtttcgacctgcctgggtctgaactcgtcggaggacgtagtcgccaattgaatgtatgcgtgctcggatgcgcttctcgtgataacggcggagggcctgttggtagcttgctgctcatacggcaactcgctcacgatgctcctcgagaaggtttacatcgatgtctcgctattcatcctggttctcgtcggaatgcttctgtacttgagtactctgatgtcgtagctcaccggggagcatggcttcagaaccgtatacgaggaagaagggtgtttccttattggacgttgtcggtgtggtgcgtatggcccatagtactgatgggagctcttcaacccatttcttgtcatgtgacatgagtctctcgtagacgcgggtttttatcccttgtagtactatgccgtttgccctttcgacttatccattgctttgagggtgagagaccgaggcgaaacatattttgactcctaagccgatgcagtaatcttggaaatcggcgctgatgaattgggagccgttgtcggttatgatgcggtgcggtagtccgtatctgcaaaatatccctctgatgaacttgatggcgttatcggccttgatttctttggttggtgatgcttcgatccatttggtgaacttgtcgattgctacaaacaggaatttgtagccgccctgtcctcgtgggaatggcccaagtatatctagcccccagcacgagaacggccaagtcagagggatagtttgaagcgcttgtgcaggtagctttgtgtgtttgctgtggaattgacaggcttcacatcgctggaccatgttgcatgcatctttaagggccgttggccagaaaaacccttggcgaaaggctttgccgaccaatgtccgaccggcggcgtgcgacccacatatgccttcatgtatgtcgaggaggagttgtctgccgttgtcggtagagacgcatttgagaagtatcctgtttggggcttttttgtataggtcgttgccgatcatacagtagatttttgctttacgggttattttctcggcctctgtatagtcttcgggtaactcctcgctgctaatgaatttgatcaatggggtacgctagtcatccgtggtttcgatgttagccacagcgcgttatgcctcggtgacctccgagctgatgtcgcgggtgctcgggccaacttcgccgctaacttcttttaccgacggttttgtcagtacgtcgagaaaggtaccaggttcgagcggttctcgtctggatgcacgtcgcgctaagtcgtctggctcgacattgtctttgcgatagacgtgtcggacttcgatcccatcgaacctcttctcaagcttcctgacttctgcaaggtacttggataactcggggttggaacacttgtagtctttgtgtacctggtttgcgacaagctcagagtcccctttgacgattagtcgcttggccccaagtgcggctgcagctcgtatcccggcgagtagtccttcgtattctgcagtgttgttggttgccctgaagttgaggtggattgcgtgtttgaattgatctccggatggagatgttaagataaatccagcccccgctccttggttattgagtgcgccatcgaacaccattgtccatgtctcattgtcgctttggttatctggcttgttatctggcatggtccaatcggccacgaagtcggcgagtacctaagacttaatggctgtttgcggcacgaagtggacatcaaattggcttaggtcgactacccatttcgcgatgcggccgacaacgtctttgtttctcacaacttcgccaagagggaaggaggaaacaattgtgaccctgtgggcttgaaagtagtgacgtagcttccttgatgtcatgataactgcgtagagcagtttttgaatctgtggatatcttgtctttgcgtcatggagagcttcgatgacgtaatagactggttgctgtactttctctcgctcgacgacaatgacagtgctaacggagtatggcgtagcagcaatataaagaaataattcttcattaggttggggagcaacgagtacaggagggtttgataggtagcacttgagtgcaataaatgcctcttcggcttcctgtgtccatacaaatatgtcttgttttttcaacaaggcgaaaaaaggctgtcctcgttctcccatcctagcgacgaatctgcttaacgccgccatgcatccggttagcttctgtacctccttgagtcttgtgggagacttcatgttctcgattgctttgatcttctcgggatctgcctctattcctctgccagaaacaaggaatccgagtagcttgcctgacggtactccgaacgcgcacttctctggattgagcatgagacgatatcgtcggaggttgtcgaacgtttcccggaggtcgtcgatcaatgaatcgcttgtcttggttatgacgacgatgtcgtcgacgtacgcctcgacattgttgccaagttgattgctgagtgtgccttggaccatgcgttggaaagtgttgccagctgttatcaatccgaagggcatcttgacgtagcaaaatactccgaacggggtgatgaacgttgttttctcctcgtcctccttggccatgctgatttggtggtagccagagtaagcgtcgaggaagcttaatagttcgcatccggctgttgaatccaccagttggtctatttgagggagagggaagtgatccttggggcacgccttgttgaggtctgtgaagtcgacgcacattctccatttaccattggctttccacaccataactggattggcaagccactctggatggagtacttccctgatgaagctagctttgagaagtttgtcgagctcttctcgtatggcttgttttcgatctgttgcaaatctccgcagtctttgcttgactggtttggcatcgggtcgcaccattagtttgtgctcaatcacctccctggtgacccccggcatgtcggacggttgccaagcgaacacgtcggcattgtcgcggaggaaggcgatgagcgcgagttcctatttctcatctagtgtagccccgattttgacagtcttgtcggggttagcactagagtgtggaacgatcttgatggcgccgtccggcttcggcgtcttgtttggcttgctcactttcttgggtggcttagacgtggcgggtggagtggacgtttgctcgaccatgtcgaggcttcgcttgtcacactgcaccgccagttttgcgttcccttgaatagtgattgtccccttcggccccggcatcttgagtacttgatatgcatagtgggatgcggccatgaacttcgcaagtgcagtcctcccgatgatggcgttgtaagctgtatcgaattcagtgacatcaaaggtgatttgctctattcggaagttgttggcttggccaaaggttacaggcaacgtaatcttgcccaaaggtctggatgatgattggggagtaatcccatggaaaggttgatcagtcggcgtcaactcactttttgggattcccattgcatccagagtgctagcaaaaaggaggttgatcgagctgcccccgtcaatgaggactcgtgctaccttgatgttccgaatagtgggttcgaccacaatcggataccgtcctgggataaccgcggtcttgggatggtctacttccgagaactccatcttctgctcggaccacttcatcttgggtgcagccccctgccatgtcgagcaaacttcgcgttccactttcttgtattctcgcttggaggagtacgtcgtggaaccgccgaagatgtgcgaaacatggaggtcggagtctgggtacgcggagttcgattcgtgaggaggcgactcctcgttcttctcgacaacgcgtactcgcttgcctttctcaaacgccatgtgcttctcgagcgactttttgaaaagaaggcaatcctccagagaatgtctatctgttttgtgtatgggacaccatgatttctttgtgtcgctgctttgtgggtccgggcgcttggaagggttcgcgtactctgctgcgaggacttccgcttgagctttccttttcccgtttttgcgatttttcttcttgctcgactcagatgtgtctgcggctgactttttctctcccccagtcttcggcttgtcgttcttgcgtcttagtgcgtcgtcgacgtgggcgcatctttcaacgatctcgaataaccttcgagtagttgtgatatgccttgttgccaactcttgggtagtgtagcgatctctgacgccagacttgaaggcgcgaattacagaagcgtcggtgatttcggggatggtattcctgcacttgttaaagcgccgaacgtattccctcaaagattcacctgagttctgtgttaacgcatgaagatcgtcctcgatcgcgtggcgcttgtatgttccttggaagttggcgacaaactgctgccacaggtctgcccacgaagaaattgagtagggagggatatg

SEQ ID NO: 94591 - DNA, 692 bp, Oryza sativa
ttcatcctctcttcttctctcagccaaagtccggttttgctccctcttctaatcaggctgagaaaagaaaagcccggcaagaagtctattatccttcccccgcgctactgttcatcttccagctccagccgccggctgtagctgagccgagccgccttgccgagtcgccttgccgcgccgtttcctccccaatctctccccttttcttccgattgtttgaggggattttatcctctcgttctcctctacctttcccctcaagaataggagcatttcgttgagtatcttatccgaatcgaactcgtttttgagtttatctccaaaaccgagtttttgatttcccggatcgatttcttgcgggaggagtccgatctcttcaatccaaggctataaataggagcccctagtcctcttctttcgtttgccccctctcccgtggtctcccgtgtcccgtagcctcgccgccaccaccgcctagctcaccggttgccgccggccatctccggcgaggtagcgcagccgtctccgtcgtcgtcgccgcttgccgctgccgcgtttaggtgcgccgtggtgaggggaagcccggccgcccgtcccctttcgtcgccggccaccggagctccatctccggcgaggtccgagccgccgccgccgttcatctcgtcgccggccgtcgtcgttcgtcgtttggt

SEQ ID NO: 94592 - DNA, 510 bp, Oryza sativa
gtcgtcgtggaggcgggggagacgcgtccgaggcctgaaaaacggtcgatgcgaagtaaggcgtaattcttctggctgtacgatctgacgacaggataacttaccaagggggttgacgccttgcgatgatgtccgcttacagaggagaacttcctcccctttgtcggaacattgccaccactagtggtagtagcagcagcatcagacgcctccttggcgaccttctctttcagagacgccgccacctgatggtccgcgagcggcccgatgatgtcagtcagaggaagagcctacgcttaatcaagtcacaatgtgatctcgaaaggaaaatgcaggatgcctatcgagaacacttacgttgatggcgtcatcatgttcggccgcccccttttcacaaaggggcacggggatgttactcgccgttgtcggaccactgatcatcacctggccgacacgacgttccacggcttcgctgttcagacctgcgaatcaagaaccaaatctcgataa

SEQ ID NO: 94593 - DNA, 589 bp, Oryza sativa
gaggggcggacgaggtcagccatggcttgtgatcacgatggcgaccttccggagtggcgacgacgactggagcgacggcgacgcacggctagaccaccggcgatgacgccggcgcacggctgcacggtgctagggctctaccggcaacgagaggcgaaggcgagggtgccggcgggtaccgaagggcttgggggtccttttataggggctagggggcggcggcgaagtcccacggcggccggcgacgagaaggaaagttttagggttcgggaggaaaggggaatccgaatcgagctcaaatccgatgatttccaaagcgatatagacgatgcttccaaaaggaaaaaggtagaggagatctcggggatcctttcccctcaatcaatttcatcggatcgggaaaggggcgacggaattggatgggcggcggcggcgcggctcggctagggttcgggcgcgaggaagacgacgaccccgacaggtgggccccacctgtcagcggcggacgcgcgcgcgtgagcggcggcttggctgcgggccggcctgggccgaggagagagagagaggggggttttgggccgactttcgg

SEQ ID NO: 94594 - DNA, 1026 bp, Oryza sativa
caagatctatccggaactcaatctctcgcttgggcggcataccgggtagttctttcggaaacacgtctccgaactctctgacgatggggatttctgacagtcctatctgatgaagttctgaacttctgacagaggttgggggtgcaaagaaaacaatcggttgttccggccctcggtacagggtgacagtgcgtctcgcgcaatccactactccttggaattgagccaaccaattcatcccaaggatcacatccaagttcttggtgtctagcagaatcaaatccgagggaaaaggaatcccctgaatttctatagggacggcaggactataatactttgctgtcataacccctccaggggtggtgatgagcagagggttcctaagcctttctatccccaactgatttctccccacgaatggcacagatataaacgagtgggaagctccagagtcgaacaaaatggtagcagggatggaatgaatgaggaacgtaccaacgatgacgtctggagttgtcagcacgtcctcggccgtcacatggttcacccgaccccgaatgacatccttcccaccgttgttggagcggggaggcgcttggccttgctgacgcctcggctttgggcatttatccgcaaagtgcccgggctcgaagcagttgaagcacagacgctgcggacctgaagcgtccctgcggacttggccaggctgcacagttggcgtaggaggacgaggcgcacgagtcccttgctgactctgctgttgctgcggctgtgggacgcgcaccacgaattgaggtcgaggcgcggagcgaggttgctgctgttgttgctgctgctgcgaggaggatccccctggatagggattggtgtagcggaccctttggttagcaccctgttggttgcggaaatttgccaagcggggcttgtgcgactcagttccttgtgcttggcttccaagcggatgctcttgtccaccagacgtaggaaatccgatagtccccggagactagaccgacggacagctca

SEQ ID NO: 94595 - DNA, 676 bp, Oryza sativa
gagagggagactttgggctgggcttggcccaaaggaggaagaggatttatttttaggtttttctttttaataaactttgataattgttttgttgcttaataattatttccggtgctctgaaaattcaagtaaaatttgagatctcctttttgaccaaggagaatttaacaaaaattctccgggccacattcgaatttttcttgtacgtattttagtgtttgccaatttctttccgaattttaattaattctattattccttttagaaaatgatttttatttcgggatgaatttatcaggacgtgacaaattcccacatcataatccttgatgagttctaaccatctcctttgccgaagattcagatccgattgggtgaagatgtatttcaagctcttatgatcagtatatatttcacagcgattcccaatgagatagtgccgccagatttttagagcatgaaccaccgcagctaactccaaatcatgggtagggtagttgccttcatgagcccgtagctggcgtgaggcataggccaccacatgaccattctgcatgagcacgcaccccaatccttggcgcgaagcgtcacaatacaccatgaaatccttgcgagtatccggcaagattaacactggtgaggaaaccagcttttctttgagggttttgaacgcctt

SEQ ID NO: 94596 - DNA, 572 bp, Oryza sativa
tttattgcgaataattccgacaacctccggggaaaaaagggcatttacttattatagagatggtgcgatttgactcttttttttgtttttttagcccctacctacaccccggttttacgagaaagagtgggggttcgcggagagaaaaccaaattagtaagggaaacccacgcttagggaaggtgaggtgaactaacaactccttctgtcgtgtatcctcgactgacgcggcctcggatgcttcaattgtagattttagtattgagcgaaaggttacacctacaggataggttctgtattacaggctaatcctactctactagtactaataggtagcataggggataaaagcactacacctagaaataggaatcaacaagagaaaaactttgttagaaattaaccctttcctgattggtatcagggctgggaagaatggttgggataccaaacaaccatcaagtttgtcctttggatacccctataaccatcaaagatcgttgaagtggctaattcctctaaatagaaggcgttgagaacaaagaaattcttggagctatcgttttcctcta

SEQ ID NO: 94597 - DNA, 588 bp, Oryza sativa
ccggcaactggactggtgttatcagtagcagcacaggtcaggtcactggcctctccttgccaagtctccatatagccagaccaatcccagcctccgtttgtagcctcaagaatctgacctacatagacctctcttgcaacaatctcaccggtgatttccccacggtgctctacggttgctcagctttggagttccttgacctatccaacaatcaattatccggcagacttccggaccgcattgacaggctatcgttggggatgcaacacctcaacctgtccagcaatgctttcaccggcgatgtgccgtcggctattgcaaggttctcgaagctcaagtcattggtccttgacactaatagattcaatgggaattacccgggtgccgccattggaggccttgtggagcttgagacgctgacgttggcatccaacccattcgagccgggtccagtcccaaaggagtttggcaagctgacaaagctgaaaatgctgtggctgtcatggatgaaccttactgggaccatccctgatgatctgtcgtcattgatggagctcacattgttggacttgtcacaaaataagatgc

SEQ ID NO: 94598 - DNA, 2174 bp, Oryza sativa
aatcggaggtgcctaaaaggtttgcaacttcatcctccaatgtttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagttaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgatcggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggatgccagggaagactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtattttcctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttatgatgtgtatctacaacctccccccctggctatgcatgaagaggaagtacataatgatgccgattattattcaaggccccaagcaacctttgtacgacatcgacccgtacctaagaccactgggcgaagatcttaaacagttgtggaagaaggaaggtgtccccgtgtgggacgaggacaaacaggaggagtttaacctacgagcgctgctgttcgtaaccattaacgattggcctgcacttagcaacctatccggacagtccaacaaggggtacaaggcttgcactcactgtatggatgaaacagaaagtacgtatcttaagcattgtaggaaggttgtatacatgggtcatcgtcgattccttgcaacaaaccacccggtacggaagaaaggcaagcacttcgaacataaagccgaccaccctacgaatcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtat

SEQ ID NO: 94599 - DNA, 635 bp, Oryza sativa
atttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacaaatgcatttgcataacatatatatgcatggtttatatatatatatatatatatatatatatatatatatatatatatatatatatatatataaaccatgcagcaacaggggcatgcaaaaaaaaaaaaggtcagctctatctttagtcccggttggtaacaccaaccgggactaaagatcgatctttactcccggttatttcacccgggactaaagatagcgatctttagtcccggattggtactcccggtttggaaaccgggactaaagggggg

SEQ ID NO: 94600 - DNA, 2942 bp, Oryza sativa
tcatcaacctgctgcagggatgggacaatgccaccattgcaggtaaaaaggttttacttcccgtgtcgtgctagattggttatttggttgagagtttgtgagtactaggaaatatgaacagctgtcaattttttcttaattatcagtgttggtgtaccttctaaatttttcagattaatagactgctttagatcagatgtttgttgagtgctaattatggtcttctagtaacatgtctggtgttgttgtttgagtcctaagagcaattggcacaattgtttatcagcaaactggatcgcatgatattaatagtctcttaatttttctagatctgtactaatcttattgaagaaagagatgttctaatcataattgttagctattgtgttgtctgttgaatcattactgtttgccattctttgttctgaacacctgtaaagattgttctatccaacaagaaagtgtaaatgttaacaaggcacaattattaaacttcttcaggtgctgtactatacataaagaaggaattcaagctagaaagtgagcccactgtggaggggctaatcgtggccatgtcactgattggtgcaaccatcatcacaacattctcagggccggtatcagactggatcggccggcgccctatgctcattctctcttcaattctctacttcctcagcagcctcatcatgctatggtccccgaatgtctatgtgttactgctcgcacgccttatagatggattcggcatcggcttggctgtcacacttgtacctttgtacatctcagagacagctccttcagagatcaggggtttgctgaatacactgccacagttcagtgggtcaggagggatgttcttgtcctactgcatggtgtttgggatgtcactgttgccgtcacctgactggagaattatgcttggtgttctcgcaatcccttcgttgtttttcttcggattgacaatattctatctgccagaatcaccaagatggcttgtcagcaaagggcggatggctgaggcaaagaaggtattacaaaaattacgtgggagagaggatgtctcaggtatgttttgctgaaaattttgatgttcatttcacccatatttccagctgaccagtttaaaaacaatttctcccagattctaaactcatggttaatactagaaaacatgtgtggcattggtaactgttaatttcttgacacgaacttaacatatgcagaaatagtgtatttttgaaaaaaaagggtaaaagaaatcaaaatctattaagcgccttctatcggtgctcttttgaaaaagcttatgaatcttcaagtaaaaattactaagtacacataactacactaattcattttccatagaaggcagaacatggaatgtacaatcgttatctcaccaggtagagcccaaatgaggtgtcccaactttttgctgagtcctaatctggagaaaaataatcaggtgatctagatagacatcgccctcttttttttttttttggtaagggtaactctagaatttggggggtgggacctgctggtataatgtggatgtgggccgacccacgggtccttatctactctagtttaactaaatgaactatattttgcttttgagattttaaaagtgaaattaagtccatctagttgacctagagtgggtcaaggagccccacagcggccatgcctaacaacagtgattgttcagaaacgttagtaatgatttatccttaagttcatgctttcctcaaactaattacataatacatgtgtcaacatcaaaataggcatatgctgttagcaagtggtttctctattttctcctctacaacagactaaatggacagtattcggttggctgagagcataatattgctgttattttaagttcatcgaacttcgctgtaagctggttgtccccagctgcactatgctagctttctattaaagctgggcccttatatttctgttatttgtttctggcacaccattcatatttatattgctgctttattcatagttactacttatttatgccaatgtttataccaatgtccaaataaaatcatgtaatctacgtgaaaaaataaagttgcataatcattcaaattatcaaattgcgcaggagaaatggctcttcttgttgaaggtttggaggttggagctgacacttccattgaagagtacatcatcggaccggctatagagccagctgatgagcatgttgttgatggcgataaggaccaaataacactgtacgggcctgaagagggccaatcatggattgctcgaccttccaagggacccagcattcttggaagtgtgctttctcttacatctcgtcatggcagcatggtgaaccagagcgtgccacttatggatcctatagtcacgcttttcggcagtgtccatgagaacatgcttcatgctggaggaagcatgcggagtacattgtttcccaactttggtagtatgtttagtgtgacagatcagcaccccaaggttgatcaatgggatgaggagaaccttcatagggatgatgaggaatacgcgtctgatggtgctggaggtgactatgaagacaatgtccacagcccgttgctgtcccgacagaccacgagcgcagaagggaaggacattgcacaccatgctcatcgtggaagtgctctgagtatgagaagaagaagcctcttggaagagggtggcgaggcggtgagcagcactggcattggtgggggatggcagcttgcatggaaatggtcagagcgagaaggcgaggatggtaagaaggaaggaggatttaaaaggatctacttgcaccaagaggaagtgccaggatcaagaaggggctcagttatttcacttcctggtggaggggacgctcctgaaggcagcgaattcatacatgctgccgctttggtaagccaaccagcact

SEQ ID NO: 94601 - DNA, 602 bp, Oryza sativa
catgggattcggtccgatccccaacattctgtgtgcggagatcttccccactagggtccgcggcatctgcattgccatctgcgccctgacattctggattggtgatatcatagtcacctacagcctccctgtgatgctgaatgccatcggcctagcaggtgtctttggtatatacgcagttgtttgctcgattgccttcgtgttcgtcttcctcaaggtccccgagacgaagggcatgccgctcgaagtcatcaccgagttcttcgctgttggtgcaaagcaaatgcaggctacaaaggcctaattcttcagcaactctgctttcaatctttatataacactgtaaattggaatctgcaagatcacaccatgaggctggaggagctttttgagttgtaaatgagagaagaggattgctattcatgctccttatgcaagggaaaagagttcattactggcacagggcagctgtaaagtaggaaattttcatgttattcatgtccacttcttgtttatttagtactgtgttaggtaatgttgttattcatcagtagttgctgctagggatgttcaaaaataagcttgctaatctgattttgagc

SEQ ID NO: 94602 - DNA, 1557 bp, Oryza sativa
acatgaatggtcacaacgctgcaaaaaaaatatgatctctagtaagaagggttagtcctacgacaaaaaaagaaaagagaaaaggcaagtaaattacctgtgagacctgctactcctctcattcaaagctgttgcactcatggctctattgtcatgccctgtttgcattagctcgattacatgagaagttgaggtgacaggacacattgttgcatcaggaacagcaagtccattgggttggatggtgttctggatccctagtgtgttggaagttaagaaaaaggaggatatttcttcacatcaattcagtctgcaaaaatcaatgtatggaacttctcaagcaagatgatcgcactagaatctgatgaaggatggccatcgtgtgtgtacacaataaaaaactgcaaattttattgcagatttaaattctatttggtgaaaggctacactaatgcaagtctgggggaaaagaatatttcttctgcacgccaccactgccaaggagatcacggatttgctcattgtagatctcaatcatctgaacaccaagttcgtaagtgattgtgtctctacggtcatgagaaatattgaaaaggtcatttaatgccctataattgactccccattccttctcagttgccttttcaggtcccatctgagaaattgatagaaacagatcgttgtaaacacatagtgactgtagagaaatcttctggcacgcaaactgaaataaacagaccaaatgtttttgccctgagcttcagcgtaccatagtgtatgtttttcctgatccagtttgcccatatgcgaaaatgcagacattgtagccatcaagaactgatctaattagtggctgtatgtccttgaagacagcatctattaacaaaataagagggataagagaattgatgtatatgacatacactattatgggatataattttttgaaggatttgttgaactaatttgatgcaatagcttcaatggaaacccaacagaagattaagttgtactgaccacttatcatgtaccttgtgtagtgatagggccaaaaactttgttaaatgtgaaatttttgcccccttccttcccttgttttgtagggtttgatagaactagttcaccattgtccccaatatattcaactgaactggacttgtcatcctccccaggtcgaaaaggtcttatccgacaatatactctgatgtttcctgctcagaaatactatgccaaggtgatatcttttgacctagataaccagacaaaatggactgatgattgtagttcacatgtaccttttagttcctggatctcattgaacaattttctgttttctgcaagagctccatgatacttttctgcagtatttgttaccaccttaaggctttttcctgttgaagattgcaactggtaatgttagttgcaatccatcgatgagaaaagaagtatttgtatatgaaacccacaagtaatcacaaggttaattcttaccaaggccagctagttcttcagaccacttgttttgacaatttaagatttcatgcctaacggaaaggg

SEQ ID NO: 94603 - DNA, 920 bp, Oryza sativa
aatggttctgactttagcttcagcttctctcaagatatcagtcccgaacacttggctttccccaacttgatcccacaaaagcggtgtccggcatttgcgcccatacaacgcttcataaggtgccatttgaggctggcttgatagctgttattgtagagaactcggcataggggagactcttatcccaggtcttcccgaaatccaggacacatgcgcgaagcatatcttctaggatctgatttagacgctcggtctgcccatctgtctgcgggtggtatgcagtgctgaagtttagtcgggtacccagctcctcttggagcttcttccaaaagtgagaggtgaattggcttcccctatcagatacgattttcttgggaacgccatggagactcacgatcctagcgaagtagagctcggctagtttgttccctccataggtggtcttcacaggaatgaatcgagctaccttggttaatcgatccaccactacccatatagaatcatatccaccttgggtctttggaagtccggtgatgaaatccatcccaatttcatcccatttccattcatgtacttggagaggttggagaagtccgaccggtcgttggtgctctgccttgacacgctggcacacatcacaaagggccacgaactctgcaatttcccgcttcatactaacccaccagtatttctccttcaagtctaagtacatcttcgtactgccagggtggatggaataaggactttcgtgggcttcctgaagtatcagctgtttaagttctctgttatctggaacgcatactcgatttccgttccatagggttccgtgttcatcctctgtgaaaccagcggttttaccctgtttcatattcttgaggagtccatgtatgtccggatcgttcttctgagcctcgcggatt

SEQ ID NO: 94604 - DNA, 572 bp, Oryza sativa
ccgtattcgccgttgcaggtatttcagctcaagcaaggaggatatgctgatcagctcggtggcaaatattcagacttgctgaaatccactagcttggatgtaagtgcatctaattatccctactagtaatgagataccatgttttactttagaaaagtttttacattgtcacccaatgctggcttgttgcagaatgcacctacgcagtcacttctgggtgttttcaacagcatccttgatgagagcattgagaggaagaatggacaaataccttatgtaggcttctcagaaaagaaatgcagttagtttgttctttccaaatttaagtgatttcatgtttttaacaccttcccttgtacaaatgaatgtaaatgtttcattgtagcgcattgcttgcttgctgaggaaggtcatactagagattgagaggcgcatttccacccaggctgggcatatacggaacgtaagataaatattttctatatgtgttcttataccagattagtcctttgtgatttcttacttgtctgcagcaaaataacctgattaaagctcgcgaagagaagtatcag

SEQ ID NO: 94605 - DNA, 2511 bp, Oryza sativa
gagtcgtggcccttaagaaaagagaattccgagagttgaagcaaggcaaccgctccgtgacggagtatttgcatgagttcaacaacctggcccgttacgccccggaggatgtgcgggaagatgaggagaagcaagagaagttcttggcaggaatggaccctgagctgtccgtccgtctagtctctggggactatccggatttccaacgtctggtggacaagagcatccgcttggaagccaagcacaaggaactggagtcgcacaagcgccgcttggcgaatttccgcaatcaacagggtgctaaccaaagggtccgctacaccaatccctatcagggggatcctcctcgcagcagcaacaacagcagcagcaacctcgctccgcgcctcgacctcaattcgtggtgcgcgtcccacagccgcagcagcagcagaatcaacaagggactcgtgcgccccgtcctcctacaccaactgtgcagcctggtcaaggccgcaaggacgctcaaggtccgcagcgtctgtgcttcaactgcttcgagcccgggcactttgcggataaatgcccaaagccgaggcgtcagcaaggccaagcgcctccccgctccaacaacggtgggaaggatgtcattcggggtcgggtgaaccacgtgacggccgaggacgtgctgacaactccagacgtcatcgttggtacgttcctcattcattccatccctgccaccattctgttcgactctggagcttcccactcgtttatatctgtgccattcgtggggagaaatcagttgggggtagaaaggcttaggaaccctctgctcatcaccacccctggaggggttatgacagcaaagtattatagccctgccgtccccatagaaattcaggggattccttttccctcggatctgattctgctagacaccaagaacttggatgtgatccttgggatgaattggttggctcaattccaaggagtagtggattgtgcgagacgcactgtcactctgtaccgagggccggaacaaccggttgttttctttgcacccccaacctctgtcagtagttcagaactccatcagataggactgttagaaatccccatcgtcagagagttcggagacgtgtttccgaaagaactacccggcatgccgcccaaacgagagattgagttccggatagatcttgctccaggaaccactcctctgtacaagcgaccctaccgtatggcagcaaatgaactggccgaagtcaagaaacagttggaagagttgaaagaaaaggggtatatacgtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcgatcagcttaaaggtgccactgtattctccaagatcgatcttcgttccggatatcaccaattacgtattcgtgatgaagatattccgaagaccgcattcaccacgcgatacggactgtatgaattcacggtgatgtcattcggtttaaccaatgctcctgccttcttcatgaacttaatgaacaaagtgttcatggaatacttggataagtttgttgtggttttcattgatgacattctgatatactcacaatccgaggaagaccatcagcaccatctccgtctggtattgggaaagttgcgggaacatcaattgtatgccaaacttagcaagtgtgagttctggttgtccgaagtcaaattcttagggcacgtgatatctgctaaaggagttgctgtggaccccgaaacagtgaccgccgtcactgattggaagcaacccaagacagtcactcaagtccgcagtttcttaggtttggcaggatactgccggaggttcatcgagaacttctccaaaatcgctcgacccatgacacagttgttgaagaaagaagagaaatttgtgtggagcccgcaatgcgagaaggcgttcaaacttctcaaagaaaagctggttgtctcgccagtgttaatcttgccggatactcgcaaggatttcatggtgtattgtgacgcttcgcgccaaggattggggtgcgtgctcatgcaggatggtcatgtggtggtgtatgcctcacgccagctacggcctcatgaaggcaactaccctacccatgatttggagttagctgcggtggttcatgctctaaaaatctggcggcactatctcattgggaatcgctgtgaaatatatactgatcataagagtttgaaatacatcttcactcagtcggacctgaatcttcggcaaaggagatggttagaactcatcaaggattatgatgtgggaattcactgtcatcctggtaaggccaacgtggtcgccgacgctctaagtcgaaaaagccattgcaacactcttaacgtccgtggcattccacccgaacttagtcaacagatggaagccctgaacctaag

SEQ ID NO: 94606 - DNA, 944 bp, Oryza sativa
ccatggttgccgaggaagctacgatcgtaggcgccgttttgcagcgtctccgggacctcgccggagagctggttagaagaaaggttgagaaagttgagatggagattgctgaaatcttgaggtatgtcgccggtgagcccgttgtcggaaagaggtcaagaatgtagaggcccatccacccgactgcggcagggatctcaccggaaatctggtttctgctaaggttgagggaggtcagacttgtcaatgatttgatagacggcggaatcgagccggataactggttgccggcgaggttcaactcggtgaggttggcaagcctagacatgtcagctggcagttcaccggagaactggttgttctccgccgtgaaactcttcagaccgacggcggtcgacgggagggcaccggagaagcgattgttctccatctcaatcctcgagatgttaaatgatatctcactgggtagagtgccggtgaagttgttgttgtaaatcatgacattggtgagcaactcgaatgaccatatcttcttgggaaagtccccaacaaagtggttgttgtatgccatgatgttgttgatggttttgcaatccccaaggttcgtcgggaacacgccggagaagctattgttgaacaccacaatgtcaaagagcttcttattgaagcaaagtgtatccggtagctcaccagagaggttgttgttggacacctcaaaattccccaattctgaatgttttccaagctccgcgggtaggggcccagagagcttgttattgaagagacggatgtcggtgaggtccggcatcataccaacaccagccgggatgggtccagtgagattgttgtagtacaaatatagtaatctcaacttcttcaagtttgcaatgtcctctggtattgatccagagaacttgttcatggacaggtcaagctcctgcagg

SEQ ID NO: 94607 - DNA, 2061 bp, Oryza sativa
gcccggcacgactattggaccgtgcctggacctatgcctgggcacggtggcccggcccggcacggcacggaccgaggtcggcacgatgggccggcccggcacggcacggcccaacggtcggcacgaccacggcccgtaccaacggtaggcacgagcacggcccagcccaacagacagccaggccgcaccgcgtgcgcccgcatatataagccagcgaacgccgcgtcgccgcccctcccctccccagtcccctctcgcctctcgctctccgcctctccgcctaaccctaaccctagccgccaccgctcaaccgcctccgccgatccgcctccgacgctccaccgcccaccagatctcgtcctccaccgtccgccgctcactcgctcagggcctcaggcgcgcaccggtgagactcaccgagtcgcctcccttccactcttccagatccagccttcctcttcgtctccgatcgatgcctcgcctgactcgcatgaggggcgcatgaggatgggggccaccggccacgcatggtcgcctgagtcatcgtccttccactcttccaaatccagccttcctcttcgtctctttcccgtttgttcttcttcgccagatcccttggtcttctcgtagatccgtgagcctatcgtcttcaacggcaactccggtgctccggctgcgcaggtacaagcatggaaccattgtttttattttttttttctccatttccgaccctaaccttgagtgttgttggctgcttgcaggtcacaagcccgttgcttagcggcagccgccgttgagggaccagagtgcctgcgatggatgacgatcctacctctgtcaactacgagttgaggactatggggatgcgcggtgatgacgatgatgatgtggaggaggatcgtgtggaggtgttcggcaatacctccgacatcccgatccatgtgaatgtcgatgacgacgacccgccggtcgacgacagtggcaatgggacgtcgactggctctagtgcgacttgtaccaacaagaagaccaaaacctccaaggtatgggatgactttgaggaactttatgaaacgaccaatggtaatagggttcgagtctctactaaatgcaattactgtcataaaactttgagtgctcgttcttctgctggcactggacatttgcttaggcatattaagtcatgcaaacctagaaagcttgggtctaatgctttgcctcagtccatgcttagatttagtgcaaatggttctgttattccatgggaatatagtcctgaagatgctaggtttgaattgtgtagattgattgctagagaggatcttccaatcagttttggtcaatctcctgcttttgtgaactatattaaggctgctcataaccctagatttgttcctgtctctagacaaactactaccagagatttttataagttgtttaaggatcgtcgttctgttattattgatcgtctcaattctgctagctctattgctttgacatctgatatatggggtggtcatgctaagcaagattatttgagtgttgtagctcactttgttaattctgattggcaattagaaaagagggtcttgggtcttaggcttattgatgagtcacatcctggtgctaatattgctgagcgtgtaattgctgttgctaagaatatggtattactgataaggttttctctattacattaggcaatgcttctgctaattctaaagctatgatcaccctagctcgtgctctgtctggttatattggtgatttatttgtgcatcaacgctgggcatgtcatatcatcaatttaattgttaaggctgaacttgtcaagttctagcccatgctaaatgacattagagctgccatttcattcttgaatgcatctaatcagcgcattgcttcatataaaaatgtttgcattgctgcgggttatcgtcctcgtatgtttggtttggacatggatgttatatggaattcaacttatctaatgcttaagcatctcataccacatagggaaccattcacagtatttattagtacacaacatccttttgttaa

SEQ ID NO: 94608 - DNA, 723 bp, Oryza sativa
ccttgcctcctgggacaaggattaatgcacgcacgtaaggaatgcccgttgggttatttccggtcgtgacacaacccaagacggtttcagagattcgtagtttccttggtcttgtggggtactaccgcaggtttattgagaacttctccaagatcgctagaccaatgactcgactgcttcagaaggatgtgaagtataagtggacggaagagtgtgagtagagttttcaagaattgaagaaaaggctagtgactgcgccagtgttagtcttgcctgatccaaggaaaggttttcaggtgtattgtgatgcgtctagacttggtttgggttgtgttttgatgtaagatgggaaggtggttgcctatgcatctaggcagttgcgccctcatgagaataactatccaacacatgatctagagttggcagctgtggttcatgcattgaagatttggcgccattgcctttttggtaaccgtacggagatgtatacggatcataaaagtttaaagtacattttcactcaacctgatctgaacatgcgtcagcgaagatggttagagttgatcaaggattatgatatggaaattcattatcatccaggtaaagcaaatgttgtagcagatgctctcagcaggaaaagccactgtaatatgtcagaaggtcaacatctaccttgggagttatgccaggaattggaaaagttcaacttgggcatagtcatca

SEQ ID NO: 94609 - DNA, 3124 bp, Oryza sativa
aagccttgtgctgcccgcgtctcgccttcgtgcaaggatcgccgccgaagtcgttccctcgccgttcgcctccgtcgtccttaagccgtctccgtcgcgctcgttcgtctttgtcgttcccacgcctcatcgcatggtggtaaggatccgtcctctcactgccccgtcctcgtcctttcggtgtcgccccgtacccgttgtgcggttgtcgaccccggtacccgtttactggtgtcggtagtcgttcgcttatgcgtgtggtgaccgtgttagtgtgcccgctcggtagccgcgtggtttccacgtgtgcagcccgtgtggtgtctataggagtccgtttgtcggccattcgcctcggttgacacatgggatccgcttccgtcgacccatggaccgtctctgtgtactcggtctactgtggtcccttaggttgacatgtggggtccacatgtcaacggcacagccttcctgtcttttccaggctagcgcttatacatgttttatatttgcaaaacctaatcacaataatccgtaaatctccatgtaacagcaataaacttcggatgatcatatcttggtcatacgaaccccgaatcgacccgttcaagtctcttaatgtttgttataacctaaagaaccgtgtgctttctttttatgtattgttattgcttctttataggcttgtagctttgcttgtgtgcttcgtgtagcttctgtcattccggaggtttcggaagcgtgattcgcggtcgtcaccgaaggttcggaaggctgttctctctgagcaaggcaagtctcatcatccttgagcatattgaatcccagtttttaaaattattttaatttaaattattgcattaccattttatttaaattcccgcgttatcactgttttatttagcacttcctattatcacctcgttcaccctaggaaaacaaaaccccaactagtgggtactctattcatggttccactagtatgaacttacgtagatgcttcgctgattaattaggcaacattaggtggttttataactttagactttgggagttctcatgtcatttggacattatggaatggttggcttgtgatggaactgatacacacacctcccctgtcacgcccggaaattcactagtaatttccgaacttatttgtgcataaaaccctcgtccaggaatcagccgaggtacacaaactgacaatttaatatacaaatccatcataataataactttacataattacaaaagaaaagaaaacagcagcggaattacggtctagcgaagctccagctccactcccacaggcagctcaactggggtataaaccatacgtcttctcctttgcaacttgtcttcaactgaggtttgattgattattgcaaggtgagcatatgacatactcagcaagccacacaacaaatatgcaagtgcacaaggataccaaaaggatggcataatatagggctcatttgcaaaagcagcatttagcaaacatttgagagttgtaaaacagtagagtaattaatcatcaatattaatcaacactgaacagcacacccatgctgctcaggcccaaccatcctgaacaaccatacccggctgcacagatctatctccaaaccaggaatgtaccattccaaaccaggagctaaattaattaccatcaattaccacattattattaatgagtagtgtgggactaatcaagaaagacattgttcgacccgcccataaccacgggcacggctattcgaatagttttactctggccaggggtgtaccactgtacccacaagacacaactccacaatatgtcaccatatcatcatgtgcccatgctgaacatgtcaccattagtgtagttgtgacaagacccctcgcataactcaaccaaaagcagtgcaccgttcctggatcgtagtcaccccctcaaaaaccagaggcatggactccccagcgacccttgtgggcttatctccgccacttctcagtctggtgctccgtaatgagccttgttatacaaagtgtccagccgttgcccattctggcttgtggttggcacgggtaatgtttcacaaccgaaactcgtgaaccggtccttaattgtcataagtacgaccatcaaaaccatgtgctcacaacccaccattatcaagttttagttggcacattaattaaccaatcacgattgaccaacgattgaccatcgtgagctatcattaaatatccatcattaagtaatagtgaaacattagttatcccaattgtgtgctaatgtttaacatctagctgaaccaatatataaagctcaactagtcaaattataataacccaaggtatgaaggaatagagtaattaatgcaaattggccatacaaaggaataattcacaccacacggtgacattcgaaaataaatgcacagttgaaataaatagagaatttaattataggatcaacatgctcaaaggaattgtgtttgggatctgtgtgacatgtcttgcaataacatgtcttcaattaatcttcttgaacacttctggcgcactcgcgaaccttcgaaacgacggaaacgacaagctaacacgcaaaacaaagaaaaagactaataaaaaccaaataaacaatacatataaagtaagcaaacatgtaggtcataattttagatgaattatgagacttgaacggcctcattctgacttcatatgaattaattatgaattttacaagatttaatctaattaaagcctatttaaaaaggattaaataaaattaattcaatttatggataatttaatatgtagatgtttattttatacaacttttgcaacttgaaccacattaaaccaagttacaatgattatgaatttataaagattaaactggattaaagcatttatatggattttaattgaattatgacgcaataaagaattatttttgaaaggaaaaagggatttattgcgtcatcaaaagcggtccacggtaaaccgggttcaaagagacggtctacgaaacccacggccgagatctaatctaagccgaacggacagtcgagatcgatccggtccaccacgggctatggatgacgtcagcaatgacatcagcgatgatgtcatc

SEQ ID NO: 94610 - DNA, 1875 bp, Oryza sativa
ctgcaacagcggccggaggttgaagacgactgacaggtggaccccacctgtccgtggctgagagagaggagggagggcgcggcggattgggccagctgagccggacgcaagcaggccgaggagagggagggagaaacttgggccgactttcggcccaaagccaaaaggggacttttaaaacctttttcaatttaaattattcatgaaatgatattccattgattaaaaatacttccttggctcaaatagatcccagaaaaatctaggaactatagaaacaagagaagtatttaacaaaattttatctagcccacttttatgttgagatttaacaaattaaaattagatcttctcttttaggcttttaagatcatttctaataattccttttaaacaacaatttataatttaaggatttttaaacaagaaaagcacttaacataattataattagatcattaattgattaactaattactgaattgttctttgtattattaaaattagaaattgagctccgaaaaatccgagaaaattccagagagtataattaaccttggagaatttaataaaaattaaatccatccatgctttatatttaggaaattttatttcccacatttaacttcacttgtaaattaatgaacatttaatataaattctattaataatttattaaataaattataaatcctaaaacaaaaaatcaggctgtgacatccccctctattcaaaactcccaaaatggtttgaggctgggctcgaggtgcatggttctgctagtagcacctcggccactgtaaggaccggtcttcgggcctctgttgcaaagcactaccgtactaaccacatgtctaatgggtaaggcttaactcggtgctcagtctagtcctggcaagagtacacggatggagatggacgaagtcagggctcgatcctgcctacctgtctcgggggttccggccataggcggggttgggtcggtgcttttgtccggctaggatgggtaaaagggttatgccacatcctttatgatgggttccccggccgtggaatgcggagtaaagatgtgtcttgtgggtaaagatgtacacctctgatcagagtataatctattgaatagccgcgccctcggatatgggtaagcctagcaatgtacccacgttagtggtttaatttttaaaacttgcttaacaactaaaatgtggaatggttggcatgggttggcttgggacgagttgggacctgggtctggttgccagttcggtctgaatcatcgtaggccttgggttaaggcaggttcgtgtggattcacggccttgattaataatattgtgtagctataggatcgtgtttacaaaatagctttggacaactaagtgacttttaaatgctgtttactgcaaaacctaacccctattattatccccttgtacccccttacattaatcatgcatctcccgatgtggcttgctgagtactgaggttgtactcattcttgctatatctttcccccccttcagtaatagaagctttggagaagaagtcctaggtggagtcctggcttataccccagttgagcacctgtgaagatggagccgcaggcccccttgtccgctgctgtttatttttgtttgtcaagcctgaagtgcctttgtaataatgtaaatattatcgatataataaagatgtgccttttgtatcctgtttatgtggtgtaccccggcttttcatgggacggggattaatacactagcgttttggaaaaagtatttttccgggcgcgatagtcacttctcttcccgagcaaaaccctagccgtgcgcgggtgctagcacatcttggcgtggcgttccgtccatgtacgtgtggata

SEQ ID NO: 94611 - DNA, 912 bp, Oryza sativa
tcgctggcaagtccattgcctctggttttgacgggcagatcatgatccaggaatgatgcactgtggtaagttgtgctgtgttacaggtattgtcaaagttcctttccaaggtcccgtggtggtatagaggtgcatggtgacatgttgtggagctgtgtcttgtgggaacaatggtacatctctcatcagagtaaaaatattcgaatagccatgtccgcggttatgggtgggtctaacaatgtttttcatgattagtctcacactactcattattaatgataatactgtgataattaaattgactcctggtttggaatgatatattcctggtatggaggtttaatttgtacaaccagggttggttgttcagatggggttgggcctatgcaacacgggggtgttgtatagtgtttatttaatattgcttaattacttaactgttttactattctctcaaatgtttattaaatcttgtttatgcaattgagctgtattatgccatcctttgttatcctgtgcacttgcatatttgctgtgtggcttgttgagtatgtcatatgctcaatcttgcaatattcattcatcagaaggagtacttcagtgaaggtgatgatatggaggattaggttttgttcgggtcaagttgcttgtggagtggagtcgccatacctgttccgtctattgtttttatttccgctgcgtagaattttattcttttgagaggaactatctacctctgtaataattatttatttcgcgagtattaattagatatttgatagtactctattatcaatttgttattgtgtgcctcggctgattcctggacgaggatttaacgcacgtgtaagcgtttggaattttggataaaaattccgggagagtcgacctgcaggcatgcaagcttagtat

SEQ ID NO: 94612 - DNA, 1151 bp, Oryza sativa
gtgacttagccacccgcctcgcagctaccgaactcaccatcgccgacatgcagcgcgcgctagactcatccgccggggaagccgaggccctccgcttggcgggcgagatagggcccggcatgctttgggatgcagtctcccatctggatcgcgccggtcggcaggcgggcctctggaaaggccagacaatgaagtactccaccaaccagggaggcctcgctcagcacctctcgaagatggccggggctctccagcagctccccgaggagctcgagaagaccgtcaagtcatcctcgagggacctcgcccaaggagcggtggagctcgtcctggcgagctaccaggccagggaccccaacttctctccgtggatggcgctggatgagttccctcctgggactgaagacagcgcgcgcgcgcaggtccgggatgccgccgaccacatcgtccacagcttcgagggctcggcccctcggctcgcgttcgcccccaactccgacgaggagggcgacgccagcggtgcagacgacagtgacgacgaggccggcgacccgggcgcatcggattgagcccccaggcccccgctaatctctagttttttctttttctttcttctaaggccttcaggcctcttttttgtatagatcaacttaatctgcaatcaaaaatgatgaaaatttttgtgttaattttactttgctatacaaatgagatgaggatgatctgtgccgtggtccttttgtgtcttagcttgatttaaggactcgtgcccaagtcccagtcctcgaaaggcgcgggtcggggctagtgcctggggagatccacatgtcgaggctggccaggccgggaacgtggtgaccgagggttatgggtgacccgattgtgggtttttgccgattcccccccccggagttcaccacgccccagggcacggctcggttctgggccccgtttggcgattttagctgaccgaaccgagcccccgagggcaaggttgagcacgagtgatcttatttcaagtcaaaattcttcaaaaaggaaaaaacggcacagatacagcccttaggaaattgaaactgcttttattgaaatactgaaataagagaaaagagaatgtgcatgtgtggtagcccccggccaaccatgcacac

SEQ ID NO: 94613 - DNA, 3031 bp, Oryza sativa
tcggtggaccaggtcgaccgcatcattgagagctgtcggccaatagaaaccttggcgaaaagctttaccaaccaaggtgcgcgaggcggagtgtgctccgcattcgccttcatggatatcggcaagaagcacaacgccttgttcccgaggagtgcacttcaggaggattccattagccccgcgccgatagagggtcccttctaccagcacgtagcgtttggagatgcgatggacgccttcactcccttcgcggtcctcgggtagagtcttatctgtgaggtatgcttggatctcggcgattcaagcaatcaatctaagggagctgggagcactcccctcgggtcccgaggcctggactccgacgggcctcgggggccggttaggcgcatccgtctcccctaaggggtcgggtcgcgcccaccgctgggcaagcctttcttcaaaggcgcccggtggggtctgggctcgcgaggacgcgagccgtgagagctcgtcggccatcatgttatcccgtctgggaacgtgccgaagctcaatcccgtcaaaatggcgctccatacgccgtacttggcgcacgtaggcgtccatctgcgagtcagagcaccggtactccttacagacttggttaacgaccagctgggaatcgcctaacaccaggaggcggcggatccccagtccagctgccactctgagtccggcaaggagtccctcgtactctgccatattattggtcgctcgaaagtcgaggcggaccaagtatttgaggacgtctccactcggagaggtcaacgtgacccccgcaccggcgccctgaagagacagggagccgtcgaactgcatcacccagtgggcggtgtgaggcagctgcgagggacccgagccggtttcggggaccgagacgagctcgggagccggggtccattctgccacaaagtcggcgagggcctggctcttgatagcgtggcgtggttcaaagtgcaaatcaaactcagaaagttcgattgcccatttcaccacccgtccagtaccctctcgattatgcaagatttgaccgagggggtaagacgtaaccacagtgacccgatgcgcctggaaataatggcgcagtttcctcgaggccatcagaacagcgtaaagcattttctgggcctgagggtatcgggtcttggcatcccggagggcctcactaacaaagtagacgggccgctgcacctttcggtggggccgatccttttcgctaggggccgcatccctggggcgctcttcacccgagcggcctcgcggggcgcactcgtcttctgtgccgacgacctcggggtcggaggacgacgggggcggccttcccacagtggcttcggggccgtcctgggggtcgggggcccctggcgtcgtcggacaagcgggcagagggccatctccggtcgtcgggagccttgggccaccgttctgctcgggggcctctcctccctgctctctcccgggccaaatcggcacagggttagcctcggggtcagagggcgataggtgcggccttcccgcagtggcctcggggccttcctgggggtcgggggctcctagcaccgtctgacaagcgggcagagggccatctccggtcgtcgggggccttgggccaccgttcggctcgggggcctctcctccctgctctctcccgggccaagtcggcacaaggtgggggtgcgcggaatgaggattgtcctcatcgcgttccacgaccaacgccgcactaaccacttgcggggtcgccgctaagtagagtagcaagggttcatttggctctggggcgaccagaactgggggagagctgagatacaccttcaactgagtgagggcacgttcagcctcctccgtccaagtaaacggcccggagcgtttgaggagcttaaataagggtaacgccttctctcccagcctcgatatgaaccgacttagggcgaccatgcaaccggtgacgcattgcacatccctaagcttgctgggggggcgcatccgctctatagctcgtatcttctcggggttggcctcgatgcctcgggcagagaccaagaacccgagaagcttgcccgtaggtacaccgaacacgcacttatcggggttcagttttatgcgggcggagcggaggctctcaaaagtttccgctagatctgaaagtaacgtttcctggttgcgcgtctttacaaccaagtcatcgacataagcctcaacattacgtcctaattggctacccaaagaaattcgagtagtacgttgaaaagtaggacctgcattctttaacccgaagggcattgtcgtataacaataagttcctatgggggtaatgaacgcagttttttcctcatcctccctagccatgcgaatttgatgataaccagagtatgcatctagaaaacacaaaaggtcgcaccccgctgtggagtcgacaatctgatctatgcgaggcagggggtaaggatccttaggacatgccttgttaaggtcggtgtagtcgatgcacattcgaagcttgccgttcgccttgggaacgaccaccgggttcgccagccactccggatggatgacctcgcggatgaatccggcctccagaagtcacgccacctcctcgcggatgaaggcttgacgttccggggcctggcgccgcactttctgccggaccggccttgcgcccggccgtacggcgagacggtgctcaatcacctccctggggaccccgggcatatccgccggtctccatgcgaagacgtcagcgtttgcccgcaggaaagagacgagcgcgtcttcctatttgccatccaagagaccaccgatccgtgtggtcttggacgggccgtcgcccaggacaacctccttgactgggacctcatcgcacgtgactatccgctgcctcggggcggcgggggcggatgtgccaagcctctcgtcgccaccctcgggcttggacacgacggcgaggcggtccgcgcgctgctccatacaagcgagcgcgactttgaggtcgccatggacagagatgggg

SEQ ID NO: 94614 - DNA, 1144 bp, Oryza sativa
gtgtgccccggcgtcacaccgatgattggctgggacggccggagcatcatccccggggccttgatggcatcaaaggctgcgggggaaaggatgttgagggctgctcctccatcaatgaggacacgccccaacttcacgttgcaaacggtgggagaaaccaccatcgcaatctgccctccccgggcaacgcacggtgggtggtcggtctggtcgaaagttagggcaacctccgaccaccgcgcccggcgcgtcgcctcatgagtaggggccgcggccagaagctctcgcttcatggccttgaggctccggcgagaaatgtgagcacacgctcctccatcgacagtggcaatggtggccccaggctcttggaaacctaggtcatcatcgccgtcgtcgatgtcctcggcgggggccttcttcttggcctcacttcgccgattgccggaaggaaccgccggggacttgccctctcggcgctcctgcctcctctcttcctcccacttcctcgtccgctcagccaaacttttgactgcacggcagtccgcgaggtcgtgaagggaagtgttgtggacggtgcaccacttgccggctgggcgctccctgctgggagcgccggcctttttctttttgtcgctcgctggcctccccttttgggtggcccgcgaagcgccctcgacggcgaggacatgaccctcgtcgtcggaatggactgacctcttcttcctcctcctgtcacgccgccctgtctgagcggcggatccgggggcggccgaagctgccactccggaaccggaggggttccaggtccatgcctcctccttacgagccactcggtccgcgagctgaaaaagctccgcggtagtctggggctctttggaggcgatcttttcgagcatgcggttgtgccgcacgccccccctgaacgcgtagattaccgcgtgtgcagggatgcatggtatggtattgcggacttgacagaaccgctgaatgtacgatcgaagtgactcatcgtcccttcgctgtactgcgtgcaagtccgcttcctcaccggggcgcggatatgtgccttggaagttcatggtgaactgttggcacaaatcctcccaagagtggacagatgcaggtggcaagttcattagccaac

SEQ ID NO: 94615 - DNA, 3092 bp, Oryza sativa
aaatccactttttcctaattggggctgatgccgagcaggcaggggcagcccatcgcgcgcgctagaaagctagcaggccgcggtgggccgcgagcccgcgagggaggggatcgggaatgcgcgaccacgcgccgggagtgagcgggaggtcgcatgcgcgatccgttgactgatttctctgcactaatttccaccgttcgccttgtcccacgtagggatggcaatcgggcgcgacgggcacgggtagtgcctacctatacccatgcccgtgagattatttgtgctcgtgggtatacccattactacatgacgggtaaggatggttacctatgcccattgcccgcgggcgtgcccgtttacccgccacaacaaaagcagtggaacaaaaagtctacaagctactaagttcgaatcgaacttaaaacatcaaatattctccacctcggtgtcgtgtctctcctctggcggcgatagagtaagaggagagaaataataagggaaataaaagggaaaccgaagaaatcaaagaactgggcttatgtattctagtggattttgctcctagcctacatataagttagatttcgtgggtaaacgggcaaagcgggcatgggtagtgattacccatacccatgcccatttactcatcgggcatagcttttgacccaataagatacccatgggtataaaatggagaacaaacccaaccctaatagggtttttacccgcgggtaaacgggcaaacgggcacaattgccatccctagtcccacgttgacgaccggcggaggttgatgccaaggatattgtcgttgccggcttgccgcgcatccatcgccccggtgcctggttacgtgcccgtcgcgctcaaaaatctcgtccacgcactgcacaaaagatcaggccggccaccgtgcccaggtgaaacacgaggtggccagtacgtgacagagccaggcagcgtgtgacgtctgtggtttttgcatgctcgcattgcccgcatccgcatgccgtcgtgtagcgtgagcaattgaccgatcgatttgtggccttggccttctcaacctgctcggctgcacctgacagcagcagcagtgtcgcagcaggtagaaacgctgttcagagagttttttttttttcaacgcgtgccagaccacaacattcccattacggattcacatggatccatagtaaagagggcccacatgttagtgactcaaagtcatgtggcttagtccgtgtttagattttttttttttgctaaaaaggtcacatcgaatgtttggacacgtgcatggagtattatttgtggaaaaaaaccaattacacagtttgcatgtaaattatgagacgaattttttgagtctaattacgccatgatttaacaatgtgatgctacagtaaatatttactaatgatggacacattaggcttaataaattcgtctcgcagtttatatgtggaatctgtaatttgttttgttattagtctacgtttaatacttcaaatgtatatccgtatactaaaaaaaatttggccaagaaactaaacacaaccttttttttgtgggagaagtttttaccgggtctccgggaaaccgggaaagtacgttggtattgcaaaaactattagaggatttcagctaatcctttccggagaattagacagcttaccccctaagaggatctcaaattctcaatcctcctcttacatgaacagaacgaagtacagccaaaccgccaaatgtattggaacttggtactagtactactagcaatgtagcaatagaatgctagacacaatagtatttttgaaagcaacacacgtttggtcgtaatcgccaaagcagtggaattacgccgcccatcatcaccatcagttggggatcaaccccagggccttgccgtacgcgacgaggtcgtcgtacatctcgtccaggttcttgtacttgaactcgaacccttcgccgatgagcttcgccgacgagagcgagatggtcggcttctcggggtgatgctcttcgatgctgcgtacatagcaacgcatgatcagattcagataaccaaatgcacgaatgcataaagcttaatttcttaattaccaatcgcatctgacgttgtactgggggtacttggccgccaggaagccggcgatctcggtgaccgtggtgttgaggctgccgcagatgtacctccccgacgccgactcctcctcggcgacgaagatctcggcgcggcacacgtcctcgatgtggaccatcggcatcgaccacccggacgccttctcgatgcccttgaggatgttcatcatctcctcgtcgcctgaaaaaaaaaattcacagatcatcgatgcagcgacccaaaaacgttcagaagtcgagttcttggattgcttcttgtttcattcattcggtgatcgctagatagttcctcaccggttatcaacgagaggcaggccgggacgctggtatcgaccctcaccgccggcgatgctccgacggcgacgaccgggcagagggtcaccaggctgagaccgttctcctccgcgaacttggtcgcctccttctccgaaagaaccttggagatcgagtacgcctgcagtgcatgcagcaacaatggcgccgaactcatgttctacgagacattgctgtggttcagtgacatggaacagctcgtgtgtatatatgtgtacctgcgtcggcgacagcttctccatggatctgaggtactcgatgtcggaccaggacgactcgtcgaggacatggccggcgccttccagcggccgcaggctggagacggcggccgtcgacgacgtcaggatcacgcgcttcaccgtgccggctctcgcgcacgacctcatcacgttcagtgtgccctcgacgccgccttggactatctctttctgccatggccaagttcagaattcagtaactaactaactgactacagatactaatcgagcttgcaggttgcagcagtggtcacctcgagatcgtcggacttgtggctcttgtcgtacaccggagcggcgacgaggaaggcgtagtggcagccggcgacggcctcgtcgaaactgccttcatcctccaagttg

SEQ ID NO: 94616 - DNA, 657 bp, Oryza sativa
gcgggaaccgcaagggggatcaatctaccccaggagggggtcgtgcttctgggccccgcgtcaggggctcggggagcaaccgccctatcgacgaccgggggaagaggaagctgggacgaacacctcccccatctcctccccgagggggcggggcagtgcgtgccagcagcaggcgcccggagggggccgcgccaacatcacagcccgagggggagcgcaagaagaaacggctccgcaagatgggggagacagaaccatctcggggaaacctcatctcccctccaaagtggtcgttcaaccgaccccctcgcaggttcatctctcactcatcgtggctgtatccattctcttcaacgcgagttttcactcacccgtctttgttcgtcttctggtcttttcttctgttttagcgagatcccgtcgcgtccctcccgtcattccaagtctggccaatctgaggccgaggatccggcggccgcagaggcacggaggcgagaatctgaccggcgagaggccgcagatcgcctacgggaagctgaagagcccgcccgggaggccgcccgggctcgccaggctgaggataccgctcgggaggaggccgcccgagcccaccaggccgaggaagccgatcgggagaaagccggatttcgccaggac

SEQ ID NO: 94617 - DNA, 2443 bp, Oryza sativa
  unsure (1)..(2443): unsure at all n locations
ggaggagggggaggaaaggaggagatgggccgggggcccatccgaaagaaaggaggaaaaagagaaaaaaaagaaaaagaaaaaagaaaaaggatttttttttcctggaattaaaattgcactttggtgatttttaattggttaaaattatttctagggctctgaaaattccactaaaaatcctgttagcatattttgacatgtagaatccaagaaaaattccacatgccgattccgattattatttgcatttattactttagggtttctctctaggttaaattaaacaatttcttcggacgatttattttatgaatttagagcaagggaggggaacttcagggcgtgacaaacctaccccccttaaacagaatctcgaccccgagattcggaagagctggcgaagaggtgcggatgggcggccttcaattcatcttctctttcccaggtggcttcttcttccgagtggtggctccactgaactttgcaaaacttgatcaccttgtttctggtccttctctcactggtctcgaggatacaaatcggcttctccacataagtcagatcttcctggatgtcaatgtgctctgagctagcttgttcctcaggtaccctcaaacacttcttcagttgagacacatgaaacacatcgtggataccaaccatattagatgggagctcaagctggtaagcgacttcacctctgcgttccaagatcctgtatggtcccacaaagcgtggtgccaacttgcctttggtttggaagcggtgtactccccgaagcggagtgacacgaaggtacacataatcccctgcttcgaaagtaagctctcttcggcggttgtcagcataactcttctgtcgagattgcgcaattcttagcctttctctgacagtcctaactttctcctctgcttcggttaacacttctgtcccaaacagttggcgctcacctgtttgatcccagaaaagtggtgtgcggcactttcgtccgtacaatgcttcaaacggtgccatttgcaaactggactgataactattgttgtaagagaattccgcataaggcagacttttattccaggctccgccaaagtcaagcgcacaggctctcaacatatcttccaagatttgatttactcgctcggtctgaccatctgtttgcggatgataagccgtgctgaaattcaaacgagtccccaattcttcttgcagtttctgccagaactttgaagtgaactgactccctcgatcagatactatcttcttaggtaccccatgcagacacatgattctcgagaggtagagctccgccaaccttttgcccgtataggtagggtgtactggaataaaatgagcaactttggtgagtcgatccacgaccacccagattgaatcgtgcccccgacacgttctgggcaaacctgntatgaaatccattccgatttcttcccatttccattccgggatctgaaggggttgtagcagtcctgcgggcctctgatgctctgctttgactcgctgacaaacatcgcagagtgcgacgaattcggctatttctcttctcatgctggcccaccagaatttctctttgaggtcctggtacattttaatactgccgggatgaattgaatactgagtttgatgagcttctgtgagtatgagatccttcagttctttgtcgtcaggcacacacaatctttctcccaaccagattgtgccattctcatcctcatggaaatctcgagcttttccaaccctcatattctttttcagctcagctatttcaagatcatttacttgagctgctctgacttgatccacgagcgtaggcccggcctctagggcagctacgtacccgtgttctacgatgcccaaatttaggtgctcaagatcttgctgcatttgtcacacatgacttcggtatatactgcattgcaatagctctttctgctcagagcatctgctaccacatttgctttgcctggatgatagtgtatccccatgtcataatctttaatcaactccagccatcttcgttgccggagattaagtcgggctgggtgaagatgtacttcaggctcttatgatcagtgtaaacttcacagcggttgccaataagatagtgccgccagattttcagagcatgaaccactgctgccaactcaaggtcatgagtgggataattggtctcgtgtgggcgcaactgtcgcgaagcatatgcgaccactctgccttcttgcatcaacacacatcccaatccttggcgagatgcatcacagtagacctggaagtctttcgtctgatctggcagaattagaactggtgcggagactaacttcttcttgagttcttcaaaactttggttgcactcagctgaccatttgaatttttcatctttctttagcaactgtgtcatgggcctggcaatcttagagaaattttc

SEQ ID NO: 94618 - DNA, 1656 bp, Oryza sativa
ttgcactcagctgaccatttgaatttttcatctttctttagcaactgtgtcatgggcctggcaatcttagagaaattttcgatgaaccgacggtaatagcccgcaagtccaagaaaactccggatctgagaaactgtctttggtggggtccactttgtaactgactccacatttgatggatccactgccacgccttgagcagaaatgatgtgacccagaaatttgacctccgataaccagaagtcacacttgctaaacttggcatatagttggtgctccttcaatatctcgagtaccaggcggagatgctgctcatgttcctcttctgattttgaataaataagtatgtcgtcaatgaataccacgacaaacttgtcaagaaactccataaacactttgttcatcaagttcatgaagaaagccggtgcattggtgagtccaaaggacataaccgtgcactcaaacaacccataccgagtggtgaaggctgtcttgggaatatcctcttcccgaattctcaactgatgatagcctgatcgtaggtctatcttggaaaacaccttagctccttttagctgatcaaacaggtcatcaattcttggcaacggatatttgttcttgattgtgacctcattaagggcgcgataatccacgcacatcctcttggtcttgtctttcttctccacaaagataaccggagcaccccaaggtgaagtactcggtcggatgtaccctttctgcagctgttcgtcaacctgcttcttgacctctgctagctcattagctgccattctgtacggcctcttgtaaattggagcagtcccgggtgccaaatcgatccggaactcgatttctctcttcggtggcattgtagtgaggtcttctgggaacacctcaggatactcttgtactataggaatatcctccaacttcctgggacttttctccactgtttctgtctgaccctcaatagcagcctgattcagactcgctacggacttctgcgacgctggggaacggaaggtgatcttcccccctttgtcgttggttagggtgatggtgcggcttgcgcagtcaatcactcccttgtttctggtcaaccaatccattccaagaatgacatccaggtctttagattcgagaaggatgaggttggatagaaacggtgatcttttgatctctatagtcaccgaggggcagtagtgtgctgtcctcatatcatttccaggggtatgaacctgcatcggtattttaagttccactaccgataatccatgtgtcccagcaaatcttttggaaatgaaagaatgcgaggcacctgaatcaaagagaactgttgctggatatgagttcactggaaacgtgcccaacacgacctctggtgctgcctgtgcttcctctgcagacacatgattggcgcgggcctggatgaacctgggtccagtgcgattcagcttcggacacttgccagcaaagtggccgtgcttgccacagttgaagcagggtcctggctttcctacagcccccttcttgggttgttctgactgaactgacacagttggcggatctgactgagctggtgccattagtgggggtggagtcgagttgtggttgcgctgcttactgttgttgtgactgccaccgttgtaatcgttg

SEQ ID NO: 94619 - DNA, 980 bp, Oryza sativa
gcttgcctccttattagtcaaggatgcaacggtacgagcctatagaacagatcctgttcaagtaaggtcgtgcttagcggtcaaaggttttgcattttaagctagattcatttcttgaagacttccgaggtggtactatgtttggcaaatgacgccctcccatgttttgttttgtattgtctcaaactctaggtctgtgcacatggttgtcatgtactgggctgctgggccttccttcctaaaatgaacccaggccttcggctacaccatggagccgtagaaagtggaaacatggttagtggtaaaaacagttacagaaattcttaaccaaccaaaataaactagtaatttgcccatgctaacgctacggcgatatctagcaaattttctacttaaaaattattttactatttcgaggtccaaatttatttaaatattattatcacaaaccggagtagctctcagtatgaaagttcaagtcgcaatcaagagaagtaatctgttcactattatttttctacttctacatgcataaacaaatatcaattaaaggttttctatttttttcatcaataatcaccatttgtatcacaattctctatccagcatttaagaaaggtttaaaaatatgtatggctatttttggaaatatcatatttgatagagaacctccgtccgtcgctcctccgttggcctcttcctgtcccagcgacagtacgccgtcgatcttcttcagcgagccggcatgtctgaatgccaccccaccgccaccccggttgatgctcgggccaagctttccgcctccgacggcgcccccgtcaaggatccgaccgagtacaggagccttgcaggcactctgcagtacctcactctcactcggccagagctcgcctatgctgttcagtaagtctgctcttcatgcatgatccacgggagccccaccttgccttggtcaagtgcattctgcgcttacgtcaaag

SEQ ID NO: 94620 - DNA, 936 bp, Oryza sativa
catactctcttaattctaaaataaacaaatcaaatataaaatgtgatatatcttgaatctgaacaaataaaagagtagcttcttaaatttgccgtatgtttctcaggctctcaccagacagcaaggagagcgtagttgggatgcttgttgtggtcaacggcgtcggcgccgcgcccaaggtgaacaccgggagcacggtgatgaggctgatgtcgttctcctccgcgaatttgcacgccgccttctccaaaagcaccttcgagacaccatacgcctgcaaaacgcaaacgcaaaaacaatggggtgtgctagcatcagccagccgtcattttcatcagcccggtaaaaaatgtatatgaatgatttgatggaggaccaaaaaagaaaggagtagaatgtgacccaagatggtggcttctctctcgtcaggtagtcgacgtcggaccaggacgactcgtccaggacatggccgacgccgccttgcagcggacggagggcgacggcggccgccgacgatgtcagaatcacgcgcttcaccgtgccggctctcaggcacgatctcatcacgttcagggttccttggacgccggcttcaatcatctctttctgccatcaaacgttggcaggaaacccagcttaatttgtcatcgtagaagttaagagcaaattaatttcagtactagagactaaagagcatgcttatcatcagatgacacaagacaactgtcaactgtgacgtcgattagagaaaaccggattaattagctaagctagctgttcacctcaggattctctgactggagattcaccggagcggcgacgaggaaggcgtaatcgcagccgttgacggcttcatcgaagctgccatcttcgtcaaggtcggcacggaagaccttcaaggtgcctagtgcctccaaccccttgagatgggaattc

SEQ ID NO: 94621 - DNA, 1540 bp, Oryza sativa
gggctataaagaaagtgtgccaaccggcacactaatgttctggtacttctaattagtgtccaaacatccgatgtgacatggcttaaagttttagtccctgatccaaacatttcaaattattttaggacgaggatgcaacactatgtgcggggttggaccatctatggaaagaaggatggaccatttacggaactgtccttacagaactgttcagttgatatgaaagtgggtggttgtttggttgatatctgattgaggagtactcctttcgtctcataaaaaatcaaccaagtatcgaatgtgacacatgctagttgttgacgagtactacaaataaaaaccaaatctatgaccggatgtatagatggccattcgggcggcacggcccaggcacggtcgtgtttaatgaaatatatttaatgtagtgtttaatgaaataaattttgtgttgtaaatgttgctaattttttctataaacttagtcaaaccttttactgaaaatgtttgacaaaaaaagttcaaaatgatttataatatgaaatggatgtagtattaactactataaatatgccaaatggttttattagattttttaaagaaacttaaaaacatgtccataatatacatcttttaacagtttatgaagcggctaaaaaaacaagtggcatccctaacagaccaacgaacggagccttaggtccctcaaaatggacatcccctaatttcttacgtatcaaccaaatgattcttgttaaatttttttataaaaaatatataaatgacatgcaagaacgaaggatatgctctaagggtattaaacttcattgccattatccactgtgtattaggctcatcttaaaacactgtactatttttttttctttaaaaacactgatcacttatttcgcaagcgcatactccagttcggtcctcgtgacagctaggttgaaggtagagcagcatcagctattcgttcaatgtggtagaattcccagggccctgccgtactctacaaggtcatcgagtatgtcgcccatattcgtgtacttgaactcgaacccttccctgatcagcttctccgacgaacagcagactctcggtttctcaggcatcccgtcgaagctgcaaagatacagagacgatcactcgctcgtcagatcgaacacaacaatatttatctattttggatttccaagttggtcaacaattcgatcgtaccggtcggttttgacgttgtactgcgggtaccttccggccatgaaacgggcaagcgccaagacggtggtgttgaagctgcagcagatgtacctcgccgacgactctgccgacgacaatgacgatgactccttctcggcgaggaatatctcggcgcggcagaggtcgtcgacgtgaacgatcgacacggagccggtgacccactgcaggggcttcaggacttcgagatgcgtctcatcacctgagaagtagtagtaaaaaaacagcagccaacttaaactgtgtaacacgcgttgcaaagagtgttgagacttggggtctgttt

SEQ ID NO: 94622 - DNA, 1729 bp, Oryza sativa
gccaccggcgccggcgatgcgcccaaggtgaacaccgggaacacggtgacgaggctcatgttgttctcctccgcgaacttgcatgcggccttctccaaaagcaccttggacacactgtacgcctgcaaacgcaaatgccattgccaattgggtgcaagcttattttcgttggtaaatttaaagaacttttcggtccaatatactgagtattttaagaatttttatcaaattaaaaatggtattttagtaattttcattctagtttgcaacagcgcagtgtctcatggtggtgaaaataatgcctatctctactccctctgtccttaaataactcaacctcttatgacacatcctactattctagtaaaacgaatctagacactctaggatgttacgagatttttttttaacggagggagtatttcgctataagttgtgagtttacataattaccctcatccaatagtatggaaagacaattttaccccctttaattttatactataatatattaaagcacaaggaaatattcataaaaatctttgaattgtttgtactggcagcacatactagtagtagcatatattagtatatattgtacggtaaaagttttcttgaatttatggataagatggagatgtgaaaatgtcaagagagaggaacgtcacccaggctggcggcttctctgttctcaggtagtcgacgtcagaccaggactcctcgtccagcacatacccgtcgccttgcagcggccttctggagatcgctgcgtccgacgatgttatgatcacgcgcttcaccgtccctactttcgcgcacgatctcatcgcgttgagcgttccattgacggcggcttcaaccagatctttctgccaccaccatcaacatcgcaaaaaaaaaaaaaaaaaaaggaaatcaagattagtagagcacatcagttacagagtatcagagtcaatagtgatgttaattagctgttcacctcaggattctctgaattgaagttcatcggagcggcgacgaggaaggcgtagtcgcagccggcgatggcatcgtcgaagcttccttcttcgtccatgtcggcgcggaagaccttcaaggggccaagtgcctgcaagtccttgaggtgggagttcttcgccatgtcatctgaatacaaaccgcagcaattagtggaatcttcagagatgaaactgaaactctgaaaattcacaccatcgtattgataaagtcgcatcatattttgatccatcatatgtcacgatatatatatgtaactatcggttggaagttggaaaaggataagatttgacaacttctccctttcgaaagatatgatattgtccacatgtgcggctaagcctgccatttgctaatgagtggttaagcgaaaacactcgctaattagctcatatggtactagcaggccgaggatatgatcatatgaatggaagaaacactgcaaaaaaagtaaaaaacacgaactagagagtgaaaaaaggaggagaatcttaccggggtttctgaccgtcgtgttgacagcatatcccttctccaacagcatcttgatgagcgcagaagcgatgtacccgttgccgccggtgacgcacgccgtcttcctctcgaccgccgacatcgtcgtcgtcgatcggtcgctacaacaacccaccagcccagatgagacgaagaggacggggaatttatgtttgttgctgtactttgggaagag

SEQ ID NO: 94623 - DNA, 927 bp, Oryza sativa
tatttcagctggttattatggagaggatttactagacaaaccaagtaaattaatcgtgacgatacaagtaaaagtactcttccgtttcaaaataaaacaacatagtattggattggacacgtacataataaagttggttattattattattattattattattattattattattattattattattattattattattattatttcagagacaagatttttatgggaggaaatattattccttccgtcctataataaattcagttttagacttttctatttatcccaaaataaatttatttttaaagtaatcattacatcatgtgaaagtatgataagcctctcccatttatcccaaaataaatttatttttaactaatcattacattagagttcttgaaaatatgatagtatatatgtattgagaataaataaaaatagaaataattatattgggatttaataaagtgagtatattataggcttgtaggtaaatattggtttgtgtgagataggtaaaaaacaaacttattttggaggaaggaatagtaattaatgtgacataattgatatctaatcaacagtggcctggcagcgatcagagacttgacaagtggcaattactacctaggacaagtggacaacatcgagtggcacttggccccacaatggcactgagtttggtgggagatgtgctacgtgtctgcatgcatttacctcaggattctgagacttgaggttcatcggagcggcgacgaggaaggcgtaatcgcagccggcaactgcctcgtcgaaactgccttcctcttccaagtcggcgcggaagatcttcaaggggcctagtgcttgcaactccttgaaatgagagttcttctccatatcatctggaactcaaaatcacaatgcgctgcagtttcagaggccaaa

SEQ ID NO: 94624 - DNA, 2398 bp, Oryza sativa
ttttaacaagaaaggaaattggataaagtgttgcactacgtactttgctagcgcatatacactaaataaggaacccccgaggctgcatagcacgtttctttttgggcaaagtggatggccactatccggataagctcttttgggctgagtttggatgtggtgctagaaatttaggatttttcacaaatgctaaatgagactaaattattagtgtcaggttaattgaatactttctccattttcatagtattgttgttttgaattttttttctattctacctttttaaatttaatcaagtttataaaaaatatagcaatattttaaaacagaacaaacacattattaaaatatctttaatgtagtatttaatgaaattaattttttttacatgttgctagtttttttttataaacttagtcaaaccctttacttaaaaggtttaactagatgatttataatatgaaacggagggagtattaattactataaatatgacaaatggttttattagattttttttaaagaagctttaaaacttttcataatatacatcatttaacagtttgggaagcggctaaaaaaacaagtggcatccctaacagaccaaatgaacggagccttggtccctcaaaatggacatctccttatttcttacgtatcatccaaatgaatcttgttaatttttttaaaaatatatataactatttaaatgacatgcaagaccaaaggataccctataaggtattaattttttttgccattatctactgtgtattaggctcatcttaaaacactgtatttttttttctttgagatgtttaaaggcacagaccacttatttcacaagcgcatatatagtttggtcctcgtgacatctaccccctctatcccataaaaaccatcctaaaccatcctagtactgaatgtgacatatcttagtattacaaatctggatatacacctgtccagattcgttgtactagaatatgtcacatccagtcttagtttcgtttttttggacgaaaggatatgtcacatccagtcttagtttcgtttttttgacgaagggagtaggttgaaagtagagcagcatgagctgttcgttcaatgtggtagaattcccagggccctgccttactccacaaggtcatcaagtatgtcgcccaaattcgtgtacttgaactcgaacggtcgaacccttccctgatcagcttctccgacgaacagcagactctcggtttctcaggcatcccgtcgaagctgcaaagataacagagatcatcactcgctcgtcagatcgaacacagcatgcatgtatatctatgttggatttcgaagttggccaacaattcgatcgtaccggtcggttttgacgttgtactgcgggtaccttccggccatgaaacgggcaagcgccaagacggtggtgttgaagctgcagcagatgtacctcgccgacgactctgccgacgacaatgacgatgactccttctcggcgaggaatatctcggcgcggcagaggtcgtcgacgtgaacgatcgacacgtagccggtgaacgattgcaggggcttcaggacttcgagatgcgtctcatcacctgagaagtaataaacagaagccaacttaggtgtgtttatattcagagacgcggtaaagttttggcgtgtaacatcggatattatatagggtgtcgtaagagttgttggggcattaataaaaaactaattacagcatcgctaataaaccgcgagatgaatttattaagcctaattaatttatcattagcgaatgtttactgtaataccagattcgtctcacaaattagtcgtaatcttgtaattagttattttctagcctatatttaatattttatatagctgttcaaatattcgatgtgacggggtgtaaatttttaaggtgggatctaagaaccacctgcaagtgttgagactttggtgggagctagcttgttgatttgatcgctggtgctggtgcttctaactcaccggatagcagggagaggatgccggggacgctcgtcctcgccaccggcgccggcgctgcgcccaaggtgaacaccgggaatacggtgacgaggctcatgttgttctcctccgcgaacttgcatgctgccttctccaaaagcaccttggagacacagtacgcctgcaaacgcaaacgccattttcaaccatacaatatttatttttggtaaacttataaaaaaagtctatgtttagtttattgctaaatttagtcaatatataagaaatcctgccaaaattttgataatattagcatcttgccaaaattttaacattgccaaaacttggtaaggtttatttttgttacaatctaaacaggccctaaatttagagaacttttctatacaatat

SEQ ID NO: 94625 - DNA, 2804 bp, Oryza sativa
ttcgccatgtcatctgaatacaaatcgcagcaattagtagaatctttgagaggtgaaactgaactctgaaaattcacaccatctttttgagatcatataaagtctcataataattcgatccatcatatgtcacgatatgtatatatgtaactatcagttggaagttggaaaaggataagattttgtcctcatgtgcggctaagcctgccatttgctaattggttaagcgaaaacactcgctaaaaagctcatatggtactagctggcctatgatttcacacctgaactgaatggaagaaacactgcaaaaaacatgaacttagagagtgaaaaaatgaggaggagaacctcaccggggtttctgaccgtcgtcttgacagcatatcccttctccaacagcatatcttgatgagcgcagatgcgatgtagccgttgccgccggtgacgcacgccgtcttcctctcaaccgccgacatcgtcgtcgtcggtcgctacaacctctccagcccagatgacgaagaggacgatgaatttatttttgttgctgttctttggaaagagttcaatttgtgtagtgagccagtgaggtggtctggcgtgcttatcagtaagtattcctaaaagaaacattctgacgagcactatatccagaatatcacctttattataaaataaaaccggtgcggtgcgagttgggtggttgattgaagtgtcaatatggagtggacaaatagatcgtcatatcacgctgctctcagcaatggtaagcatagctggtagagtactacacaatactacggtggtgtttgaatattgaagatgaagatggagattaaggggctgtttggttcagatactaacattgactaggtttaccatgctttcttaaccaaacttgccaaagatgaggccatcaaaatccaagccacactctagccaacaaaatgaaaccatgccacactttttagagacacttacatgtgggacctagattacaaaagaggaatcttgccacacttgtggaagccaaccaaacaatcatctaacatggtcaaacttgtctaaccttaagtatggcaaagtgtagtaacttatggccatcaactaaacagcccctaagtttttatgcaaaacaatatgctattaacgtatgattgattgagttttaattcttacaaacttgaaaaatagattaatatgatattttagtgcaacttttatataaaaagtttttgtacgaaacacatcatttatcatttaacagtttgaaaagcgtgtcacgaaaatcttaatatttatctaagtcttgtggaagaaaagaactggacctgagtcatgcattcgtgcgtctggactgacatgtagattcatggccgaccatcgacttacaactgacgttaatccgggcgtgcgtcatacgcattgtccgtaagccgatcgagagaggggacggtaggtaaagtacaatcgccccgtgtgtcgtgtcgtgcaccgtgttaattgggggaaaaagtacacccaaggtccctcaacttgtcagcgagataaaaaaacatacttaaaccataaaaccatatatatatatagtcccttaactaaacaaaaccgatcacccgagatccttcggtggttttgaccccgatttcggtctatgtggcggctgagtcagcatgggaccaacgtgggtcccatatatcaggatgccatgtcagccggtcctcggttcctcctctctgttgagcgcgagcgcgaggcttgcaggcgagcagatggttgaggactctgcgagctcggaccggtgcacgacgcggaaggggtccgggtgaccggcgagggcgcggtcgacggctgcaacgcccacggcctcggcggcggagaggaggagatcggcgaccagcgccgccgccgccgcgcttcctccacgcgctagccaccaccgcctccacggggacctcgccgtgggcggcggccatcgtcgacctcgccgcccctagggccctccacgccggcgcacaaggggcttgccgcggaggatgagcggcgtggagctccagacgcgccgccagcgggaggcgagcgcggcggtgcgagtcgcgcccttgaagggaggcgggcgacgaggaggtcgtcggggagcgcgctgacgcggtcctcgccgtcgtatccctcggcggcggaaagcatggcgccgttgtcggaggcgggatggccggggaaccaccggaggcggacttggacgtggcgctgtcgtcgtcgtcgtcctcggcgtcggggaagaaggtgggcgcggcggcggcggaggctagggggttgccgcggctagtgtggatggaaagctgaacattgcttcttcagctccaatatattgtaattcacgagcctttttattttgatggttgcttcttcagttcgaaagatgtctctgtttttattcttgttcaagccattggcaagtctgaagaacctagactgaattctatactgtagtacagttctaccatcgtcagtacagtataaagaagcaatcttttgaatccttttcaagtaggagtatagtatgagattattatagcctgtcaacttgctgtttgtaactagccaatgctaatcttttcagctcgattatgatatatatcacgtcgtcagatttgtgcaaaattggtatagagacattctgaccgggttatggtcgatgacactgtccatcatctgagagtttgcaagtctctgaactctgaacattgcccagaatctcttacaggaatctttttgttggtcttctcatacagtatatatcattggcc

SEQ ID NO: 94626 - DNA, 522 bp, Oryza sativa
caataggacaacgttctttaaagatggccgcttttcactaatcacccccgattaatccattacttaattaactggagttaaaactaaatttagctgaatttggcttgcagctgtcgtccggcggggacaagcacaacgagttcgacttcgagttcctgggcaacgtcaccggcgagccgtacctggtgcagaccaacctgtacatcgacggcgtcggcaaccgggagcagcgcatcgacctgtggttcgaccccaccgccgacttccacacctacgccgtgctctggaaccccagccaggtcgtcttcctcgtcgacgacacccccatccgcgtctacgagaacaagaacgccaccgccgccgtcaagggccaccaccgccacgccgccgccgccaatggcaccagcaacgccacatcggcggcggcgtccgtgccgccgttcccgtcgccgcagccgatgtcggtgtacagctccatctggaacgcggacgactgggcgacgcagggcgggcgggtgaaga

SEQ ID NO: 94627 - DNA, 849 bp, Oryza sativa
taccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattatgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtacgcgctactggatctgacactaccatgaagcgccgaaagtgcgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacgggcaactcgttctgcctgtacaggtgtgacctctggctgctcctgagtgtgcgcctctggagctcctccagctgagaggagcctagtacgtcgtggtggtgtgcaccgtgcaagtcgtcgtcgtagaactggctagtaggac

SEQ ID NO: 94628 - DNA, 1496 bp, Oryza sativa
cctatgcaagatggaaataaaaaattcagtagttgtcctatattatgcaagataaatgaaataattgtaagaagtaatacaaattcgacgtacccccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacatgtgaagagaggtacattatatggctcgatgatcgcttaattatcataaaaatttagaaatgaacaatccgaactcacgagtggtcggcaaggaggacggtcggctgcacgttgcccggaaacacctgcctaagtccgaactgtctcatcacatgctgcgggcagtgaggctcaacgaaaatgtcgaacaccatcggcaggatggtgagccagtaagcctggtcgcgtgtgcacaaggacgaaagtcctagcggtgctctcgcagcgacggcttcttctgtgtacggctcccagatgacgtcgctcggcaggagacggtcaaactcgaacacgaagtccgggtaacctcgtctcacctggacgtgagcgtaacgacgctgcaataaacatgatcggaattagacatgttatgtgaagaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgtggcacgtcctgtggctgagcatccgcgatgaaccgtgcgtagtggaccagccggaagtccacagcgtgcccgtgggtgctagtgaacatcacccacccgaacaacaacaacaggtacgcctcaagggagcgtcggaccgagtaatcatcagcgtcagggtgcagaaggtccgcctacaattaagaatgaaatgttagtacaaaacactctgttgatcgcaaataagcatgtatgataatacaacttatttacttacagtgaactggagcaaccaagccttgctaggcccgactgtagagtacgaagaaagggtgttggccggtcctaggtgtggaaggcgcatcacctgctcgaagcgcgcagtgatatcctcctcccacccaaaaacacagtccacgggaccaactggtgctcccgccagcggtagcccgagcaggt

SEQ ID NO: 94629 - DNA, 819 bp, Oryza sativa
ccaaacaagtgtagcagctaccattagcaatcatgcaaccaaaataattgtaagcagaacagattgaaatataaaaattatcttgacatacaggtgaaagcaacactcgctgtagagggagctctgtagaagcaaagaggccaacagctgttgcaacagtgcgtacaaattcttcccgcaccctccagctcttgtgagtccatgcataacttccagctctttcaacaatgattgtcggtgatgaaacctgagaatgtagagagtaaaaacagcttagtataccccgcaaaataatatcagaaccataaaggtccataagaatataaatgaatattaacattggaaaagcaacagtccaacaaaagatgagaaatctccatgcatacaagagaatatacagcctggaaaataagctcaagccaccaaggacattttttaaattcaaagtacaaataagtatttattttcaatggtgtagcaaattagcaacaggcaatgccatgtttcaaatgcaactaaaacattgattttgaagggctctgtccaaattcatagctaaaggtagctatattttgagacaaagggagtaaaaaagaagcagcatgcagaaaaggagaaatataggttcaactagctaaattctgtgtgttggtaattggctatggaaaaaaataatcaaacatgttctatatccaaaataagtgaatatgattttcgaacaaacatgtattttccccttttgtgtgcgcgtgtgtgttatagacatgacaattcagtcgttttgggctgttccatattaaatttgatttttcttaatgg

SEQ ID NO: 94630 - DNA, 548 bp, Oryza sativa
tttgggacaaagtttgaattacagaagttgatttattttgagacgaagcgagtacacatttgtttctggcgtaaaatgacataaacagtgtacaaaaaaaggggagaaattcatcagttgtaacttgcaaagacatatcatcgttgacaggcaggaacaaaatccagcacagcttctccacgagctccttccagactccaccctcaatttgctcggtaatgtcaaccaactgcgtcctcatcgttttcacccagcctgttccttcaacctcctgcttcgcaactctctctatcatgatcccagcattatctctcgtgctcacccagaacatccgtgccccgtaaatccaatctttcaggatgctccaaacttctatccgcaatgcaggagagaaggcgtccatccatgttcttgagtgtgctttgctccatgggaatgtacttagcaaggtgttctcgcggatctcaacaagagcaacattgacacaatcgaaaagaagcctttggtatgaactttgctcccgaagctccaagactttgttgaacaga

SEQ ID NO: 94631 - DNA, 729 bp, Oryza sativa
cagttagtgttcaacccttcggtttcgccgttcattcatgacttcttttattatgcagttatatgcgggaagcttgagtggacgtccacccacttattgcatgttatttaaatgattataaaaaaaattaaaaaaaatatgaacaagatagatcaatatgtaatatatcaattcacaaacatgtaagttaaaattcaacttctacaaattataacaaaaataacaaacaaaactcaaattactgtatgtatatttacaattaaatttgttatttttgttacaacttatagaagttgaatttgaacttacatgtttgtggagtgatatattacatattgatctctcttgtcaatttttttgaaaattttccgtaaccatctagctgacatgcaataaacgggtggacgtccactcaaattattagaatccatctctatgtatatgcaaactgtttttgagcaaacaaatgaaactaaatcacctacgagatcctccatgtccgcgggcttcatgtccacgacgttgaagcactggtccgtcacctccaggtgccacaggttgatcctgaggtcgtcggccgacacgaacgtctccccgtcactgcacacatgaaaaagagaacaaatctacattatgacctcgttaattctcagagttgagacagaatggcatgacacaggttgtaaacttgtactgtaatagctggatcaaccaacctaccagttgttc

SEQ ID NO: 94632 - DNA, 678 bp, Oryza sativa
ttcctttttgaagaatcttgacttgaaataggtcactcgtgctcaaccttgccctcgggggctcggttcggtcagctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgtggatctccccaggcactagccccgacccgagccatttgaggactaggacctgggcacgagcccttgatcaagccaagacacagaaggaccgcggcacagaccatcctcgtctcatacacacaacaaatagaattgacatagaaatttcctctttatttggttgcagattaaattagtctatacaagaagggggcccgaaggcctcggaagaagaaagaaaaagctattcaagattggcaggggcctgggggctcactccgacgcgcccgggtcaccagccttgtcgtcgttatcgtccgcaccaccgtcgacgccctcctcgttggagtcgatggcgaacgcgagccgaggggccgcaccctcgaagctgggaacgatgtggtcggcggcgtcccggacctgcgcgcgtgcgccgtcctcgggttacaaaagggaactcttccagcgctggccacggggagaa

SEQ ID NO: 94633 - DNA, 1274 bp, Oryza sativa
agtgcaagttcagactgggtagctagagtaccagcctttatttttattcagacactactgcaccaaggacagaaaggcattcaagaagttatgcagaattttgaaaaggtcatgaagttatttttccgttatttggatgatcctcatcacaaagttgcacaggcagctttctctacacttgcagatattattccagcttgcaagaagcaatttgagagctatgttgaaagaattttaccgtatgtattttcaagacttattgatccaaaggaattagttaggcaaccatgttcatcaaccttggaagttgttggccgcacatatcccattgacacattgctacctgctctagtacgttcactggatgaacaaaggtctccaaaagcaaaactggctgttcttgagtttgctaataagtcattcagcaggtacaaagtagactcagaaggttatagtaacagtggctttcttaagctatggctttcaaagctagcacctttaatacatgaaaagaatgcaaagttgaaggaaacttccatttctggaatcatagcagtttattctcattttgactcaacagcggttctaaattttattttaaatttgtctattgaagaacaaaaccttgtgaggcgagcactgaagcaatatactcctcgtatcgaggtcgatctggtaaattacttgcagagcaaaaaagaacgttcacgtcccaaatcttatgaccaagttgattttggaaattcttctgaagatggttatgcactgacaccaaagagtagttatgcatttgggcggttttctgctagttcccttgataatgcatcagggaagaagatgaatatggttcatggatcaatattccttgatatttctactggccgaacatcctctgatgtcagcattgataatgttaagcaatgtttcaaacctgaagctgaagttcttgcaacaagtagggaatcaaagaacattgctcgcacagttgtagaagctgcacgttcatggacagactatcctggaaaatcagatgctaccattgatgatgaaaattctactggtactcctcgtctggagtttggtcgtcttgctgtttctgatggacgtggtgctgttatttcaacttctgtggaagacgctcaagagggaaatccacttgtggagcttagttctgtgaagattaccccacacaccagtaatggccctagcatcccacaacttattcatcaggtacgcctgaaatatctcctttttccatcaactttgttagtaat

SEQ ID NO: 94634 - DNA, 1946 bp, Oryza sativa
catgtgaccaaggatgtcgtggcgaaggtaaactttcctcatttaggaagccctcttgcttttgggctaatccctttttaatgccggtgcaggtttcaaatgaagcaaaccagtgcttaaatgtcgtgttggcaaaatatgatctttttaaatgccttgctgtatgtacagagctcccttttttgtataaaagagtatatattaatgcaacactacttgtttacacttcttgttactagcagcttatacttttctttatctttgtgcttgcactgcaggttattgtacctttgttggttagtgatgatgaaaagatgcttgtcgtgtgtaccaactgtttgacaaaggtatcttagttacacgctttaattatcattgatgcaacaccaactccaaagataattgaataaaaacatcagacaatgaggagaagtaattgacctacatttaatttgtaataactttatatgtctatattcgtaaattcaagattcaaaataatctcaaaattctagattcctgaagtgttactagtacaatgaggcagtcattaatggtatttttatctctaataaggcctgtcacaacttgaatatcttggcaactaccaactaccgagttgattactggtgtaccttatacaactatttcattgaagcttcgttgctggtttacttgtgaatgagattaagtaaatattttttatattacaagaaacatgttagcttgtagagctgttccatctcatactggaattttattgttcatacataccatactaaccttatttggttgctggttttctcctggtaattttgcagcttgttggacgcctatcagaggaggaattaatgactcaactgccttcatttttaccagcactttttgatgctttcaataaccagagtccagatgttcgcaaggtgctttgcttgttctttgacactagtaatatgcccgtgcattgcaatgggcccatactactgagaatgggttgtggattagcctaaacatgcaatttttttaaccaattgtttttttttgtttttgtccggggaattttctatttttatgtgggagcacgcgctgcgtgcgaggggaggacggatgactccacttttatgtagtagagagttttcatagggatatgctagtaaagaaggcaatagactgatagttaacatgatagaaacatggtaggcatgtaaagaaggcaatagactgatagttaacatgatagaaacatgtaaagaaggcaatagactgatagttaacatgatagaaacatggtaggcatgtgatagactgatagtaaagaaataagtacggaatccatttatacaacaaaagtttacttcatacacaggaacagtatggcccatttgtagtcattcctaaaattatttaaactgatttatcatgattgtttaaattggatatatgaaaatgatatgtttgggtttgttcgaatattatttccattatattataatttaccatgctctatgttagtgccatagtgcattctctattttgagtttctaataatatgtccatgtttggtcactgtcaattgcactttaatcacaagtgaccatctgcctgctgtctaccattgttatctggattatgtatcaatatgttttagataattaaattcattccagcctttgcttcacagaagctacgtgtaataatatatgactatgtgcacgtttaatacatatcacctttaaaaaaatgaatgttttgtgtttggaatctgatatcgtattcactttcttccagactgttgtattctgcttggtggatatctacattatgcttgggaaagcatttgtaccatatctagaggggcttaatagcacgcagctgcgcctagtaacaatctatgcaaacaggatatcacaggcaaggtctggtgcaccgattgatgctaaccacta

SEQ ID NO: 94635 - DNA, 761 bp, Oryza sativa
cgagctcggtaccccgttatctctgcttcttgtttgcaagcagagggttatggttttagatctgtggacaatggttgttcagtttattataatgacattttctatttccatgcacccatgatgaatggcttatacattgtgaatcttgatggatgttcagtctataacattaatgcaaaaagacaacgtcctaatgatttgaatcccacttttatttggcattgtcgcttgggtcatataaatgagaaacgcatggagaagcttcatagagatggacttctacactcatttgattttgaatcatttgagacatgtgaatcttgtttacttggcaaaatgacaaaggcacctttcacgggtcaaagtgaaagggcaagtgaactattggcactagtacatactgatgtatgtggaccaatgagctcaactgccagaagtggttttgggtactttattacctttaccgatgactttagtagatatggttatgtctacttaatgaggcataagtctgagtcctttgaaaagttcaaggaatttcagaatgaggtacaaaatcatttgggcaagacaatcaagtatctacgatctgatcatggtggagagtacctgagacttgaatttggtaatcatctaaaggagtgtggaattgttccacaactcactccgccaggaacgccttagtggaatggggtgtctgaacggaggaatcgtacattgttggacatggtgcgatcaggggatcctctagagtcgacctg

SEQ ID NO: 94636 - DNA, 660 bp, Oryza sativa
aggcaagacagaatctgtctcgcaacttttcccaactaccgtttacacatccaacggtagaggtgtaccattgctttgctctctcttgaagagagaacgggaacaatttcgaccgcacagtttcttgtttcatgccacgaatcttaaggaacttacgaattacatgagcagacttgttcaaagtctcgcagatgattgtagggattttctagatcaaagccagaaaaaggattttccctaaccatactgattagttgtgtaaatgggctccaataaaggaggtggctcatagaattcgccccgaggagcagacagctcaaaaagaggttgctccatggtcgagaagagtgacaggaatacttctctagtatagcaggagcgaaggtagaaataaaaaaaataaaaaggatatgaggatgaactaggttcagaaatgatcagcaaccgttccccggcaacggcgtcagaaatgcttgttggtatttaatacggtcacagataaaatccgcaagcgcacggatataccgatgtagcactttccctacggagtattccaagggtatcgaatccaaaggaacgtgtgtgggcaaatctttcttgcggtcatccaaggacaccaagccaatgataggctaggatagagaggatttactagtgaga

SEQ ID NO: 94637 - DNA, 2771 bp, Oryza sativa
ccccgaaacagtgaccgccgtcaccgattggaagcaacccaagacagtcactcagattcgcagtttcttgggtttggcaggatactaccggaggttcatcgagaacttctccaaaatcgctcgacccatgacacagttgttgaagaaagaaaagaagtttgtgtggagcccgcaatgcgaaaaggcgttccaaactctcaaggaaaagttggtttcctcgccagtgttaatcttgccggatactcgcaaggactttatggtgtactgtgatgcttcgcgccaaggattggggtgcgtgctcatgcaggacggtcatgtggtagcctatgcttcacgccagctacgacctcatgaaggcaactaccctacacatgacttggagttagcagcggtggttcatgctctaaaaatctggcggcactatctcattgggaaccgctgtgaaatatatactgatcataagagtttgaaatacatcttcacccagtcggacctgaatcttcggcaaaggagatggttcgaactcatcaaggattatgatgtgggaattcactatcatccttgctaagccaacgtggttgccgacgctctaagtcgaaagagccactgcaacactctcaacgttcggggcattccacccgaacttaatcaacagatggaagccctgaacctcagcatagttggtcgcggattcttggctgcgttagaagccaagcccaccttgctcgatcaaatccgcgaggctcagaagaatgatccggacatgcatggactcctcaagaatatgaaacagggtaaagccgctggtttcacagaggatgaacacggaaccttatggaacggaaagcgagtatgcgttccagatagcagagaacttaaacagctgatacttcaggaagctcacgaaagtccttattccattcacccgggcagtaccaagatgtacttagacttgaaggagaaatactggtgggttagcatgaagcgggaaattgcagagtttgtggctctatgtgatgtgtgccagcgtgtcaggcagaacaccaacgaccggtcggacttctccaacctctccaagtgccggaatggaaatgggatgaaattgggatggatttcatcaccggcctcccaaaaacccaaggtggatatgactctatatgggtaatagtggatcgattaaccaaggtagctcgattcattcctgtgaagaccacctatggagggaacaaactagcggagctctacttcgctaggatcgtgagtctccatggtattcccaagaaaatcgtatctgataggggaagccaattcacctctcacttttggaagaagctccaagaagagctgggtactcgattgaatttcagcaccgcctatcacccgcagacagatggacagaccgagcgtctaaatcaaatcctagaggatatgcttcgcgcatgtgtcctggacttcgggaagacctgggataagagtctcccctatgccgagttctcctacaataacagctatcaagccagcatacaaatggcaccctatgaagcggtgtacggtcgcaaatgccggacaccgctattgtgggaccaagttggagaaagccaagtgttcgggactgatattctgagagaagctgaagctaaagtcagaatcattttggataatcctaaggtgggacaagtccccgcaaaaaaggcatgcagataaccgtcgccgtgatctggaattcgcagtggatgactttgtgtatcttcgggtcacgccattgcgaggtgtgcacaggtttcagacgaaagggaagctcgcacctcggtatgtgggtcccttccgtatcatcgctcgacgtggagaagttgcttaccagctggagttgcccgcctccttgggcaacgtgcatgatgtgttccatgtgtcgcaactcaagaaatgtctccgagtgccatccgagcaggccgactcagagcaaattgaagttcgcgaagacctgacgtatgtggagaagccagtgaaaatcctggacaccatggagcgcaggaccaggaaccgggtaatccgtttttgcaaggtccagtggagcaaccacgccgaagaagaagctacttgggagcgcgaagacgagctgaaggcagcccatcccgatctcttcgccagttcttccgaatctcggggtcgagattccgtttaaggggggtaggtttgtcgcgtcccaaatcgactctaaaattcatcctcaaaattgtgcaaaagaataattaaaattcatgtgaaagcctccaacaattaaaatgtgcaaagataaaagtcaaatgaggcttggaggatttttgtatatttcctaaaagcctaaaatacttaaacaaattttagtggaattttcagagcacaaataataatggaaaagaaataaacaaagttgaaatggttttataaaaagaaaatcctaaaagaagttcttttccccccccttccttcttgggccggctcggcccattccctccctctctctctctttccccccccggcccatcggatccccgcgcgcgcgcgcgccgctgacaggcgggcccgcccgccgctctcgctgacgggtgggacccacctgtcatctaccttctctcgccgcgcccgccgccagcgcccgtgccctagcgccgccgacgccgagaatcccgccgctcccgtccgccccgcgtgcaatcaagaggggggaattattccccgcaatcccctcccccgtttccccctctttaccctctctctctcccttggattcg

SEQ ID NO: 94638 - DNA, 1026 bp, Oryza sativa
ctgatcagagtaaatctattcgaatagccgagccctcggatatgggcaagccgagcaatgtacccaagtcagtgttctaattcttaaaatttgctcaacaactaaaatgtggaatggttggcctgggttggcctgggacgagctgggacccagggtcgggttgccagttcggtccgaatcatcgtaggccttgggttaaggcaggttcgtgtgggttcacggccttgattaataatattggatagttctaggatcgtgtttacaaaatggccttgagcaactaaatgtctttaaatgctgtttactgcaaccctaaccctctatattataattcccttgtactcccttgcatttattctgcatttgtgggtgtgtcttgttgagtacggtggttgtactcagtcttgctcaattttcccaagcccagatgaggagttccttgaagatgaaggctttggtgtctagctcgtgcctgccgtcaagcgcctgtggtcgtcgccctagtcttccgctgtttttcgttgtctttgagtgtgctgggccgttgttgcccgtgtaataattttatatacgcttccgcttgttaaactctgaattgtatcaacttttggtgtaccttgcctcctgggacaaggattaatgcacgcacgtaaggaatgcccgttgggttatttccggtcgtgacacccactccctcgggcaaccctcaggcgacagcctccggggaggctcgcgacgaggccgcgggcacatcgcctgggcccacctccccgggtgacgcccaggatcaaacgggtccgggggacatccccgagcccagcacgtcctccggggggccgagccgcatcgccttctctccaaggcggctcttctcctcatcttccgtcgccccgctgagcgccgagcccattctgcaggccttggccgccgcaaacaccgcggtgctagatgggttcagcgcccaagtggaggccctgcgcgcggaacgagcggagctcgagcccgcatgggcacgcgttgagcagg

SEQ ID NO: 94639 - DNA, 1794 bp, Oryza sativa
gccttcgctcttccaagtagtcgaggtcatctctacgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggcaactcctcgatccatgaatcgccatgcttcttgagaatattgaaggtcttggttttaaggcctttgaggatttctgcattggcgcgctccacttggccattgcttctggggtgggcaggtgaggcgaagcaaagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgataaccggataagcctcgggccacttagtgaacttgtcgatcgcaacatacagatactcaaacccgcccggggcccgtttgaacggtcccaggatatcaagcccccagacagcaaatggccatgatagtggtatgatctgcagggcctgggccggctgatggatttgcctggcgtggaactgacacgctctgcatcgccggaccagatcgactgcatcattgagagctgtcggccaataaaatccttgacgaaaggccttgccaaccagggtgcgcgaggcggaatgggctccgcactcgccctcatggatgtcagcaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggctatcatgttatcccgtctgggcacatgccgaagctctatcccgtcaaaatggcgctccatacgccgtacttggcgcacgtaggcgtccatctgcgggtcagagcaccggtactccttacagacttggttaacaaccagctgagagtcgcctaacaccaggaggcggcggatccccagcccggctgccaccctgagtccggcaaggagtccctcgtactctgccatattattggtcgctcgaaagtcgaggcggaccagatatctaaggacgtctccggtcggggaggtcaacgtgacccccgcaccggcaccctggagggacagagaaccatcgaactgcatcacccagtgggtggtgtgaggcagctgcgaggggttcgtgctggcctcggggattgagacggtctctggagccggggtccactctgccacaaaatcggggagggcctggctcttgatagcgtggcgtggttcaaagtgcagatcgaactcagaaagctcgattgcccattttaccacccgtcctgtaccctctcgattatgcaagatttgaccgagggggtaagacgtaaccacagtgaccctatgtgcctgaaaataatggcgcagtttcctcgaggccatcagaatag

SEQ ID NO: 94640 - DNA, 1874 bp, Oryza sativa
tgtaaatgttgcacgtggtgttcttggtgtgtttcactcagtatcttacgatgttagtagttacaactatttttcttgtatggtataaaaatgtttcaattaggaatataatcatatatttgataaaaataatcatttgagattttgttttgaaaatttacttgtaaggagtataacaatgtaggagtaattagatagtatatataataaatagtttagtagaaaaatcaatttaaaatttatttatgttgcatgtcctccttcttgcatgcatggagtagaccatttattcataagagaaacaaagagatagacacgtagacaggaaagatgcatactttttgtatcgagtagtagtactagtctactgcatttagggcagtaacagtgtgccacacattttcgccgaacctcgcttgccaccaaggccaggaacggtattagctacatgctctacagtggaggtcactcatggtgggtccccccactctctctattgctctctctatccccctttacttttcactctgcttttcatcacatcgccttttctatcgcgtaggaaatgaggcgtcggcacggagcgttcccggcgatggactcggatccaagcggagctacggtggtgtttagggtggaaaataacatctgagatctcgtttgtttagagatacatatatgtgtgggcgtgccagtgtacctgaatacacaatgtaaacaaaacataggaaacatgctctttattaatcttaaaagatcataaatacaaattcccaatgtaatatatatgtatgcgcgctccataatctgtcattggacagatctgacttgtgcgatgtggtctcctggttcctggggcctcgagaagctcccagttaattacctccgcaggtctaggcctgcaagagaacctccgattaagctgcttgtggtcgtctcgtcgtcttcacttcgcattctccatgcatggttgtgatgatgatgtaaatgtgtgtgtgtgtgtgtgagcgccggcagcgatccatggcctcgtcggtccgtgcgccagtgttggtcgcccaccctccgtcgtctagccttgtcggtcttgaacaacgtgtcgatgtagattgttggtgaagacatgcatggagttgcgtagcttgaacgacttgacgtcacagcagttgcgtcgagattagattagagaagaatcagggaggaattattgaagatggttgatgtagacggtggccggatttaatcaaagctcggcatctcatttgggacaaataagaaaaaccaacaggacttcttcagcccacgcattggtttgtgcatggcactgtagcagcgatgacatgtcgtcctccgattggttggccacgttgccacaataattaacttaatcaacatgcattagctagcttgttgccatccaacagcactggctcgccgtcctcccgtcgtccttcctctgtactgcagccatacttgcctccatcgtcatccgctggtttcgacgccatgcatgatgcttgacctccggcatgagaactgatagaagtcttggcagtcggcggcagctccgccgatcctcggcgcgctccggcagggcggcttcccgacgacctcctccatggttagcccgctccagtgcggtgaagcttgcaaatcaaggatgtctggtatctcggcgaggtcgcagcttcgggtagatgcatcaccagcggcttgaattagcagcgtcgagtccagggacaagtagcactgcgtcggcttgaacagacaccggcatcgatgaagcttctgtgacgccgtaagatgaatcggccaccgcgacttccccggcgacgacgatacgtgtagaaggatccctatgcatggatgtgtgc

SEQ ID NO: 94641 - DNA, 2628 bp, Oryza sativa
atgttactacggctacacttaatctaagcctcacatcaataccatagtgcctgtgaacctcgaatattaacgattcattcgtacaaaaatcctacaaaatttctgttaagcagtggtcattatggacagatccttttttttttgtccacacgaaaattctatgaagttcagacgtttaattgtccttgatcatcaaagttatatcgaccgtccattctccgatgtactcatcctggccgtccaccgctacgagccttctccccctcgtacgcatacgcgaaacgcccccccaccgccgccgccgccgccgtattcctcctccgctcctcccttctcaagcaaaccaccggacctccctcgtctccgcatccggtccacccctcgctgctcgggtgtgcccctcgcgttgccctgtacgccggcgaggcgctatctccacctcatcgtgctgattttcccttctgtgggtgtgcaggaatcatcagaaaggaggaggaggatatgccgctgggactgatactgagctcgctcggaaggtcgatgcggcgtaagcggctgtcctcgctcggcatcctctcctccaagagggcgcctcgggattactacaaggggaagaactgcaagcccaccgggttccacacccgcaaaggtaatgccttgcgggacgctctgtgatctgattctagtcgtctgtattgctcaagcatgctctctttgtgtataatcgcatataagattgcgaccaggttttgcttagctgagaaattttgtgatttcgaaccggatagtttaattaaaccgaacgttgatggagaatgaaatggtgacagttgctagtcaccacactatttgcccaaccggaaatctggaagaacctaggaagggatgttctttatgtgaatcgttttgttccaggatttatctgagtcaaccgtgcaagtaattgtctgcttactgtaatttgggaggtgctttcaataatgtcaaatatcgcttcaataaaaggtgtgagtaaccaaagtttaataaggcattaaagatctagtgagtagcaaataacatttcaattcaacaggtccatttcaactggtggttcagccaagcagaaatttctcatggacacattgaaaaatgctctatctatcatagttacataatggtattttaatttgtatggtatataatcatcctacagaacatagtaaatcttggtgctatcatggctgcagctgtactgtggtaacgctcaagccatggcaaggtgcaaagcactattgcattggcttgcagccgcagcccacacaaccgcagcaaagagatccgaacagcctgtttgttagtctgccagaaagaaaaatattgaagagcagagtctggtggtattcagttcaccttgaaaatatgtaggcagtattcaacaaagaggcccaaacataaaatattgaagagcagagtctggtggtattcagttcaccttgaaaatatgtaggcagtattcaacaaagaagcccaaacatatctgtatgcaagtacagttttaccagtgctagatgattatgggtaacaaattacaggataacgcaaagacttatccatcagtggatatttgctcttagctataacttagccttgacctttctatgcaattcttgtttggagcacggacatgtttaaattttagttatcattgattagtttgattgttttgtgcaagggacggatacttctccattgtattcctgatttacttgatacttgattcaaatgacatttgtactaactattatatgatcattcaactgattgtcgttatctatgtccatcccttttctttcatgagtaaagcaacctacttgcttagtctaattttcgaaatattgattaattctgcaggtggatatgttatggtggatgagaagttgccaagatttgtggtccctgacttgactgatttcaaggtaattagcatactgccacggtttagtgtccactgcttctctggttaattccagtctgaacttgctgggcaaacttttaaaagtaacttaatggcacctaacaaacagaaaatagctaatataacataatcaaagctctcagttctgtttgaggtccttcttaagaaatatgatggaaataacttgccatgtccaaattttatctgaaaagatgatgacttcattccttgggcaatgagttgaatgctccataatccattactgttgaaacgtttaactcaggcaagacagataaattgatcatgaatggtataacatggaattcttctttatgtggtatgagtgaccaaggaatcatcttgttcctgttttttttcccttttcaattatggttgtgtgtatagtaataaatttcctgtataaatgactgcagttgaagccgtacgtgtcacaatgtgccagggacatcacagcgtcatcggcatcctccacttcagcagagactagtgaaaacaagaagtgatcttatggatgctctaggcattgtttgtgttttgcaagaacgcagagcatctttgcagttatgcttttcttatggtgaaaacaagaactgatcttagtgcatgtagcttcatcgtctgctgcatgttgactattatttagctacatc

SEQ ID NO: 94642 - DNA, 1845 bp, Oryza sativa
ttcttgctctattgtaagtatatcctcatgaattgattcacattctcaggcagttaaatgcatcaacccacaacttagattagctaagagagctggcaaaaagaagaaagagtacaagatctcattgatttcagataaatcctatgagaaaattagaacattatcagaagcacccattgaagaagtcttcactgattcaacatacggcaaggtgattatatgttatctgtactcttccttaaaaaatatgtggaggggaaataaaatgctcgattgtgaccattttgtatgaattcaagccaccactatttgttttctatgccctgtcttttgtttgagaagcaaaatgtaacatgtttcaaactttactttttctttacaacatgaactcactgagtatttttctttctgcagtttgagcgaggagaagccttggaaaatattacacaatctgtgaaagcaaagcttgaagaagaatgcgatgaggacagcttgaagtttcttcacaaggcagttgatacagtgagaaaacaggtagtgcacactaattgctttggttaaagccttgcaaatggagggaaaaacctatttttggcaactgatggacatcaaatgcatgcatgtcggtcaacttattattgtacatatacagctaacatatatcctgattttgcaatgcgcgatggctgatgtcattattcgaccttttgcccttctgcatgaatgattttatcacatctagttttcctgcttgaatgattttatcacatccaatttaaatgcatcgaaacttacaagtttggaatgacctggtcatgctaacagaaatagcagagcacttttatttctttatgatttaacagaaattataaactttggcaagtctgtaacttatgtatccaacacattagtgtataacaaatctcattgtttagcactttaaacttagcatgccggttttgcattgagacaagcaaacttctagtcctgatgcatccttttgagccttcgtttgcttcatatgcctagatttacacaacctacataatttattggtgttgtagatcccagatgtactagctatccttgacaaaaatctgatattactttattcagtgttatgttcttatgtagagtcacttctgttatttcagttgacatggatttgtgcccatcttttgcgcaggttatacgcaaaagaataatcgagaaaggacttagagttgatggcaggcaacttgatgaagttaggccactctactgtgaatccagcacatatccaatattgcatggatatgccctgttttcacgtggggatacacaggttctctcgcacacactttaaattgaaggaacattgcaacatttgttttccagtaaagtgcccacccacatggactactttatttgtaggttttatgtacagttacccttggtgctcctggtgatgctcagcgattggattcaattgttggtcctccaacaaagcgtttcatgcttcactacagctttccaccattttcaataaatgaagttgcgaaacgtgggggcttgaatcgacgtgaagttggacatggtacattgtctagtttatgtttgtgtgcagattataggaactagtgagttaattaccctgaagtattagacaaacaactaaggtcatgtttggattgtggcctattggtacgatgagatagtctcacatgggtacgtgtactcagtaagagagtgtgttgaaaaatggagaaaggaccagtgaacaatagatagttgagtccttggcaatgggtacgtgtactcagtaagagagtgtgttaaaaatgggggtaccgagctgaattcgcc

SEQ ID NO: 94643 - DNA, 708 bp, Oryza sativa
gaacaagataaaagcaatctgaattgtaaataggagttaaatacgaatgataagttggggttccgaagaacaagcagacggacggtctagccgacacgcgcgctgcaagcaagtagcaatggctaaactttaatctatcaaaacccaataaactgtaaaggggtacctgactatttaaggaggtgggaggacgacctaaggggaccctagggtcgtgctccacctggttggggcgcaccccacatgggccccacttgggccggggtcccagacgaagttacaagcccataggcccattataggtgacgcagcaccttcttttttgatttcgcccgactgggatggaatttggcgatgaagctggatccattggaaagatgactccgagagctttccatcaagtactcatggacccaaaatggagctcgcatgcatatttggcggccgtttgaagtcgacactgtagcaggtggccgaactggattgcagaacttggacagcttgatcttgatgtgaacgacggttgtatctatagtagccatggtcacatcatcctccccttcttcacggaaaaccgtcctcggtttttccatatggtgctcttcgtgtagtccatttaaaactacctgtttcttccaatcacaacaagacaaactcgagataattttgttagcaataacatttctctctagattgcatgttttatcc

SEQ ID NO: 94644 - DNA, 562 bp, Oryza sativa
ttatgccggttccgtttttccaaacagatctcgaaaccgacaccaaacaaaaaattcaccaaggtgtatgggatggcacggtgtagattgaaccaaaaggaaaggagagggagtcggactcaaggggggaatgccgcatggaaggtggtgggactcggtgagaaatctaaaagaaggaaaccgattccttttctgcgtggcccccaaatagaaacgaaagcaatctaatctagtctaatattctccttctatcttcctcatgcgcatcttctgcttccttcttcttcacgcgcacatgcacggcaaaaacaaacacacacaaggatcggcaaactctagatgcaactcaagaactcaaaactaaccgacagaaacttctgaaaactacaaaaatagaaccgtggcagcgagccgattccgttttcgtaggtcccgacaacaacagagacacggtggcagcgacgactgtggtacaaaacgtgaccagaactcgaaactctaaacgaactagacgctaagaccagcaacacgacgtgacgatgcaacacaaaattcaacaaag

SEQ ID NO: 94645 - DNA, 754 bp, Oryza sativa
agatatgtagctgtttttcaaactttctgctgagaaaatgatcagggctgccattgctctcttgtgttttgctgagtaattgtatcggtcaaaatgtgccaaatcctggaccatgtttttcattacgctatatcccacctgaaaacgtgacaattcatttggttctttgcctacaaggtcaccatagttgctgttgtgttgtagaagtattgagcctttaatatacttctttggccttggtggcgcattttccttcaccacatgttccttgcttgaacttgctaattcatacttggctctttgcttgttttcttatccatcttctcacgcttctggtcctttataataccctcctcccttgtttacctttctcatttatagaacccttcacatctgcatctcctccttatcgtcaaattcatagatttgggcatcagcagtcctaaaacctctcatccacatgttttttccttccactatggccagtacaggtgaagcaccatcagtaaaggctacagcaaagacttcaatcccttctggggtaatacagaattcctttctcttggaaccagtacccttcacaatccttctgaacctgcgcttaagttctttgcgggctttatcaattttttgggtagatgatctcaggatagcactgaagtcattagcatgagttaacttcaggtctaaagtaaatagcagttcggatggcatgtcatacactccaaatgactgttcatcacccattctgaat

SEQ ID NO: 94646 - DNA, 596 bp, Oryza sativa
gagtaattaagatcaatggtgatcacctggaggtagggcttgaggatggaccagccggtgccgatgaggatgatgacggtgaagagcaggacgcgcttgaagaagccgaagacgtagaacgccacgtcccagccgtgcggcgtgccggtgcgctccacgtaccacgagtcctccgccgcgcacgccatcttgagcgccttgaacagcagcagcgcgcccatgacggcgtggatccgctccaccgtcgcgcggtgccgcacgcacacgcacgcccacagcgccaggaacgcgaagtacacctccgacacgaccgtgtagatggtcggcagcggccgcaggcccacgggtaggtagtccctgggcccgtcggagatgccgtcccgcacgttgtacatctcggtgtacacgtcgacggtgacctccacgccgtcctggcagttgctgaacacgacggcgtactggtctgggtcgtcgatgctcacggtggtggtgaacgccccgggcgggacgtcgccgagccggagcaccgggagggcgtactcgctcgtcagcacgcagtaactgcccccgccgtcgtcgccgttgtcccccgggtc

SEQ ID NO: 94647 - DNA, 3164 bp, Oryza sativa
  unsure (1)..(3164): unsure at all n locations
gttggtatttcttacgatatttactagaaatataattccaagcaatggcgaagaaatactcntgatatattatggtacagggttcatccgcaagtgcacggatataccattgtagcttttcacccgagagtattccaagggtattgtatttgtttaattccatgggaagatcatagtagagagaaccatactaataatttatatgttacttgtaataatcatagtctaaataggggttaagataaatcaaagggtagagtgacacataagcatggagctactcattctcatactaaaatatctaagctaagtggaaagaaaatagaaaagaatctattcctatacttccagtatacatagtatgcatacattctagttatacgattaactagctaataccctctttctgatgccctcctggtacttcaaaacgccacccctgactgtcgattttccttacgacagcctgtcatgaccatataaccggggtaaatacggaggagtaccctccctaggaaattaacataggactatatacacgcgtggaggaatacccgtactgagctgtcaccatcagcggcccacctctcatccgcagcatataaccccaaatagtgatatcccataatctagacaccacgccaaaactaccacatactactctaatatcatcgtcatgacatagagtaattgcataggcaaacgttatacccgttaactatgcagtataatcaatataagatgaacataatgtaaagttggcattcatatactcggaaagtattccaataccagaaatgtataaagaagagtattctatataaagtacaaagcttacaaaagacgaaaggagagctactagagccatacccgaactcttccggactccgatttttattttattcctacttcactagcttaagaacactaaactaaacttgagagaatatgagagagtgtgttgaaatgtagagagtgagctccttaaatagacaggtaatgacggctatgacggttggaaaggtcagtaataccctccaaccgtcattggggatcaatcccagccgtcaatcaaagaccttgcatccagcggctgcatggctggtttggccgaactaggggacggcaaaatccagcccaatttcggctggcggcctcctcttctgttgctcactttagacttgtgaattttggcccaattcatcgtgtcaattctgagttcttggccaattcatacataagtctgattctcgacatcatccgattgatttgtcgtctaatttgatgtcgattctcctccactttatgattattctctgcaaaaggtaagtgatccaaacactagtggaatattattattctaacacaaatatgcattgcaagcataactagttctcctctattttggtaatattgacggtcgaaactgatcgctaacgaccgtcacagccgagaatgctaatccctggttgccaatcgaagaacacaaataagaaacaagatagaatacaaccaaaattgcaaatgaatgattaagctcacaagttggggtcttacaaaccgatctagtggcgaaactgttctcgacagaataatctaagcaaaacccaaaccataaagatgacggccggtactgatatatagagtttgggtcgtgcaacaaacccttggcgcaaccctaatgggctccaacacgatacattgcccaaaggcccaaatacggtgatgcagcatcggaacagattctggatgccaacttgttcgatcgattcctattgactcggaaagaatttggacatgggaccaaatccattggaaaggttatcttcttaccttttccatacatgtaaagaacgccccaatccaagcgcgtatgcgacctggtcgcccgttttagtgcagactggtcctggactccgagttgcactagaggttgacttggtttgggcctccaccttgatgatcctcgatgattctaagtccttctctaagtgtctccttgtcccctccattgttcctaatcacaatataatgattagatagcaatctattctcaaatttgtaccaagaagaacataggtacgagctcatctctaaattcaatcgtcgcgcgcgagctcttgttatcggtccttgaatgaccattgaaggattgttgaaggagtgatgtccgcatcatcttccccctcctgaattggagtcatcctccactcaagctcatgttcttctccccaagtatggcttcaaatctgaaatgttaaacgtgggactaaccctaaactcgggaggcaactcacgtttatatgcattatcattaatcttctcaacaattttgaaaggaccatccacgcgaggcatcaacttagactttctcaattctggaaatctatcctttctcaagtgcaaccaaactaaatcacctggttcaagcttcatttcttgcctacctttactattatcaattctatacttttcagtcatcttttcaatattgtgcttagttgtctcatgcattttcaaaataaatgcaacacgtgccttagcatcattgtgaaccttctcactagtaggtaaaggcaagatatcaataggagcacgagggttgaaaccatatactacctgaaaaggacttaccttggtagtagaatgtcttgcccgattgtatgaaaactccacatgaggcaaacattcttctcacatcttcaaatgtttcttcaaaatagcccttaacagggtacccaaagtatggttgactacctacgtttgtccatctgtttgtaggtgacttattgtagaaaacaatagctttgtacccaacttgttccatagtgtgtgtgtgccaaaaatgacttaagaattttgcatcgcgatctgaaacaataatagaagtcatacaatgcaagcgaacaatctcatgaaaaaacagatcagcaatatgaatagcatcatcacttttatgacatggtatgaaatgtgccatcttagaaaaacgatccaccacaacaaaaatgctatccctacccctcttagtcctaggcaatcccaaaacaaagttcatagaaatatctgcccaaggaatagaatgtataggaagaggtatatacaaaccatgtggattaaatcgagacttagctttttgacaagtggtgcaacgtgccacgaac

SEQ ID NO: 94648 - DNA, 690 bp, Oryza sativa
ccatccgtaaaactcaatatcttatgtcttgaggcagcatcgaccagctgatcggcaaccggcattgggtattcatcctttggggtagctttgttgagatctcgaaaatcaatgcacaccctgactttgccatttttcttgataactggaactatattggaaacccattcagcatatcggcacggacgaataaaaccagcatcatataaacatttgacctcagccttgacagcttcaagcatatcggctttgcatctcctcggcggctgctggtatggtctaacccccggtttgatagggagccgatgttcaacaattgatcggctgagtcctggcatctcataatattcccaagcaaagcaatctcagtattttttcaagagctctatcaacttggttataaatttggaagataagttcttgctgatgaatgtcagccttggtctatctcctggacctatatcaatttcctccaaatcatcagccgacatgaaaccttgtccttgcttgtcatcgagatcatctaccgtgtccttggtgtagacgtttgaaccctccacgacgccctcaaaacaataatttgggctctccatcttcaattggctgtatatcacgatcggacacatttagaaaatctccatcccaaatttttccagacaggcaatcaataccatccatctcccaaagagc

SEQ ID NO: 94649 - DNA, 692 bp, Oryza sativa
ctaccccaaaggatgaatacccaatgcccggttgccgatcagctggtcgatgctgcctcaggacataagatattgagttttacggatggtaatgctggttacaatcaaatctttatggcagaagaagatattcataaaacagcttttagatgtcctggtgcaatcagcttgtttgagtgggttgtgatgacttttgcttgaaaagtgctggagctacatatcgacggcctatgaattatatataccatgatctaatcggctggttggttgaagtttatattgatgatgtggttgttaagtcaaaggaaatagatggccatatagccgatttgaggaaggttttcgagaaaactagaaaatatggcttgaagatgaacccgacaaagtgtgcttttggtgtatcagctggccagtttttgggatttcttatttatgaaagggggattgaggtgattcaaaggagtattaaagcaattaagaagatccagcctccagatgacaagaagaagctgcaggagttgatcggcaagataaattttatcaggagggttatctctaatttatctggaagattggaaccggttacacctttattgagattgagagccgatcgacaattcacttggggggtagagcaacagaaagctttggataatataaaggaatatcttaagttccctccagttttgatt

SEQ ID NO: 94650 - DNA, 4120 bp, Oryza sativa
actggaccgtaagaatgccaaggcttattccaccagccgcagtcccaggatacagagacatgcttaagcaatgttaacaaatggaggaccaaaattcgaccgaaaaaaaagaagagaaggaacacatatctcgactgtcgtattgataatccaccaacaattgcccaatcatatacactctacatttggagaccttcctaaaagatgtagctgtcaccttggggcttggggaggttcgacaacaagcatccatcaaccaaaaaggagatgagactttggatcaaaacagtatgacaagtatcaatatagctcccaccatgacccactggagaaatgaactgagtctgcttctctcccaagaacatctgtgcctcaaaattggccgccaaaaacaactaggccaagcctgcaaaagaataactcaccgcctgcgatcaccgaatcacaggatactgaccagtgccagtgtcacggattggcaaaactggagaaacaaccaagtaatgactctcttcactgcgcattcgccttttccaacttctctttctcaatttcaacttttctttcctcggcatgttgagctaagccattcgcgagtgcctggtagcggaaatctagagtctgcatcaggctctggaacctggctggatcagatgcttgcatacctgtaacagatggtcactaacttgtcaggtaacttcagccatagtagcatagagtaagcacaaacttgtacaagaatgctgttttaccttggatggtatcaacaaagaagatgaatgggtccacctcatcaattggcgattgcaactcctcatcatcgctaaagtcatcatcagaatcatcatcgtcgtcatcatagtgcggctggaaacctcttgcctaaatcacaggaagcatacaaaaacatgagtacagggtacagcataaacatgaaacatttacatgaaataaagatttgaatttcacaagacactatggtaaaaaattagtctagggaagagaaggtgacactttctgtggcgtgctaaaagaagacagcagcaagctcaaaggccagcagagaacaaaggtgattcacgagaaatgtgaggcgctctaatgtagttttttaatatacatatattatggaccacttcacccaccatgcatggtggcaaacacctccagaactgattcaggggtttgcttagaccgtttagcatacttcatggatagatttacacaattttatagtttaggggacaatagtttacaggtttaaatagagcttctcctttttgtttaactagcttttgtgtgtgttatatatgttacagctactgcagtttaggatataaatggccagcaaaacaaactcaaatacactttgttatatatgcaacaactatgcaatttgggattaaacattgctagcaactcaagccgtatatatatagtaatttagtttgtcagctgtaattgtcattattcagaattcagtgatacaacatccttcatagtcaataaaacataagttaatatttatttaaagggaagtatttgtgttactaactttactagtccttttgttgaggggaaaccagactgaaaacacttgttaccagagaccgtgttagttctattaaataataccccatgaaaaacacttgtagaaaaatttaactattttgagcatctaaataaaaaggaacacatttttacatgctaattctacttaagtccatatcacaatacaaacctctcttagtttctgaagattgacactagatacttcatccccatcctcatcatcatatcccatctccttatcagactcaatatcctcatcttcttcatcaccatcaaatccatccaaatcttcagctgcagcctcattttcccatttagattctgcttatgaacaggaatgattaagatcaggcaaaaggaattttaaagacctctcctctacatcgtaattgcaaaaaggagacataagattagaaaattttctcaggtcaacatgttaacagaatggtatcacagagtttttgttcgaagtatttgaattgtcatatgttcatcagaaaataaacaaaagataaaattgaacctgcaacttgatccttgtaagaaacaagaagctctagtgttgctttgaaaatgcgctcaagagcttctggtggaatgtgattagctggaaggctaattagtgaagtcaatcccaagcaacaaaccttcttatcatgttctctgcaaataaagaaaaataatgtacggagtcagtgcagcataaaaacacaacatgtatagtactacaaggtacaaacatatgctaacaagacctacctcttaaagtttgcccttatgccacttttctttacttgctgtaacatgccaaaccaaagattgaagatttcagtagcaactccaagcttatgcaatgttcccaatgtcaatgaaggattgtagtacagtgtattagctatctgcaatcacagtggaaagttttaggtatacatgtcatcagttagcaagagatacagatgccatgtttgaacaaacatgacactacagtgattagattgatgcaacatatgaatatggactaccacattgggaagtgttaggtaaatgcggccaacaaataatagtgattatatgcagttgttctgatggaacataactgaaaattccactgctaatgactaaattgacctatgatattgatcggccagatacagatatgagtttgccccatgcaacatgaaaacctatgttccttgaagacactataatcaaatggttacatcgctttccacaagctggctactgtgctgtctaagctatccctgctttatccctgctttatccctatgtagaaaaactatccctgctttatctataccaaatgacaccctttttgatcaaggagttataaatgctgtctaagctttaagacaaaatgtcatatgatggataatttacatataattgctcataatttctaacttccgctatcactgggtgtaataaagtcaattcatgtgccagatcaatctaaacaacaaagttttattatccagtgatcctgtcacctgctggagttacatagggatgatatgctacaaactagtcacagcacatgcagagtgtcactgtttggaatgcaatagatatcttacaccaattacatcccatagctatacatagcctataggatttgcaactttctatcattttatcaatatctatctattcactgcggtcaagttgtgcaactagtcagacagagcacaacttgagggcacgaccagacttgggccgcttgagagcaaattgggccggcatagtcaatcagaaagggagataggatcccacgtacatagttagatgctagagccagaacgagagcaaggttagaggaagcagcaagagctacacgctggacattggtgctcaggatgcagttgcccatcactttggcaggagcggagccaggtagagaagcttgacagagagctgcacagggctgccaatggccttcctttccccatctgctccctcttttttcatgagcatgatcccttgtaatggactagtcaactcaatcaggactagtgcacaagtcaatacagggatgactcaacttgactttatgacttatacaactatagtttacaaacaaccatgtatttattccttctttttcatcttgcccaccccccccctccccccctttgttctgacagcaagatcactgagtgcctcctgcagtaggcagagccaacaatcttcctgagggggccatcttggcaactgccagtatgaacatgtgttaggtaaactgtggtgccatggatgccttccaacacctttctgccggttgcagtcgcacctcaccatcgtcctcccatagcccattgacaggctgcaattgttggagcaactccatccccattgcaagcaaataatacagcgtcggcaagattcttcttccccttccccaccataaagcctccatgcattctccagcctacatctccagctcccaccttacacctcctcttagagcgagtacaatagtacaagctggactggtgataggagaaacacgtcagctacagtgatgagctgg

SEQ ID NO: 94651 - DNA, 983 bp, Oryza sativa
ggtaccctgctggtgaatcaggtgacaaaggtggtggttttcaggagggaatggtcgaagatcttggtccgaatggcaatggattacaaccgcagttcaacattttccaggaccggatcgactacgtggtgcaacatgctttgatcaaccaatcaggagtcttggtgaataccttaactaacatggtaaaatcaggggttgatggcaaaatagctgagcatcaagttacagggccagtatatttgccaggtggtgtttttccaaattacagacctttggttacaggcaaccaacagggttcttctagcgcaccaccaacacagtcgatggcaccagctgcggcttctgctccagctgcacaggttgcaccatcattggcaccgggacaaataaccaatcctaggctgttgaccagagaacagccacagcatggtggacaaaacatcaatcggctaacccaggagaaggtggctgctatgttctatccaaatcaaccaactgccgatctagcgctgccgaaccagcatacgtcagcagcaaaccttgctaaatgcatcggctaggatgaggacacctgataatcagctaaggcagcatgttgcaaatcgagttatccctgagcacttggttcataatgtgcagccagatcagtcagtgatacctcaagttatacctgaacatttggtgcgtaacatccagctgaatactcagaactacaaacggggtcacttaaattatcattaccagcctccttcacctcatgtgcatcaaagggggtcacctcaacctcagtttgctccccagtttaatcagtttgagccaatatcacagcaaacacaaggggaacctcagcagagacagtgggccgatatgattgcagatgtgatgagggagcaatttgggtttaagccgaaggatactgggaacttgtatcggcatccatatcctgagtggtttgagagaattccattacctgcccgata

SEQ ID NO: 94652 - DNA, 9547 bp, Oryza sativa
  unsure (1)..(9547): unsure at all n locations
atctgccatcgcgcaaaaaaaaagaaaagaaaaggcaaccccgggcatggttgcccaccgctccgctgtggctcgcgcttttctcaacgcgggcgtgagaggaccggacttccaaggaagactgcttggacctcgccctccttttccatccctgggccccatgtcctcccccacgcgagagcttccaggcattgccgtcctcgacaacgacggcttccacaacgccgacgacggtcgcgcgagcgcaacgaataaggcggtcaaacgggctcgcggtcagcccatgccagtgaaaatggcccacaaacatcctcaatgtcgtgcgccgccgttcgttgctctgtttctggaggggaaaaagggcgccattatactcggatggagggaaaaaaaagaccattcggctgctgttcttacggcgatgaagatggtgagcgagcaacaagaagcttttctccacttgatcgtaagtctgcactagttacctatcttcttctatatccttcattaatagcttcttagaattcatcaaactccccttattaggttgccccccttgccatcaaagaaacatcagactaaagatacaaatcaagttctgccatctaactcgtgagatggaaggagataggtttgtaatacatctccatgctcgtgtattcttttcctttttgtcatatgtatgcactagtctcatatttttttatagagaaatgctagtaccatgttctgtacctcacattggaatggaattcaaaagtccagatgaggcttggatattttggcatcactatggaggtcaaaaaggctttgaggtcaggaaaaggtacacaaacaaaagacaatcggatgacaaagttacatcatttagatatgtttgtggaaatgagggtcatcgaggacaagacaagagggatcatctaacaaagtgtccctgagctgaaacccgcactgattgtcaagtccgcatgggtgtagtattggacaaaaagacggaaaagtataaagtgactaacctagttttggaacacaatcactccttgcacttgcctgaaaccttgcactttatggtttcacaaaggaaaatttcagatttacaagcttttgaaattgaaacagctgatgatgcaggaattgggccaaaggcagcacaagagttggctagtagctaagtcggtggatcacatagtcttagctatagccttcgtgatcgcaagaattatttgtggagcaagcggcaaagagagatggcatatggtcaggcaggtagcatgcttatgtatttccaggacaaaattgctgagaacccatcattccaatatgcattgcaaatggacagtgaagaacagatagcaaatattttctgggctgatgctaagatgataagtgactatgtacattttggggatgttgttagttttgatactacttttggaacaaacaatgagagcaggccttttggtgtctttgttggattcaatcattttagagaaacagtagttttttgtgctgctctcatgtatgatgaaacattcgactctttcaagtggctctttgagacttttctaaaagcacataatgggaagcatcccaaaacaatatatacagatcaagatatagcaatgggaaaggccattgaggaagtatttcctgcagcatggcatggattgtgcaccttccatatttcacaaaatgctgcaaaacatctatcgcaagggaataatggagaatcaagtattctttcagatttaagcgcatgcatgtatgagtatgaggatgtgacaaaatttgaatatgaatttaacatcatgagggaaaaggtgagcaagcaaacttggctagatagtatatacaagttgaaagaaaaatgggctaaatcttatatgaggaatgttttcacattgggaatgagaagtacgcaattgagtgagagtttcaacaatgacctgaaaattcatttcaaatctgattttgatatcattcgttttttcaagcattttgaaagagtggtgcaaggaaaaagaaatacggaactagcttccgaatttgattcaaggaaaaaattgcctagaatcaaaatgagggcacctatgctgctgcaagctagcaaggtgtacacccctattatatttgaagcttttcaaggggaatatgagagatcaatggcagcatgcactaaagcattggatggcgataatgaatttctagtatcaattaggagttttgagggagatctaacatttgaggaggagtacagagttgttggtgatccttcagagcagacatctatttgcagctgtgggcaatttaataggattggaatattgtgtgggcatgctctaaaggttcttgatttgatgaacatcgagtcacttccagcacaatatatattaaagcgatggacacgggaagcaaggagtggaatagtaacggacagcaagggaataaatataattgagaacccaatgatggaagcttcccttcgctacaaatttctatcccacaggtttctcactttggcccaacaagctgctagctatcctgagtgcacattgttagtaaataatacacttgacattcttagcaagcaaattgaagagcacctcagtggatgtgctagtacttcagatcaaagtgcaacccacaaggaggttatgcccccaaataacttgttgagtaatgcacgcctaaagaaaaaggaggttcgtgttagaggttcaaagcgaaaaagaatttggcttgacaaaaaacgagacactacacaaaaacgacaaagtaaaaaagggtaaaagtccaaaggtatgttctaagaagatattgcaataccatgttactattcagtcatgtgttcacttcatccttttacattatttggttcgaaggaacaaaagactaggcaaaatgcactccatgttggtgcagcaacacaagtggcagaagatagttttgctatggacaaggaggagcctggagaatacatgcacctaaatagcttcactcagcttttgacggtaatacatgcacctaaatagctatgaaaatatataataaaacaaccaatgattaatctttttctttgtaggggcagataaatgatgatcttttagttgacgatgcattttagtgatgaagtcatgttctggaggataacccaagtttggttgcaatactgtgataatacaagtatgatggagctggggaaaaaacatgagaacttttgtgtctatggttaattttgttttggcagatcctagtgaagcacttctgttctgttttggggttatcctatccaagacatactcttatattggcagcactcaatgatgtatatatgtctagctttcatttgctatcttgaaagcaaaactttagggacaaaatatgttcagtcattagatgtccaatgcagcaacaagtatcacattttaatgttcagtgttcactgtccaagactttctgccattgctatctgaaactctcaatctgattttgtcacaaataaaatgacccaattaacttcttcacattctcaaatgctcacaaaaatcagagtatcaaattgacattattatcacattcaatactgaatcacagtttcaattgacatcgattttcaatctcaattcagatattcccaaattctaaaacagagattttcgccctcttcagaaagctatggtggtgctgccatgcttgtcgcctccttcccatgcctgtccgggcttggcagcaacggtcgccctttctcccgtttttgttcggctcttgcgattccttcgacgtgggtggtggtgaagagcttggcgccgccgccgctgtggaagccgtcgttgtcaaggacggcaacgcctagaagctctcgcgtgggggaggacatggggccgagggatggagaagagggcgaggtcgaagcagtcttcctcggtagtccggtcctctcacgcccgcgtcgaggaatgcggcgagccgcagcggagcggcgggcagccatgccggggattgctttttcttttcttttttttttttgcgcgatggcagattgacgaatgacgagcagtctcgttcatttttgtccctccgtggttgctcgtaaatgggctgatgggccgtcctcgccgcgctcgtgcgatgcggaacgaaggaagcagcagcgccgtgagatgccgatcggatgatggatcgacgctggacgtccctctgacgttgtgcgcctaacgtcagacgatctgcttcccccgctggtagatttcaattatggctgtgtttagttcagcgtaaagtttgaattttggttgaaattagagatgatgtaactgaaaaattacgtgtgtatgacaagttgatgtgatggaaaaggactgtagtttgaatccaaactttggatctaaacacagcctatgactaaccattatttgcctgcgtaatattttactactactatgaggtatttactattttaaaaagtctaaccctccgatttagattataaatcgttttgaatttaatcaatcaaattgcttcaagtttaaccaagcttgtagaaaatggtttgacttcgaccaaagttaaaaccacttataatctaaaacataccaaagttaaaaccacttataatctaagggagtacttaataccagtttaccggaaatcgcaacactcaccattaccgttttcttatcagtcactaatatttcacattcaagaaccagcgaccaggggttatcggccaaaaaattctggcatgattattatacatttttttttacaaatccagacaaatacatcgcaaatatattgcaaatatgttaaacgatgaaaatgcaatcaaaggaatgagaaaggcaaaggaaaaggaaagaacaaagaaagcaaagaaggaaagaacaaagaaaatagctgtcaatggaataaattgaattattgtggtaaaatttttattttttggttctcgcaagattgactcccggctagggttccagcggttaccgctaaggatccaagattaacgttgcataaatgcaaaggtaagttattttggggtaacttatccttatctattgagagctacaaacataaataaatcatcatattctacaaaattctcacgttccataacttccggaaagtttacaagataacccacaaagccgcctccagaaaaacccttttactccaagattcttgccactaattatcatggcattttgtaaagagtccaggtatcgctgacaaaatgaaccgggaaaaacaggaaagggaaaaaaagaaccaagcaacgttttctaagcactactctacaattgaattagcaagggtcactattacttacacaatgtacaacagatctgacctgttccacctgtacactcaaaacaagacttaaacctaagcctaagaactccagaaatctagtttactcaaaataccaaggctattctaaccacgatcaaaatgtatgctaatgcatatctaactttaatatatctgcactagtctggaatactcctagaaattggaggaaaagttgcaggtttagatcactaggctgcctctcaaattcagaatgtggctgaccaaccatgagataaaaggtggcttgtcagcaccaagcatttcagtgcccttctaagcctannnnnnnnnnnnnnnnnnnnaatctatcagggtcagggctaaagagcgaataatcttgtatctccagatttgctaaatgccaattgacgaatccagcttgcaatgatttgacaacaaagaggataataggcagtatccaccattcattgtcttccctactcttaaagctgcacaagattccagagaaagaagagaccagcatatcagtaaagcagatatggcaaggtgcaggtttttccctaacatagctaaaagaacaattaagtcctgtgaattgccattgagaagacagttaaaagaaagtgtagaatatataatctagatatatatttaaacagtttttttaagagttcttttaacagattagacagaagacatactaaatccaaaattaaaaaaaaaaactacggattgagcttccatattcctttatcaaggtgcagaatatatgactaccacatattacatcacagatagagacaaaatcagatgtccccaatttataaaagattttggttaatgaatccaatttgaagaatgctatttattgtacaaaacaaaaggtttcaagttgttcaatttaaataaagacaattcaaataaacatactccctccgtttcaaaatgtttgacaccattgactttttagcacatgtttgaccgttcgttttattcaaaaaattttgtgaaatatgtaaaactatatgtgtacatgaaagtatatttaacaatgaatcaaatgatatgaaaagaataaataattacttaatttttttgaataagacgaatggtcaaacacgtaaaagtcaacggtgtcaaacattttgaaacggagggagtactattttaggctggtcactcattcaggttttcgataaagtgagtatgccaaagatataggaaaatgttgttggctattacccccaggaccaaaaacacacacaatcgtacatacaggaaatgaacattggagactagtcaacatgaactcatattacatcaattatctttctgttattccatgcaataactcttgggtgatttaaattcaatgactacgggtaactcacagcagcctatatatgataatcaggttcatgaaccacgaatccaagtatatggacatggtcacatctcctaatcaccgagagcatgcacccaacatccaaactaatcattcaactaatgcaaaaacaatgtgaaccttattatcatcacatgtatggctcatgcactcatagagaggaactgatatgctttccatggtccatcactactaaatgcatgcaggaagagacttgtgcacaaaagaacatgaacaagttaactcctaacagggactttcttaacctaaattatattaatttagatttggatataaatatatattctgttataaatgtattttgcaaactcttattattgcaaccaacagtggaaaattttggaaaggttggtagatctgtagcatgtagtctttcccaactagacatgccttgaacccacgatatgcagccacatgggcatccctaaatccccagaaatactgcctaatctcttatgttagttttgatgtgcaaagtcataggataatctggttgggaacatatcatgtgcacacaagcttcccgtgcacaccaactagcaaatgtcacagaaaattctacaaaaaattagacacatagtttcaatagtactacacctacatgtgcaatcttatcttcaaattcattatattttagccgtaacaaaaaagacaaaatcctgacagatttttacccttaaaactgtcagatttttcacttttttattacgactaaaatataatgaatttgaatatgagactttgcatatatgtgtaatactattaggagtaaatgtccattttgtagaatttttcgtgacatttcctagttggtgtgcacaggaaagttgtatgcataaggatatgttcccaagctagtttcctgaacattggaagtcaccttttctttatttggagaatgaattctggaattcaaaagaaatattagaactacaaaccttttagtgtttagtgcatgaggaacggaagacactgataaagaagacagcccagagtacaaagctccataaatgattgctacaatctgcatagaataaaaattgcatataaaatctccaccgcctgttatgaataattaagccataaaattgagtatatgaacattacttaagtaacaggatgcaaaccaactcttgttaggctattctgaaatagaactttgtaacaaagcataacagatcatgctactcatgcaataccacaaataaaggggttcttagacaaaccatgagaggaaaggcttacaatgtttatgacagaagtagtattccaaagtgcaaaaatacgggtcacggaagatctctttggtcctcggctgaaaagtgcattgagaccagcaagaaagggagacagcaaagcaaggggaggaataagaagtacagcaaggaatgctccaacagatatccaatagtactgcacaagcataagcagggtgacggaaaaatcacccagtagtataatacatataagcagctgcaaagtttcctgaaatattatagcatggttccagtaaagatgccttcctctcaaatatgtgtgtaaaacaggattatagtgcttaccgcataaccaatgggcctacaattttgcaatagcaatgagaaagggaaaagataatctcttttacattccagtgattttagtgtaccctcattgattatcccaccattcactccacctgtcaaacgctttctagaaacagcatagcttgtgcaaggctgatcttgatttagcttcttggaactgatgttcttcctgtaggattaaaagcgataccactattttacacagcaagagtaatattagtaaaatatgatattgtgattggtaattatttccataccttgagcgatcgatgaattctgagacatgatcatgctgatgaagactcttatagaagtgctcattgacagcaacaacaatacctagctgataataacaagaagcagtggcttggaaccatcctaactccactcgaacaccatgccgctcaagttggggatttccatgactattaatccaagaaacaacaggtcccaaagttgatcggatgttcccttgccgtactgtcctcaactgagcattcaagcccgcaaccaatctgttccagatcgcagttgacacatactagagaaagggaatgaagtcaatggaaatgattggataataattttgcacttctacatagaggcttcagatatctagaatatcatatctagactgttcattatctaaatacagcatctgcatgctttactaggtcccaaaaactatgcaccaaacatatcttggtcagtggcaccaataatgtggaacaaagtgaactgtcctatgtgatgatataattggaagtttggaacaccaggaatgtcattaacatccctattaagttaatcttatttttacctggccaagaaggttagataacaatgtatcactgtgtaggtagtatggagacatatagcttccatcaccaccaaaaattaagcacatgggaaacctcttctggattgtggatgtaacatcaagtcgtttctcatcacccccgagaaagaaatcaatgtacgcgaccatcaagtctggtgtagaaccaacctgtaatgctcaaaaattagccatgtgctctcgttataggctaatggtctgtaacaaaaggtgatgcacctgctgttttgaaacacatccattcctaccactttttttttctctaaaatgcaggacgaatattcctaacacttcactactcatagccagaacatataggatgttgagttactacctccgtcccaaaatgtagctacctagtac

SEQ ID NO: 94653 - DNA, 541 bp, Oryza sativa
gtaaagatgccttcctctcaaatatgtgtgtaaaacaggattatagtgcttaccgcataaccaatgggcctacaattttgcaatagcaatgagaaagggaaaagataatctcttttacattccagtgattttagtgtaccctcattgattatcccaccattcactccacctgtcaaacgctttctagaaacagcatagcttgtgcaaggctgatcttgatttagcttcttggaactgatgttcttcctgtaggattaaaagcgataccactattttacacagcaagagtaatattagtaaaatatgatattgtgattggtaattatttccataccttgagcgatcgatgaattctgagacatgatcatgctgatgaagactcttatagaagtgctcattgacagcaacaacaatacctagctgataataacaagaagcagtggcttggaaccatcctaactccactcgaacaccatgccgctcaagttggggatttccatgactattaatccaagaaacaacaggtcccaaagttgatcgg

SEQ ID NO: 94654 - DNA, 527 bp, Oryza sativa
tgtactctgcatcaaagaaatgcatcacaacattcagcataaacaaaatgaaatgtgccacaagacttgccctacagaaacgagaagaacctgatttgttagctggttcttgaacttctcgggatttctcttcctctcagagtgaaattcgtaagacacttgtgcatccatccctgcagtatgtgaagtcatgatgaccatgtttctattactgccttattaatcatgatatgcttaaaagatactaaaatatgttctacgataatattgttaacaagtcctgattaaaaggtactggataacaacggtgactgtttgatatctgttagagcaagaactagcataaaccaaaaaaaaaaaaaaacatcatgctgtgccttggataccagaggaactcttacccatactaaagtaattccaaaatcctccacggtatgtgtggtagccctcctgaacaaaaatataaaagaaaaaactgctaagcaagcttaaagatctatatattcagttctcagcctgtccaattg

SEQ ID NO: 94655 - DNA, 1163 bp, Oryza sativa
tgccgccctgggggagggcgattttgtactgtgctctatatttttttatataaatatcaatagttatcaaatctttttatattgaaaactatacaagattaaaatctccaagactggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatacatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcttgctggacaaggaccatcagtttcgtacaggtatttaacagtattaataaaaagtaaagtaccgtgtgggcgagggaacgacgctccgtgagggga

SEQ ID NO: 94656 - DNA, 2823 bp, Oryza sativa
caaatccccggcggttccttccggtaatcggcgaagtgaggccaagcagaaggccccccccgaggacatcgatgacggcgatgatgacctaggtttccaagagcctggggccaccattgccaccgtcgatgggggagcgtgtgctcacgtttctcgccggagcttcaaggccatgaagcgagagcttctggccgcggcccctactcatgaggcgacgtgtcgggcgcggtggtcggaggttgccctcaccttcgaccagaccgaccacccaccgtgcgttgcccggggagggcagattgcgatggtggtttctctcaccgtttgcaacgtgaagttggggcgtgtcctcattgatgggggagcggccctcaacatcctttcccctgcggcctttgacgccatcaaggccccggggatggtgctccgcccgtcccagccaattatcggtgtgacgccggggcacacgtggccgttaggtcacatcgacctaccggtcaccttcggtggatccgccaacttccgcacggagcgggtgaacttcgatgtggcggacctcagtctgccctacaacgcagtcctagggaggcccgcgttggtgaagttcatggcggcagtccactacgcctacctacagatgaagatgccgggccccggtggccccatctctgtccatggcgacctcaaagtcgcgctcgcttgtctggagcagcgcgcggaccacctcgccgctgcatccaagcccgagggtggcgacgagaggcttggcgcttccgcccccgccaccccgaggcaacggatgatcacaggcgacgaggtcccggtcaaggaggttgccctgggcgacggcccgtccaagaccacacggatcggtggtcttctggacggcaaataggaagacgcgctcgtctccttcctgcgggcaaacgctgacgtcttcgcatggagaccggcggatatgctcggggtccctagggaggtgattgagcaccgtctcgccgtgcggccgggcgcaaggccggtccggcagaaagtgcggcggcaggccccggaacgtcaagccttcatccgcgaggaggtggcgcgacttctggaagccggattcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctagatgcatactctggttaccatcagattcgcatggctagggaggatgaggaaaaaactgcgttcattacccccataggaacctattgttatacgacaatgcccttcgggttaaagaatgcaggtcctacttttcaacgtactactcgaatttctttgggtaaccaattaggacgtaatgttgaggcttatgtcgatgacttggttgtaaagacgcgcaaccaggaaatgttactctcagatctagcggaaacttttgagagtctccgctccgcccgcataaaactaaaccccgataagtgtgtgttcggtgtacctgcgggcaagcttctagggttcttggtctctgcccgaggcattgaggccaaccctgagaagatacgggctatagagcggatgcgcccccccagcaaacttagggatgtgcaatgcgtcaccggttgcatggccgccctaagtcggttcatatcgaggctgggagagaaggcgttacccttatttaagcttctcaaacgcttcggaccgtttacctggacggaggaagccgaaaatgccctcacccagttgaaggcgtatctaagctctcccccagttcagcccttgttactctacttagcggcgaccccgcaagtagttagtgtggcattggttgtggagcgcgatgagaacaattctcatttcacgcttccccaccctgtgccgacttggcctgggagagagcaaggaggagaggctcccgagccgaacggtggcccaaggcccccgacggccggagttggccctctgcccgcttgtcagacggtgctaggagcccccgacccccaggaaggccctgaggccactgtgggaaggccgcacctatcgcccttcgaccccgaggctaaccctgtgctgacccgacccgggaaagagcagggagaagaggcccccgagccgaacggaggcctaaggcccctgacgaccggagttggccctttgcccgcttttccgacgacgccaggagcccccgacccccaggacggccccgaagccactgtgggaaggccgcccctgttatcctccgaccccgaggtcatcagcacagaagataagtgcgccccacgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctgatggcctcgaggaaactgcgccattatttccaggcgcatcgggtcacagtagttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcacggacccctcgcagctgcctcacaccgcccactg

SEQ ID NO: 94657 - DNA, 3405 bp, Oryza sativa
ccgcagatggacgcctacgtgcgccaagtacggcgtatggagtgccattttgacgggattgagcttcggcatgtgcccagacgggataacatgattgccgacgaactctcacggctcgcgtcctcgcgagcccagaccccaccgggcgcctttgaagaaaggcttgcccagccgtcggcgcgacccgaccccttaagggagacggatgcgcctgaccggccaccgaggcctgtcggagtccaggcctcgggacccgaggggagtgctcccaactcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgacagctcttaatgatgcggtcgacctggtccggcgatgtagagcgtgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaggttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaacatactcaagaagcatggcgattcatggatcgaggagttgccagcggtgctctgggcaaaccgaactacaccaagccgagcaaccggggaaacgcctttcttcctcgtctacggcgcggaagcggttctcccatccgagctcaccctgaggtctcctcgggctaccatatattgcgaggctgatcaaaatcagcttcgcagagatgacctcgactacttggaagagcgaaggcggcgcgcggccctccgagccgcgcgctaccagcagagcctgcggcgctaccatcagcgccacgtccgggcccgatcactctgcgtcgatgacctcgtcctacgccacgtccaaacgcgtgctggattgagcaagctttcaccaatgtgggagggtccgtatcgagtggtcggcgtcccccggccgggctccatacggctggccacgggcgacggcactgagctgcctaacccgtggaacatcgaacaccttggtcgcttctacccctgagggggggggttgggtgtcaggtttcgggctcgggccaaccccgcacccccctcgggcgtgcagggttggccgggggctacaacatatgcatattcttatttctcttatatctgaatttctataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgccccgaggcgtggtgaactccgggggggaatcggcaaaaacccacaatcgggtcacccataaccctcggtcaccacgttcccggcctggccagtctcgacatgtggatctccccaggcactagccccgacccgcgccttttgaggaccagaacctgggcacaagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcgccggcctcgacgtcactgtcgtctgcaccaccggcattgccctcctcgtcggagttgggggcgaacgcaagccgaggggccgagccctcgaagctgtcgacgatatggtcggcggcatcccggacctgcgcgcgcgcgcggtcctcggtcccaggagggaactcatccagcgccatccatggagagaaattggggtccctggcctggtaactcgccaggacgagctccaccgctccttgggcgaggtccctcgaggatgacttaattgtcttctcgagctcctcggggagccgttggagagccccggccatcttcgagaggcactgggcgaggcctccctggttggcggcgtactttacggtccgccctctccagaggcccacttgccgaccggcgcaatctaggcgggagacggcgtcccaaagcatgccgggccctacctcgcctgccaagcggagggcttcgacctccccggcggacgagtccagcgcgccctgcagatcggcgatggtgcgttcggcagctgcgaggcgggcggctaagtcgctttcgcccgtggccgccccgccgctgcgcgccctcgcgtccagctccttcgcccgcgcctcgagctcagcggcccgttggttcagtacggccctctcggcgcgggcaccttccagattgcggcgcgcctgctcctcctgcgctgcctcgcggagggacaggttgaccgccagctgttgcgccgcggcctcggccccctcgagagctcgctcccgtttggtgagcgcgtcctcgcggaggcggagcgtgaactctttttcggcgcaggcagcctcgtgcgccgccagcgttgcttcccggatggtgacggcggcctcgcggtccgccagatccctctccacgacgcaggcgcgctcttccagcgccatggcgcgcgcctcaagggcctcttcgcgccgccgggacgccgcttcggtctccgccgcccgctgttctcgggcagcggcagcgtcaagcaccccctgggcggcgtcgagcttcttccctagctccgcctcccagctcccgtattgaaggcggcgcacctccaccatggcctccaccgagcgtcgcccctcttcgacacgcgcccacgcggcgtcgagctccgcccgctctgcctgcaggacctccacctgggcacttaacccatccaacaccgtggtgtttgcggcggccaaggcctgcagaaggggctctgcg

SEQ ID NO: 94658 - DNA, 646 bp, Oryza sativa
cggtatagttattttgaatttttatggacatagagcattccatggtacttacataagctaataggttgggaaagtccatcagccgaggtaagctaatcttcagaccacttacaatctccaagagtataacaccatagctatatgtgtcggacttgactgaaaaggcgccatccattgcatattcaggagacatgtaaccactgcttaacagttttagtaataagtaacaaaggatttttcaggaaatcaatgtaatagtaaaaaacaaattcctggatcactcactatgttccaacaactcggttagtattggcttcttgctggttgccaccgaagattcttgccataccaaaatcagatatcttagggctcatatccacatccaacaagatgttgcttgatttgagatctctatgaattattgtcaaccttgagtcttggtggagataaagaagtcctctagctactcctttgattatcttaaaccttgttggccaatcaagagcatacttacttgcaggatctatcaagaatggtatacaatgttcttatagtaaggataattttatcatctttgagaaagtactggtaagtatcacattgtttattgtaaattttggtaccttcagatactaaatatctcaag

SEQ ID NO: 94659 - DNA, 612 bp, Oryza sativa
ctcttgttgggcatgtattcatacagcaacatcttctcttctccatgaacacaacaaccaaagagcctaaccaaattccggtgttgcagtttggatagaactatcacctcgttcttgaactcttccaatccctgactggatctgtttgacagcctcttgacagcaatctcctggccatcaggtagtaccccctagaagtaatatcaactatgttggttcaggtattgatcttatagcattacgattttgaattccaggtcagaacaaagatagtaaaaacaacaatttcattcatattaacaagataggataaaatgataaaatgtttaaatgaccataccttgtaaacaaaaccaaatccgcctccaccaagcttgttgctaaaattatttgttgctgaataaatcgtgctaaactcaactagtggtgagcttagaactgcggatttcactgaatcacttctgaatatagcttcatctgcaggtggtccagcttcttttgtgatcagccgtggtgcttgtattctccttatgcctgcagattagtaaaaatattagatataaacctaccagacagctgttaacgcaaactgaactatatcagcaatctcta

SEQ ID NO: 94660 - DNA, 2303 bp, Oryza sativa
aattttctcgtgcggtcctcttaaatggaccgcacacgaaaatgagccgattttcccgtgcggaccgagttaccgcccgcacacaatctaaaagggtcgtgtcgacgtttgatgtctcgactacggtatttgcatggcatggggattgttggtactaggatatacgcgagactgaggtaaaagagatggagacagagatttttatacaggttcgggcccctgaattgtcaggtaataaccctacatcctgttggccgaagccggtattgctcttattcatgataatcacaccagtacaatatttggggtagcctatctaactgttgtcgacatggcggtctgacgatctaactcgtagtcgacaacagggtagccttcctcctcgaatccgtgctcggcgagatcagagatagcgctttcgtctctcctgacagtatccggagacaccgtagggtactagccgtgcttatccctgaagtcgatatccagcggcgtgtcttggcgtatgtaggcttctatgttatggcttctatgtcgattgtgttgggtgttgatcctcccccctctcctcctaggggggcttgtatttatacccataggtgtccccttgtccaagtagaactagggaaaccaatatggatacaatccgagtagtccttgtcgtctccatgtagaactctggttgtctttccttatccggaactcctcctatatccgaaggttgcttccatataggacatggtatgtagtgggtcctgccgagatttattcaactgctattaggtatgtggtatccataaccctgacagtaacccccgacttcaatgcaaatgaacgagttcatattctcaaccgcagaccttggaggaactgttattgagcgcacgtgaccgttctcggtgagttcagagataacgttagacttcctttatcagcctcgtgcggacacctaaagggtttatctgagtcaatctccgacgtcaaccaagaaagtacaaagcatacgactaagtctcccgtcttgctgtaatcgagaatttggattgaagtcaagaaattttatctcggcgggcacaccatctcttcattccatattccttgtcgagatccaccaaccgttctcgagtaatcgagtaggtgtagagtctgcgacggagccttgtcaacatttgtcgtactcgccttagtcgatcttggtgtagaaccatagagacatggagtcttcaataatgtcgaatagaattttcctgaaatcaatactcagaaaagaatattagatagaaatagcccccgagcgagtgctcaaagggtaacatgttatagaatgtatggaaaactgaacatgaattaggtttacaaaccagtgttttgtatatgagcgtctactcttttaccgacttcgaccagtcagtttgttgagttatacactctccctagcccccagccttgtcgtcggagaatagttctcggatgataaggctcttagacctttgacctgccttagttgaacaagcactgatcctagcccccagccgtgaagttggaaaatccatttccgattacacggcttggttaatacgcacggcgagaactattacacgaccagatcttacatggtctttcgtctctgaaggatccgacaaagccttatccgctctgggcgtccccagccgaagttcccttaggttcctcagaggctttgtcaagacagcgtaaagggacattaggataggtttcaacgctaggtgtcttttgtggtaagggatctttgggtaaaacacttggcgatattgtgcacctgatatcaactttgttgaggtagaggtagtgggagaatcgctacacctctggtcgaggaccaggtagtagtcgtaactcgaccacttaaagtggaagtagtgggagaaacgctacaccgctggtcgaggaccaggtagtagtcgtaactcgaccactagaagtaaatgtatgagagatcgctacgattaactggttgagaaccagtgagtaggtgtctttcgatcaattggagtcgtggtacgaggatcgctacgctgccggtcgaagactagtcgtagctgttcctcaaccatctgaagtcatggtgcgaggaccgctgcgttattgctgtagtcgtacctcgaccatctgaagttaaggtgcgagagattgctacgttttactagttcgagaaccagcgagcgagtagaattatctctcgaacaccaatggaagttgcggtgcgagagattgctacgtactggttcgaggaccagcgagcgagtagaattatctctcaaaca

SEQ ID NO: 94661 - DNA, 626 bp, Oryza sativa
ggacttggatcgatccatgacacgccatccgataagacccaaatgcttcgtccaaccgagtatgccattgccgaggatatccagaattttttctcttaatcaatttgattaagctcttgttagatgcctcggcttgcccattagcttgtgcataatatggtgaagaattcaacaatttgatacccatgctatcgacaaactgaacaaactcatcggacacgaaaattgaaccttgatcggttgtaatagtttgaggaataccaaaccgatagattatatgttcttgaacaaattgaattgcatccccagaatcaacttttttcaaaggaatcgcctctaccaatttggtgaaataatcagtcgccaccaatataaacttatgtcctttactcgatggtcgacttatcataccgatcatatcaattccccaacctctgaatggccatggcttaataataggattcatagccgacgccggcgctcgctgaattgctccaaacttctgacaatcttgacaccctttataatatttgaaacaatcttccagcattgtcggccaaaaataccttgcacgccgaagtaaccacttcatcttatgagccgattgatgagtaccacaaattcct

SEQ ID NO: 94662 - DNA, 3780 bp, Oryza sativa
  unsure (1)..(3780): unsure at all n locations
cctcttgttgaagatcgaaaccgatgcagctcaacccgaaagcaagaactcatcgaaataaaactaaagcaaaaagggtggcgatgcgccgaaattgtattgaacgtgtgtgttaaaaattacatagggctcggggtctatttatacccgagaattacaagatatgtccataccggacacgactattatctctaacaaactctaagataccataagtccttgcggcagacttttgcccatatttatctgtaaaaaatttatataaaatatcataattaatagatacaattgccttcccaggactttatccatgtatggcaatcatcttgaagtacgtcaactcaaacccgatatcgaatacaagtcgtattgtcggaatcggctgcatcacttaacccagtctgacttggacttaaccgatactaatcgtagccgatctgggctccagccgattcttgctctgttctcgaatcgatctccgccatcggctccacttcgatctaatcctcttttccgatgctgatattaccaaatttggtcgttaacacatgccccccaagtccggaatatttggtaatgtttcggattttcttaacatcgactccgagcaagtttcgcactttaccgttttccgactgttattcaagcgctttaaatactagggaaaattggaaccatgccattataattttgcaaagtttgagatgtgccatnctgaccgacatgtcattgactcatgtgggtcctacatgtcattgagataccgatggcatatctcaaactttgcaaaattataatggcatggtttcaatttaccgatgccgcagagaaatcttacaccattactcccgttttcaccgctcaagtgaaactctgccttctctctctacggcgattcttccaatgcacaaagcgatttccaggcgacttcacccttggcgagatctccgcccgcaacgatgtcgtcctccgccagcccgtctgctgcgccatcagctgagtatgccgaggtaagtccccatcggctagatcccctttctcaacagcagatcgattttccttacctcacattgctcttcttctttccggttgctttggatttgcagcatctttccaacctaattgcgattcccagcttgtcgcatgaaaaccactattttctgggtccaatcggcaatcttgactccactgattttatcattggtgaaaccaataggatcccctttaggctagccaaccctaacctgagccactggaaaaacactttcaagtcttggccatctcttgagaaaaccacccctgagaaaagttggatcacatggtaccagcgcgtatcggctaataagaaagttcactgggatgagattggaatcggccaagcacttgacctaaccatagccaacttagctaaggacgagcccttaatggcagccgcctcttatttttggtccaacaccattaacgccttcttgttcaaccaagggccaatgactccaactttgatcgacattaccatgatcaccggtttagatgtaacttcatcggctaatcccatgagcatgaacaccaaaaatcagtttgatttcagaaccaaaagcataggtggctggtctggctatatggcggcatatatgggccaaggatctgttacccctcgagagcatgtagctttcttgctcatgtggctagaaaagttcctcttctgtggatccagttgtggccctacaaccaactagcaatttgtagccgaagccttagaatcaaagaaagaatttccattaggcaagatcctcctcggttacttataccaaacattgaacaacgcatcggccaaaatagccgttggctcagtagttggtgcaggtagaccatggtggctgctacaaacctggttgaacctgatggttaggaaagttttcaatcagccgcctgtgacagaagctgagttcccattgccagagccgattgtaggagacgatggagaagaacgcactcatcacatatgcacatcatacggagaatatacatccacacaaaccgatgctcgagcgaagctatcggctgagctactcaaggactggttctgcagcttctacgaaggttttaagaaagatgcacgggtgtggttttcttatgaagactcagcagatcttgaacttccatcagactttagatttcaagacattaatcatgaaaaattccaaaaatctagagaagttcttacagcttcaatcagtccatgcatccttcatgtcaacattcaccaagggagaaacatctaagtctcctacgaattttatcacccaatgagctcggccagacaacttggattgtgccaactcccaatcagcttattctttgccgacaagattcagtgccgaggagaaatcacatccactctaatgatggatcggctacttaacctaccaggaccccttctgggcagtattgataatattgagttggcaggatttagaagcaaaaatttcgacagatggtggggtgaatggaagttgcacttgtttcatcaatcagcttcgatgtatatgacagatctattccctgatgtcatacctcaggtaaacctcaccattgttagcttgaataattgttagccgattcattacttgactaatctcttgtttttgttctacagacaatcgactcttcggctaattactcatagactttgtggttgcagaagaagaaaactgctgtgaagaaaaaaccagcagcaacaattgtcaagtcggctccaccagtaagatgtctttaattcttttacttaatcaatctcaaccggctctatataacacttgtctattctacagcctcctcctcctccttctcctcctgtacagcaaccgtcaagtgaccagactccatcggctgtggagagtcatcacatcgaggaggaagaacaaccagctgctcctgctatcccaataagtttttctttgtctcaataattagatcagctacattttacccagctcttactctttccgaaattgtctctgcaggttttagccgatcttttctcttttgacatcagagattatcttgataaggcagaagaagatacttcaagcaaagctttagctcctctatctgacgatgtaaagataacacttgaagatatctctcaacggctagctagaagcctcttctttagatagcttggtagttgactgcggatcaattaggacacggctgcatgaagttcaagctctgattcccgaagaattggccgatgtcctaactccagccgcttatcttgaacaacatcagttcaagctggaaaaagccaagctaagactagccgaacgccgtgagcgcaaggagattgaagccacaatccaggtcaatcggcagcttgtgcatgaagaaaaagtcaaactcgatcagctatctgagggtccgattaagtccaatattgatcggctcgaagctcacaagatcgatctcttggcacagcttgaagaatgcaatgctgaactggatatggagcacaaaaagctagccgatctcccaaaatctatcaaagaacaaaaggcaaggctcaaatcgactatcaagaatgttgctgacctaaccaagtccctgaaggtcatctctggaactgatgctcaagatgcccaagccattgaagaagttgaacaaattaggctatccagcagtacttatctcaataactcttgtgtaataggacctagaaatttttgtaatcggctaagatgccttaatgacccgctgttttaacactacctttgtgccgat

SEQ ID NO: 94663 - DNA, 681 bp, Oryza sativa
tcggttgggctatccgaagacaccacacgaagaggacgacgacgcgaactcaccggtgcaaagaacaacgacgaacgacgacaaacgacggccggcgacgagattgaagcggcgacgggctcggcttgacggcgtccgcggcgctccggcgggcttcggcttcggccgaggggtggacggtgtgcaactcctccttgcgaacccgatggtgtcgacggcgaccgaaggcgacgatggacggagacgagcggcacggctggagcggctacgacggcggcggcgctagggtggaggcggctagggcgctacgggcgacagcgagctcggccaagggtggcaaacgaaagagggcggctaggggatcctttatataggcatggatgagagagatcgggcttggaacgcaagtaatcgcgccgggaaaacctagggtttggtttggagagataaacacgaatcgagctcgattccgtgttgatttcatcgggataaagtccgattcttgggggaaaagatagaggaggataagggaaacaaatcccctcaactaattttgcaaacgaagcacgggatgcggcggattcaacggaggaagcggcagcacagagctcagcacgggcggctggagcttgaagaagaacagtagcgcggggacgcaaactagacttttctgtgtggttt

SEQ ID NO: 94664 - DNA, 700 bp, Oryza sativa
atccttttcttcaactgaggttgattgattattgcaaggtgaacatatgacatactccgcaagccacacagcaaatatgcaagtgcacaaggataccaaaggattgcataatataggctcatttgcaaaagcagtatttagcaaatatttaagaatagtaaaacagtagagtaatcatcaattttaatcaacactgaacagcacacccatgctgctcaggcccaaccattctgaacaaccaaacccggctgcacagatctaactccataccaggagctaagcaaattattaccaattatagcatcaataattattgtgagaggtgtgagactaatcatgaaaaacattgctcaacccgcccataaccgcgggcacggctattcgaatagttttaatctggccagaggtgtaccactgtacccacaagacacagcctcaacatcatgtcttccatgcgtcgcgatactggaaagtacccgaatagaggctgtgacagtacctcctgcacaacacaactcaccacagtgcaccattcctggatcataatcaccccctaaatataaccagaggcatggactccccagcgacccccgtgggcttatctcgccacttctcaatctggtaccccgcaatgaaccatgctatacaaaagggtaaagccgttacccacgctggcttctggttggtccggttaatgtct

SEQ ID NO: 94665 - DNA, 2237 bp, Oryza sativa
  unsure (1)..(2237): unsure at all n locations
gatgcgacacctcgccgtcgtcctcctcctcctcctcctcctcgccgccctcgccgcctcccgggaattcacctactccggcttccgcaacggcggcggcggcggcggcgccgggaacagcccgaacctgacgctgaacggcgtgacggagctccggccggacggcatcctgcggctcaccaacgagacgtcgcggctcatcggccacgcgttctacccgtcccccctccgcctcctcgccggcggcgcggcggtgtcgttctcgacggagttcgcgttcgcggtggtgccggagtatccgaagctgggcggccatggcctcgcgttcgtcgtcgcgcccgacccgcgcctccccggcgcgctgccgagccagtacctggggctgctcagcgccgccgacgtcggcaacgccaccaaccacgtcctcgcggtggagttcgacaccgtgcaggacttcgagttcggcgacatcaatgacaaccacgtcggcgtcgacctcaacagcctcgtctccaacgcctccgcctccgccgcgccggtcaacctcaagtccggcgacaccatcgtcgcctgggtcgactacgacggcggcgcgaagctactgaacgtctccatcgccgccgcgtcggcgtcgaagccggcgtcgccgctcatctcgttccacgtcgacctgtccccgatcttcctcgaccagatgttcgtcggcttctcggcgtccacgggccttctcgcgagctcccactacctcatgggctggagcttcaagctcggcggcggcgccgcgccgccgctcgacgtcccctccctcccgtcgctgccccgccccgccgccggcggcaagaaccgcacgtcggcgatcctcgccgcggcgttctcggcgttcgtcgcgctcgtcgccctcgccggggccgccgcctacgccgcccaccggtacaagaaccgcgacgtggtcgagccatgggagctcgactacgggcgcaccgctacagctacgccgagctgcggcgcgccacgcgcgggttccgcgaccgcgagctcctcggcgccggcgggttcggcaaggtgtaccgcggtgtgctcccggggaagccgccgcgcacggtggtcgccgtgaagcgcgtctcccacgagtcccggcagggcctccgcgagttcgtcgccgagatcgcgtccatcgggaggctccgccaccgcaacctcgtccagctccaggggtggtgccgccgccgcggcgacctcctcctcgtctacgactacatgcccaacggctccctcgacaagcacctgttcggcgacggcctcgcggccgcgcggctgacgtggggcgcccgcgtgaaggtcctccgcgacgtggcggcggcgctgctctacctccacgaggggtgggagcgcgttgtgctccaccgcgacgtgaaggcgagcaacgtgctcctcgacggcgacatgtccgggcggctcggcgacttcgggctcgcgaagctgcacgagcacggcgcgaacccgagcacgacgagggtggtggggacgctgggttacctggcgccggagctgacgaggacggggaaggcgacggcggcggcggacgtgttcgcgttcggggcgctggcgctcgaggtggtggcggggcggcggccgatcgagccgcgggcgccgccggaggagctcgtgctggcggagtgggcgtgggagaggtaccccgccggcgaggtgggggcggtggtggacgcgaggctgcgcggggagttcgacgccggcgaggcggagcgggcggtgaaggtcgcgttctggtgctcgcacccggcgccggcggtgcggccgacgatgagggaggtggcgaggtacctcgacgccggcggcgcggcggaggtgcnggagcngccgccgccgccgcctcccccgccggtgagctccggcgaggtcggctactacgacttcgtgcactcgtacccgacgtcgtcgtacgagagggcggcggcggcggcggacggcgtgacgcagacgtcggtggccacgttcccctactcgccgctgtcgatgaggtcatcccacgtcagcgtatgactccacagcctgggcccgcctgtcagtataacgataggtgggacccactgcccgcaaccttggttcaagtgggaccagagaacccattgtgatactctgttcttgccaccaaggtcgttagcgttgggatacatattgtaggatactgtggtggatagaaccgcacatatcgattt

SEQ ID NO: 94666 - DNA, 977 bp, Oryza sativa
aaatcttgtgcttcgtggtggatggcgtcgctgtccaaataaccggccaactcttcggccacaacatgcgaagaggcgtctccacttgtagccgacgaactgccacccacttggattgaacttgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcaga

SEQ ID NO: 94667 - DNA, 1051 bp, Oryza sativa
ggctcccctgataagctagttactcagccaggggtgtcccattccacccatgtggtcgtacttgtcttatctttggatgaaattccaaggaaacggtccttaagtgcaagagtggaaaaccgtacacccggtacgttccccggtccgcggttttgggaatttcatttagttcgcaagcaccgacccaggtgtcgggttttccaagtcttttgtaaaacccaagttttatccaagttgtttttcagatttttaagtttgaaggcgaccgtcgatactcgcacagggtgcacgaatatcgaggcacaactagatggttacaaggggacatgatatatcaattaacaaaggaaggatcaaatgcaacaaactaggtaggtccgccaatctgccttgcagacgggacaaacagattaagtgcgatcctatcaatgcataatattttgcaagcaacataattaaattcaaatataggctcaagatgttcaaaggtggcttgcctttctcgagatctggagcttgatcctcgaaatcctcgcactgcgggtcttcgggcttcgaaactacacgcaaaacgggatgactcaacaaacggtgaaaataaagccctattaatgacctataagcttgccattagatagatctcgagatttgaggaattttggaagttgaacggagtcaaacggatttacggttgggaagatattgaattttaagattattggatttttggtctaaaggaaaaaggatttaattaaatccttttttggaaaagaaaagaaaagaaaagaaaagaaaagagggagggaaatcagacttttcctcgggcggctagggcgcggcccgagagaaatggagcggtccggccgagctaaatgggccggccggcccaaggcggcccaaggcgcgcgtgcgcgggagggaggagagagagagccggtggaccgggctcaccacgcgtggtcccgggtgggacccgcttgttggtgacacggttcaccgtgcggagcgagcacgcggcgcacgcgcgcgggcgggggagggacgcggtgca

SEQ ID NO: 94668 - DNA, 534 bp, Oryza sativa
atgtcccctgagcttcaaaggaaatatgatgcattggatgctcatacgataatcacgagactacgtaacatgtttgaggaccaagcaagagctgagaggtttaatacctcaaagtccttggttgcgtgcaggctagcagaaggtaatccaatgagcccacatgtgatcaaaatgattggttacgccgagagtctggataagcttggttttccccttagccgagagttggttactgatttgattctccagtcgctacctcccagctttgagccgttcataatgaatttcaatatgaacaacctgaacaggaccttggcagaattgcatgggatgctaaagactgctgaggaaagcattaagaaaaactccaaccatgtgatagttgtgcataagcgcaagcccaacaacaagaaaagttgtcaaaagagaaagctaaactctgatgagatcacgagtactagcaactctaagaccaaggttcaaaagacagggcccgctaaggatgcagagtgcttcttttgcaaggagacaggt

SEQ ID NO: 94669 - DNA, 749 bp, Oryza sativa
gacatactcaacaagccacacagcaaatatgcaagtgcacaaggataccaaaggatggcataatataggctcatttgcgaaagcagcatttagcaaagagttaagagtagtaaaacagtagagtaattaattaaaaattttaatcaacactgaacagcacacccatgctgtacaggcccaaccatcctgaacaaccatacccggctgtacagatctaactccaaaccaggagctaagcaaattattatcaggtattaacatccataattattgtgagaggtgtgagactaatcacgaaaaacattgctcaacccgcccataaccgcgggcacggctattcgaatagttttactctggccagaggtgtaccactgtacccacaagacacaaccccacatcatgtcaccatgtgcctcaataccaccacggtacctcggaaaggagttgtgacaataccccttgcacaacataatccattacagcgcacctttcctggatcataatcaccccctcaaaaaccagaggcatggactccccagcgacccccgtggacttctcgccacttctcagtctggcgcactataatgaatcacgctatacaaaagataaagccgttgcccacgctggcttgtggttggcacgataaatgtctcacaacagtagctcgcgaaccggtccttaattgtcatgagcacgactctcaaaaccatgtgctcacaacccaccattatcaagttttagttggcaag

SEQ ID NO: 94670 - DNA, 1063 bp, Oryza sativa
ccagaagatgctttacgctattctgatggcctcgaggaaactgcgccattatttccaagcgcatcgggtcacggtggttacgtcttaccccctcggccaaatcttgcataatcgagagggtactggacgggtggtgaaatgggcaatcgaactttctgagttcgatttgcactttgaaccacaccacgctatcaagagccaggctctcgccgattttgtggcagagtggaccccagctcccgagcctgtctcagtccccgaggccagctcgggcccctcacagctgcctcacaccgctcactgggtgatgcagttcgacggctccctgtctcttcagggcgccggtgcgggggtcacgttgacctctccgagcggagacgtcctcagatacttggtccgcctcgactttcgagcgaccaataatatggcagaatacgagggactccttgccggactaagagtggcagctgcactggggatccgccgcctcctggtgttaggcgactcccagctggtcgttaactaagtctgtaaggagtaccggtgctctgacccgtagatggacgcctacgtgcgccaagtacggcgtatggagcgccattttgacgggattgagcttcggcatgtgcccagacgggataacatgattgccagcgaactctcacggctcgcgtcctcgcgagcccagaccccaccgggcgcctttgaagaaaggcttgcccagccgtcggcgcgacccgaccccttaggggagatggatgcgcctgaccggcccccgaggcccgtcggagtccaggcctcgggacctgaggggagtgctcccaactcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcc

SEQ ID NO: 94671 - DNA, 1086 bp, Oryza sativa
tggagtagttcattgatgagtgtgtaactatactaggttgcttgcttaatcaacttgaacaatataatggtctacacacatcagatcagtgttaacctggttaaggtcttgtctttagtgtaacccctctccttctaccttttctaatctgcatcagaatggtgggatcatttccggatgaacagagcagaacgacaaccaatcacttgggaagagtttaccgaaggattcaagaagacacacgtacctgtaggagttgttgctttgaagaagcgtgagtttagggctttgaagcaaaaggatcgtaccgtggcagagtatcttcatgagttcaatcgtctggctcgctatgctccagaagatgtgcgtactgacgaggaaaggcaagagaaattcttggaaggtccgaaggatgaactgtcagttatgttgatctctcatgactatgaggattttcaggagttggttgataaagcaattcgactggaagacaagaagaacaagatggataaccgtaaaaggaaaatgactgtatcccaggaggcacaaggtagtagccagaggcagcgtatcaagccactccaaattggtgaatctttttctgcaggtcaagaacagtcacaacagttgggcatcagtggtgagatcaactcagagactaatgcaagcaatgaagacaatgatgagcaagctactcaatcagtgtcatttcagcaggatcagtctcaagaagataacagtaatggaagggagcatcgggtgtgtttcaattgttatgagccaggtcacttcgtaaaagagtgtccgaagccgaagcgtcaacagccacaaggccaagtcaacaacattgtcctcacaggagcaaatgcagtgccggttgcgtctcaagggatacagctcagccatcagttccaaagcagcagtagctttctttaaaaccttagaataattattggagttgtggaataaaagatagactgtagtttacctatgcctttttctttctagccgttccgaatctcgggatgagattctttgtaaggggggtagatttgtcacatcctgattttcgtttcaggatttata

SEQ ID NO: 94672 - DNA, 2042 bp, Oryza sativa
aattagatagtcatggctaacaaaaatattaaaaaaattctattttttgtcaatccgaaataatatttggctaatgtgaaacattaatgacgatggcatagatggaataaaccattaattcaaatttagcataacacccgagaacagatctacgaatgacttatggatccatacaaattaatgactagtgcattttacatgtattactgcatggcagttcaattcaacgagcgggtgtgaatcggggtgagaaattctgaatatttaccttgtaggctttaatcttcaaccaaaacccaagaaaaatcaagcaaaaccgcttccacctcctctagcggatcgatgggcacccttaacataaatttgagataaatcaaactatcaatggatattttcgtggccttaacatagtttgacaagcattaatttgactaatggccatgacgtagatcgaagaaaacattaacgcaaatttagcatttcatccaacaatagacacaaaagagataaaaagaattatccctaaaaacaacacccatagcgtattttacatgcatacgtgcagcacacgacaattcaaatcaacaaccaagagttaaacgaagcgagaaataatgaatatttacctttaggcttcaatatttaaccaaactgtcacatcctgattttcgtttcaggatttataaattatttaataaattattaatagaatttatattaaacgttcattaatttactagtgaagttaaatgtgggaaataaaatttcctaaatataaagcatggatggatttaatttttattaaattctccatggttaattatactctctggagttttctcggatttttcggagctcaattcataatttttaatcatacaaagagcatttcagtaattaaccacatattaaattaatcattaaatggtctaattgtaatttttttaagtactttgagtgtccaagtattttcaggatttttcttcaaattatttgagcattggaagtatttttaataattcaaagatcatttaagtgattattttaattgggaaagtaataaaatcctcctcctcagcttgggccattttcggcccattccttcctttccttcctctctcttccgccggcccaacctgagccgcctcctctcctctcagctcagccggaaaagtctactttccctccctgcgctactgttcatcttccaactcaggcagagcccgagccagccgtgccgtgcacagtgccgccgcctcttccttccaaatctcgcctccccgttgctctttttctccaattttgctgaggggaaatattcctcttatcctcctctatctttacccccaaaaatcggagcaaatcgttgagtatcttatccgaatcaaactcgttttcgagtttatctccaaaaccgagtttttgatttcccggatcgatttcttgcgggaggagtccgatctcttcaatccaaggctataaataggaccccctagtcctcctctttcgtttgccccctctcccgtcctcttccgtgctccgtagctccgtcgccaccgccgccaagcaaaccgccgccgccggccatctccggtgccgccgcgccgccgtctccatcgtcgtcgccggtcgccgtcaccaccgttgggtgcgccgtggtgaggggaagctcggccacccttccttttccgtcgccggtcatcggagctccgccgccccgtgcaacccgagccgccgccgtcgcctcctcgtcgccggccgtcgtcggtcgtcgtttggcacgagggtgagtatcgttgggttcgtctcgtcgtcctctacgtgttcatgtcctccaaatccgcagccggtcgctctatctccggcgaggtcgccatcttggtccggccattgatgatgtcatcatgacgtcatcatcttctccttttccagttttttctaatagattaaatcttcggaaattcataactaaatcatcgtaactcggttttgagtggttcaagttgctaaattcatctaaaatcatgatctacatgtttgtt

SEQ ID NO: 94673 - DNA, 600 bp, Oryza sativa
atcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgatagctcttaatgatgcggtcgacctggtccggcgatgcagagtgtgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaggttcactaagtggcccgaggcttatccggtcgtcaagatcgataagcactccgcacttaaattcattaagggcatcacggcccggtttggagtgcctaaccgtattattacggataatggcacccaattcactagtgaactcttcgacgactactgtgaagacatgggcatcaagctctgcttcgcctcacctgcccaccccagaagca

SEQ ID NO: 94674 - DNA, 673 bp, Oryza sativa
tgttttcttttttttttttgcggggacaccttcctgttgttgttagtattgcatacatcaaaacatttatctcatgcttgttcggtggcctcaataatcctcctgtacagactgcgcaattcaaacatatccttggagtgaagccaacaccgcatagtgtgctaaatgatgtccctgtcaaaacttatccaagatcgctgatgcttccaaaggagtttgatgccaggtctgcatggtcacagtgtaacacaattgggaccatacttggtaagttcaattagtacctcaatgtttgacctgtaattagttctaatgaatacactaaccattcttcatttcctcaataattttccaccaaaccatgggaaatgttgattttcatgcgcagatcaggtaaactacgcgcaccaccataaattgttaatcccatgagggtttagaatgcaagatataataggtattatgtcttggttgacaatgacagggtcactgtggctcgtgttgggcatttggtgctgtggagtgtctccaggatcgtttctgcattcatttcaacatggtcagtgaatatgaatgacaagtccgttctcatggccaaggcttctaacttaatttattgttcctttgctcacatagccaagctactgttttttattccttgtagaacatttcg

SEQ ID NO: 94675 - DNA, 583 bp, Oryza sativa
cttcagtgcctttatactcttgccaacgctgtgcccggctcctcgcttctcgcgccctctatttcgccccctcgtttctcgcacccacgcttccactaatcctattcgcccgcttgcggcgcatgaggtggatatgcggttgtggcagtcgagatagatcatatcgtgcgcgcgctaattacgctcgccgaccgaagcgacgttaccatatctccagatgaaacgaatcgccatgtccagattcgtgtgctactcaagtaatgtggcagtcttgaagagaccgctcattgttgacagccgagttaccattgccgatgtgcgtggtttgtgaccgttgggtttctgcccaattgtggagaccggtcccacctgtcaccaggccttaggagtggcgtcatgcccgaccgtttcccttaaagagggcgatcgccctggcataacgccgggggctactgtcggtgacatgggatcaggagtatcatgactggaggtttgaggcagacacaatcgcacacgtggccttgcacccccgagggacgtcgggcccgagggtgatgtggtcgccctcctcttagtccccccg

SEQ ID NO: 94676 - DNA, 1212 bp, Oryza sativa
ttagcggccaccaaacgagccctctgcgaatactttggcgggttaccatccttcagaggacggattccagtaacctgcaaggcatgcagaaaacaacattatgataaaatgaaaccagaaggaagatcaaatatggagaagtgcgagtctgtaaacaaatatggggagattaccaaccttcaaatcactgaatgtactcgatgcggaaaatccaatagatatggggaaaaatgttgatggatcagctggggggacaacgaattccatggagccactgcaaataagggggaaaagagttaacaacggagggcaaaaaacccaaatagaagtacaaaacataattatatgaactcatatttcaaggacctgcggttcgactgatcgataagaagaatggaccattccaacacggagtttctcgagtcatacctgtatgcacagtgaaatgtgaaacaggcattagaccaataagctttcactgtgctgtctacgttattgccaacaaggaaaaaaaagttgagctctatctacaagagatgtcatttaggaccaattcatacaagggatctggactaaatcccgataaattcaaaacacatccctcttaagcatacagattaacagtttgagatgccaataagactgtcaggaacaaaagccagaattgaaagttatcacttgttatattttaatactcctaccatcaagactaaggaaggagacaagtatgacctgttggaggattattttagtataatataacagataagttcactaaagaggaatttgaaacattacttccattctccatcaatctgtctaacacttggagcctcccggagagcaggcaatggtatagagatgacaacattgtgcaggtcaaacatctcagcagcttcatactcaatgttgacataggtttcacttccagatactgatggccagcagttgactatgcgaagaaaaagcaagttaccaaaagtattaagcaaccagtgtaagagaaatacatgtccttgaaggacgagttagtggacaggagaaaataaaatgattgtgcacctgatacaggtaacgatgactgatccatcccctgaattctccatttaaccagaggagtttcattttgaccacttgggaatggcctgtttggctcttttgctctcgcgccgtgttgtctgatacacagatccacgctgatattggggtgtg

SEQ ID NO: 94677 - DNA, 2067 bp, Oryza sativa
accattttgttgtttgttcatatcaaacagagttgaagggcttagataaaagtgtctgaagttccatcatggctactacagctcaaaaaaagtgtcatgtgcaaatcgggaggatggagacttactgcgccagcattccatttgattgaatgaagttcttttcgctcaagtatacttctgtagccatgtcaaggaaaaactacagggtgtactgtacagcagttacaaagaaaaaaaaagtagagaattatgcgaatgtgatcaatctatcaggaacgatgagatgatatactaaagtaacaaagatgctgattactgaattgcttccaatgtaagtaaaaagagggagtgctttaacagaaaatatcaaattaaatagatggattaagtccaaggatacatttgtattccactgataatagctccaaaaagtcccaacattgccatcaactcaattctgttgcttttcttgaccaggtactcctgaaatattagagagaaaaaatgataaatatattcatgccctgttgactctagatcatgccaatatgcaatcagatagttgccacatgcaaatgaggaaaggtgaaatgaaatactttgtgacttgtgaatgataagagttgctacttacctctgtaacattgctgcaagcataaagcatggaaccaaagattacgagcaaatctcccttcaaagggttgggtccttctgcaatacatttcagaaactgtacttatattctgatcactgatcagaatttgtgaaaagaaaaacataaaaagtatatattgctgtaactagtacaaattgcatcatgagaagttatgtccttactagctcgatcagaggcatggacatctgaaaatactactaatataagtccagccacgcaaactccaacaccgatgaacttcctgagcccatacttggtcttcaaaaatatccatgtaagaataatcacacaaggaattgaccagcaatccaagagcatcacgcttgtcaaagatgtgtactgataagacttcacaactgtttaaacaacaagagattcgcatgttttccaaaaacaaaaaacatgccattttattaaatagaatttacattaacacataagtgataaaagtagtctattattttttgcttctttttgctacatacctatataattcgcttccacgtcaataatcccaaggatcaaatagtagtaccattttatctgcacggaagaaatggaaaacttccaatcattatcctagataatttcacatggctgtgccagccaaaaaccaaaatactagtctacaaagtacaaactctaaagagcagaatcagaataagcatcagtctcatcgaacatgtagataaaggcagcaatcacaggtcctgtctataaagataagatatgccaatcttgcagcctacaatcatcaacggtgcagaaggaaaacaatgcaaaccaaactgctatcaactagtaaaaaagaataaactaaaggctgcccatgtgctgaactctacatttatagctaagagcaacagtccaggactccagattctgtacgtttctgaacaatttcatgtctgaaaaatgctcatccaacatttcactatgacaactatatacaaaattttgctggagatcgagggtgtatttagttcatgccaaaatttgaaacgatgtgatggaaaagttgaaagtttgtgtgtaggaaagttttgatgtgatggaaaagttggaagtttgaagaaaaagttgagagcttaaccagagtacaaaattttgctggagattgatgacagaggatgtggaacgtaccgtgaggggctgtctccggtagatgagtatacctccatagataaggaagagaaggatgtagttcaacagagactgagatgtcggtgcattgatacctgaaaaaaaaatcatttcagcaatgagatattatgttgaaaatttggcccgtgtgtttactaaattaaaattgatgctccatggcaccttctgaactgacatggcaacatccaaactaactgacactaattaaaaacactcatctttttccc

SEQ ID NO: 94678 - DNA, 4740 bp, Oryza sativa
aggcattcctctcgtactacaaattcagggtaaatgcatgtttatctttgtcgtgtgtatgtaacgggcataattggactgagggacattagtccttgttgaggtttcctggacctagccatggtggcaccagggagggagagaataaggactactccttacaaacttttctccaagatccagcaaatagctaccaaatcgatataatcttatctccaatctgaacaaccactatggatagtaaccatgcgggtactgttgatgtgcaatttcactggccctagggaggctgactgctgcttgtatatgggccctaatgggcacttaatgacttcaatgtataacctgaagcgccatgctctgtgtgcaggtggaattattggtcttggagaggcagaggaggaccgtgtaggattgttgcatacactggctactttgcttgcacacccagagagtgttcctattaatgcattggttgctgtcaaaggcacgccccttcaagatcagaaggtattccgcgctgctgattagttgttctaggttggatatttgcatctagcatcaggatatataaactgtgcagactataataagctttggtataagattatatgttgtgatttctgtatccattatctctaattaacattcaacttcagcctgtagagatctgggaaatgatccgcatgattgccacagctcgaattgtgatgccgaaggcaatggtgaggctttcagcaggacgagtacgtttctccatgccagagcaagcgctctgcttcctagctggggccaactccatcttcgctggtgagaaacttctaacaaccacaaacaacgactttgatgcagaccaggcgatgttcaagatccttggtctgattcccaaggctccaagctttggtgatgaagcaccagctgcagacactgagagatgtgaggaagctgcatcaatgtagaacaccaatagaaactcttgagaacacgttcggtgcaaaagtagcaccattatttccggttagcgcattgtattgtagagattacaatatcttgtagtaagttagaaaaagatcgacccaaataaatagggaattttctgtatcattgttcttgttgtgccattttgtgacatttcaatcagcttcaatctcagttttcctttttcctctttgatgctacactgaagtactgatcattatcaaatgaacctacattgtgaaactgtgaccattgtttgaagaacaagtagccactgatgttgtcactagataataaccagtttacccgacctgattgtgatagcctgatagtctgatggcttgcttcacacctgatgttggtgcatgcataagcatgacagtgacaggcaatctgaaattggtgtcagatcctgcaatcttatgaatcgtgaaactcatggcatgatgtaatctcatacgattggtccaaataaacaccgaccattgttgccttttcaagggacctgtagattgccattgcatgtacttgaggccatgatcatcagtacaagcttctaccaaaaggtgaaggcatcaacttttccttttccatctcaaaagatttgaaaataaaaaggcatcgtttttgcatggaaaaccttaacgtagacgttgattaataaaaagtttggccacatgtcgttatgcagtatgttcaaacttgcaatgacggataaatttacaacaaaggattgcgaggacctacgcaacaattccagttccatgatgattccatcgtacgtgtgtcatgagtgaaattggggctgaaattagcacttaaaacttctcttggaagaacactttgcacgtggaggcaactcagcatcaggctttcgaagaaaagagaagaacatccaacgaatatagaacatggtatctcagtataaaatcaatactttggtccaaaaagaacatgcatgtcttgaccgtactatagaaaaagaaataacgatggagcacaaatcttcagtatttatgctaaggccttgttctaaactctgcattgtttcacctttcctttttcacaaaattatattgttccatatgattgtacaaaatttaaattttcatgtctcagccaactgcttaccaaacaagccgcttatctcgagtaacacgtagggcagtggtatgttatgagtttaggtcccaagaaagttgtttccgagtttgatgacctcactctaaatgtaaatgctactattccaaactaccataaatgctaaaaccaaataaagcatatcttccaaagttttggtttcaccataaattttcttttctgaatagcggtcaactaatacattgttattagtggcggagaggaatttaaatctgtggggtcaattactagtggtttgtatttaagtgggaacatttctctaaattcttttggatttatacatgaaaatcaaggtttataggatgtttttcaaaaagttgtggggtcagccgaccccacagaaatggcctaaatccgccactatttgttaataaaacttcactaaactaatcacaatagaggggtctagaacaacaaaataaaaccatttcaagaaaagaaagaaactatatatatgcacgccgacacattttcttctccaaattagtcgaaacttgtgcatagaacgaaccctaagcctcccttcctctctaacatccattcatcccacccctcccccctctttttgccgcaatctccctacctccaccttgcccctattgaatccacggcctccctaaccttttctactgacttcacatatgtggtgctttccttcccatgtccaacgatcgccatcagatacatactccagcaccacctgatgctcctagccgctacttccttttcaccccacctaccactgcccactgtagtggacccccgtttttataacaggaatcaaccgtgtaaacagtaccatttccctggatcaagtagtctggtacacacgaattcatagctgaaataccaagtgcacatacacgagtgtctagtacgaattattacatcataagcccacaggcatagtcttaaatcatcgaactgagcggtccggaatacattccaaaaacagaagtaggtaaggcagcggagtcaaggcagcggcacgccattgccacaggcaacgaccgtaactaagacctactgagcgccatcgtcttcatcaccctcctgatagtaagcgtagggatcctccgaagcttcatctccgacctctgattaagtttgtatattgcaagggtgagtaccaaccgtactcagcaaaccaccacagcaacaatgcatatgacaggggtattcaaaggatggctatggttcttttgcgcaaagcaagttttgtaattcttttcacaagcctaagacctagcacagactgatcaaattttagtaccagtgttcatattaaacaatgacggttctatccaccatccattgtgatcccaaggatagcttcccgccattgagtcgtcatggttttctgaggacgcccacattcccgcctctcaggaagtggctccatcagtgtagaaatcatcatgcaatatcccatcccacacaggttaagaatttagagtctagccaagtgtaatacatgtcccggtgctcaataaccgcgagcacggttattcgaatagatttggtttactcacactgcagtggatgtacactttacccgcactccgcgactgcccaacatatgagcctcgtcccaacacatgagacgcgtcacggcaaagcttttcgataacctcgcattggcagtacccgctccatgaactttagccctcatgcactctaggcgtcatacgtttctagcagtgagaagagttctggcgctcccgggaagggaaaaacacacacattcctacgttgtttcttgtcgttgaacccagtccatcatgattgttctcttatgggtatcctcacgtagtattgccaagccaacctctgaccatccggaatgggcatctgccatccacctggccatccgaaccgggcatccgccagcagactgcttgccgcatcacacacctaaaagaagaccactacgcatggatactgcctctgctcagctatctactccgctaggtctatacccatacgagaagtgcggttgtacgggggtcgtttcatgcttaacttcatggctcggtccttaattgactggggacggtactagcattttccggataccacccaaatcctccgtccgccccagtcgaaaacagttgtttagttttatttctcctttcacaaatcatgtcatcaacattatggcaatgtggcgctcatatctccacataccgcatctcaattaccttcccaaaggtaattgcccaagcatatagcatttgataaatatgagtatgcataaatctagagtagcatttctaagcatttgtcatagttgactagggacttattcgtaaatcatagttacaaggatttaagggtaaacaataatcaaggcatggcatactcacaagtaggatgttcatcattgcatgcgattttatttgtaacaaaataatttcgcaattgggatcaacatgttcaaagaatagtgatgacttgcctgctcaaagtcttgcaggtcttagccttcacttggatccgcaactccttttgtttctatagctacgtgcgaaaattgagtggaatccggttagaattcaaataaagatccacatgcatccaaatgaaagtcgcatgcgaaag

SEQ ID NO: 94679 - DNA, 1741 bp, Oryza sativa
tatgagttctctgttcaggaacatcagcaagttaagcgatgaatggtttgcggatgaagaaaaagttcgtgatattgatggattacttttaaatggaattgatcttactaactctagaaagggttgtattatttattcaaatgccagtatattgttatcacttggttggtgtgctggccacatgtcatatctgatcaaacctttggcttgggctacatatacacttgttcttacatctgacagctgttttggttgcagctaacttgtggaatatgttttgaaaggtattcttctgatgtgatgagttctgctgattgtgatcatttttattgccatgaatgcttggaagggctctctctctctctctctctctgggcatgcttttgtgcataacttcctttttgcaattccaacactagcttagatagtttcaccatcagtgctcatgtatagactatcttgtagacttgtagttgttgtttttggtaaccatgatcaagatctgttcctgtgttgcagttattttatttttccctcagaataatgaaaatttatgataatataaattcaacctttcaggtatattagtgctgcaataagtgatggtccaggatgtttgtcattgcgatgccctgatccatcttgtggtgctatggttcttcagaacatgattaataagtttgctaaagatgatgataaagtgagatatgcacgatttatcttacgtgcatatgttgaagatagcaagaaggtaatatgtttgaacaagctaactaattactccacttgatagttctttgtggagtacctattttttattgtttatttttctaacgatttgaaatgatgagctgtgctctttctgttaaccttttgtataacctatggcatttcctgcagactaaatggtgtccagctcctgactgaacatgtgcagtggaatttgtcagcgatgggaactatgatgtctcatgcaattgcaaattcagtttttgttggaacgtaagtatttctggctccattttcctgacgatttaattctacttttttttattgctagtgatgaaaagtgtggagcttcatcaatgctttggtgatgtttgcagtgcacggaggaagctcatcgaccagtgaactgggagactggttctaggtggatattaaagaatagcgcagaatctgaaaatatgaactggtatggttcaggctcaaaactttattaagccatagtgtacggatagtgtatagataaggaattcattaatttttgtggagataaatctatgttcaaacatttgtgttgtatatttacttctttttttaacctatccttgatgccaatattgcagctatcttctaactttcctcatggttatgagtaaaaactgaggtggtgaaaaaaattgtgcatttaatttacgtacgtatattcagatgttatgtattcagaaacatcaaactttgtggacatcctcatgtgtgactggtggtctggaagcagaagatttgaggatgcaaggaactgtgaacactattaactctttgctgagtcagggctgcaagggctgatgcattgttttttaacaatatattatgacggaaaacatgtattatatgtggcactgtggcttaaacctcataataaacacctcttaatttatgttaaatacttggcattgactccatttttatcaattgatgacttctttttatggaaaaacttgtggaggctctagtgaga

SEQ ID NO: 94680 - DNA, 1745 bp, Oryza sativa
atatttatgtccatattactagtgtatgtacctctcatttgttttctttgaacatttcaggttatgtctgggttcatgggctgaacatggggagagaactggtggattttacgcttgtaatcgctatgaatcagcaaagaaggagggagttgtatgttttatcttgagactatccaattgcatttagtagaaggaatcagtttctagatgtcttgtgtattttgttattgcttctgtagaattaaatgtttcaatcccacaagtcaatgtcgagtccaaattgacagtttgttcaattagttcattcattcatagaatcataagggttactttttcctaacttaattacctctaatgcagtatgatgagactgaagcaaggagggaaagagccaaaaattcacttgagagatacatgcattactatgagcgctgggcatctaatcagacggtatgttcaacatgctcaagtttgatgtctctttgagtttttttttctttctacaacaactatacgtgcagctttagtcattcttgtgctcataacttactctgtgtttttgaaccttctggtttacttggcaagtgttgtgttggccatatgcttgggcagatactaattttgacttaaattcttacctaccgagtgtagcccaactagctgcagctttatttgaagattacttgccaagtttatctcttactccctccgtcctagaatgtagcaacctaggataggatgagacccatcctaggacaacgaatttggacattcctcatgtccagattcgttgttctaagatgggtcatcctatcaacattatgggatgaaggtagtaagtgctaataaatgctcttttttaatttttatgttggattaccttatcagttcatgatataaaaaaatacagttccagatgtttttctatacctgatgggtatatagtttctaatctactgtacatgcttgggatgaatgttctgcattgttctattctgaacttggaattttttctgctgtagtatgcaagtttctgtactgacatattcacttatattgccagtcgaggcagaaggcacaagcagatctgcaaaaggcagaaaaggaacaagtaagcattcgcatcatgttaggttgggggcgttgcatttagggcaagacataattgtttatcttcgccattcattcgtattttatatttgatagctgctaactctatttcttctctatgtgctacagcttgcaaaattaacagatgtttttggaataccggagacccaactgaagttcataattgaagcttggtcacaggtttgatatcataaatatgtcatgacccaaatgacactccatactatacaattcacctgcgtctgatgcatgcaccattccactatgtctatttcagattattgaatgcaggcgggtactcaaatggacatatgcttatggctattatctggacgacaaggtcaagagcgaatttttcgagtacctgcaaggtagttgtttgttgcattccaaaataaaatcctaagttctaccacgtgcttgccaaaaatcatgtggtatgtatattatatcttttataggtgaagctgagtctggtctggagcgtcttcaccaatgtgctgagaaagacctgcaatcatttttgactgtgagatctgataatactgaacctgcaccatcaattgctgaattcggtgacttccgggtgaagcttgagtattctatagtgtcac

SEQ ID NO: 94681 - DNA, 1657 bp, Oryza sativa
cttgagtcaagtaagagcccaaggatatgatggggctagtaatatgcgaggtgaatataatgggctacaatcactagtcatgagagagtacttcagcttattatgtccattgcttcgcccaccaacttcagttagtagttgtggctattgtgagtatgatttctaccttgttaaatgtggttggtggttcagctaagagacaggacatggttagagacatcaatgatgagcatgtgagcaaagcattaggttgtgggctacttcaaagtggaaaagggttgaaccaagagcaatgtcttcaaaggccatgagatactcgttggagttctccttacaaaactctcaaaattttggtagatatgttcccaacaattgttgaagtgttagaatttgtagaagaggatgatagggatagagcaaacagagatcaagcggcgggtcttttagtatatttctagtcttttgactttgtcttttatttgcatctcatgttgactgtcctaataatcacaaacaccttgtcattagcactacaatggaaggatcaagatattgtgaatgcggttaaatgtgtgagatctacaagaggtcatttggatgaccttagaagacatggatgggaaaaattagagagtgatgtgtataacttctgtgacaaatatgatcttaccaaactggagatgggagaagtatacattaatccaaagaagccaaggcaaaaaacaggaattacaaacaagcatcattatgaagtggattgttttaataatgttattgattggttacttcaagagctagacaatcgctttaatgagacaacatctgaattgcttgtttgctactagtactactacttttatactactactagcagtattactacactgctactagtagtactactactatactactaccagtactactactataaaaaaatattttatatgtatatattttttatgtataaaaaatatacaaatatacacgtataacaaagtttatatatgacgtatacaaactttatatatgatacaaactttatatcattcgtattaaaaaatcaaaaaaaggagaaaaaacatcacgtatacaaattttatatacgcatgtacaaagtttatataatgtatacagagtttatatacgcatatacaaactttgtatatagagtttgtatacagagttcgtatataaactttgtatacgtacgttcatattaaaaaataaaaaaaaagagacgtcacgtatataaagtttgtatacactatatacatacatatataaagtttgtatacgtatatatataaaaaaccagaaaaaaaaacagaaaaaacaaacaaagaaaaaaccgaagaaaaccgaaaccacaaaaaccggcgaaaaaggaacgtgggcccccactgcgcgtggacgccgcgccccctcccctcatacgcgcgccacgcgtccatccgcacggggggaggggtgcatgatcagtcgctaattagcaatttcacctctttctcatctgttcgctattttctcctacctccgagagcaaaatggaacggcgcgcttgccccgcatccatgcccccaccgatgtcgattttttcccatccatctgccgtccgcggcagcaaaaccaccggtgagctccatcaccagcagcg

SEQ ID NO: 94682 - DNA, 9236 bp, Oryza sativa
agtttatataatgtatacagagtttatatacgcatatacaaactttgtatatagagtttgtatacagagttcgtatataaactttgtatacgtacgttcatattaaaaaataaaaaaaaagagacgtcacgtatataaagtttgtatacactatatacatacatatataaagtttgtatacgtatatatataaaaaaccagaaaaaaaaacagaaaaaacaaacaaagaaaaaaccgaagaaaaccgaaaccacaaaaaccggcgaaaaaggaacgtgggcccccactgcgcgtggccgccgcgccccctcccctcctacgcgcgccacgcgtccatccgcacggggggaggggtgcatgatcagtcgctaattagcaatttcacctctttctcatctgttcgctattttctcctccctccgagagcagaaatggaacggcgcgcttgccccgcatccatgcccccaccgatgtcgattttttcccatccatctgccgtccgcggcagcaaaaccaccggtgagctccatcaccagcagcgccgccgcattcaggagcgacggtgtcgtggcattccgcgtcccctatgccccctcgacggctcaaggaattactaacttgctctgtgaaaaaaaaatttcagcaaagtagaagatgtatgagaattatgaagtgtttctttgcactggtagaagttgaacctagaatttgatcataattttaatgtttgatctcgatgtgtgggaagttgtattgttggacagaggattatatattgtttgccactatcatgctatgagacttatgaacgtgtgtcctgtacacactttgttgatgccctactgctgtatggtgtagttattttgtaatgaacaattcaatctgccatgtttcttgtaatgaatttgtgagaaaagcacaagcttttgctagggactttaatctttaaatggaagattttaggctaacctgctgtcttatttttgtctgctgtgaacagagcatatatctgaatggagcttgaatattgcaatcttgtcttgcaatccagatcctctgcagtacggtacagtactgctcactgacacttggcttgaacctctattcttttctgaaagctatttaatgggacctgcactgatataacactaagtttgcatattgctaagctttccaagttcgtctgatatatagacccagctgcgtattgtgaaatgtagagaattgtgacagatgggctggttaaggacattggtgtctgcaatttctcagttaccaagctcaacaggctgttgcaatcagctaatattccaccggcagtatgccaggttgcggactgtcagatttaagttccaacatactgatttccagtgagcctcccaaaatagtgtcgaagtgatggttccatatgaataattttctggaaaatttgtctcagtacacctgaacttgcaaccatccatccggtactcatcaacccaaatgaacaatgcacagctagaaaaatgagatgacaatcaacggcctgagaccccatttcttttactacaaatcagatgacaaactacgtctgttgccttaacatagctaatttacatgtagaaaatcaacaacggcaagcatagtacatattatcaaataatttcatgagaaggaacacaactacatctattgttcttatgaaccaatttctaatgtcatcagttttctgtttggacaacttcttctcgaatgaaatttccatatctgaaagacggtgagccatttccagctctagcttcattccctcttctgcctttgtttttttttcaacataacaggtccactcagagcgcctccgacctggattggtacgttctagcaagtgccaaagctgctcgaatgccttttgtacttttggatgccactctggatctacccaaatcaaagtgtcgcattgctcatcctcctaacaaaaaaatagtactattatttagacatgcatgactaaattaacagaaaatctaagtatcaatgaactagtaaaaagtacaacaaaccaaacctcaggaaggcaaccaagaaatctccttccggtgtcagttccttcccatgcagtcctcctttttggtcacatgccatgtctgcacttcgaatttgtgccatgttcctccctgcaatactcatcatcgatgtataaaggaacattcaacaataggccaaacctgtcctgctatatcggaaacaaaaggattaaaccaaatagcgggacttacccacctgagctataacccatactagaaaatacgcgcgccgtttggcgtgcttaatatctaaaccgttggttactttgtgtatgtataaaacatgatttataaatgttggtttttagtatgtgagcatgaagaataagtttaacataggcttatatatatcggaaaatagttatatataaaaaaatatcaaataagatcgaaacattacataaccaaatatgaatacctctcttcttcttttttttaacgactcggacgagacagtgcgaagttcaaattgataaagtagaaaaaattacaaaatcacaaccctagtaggccataaccaggaaaaggaaaaaaaaagataccaccacccacacaccgacagcgccaaccgcaaacccaagagaaggctagcaccggaccagccaccgctaagcgtgaccgaccgccgctagaccaacaaaggagctacaactgggatcgcccagaaaccaacccctacaaccgacacaaagcactactctatccacatctaagggatctagggagagggagtgagagagaagaatggaaccgctcccccctaaggccctccgatgtgtccaacttgtataaactagggcgccgatacaagacgacgtgactctagagcaagcatgcaacaaaagtttaggtggttccggcaagggtgctacctagacagcgtctccagggagagtgtcgaggggtgaccctctctagcgggaggccgtgagaccccccctttgtgagttcggccaggggaccgggtgcaagtctgaagagcgcgttctcgtgcccatgtcggtgggaattgtgcttgaagggtcaactgtgaggaaaagagagagggggattatacaggttcgggccgctatggagcgtaataccctactcctgtgtgtatgatgatctttttgaggttacaaagagttcggatcctgggagcgcaaactagggctttactagcctctacccagaattccgttcatccaaccgtcctccccttgctcgcaagatgaggtcctccttttataggtaaaggggataccacatgcagcgtccctgccctccctgttcgggagaaggacccacatggcctacattaaaaagtgtcccatgccttgggccggaagcgatccgaacggccgcccctgggtggcccccaccgaagtcctttatctgacatgggggacatcccccgtcattccctaataaattcttggcgacttcatgggctcacacgcgtgggaggcggtgacctgcacgtcctttccttgcacacgatgggacggggcataccagcccccacgccgtctgacacggagtgagacgtgggtgcgctgccgcctgtcccatccatccatcgccgggtcacagaccggtcaaaagccggtcgcctggcgcacatccatcagtgggcggcgcacgtcctgccacgttgcattaaatgcgacggggcggttggagcactgcccataaatgcgcctggcaaacggcgctcctccccgctcaagcccccatgtggcggccacgtggcggccgagcgagggcctcggggcggtttagcccctcgggcccgaggggcgcgacaaggtaccccgagcccccgggaggcgaaacgggcggtcgctcttcggccgaccgcacgaccccccgaggggggctgggtccaccgcgcacgttgcggaggaaaggcttctcttcctcctagcctaggtaccccccgggcccatattatcgatagagagaaacaacaaacatcgccgccgctgtccgcgaggtctcaagaaccctgactgcgctttcacccactagagggggtgagacagcatgacaacgccctcaggagggagtgacgctcgactgccatcgttgctggctcggccaaggacgggctgggttttcacccgccatccaccgcctgcctatccactgttgacacaccgatgctccactgccatctgaacctccgccagcgtgtgggcaccactacaccggtgccccgtgccgggcagcctccgcatgccaccactggctgcgccatgtcacctcgttgtgctggtcgctgcaccggaatggcacactcctctcgatagctgcaaccactgttgccgccgactgaacctcctcgcatcgcgactaaccccgtcgccgctacccgcgcctcgccggcctacacagccaccagctgtgccgcacctccgcgcctcctcgcgccgtgggcacctcaccggtcgccgccgttgccgggtgctgctgccgctggctggccacccgctatcgccgtcgtcgccacgagcctcgcgctgccgttgccgccgtgacgagcgctcctaccgcgagctcgccccacccgatctggccgcagggtggccagatccgcctccggtgcgtcgaatctggcccgccgtcgccatccccgccgcgcggcgcagctcgcccctaccatcgccgtctccatccctgccgccaaccgccaccccaccagatccagccggagcggcaaggatctggtggtcaccgccgccgccgccctgggcggctcccctggccccgggagcgagaccctatcggcgaaacgaggagcccgccgccactgtccttgcggccgcgcggctttgccggcagccgctcaggtggcggcgaggcggaggaggaagatgagtgggagggggcagccggagctcgtcgcctcccgagctgcccaggggagggcgacgcgagaatttagatggagtggttttgatcagaatacctctcttcaaatatttaaaaactcgtattcaccatatttcacttagcttctgaaatttgtttttgctcgattgaaatctcgaaatttttttctagcagggtgataattgcaaaactacataagatctgattgaaaaaaaaaacagcacacgcttcagtcacttttcacctctaccatcatcagaactgcacatacgattcagttatttttaccgctcccgtcaaacttgcacgtaatctaaaaaagcccaaaaagttcgcacgttttggcgtctcccacatataccagccaaaaaaaaaaagaaaaagaaaaaagaaaattcccctctgacctgattctatctctcgagcgggctcggctcctcctcgtcggcgttcctccgcctccgccgtcttctccgccatctcctctctcgagctctctccctccccgatccgctccggcatctccggcctccgctccgttcggccggcgcgccagtgtcctgtgtgtcccccacatcttctgccgcaacttgcaaccctagccgcggatggcggcgcagccttcttcgtcggcgtcgacgggtaatgcaattcgtctcttctcgtagattgcccctagatggagaagatcttcctctcgttgattggattattagtgtttcggatggtttatgcttgtggttgctatgtgtgttctaggtatgaaccggattagctagttaaccgaagtgatttagtttgggttgtttgattcgtttcagtagttgtatatagagatctagccacgaaatatgttgtcacttgaggagtggagcacaccatcaatcccaactcaaaatagcttctccttttacctttaaatgaaaggagtgtggagatgctgtaccattcagtactgattcccgggatctttgattgtctctggctctgtgcaggcgataccaagtttgatgcgtcgcagtatgctttctttggcaacaacgcggtggaagaagttgagctaggtggattggaggatgatgatggtatcgatgctggttttgttggtcctggtgatgaagaatacccttctgcttatggaagggatatgtttgaggtaacatagatgacagttcatttaattttgatgtgacaaacttccatccattatttattactttcaatttaaaaaactttcacaagaaatcaatgtttctttatgacacagtgtgcccagtatgtaattttgtaattcccacagcactcatgactttggtagcaaacacccttttgtgttcagaacatgagagagaggtgggaggtgctcctaggggttattttgatcattcttttttacttcttgtttgttttcattgttgttcaatccaacgggaattaatagttagtctatcatggttcagtaagaggtagcagggtccacctgaacactacggatttatgttgaatgaagagtaaatagtaagcatcggtgttatggtagcttcagaggatgcacatagtccatgagactgtggactcatcatgcggaagccttggaccatgctgtgttgaccattgaaaggagagagggacattagttgaggacgggaagatggagagctaagcttagacattgttgtttcttgccattgttattgctggaactttcctttggtgctgtcactaccatgatttctgctcgcccttgcaattccttttctagagtaacttcagggtagatagcacctttgttaggcattgactgctgtagcatccagcagagagaagcagccaatcaacagaagggtaaatttgggatgcactaggaaagtggcaaatgggatgtgtagcgtagggggtgtttcgcaactatcccgatccgcactggttaactcggttgatcagtatttgttatttagtgtttgataaaacatgttttgaaattttgctttttggggtaaaaactggctaggaactgaatatatcaacaataccgaataacatgaacctggccttttggtgtcttgtgtactgcgacatgtttctgtctttgcatgcccggcttgataatcttcttggctcagttgcccagttggccaactttccaacaattagcggccacttgttttgactggccaatactggctacacaaccaacataagcacctaatattgcttgctcatgttcatcagtaagctgcttgagtgattgtcactgttttattatcctgcgtgtggttgtgtgcatgcatggattaattcttcttgtctcatctgttaactgtcagctatcattcttagtttgtaattatgttaaaaaagagttgctgtaaactttggtaaaatatggtatttaccaaagtagaactgaaaaaacttgtatctaccaatagcacaacaatgatctgtatttttgtaagtataatgtatttactaaacaaatactccctccttcccaaattgatcatcatataatggaattcaaaatttctcaaattgatcatcatataaccgtatggatacggatttcatcagaatacaattaatgcagcaggggagaatgtgtgtatgctaaggtgtaattggcatggtgttttaatcgatgcatgcattgtgggagattgatgtgatttaaattatccttggtcttagtgtataaacttatatgatgatcaatttgggaaggagggagtaataccatatttaccacacagaatttaacgaaaatattgtggtaaaaggtaggtgtcgatgttctgtttcatcggtttagtcgggtcaattcttcggttttcataaaattcggtttctcgataatagccgctgagaattttttttttacaaatataaaccaagccgaaaaaaccaaataaaatcggttcggtagttacggggaatggtttttaccgaagaatctcacattaaggcgacaggtgttcgtgttactcatgttgcccgttgcccgcacgcctgcaccacccatcttctcctgctcgcagctcgcaccactcttgtctactaaagaatcgacagatgggagagatttgccgtgagatttgtggctgtggcatgtgactgccttatcagcttatatcctccaatgtgatatggctgggccatgggatgcatggatgagtcttgcattgactaagctcacattatacttcaaatgagctcactttgagccaagctggattccgagctagagaactggctcatgctggactcgactcaacgtcgagtgaatttcgagcctaattcagataaggaaacaactacaaaaagtctcatgaagaagggtatcatgatgcccagctattctaagtatcaccttacaacgacttaatgcatccattgtcaaataaaaaggcagtattttattcgaacaggcgaatccaccataaacaatttaagaattcattacttccatctattggaattaacatcagatatactataactcaagacatatagacaagtgcctcggttcaatctcaacttgtacacctgagctgcagaagagcgctcgcaagccttgagcttttcttgcatcccatgacttgatcatcccggaacttatgtcaccaaataggaaaccaacagcatcctttctctgcactagtaatatgcccgtgcgcagcaatggacattgattcatgggcttatgggcccatataattggggatgggctcggagtgtagggagggtgctacgctcacgggagggaggcgtacagggcgtgctccgcgcggtggggtgcggaggagagcggacggatgactccattttttagtagagaaaaaatcaaggttaaaaattttgtgatgggtacgcagcagttcacccacctagtagctatccaagaatcactgcttcagcaccaactgctgttccgtacatgatatgcatgtcatacaacatatcggaactgcatcaaatcgatttagaattacaagaaaacagatgcaatacggcagcggcatgggactggaacaatacacacagatacagcaggcccaaatacccagagaccagaggtactgctgctgttctcaacacctatcgccaccactgcacctttcccctgccatcagctcatggtaaggacgatcacctgggggagaagaaattgaagcagatttgctatctctgatagcgaggtcgaaaatttggggaattggaggaggggaaacagcagcaaacttggcatgtaatggtgggggagaggactgggtgaagtaggaagggaacataata

SEQ ID NO: 94683 - DNA, 13945 bp, Oryza sativa
catcatttgatcccctctttgggctgcttacagagtattgcatgagtaaattcgatagtgtgattcatgcattgcaaacacaacctgctgtggcagcagttataagcagggaaatgccagttgaattgttgcgtgccagccttcctcacacaaatgagtatcagcgaaaacagttgctcagtttttctcagcgcacggtgcctgttaacaaccatagttctcatgggtccaataatggacctatgacatcagaatctatcccaagttcagaaagccggaaaatataagttaaatcatagtgtttttgcttctttgggtaatcagtatacttgatacaatggctctttaagatggagactctttccccaatttcctagtaaagaaaagtctatatgaatccaggaaacaagatcgagagggttggagcatcgataaacagcggtaatataaggcaccgagtttactatcgtcgcgacatgtctggtttattatgtactgtagggatgcagtctgttttgcatgcattatgcagatggatgtgtttttgttactgggaagtttcttcctgagttttgttgctcatgaaacctgcctggtatctatctctggctgtagaaggtgcttcttgaagatgctgtttgattgttcttcaagacaagtgtcctggaatcatcaaggtggaatttcaatcaggccgcctttttttcccattttgttttgttcaagggttgaaatgtaactgtcgatcatgccctcatattgaaaaaaatcctagctgtactgaatgttgagcattggtttatggtactatgttttgttattattatttattaatttgtctcttttctgacttctttttttctattctagcggaaggtataattcgggattttagctgagtagagaatgacaatgtagtagtagaaacttgggtggctgtaatgatgtttgcaagtttaaatgcaacaagttagaagtgaccacctgaccatcagatggctcatgtcttggggtggtatttttggttgaaggttgtgttaagcgtggcattttctggcgccaattgttaatatggtgtagaagtattttgctgatgagttcaaaaagggaaaaggaaaaaatggtctactacatttcaattcatagaatgccttataaattcaactcgtcggatatatagctgccacttgatgtcgacaattcttgcctcttactgcatcttatatgcggtgctatacccgtatatgacatatcctagtaatacgatatctggataggcgtcaattcagcttttgtccagcttcgtagcgctaggatgtactaggatgtgtcacatcacgtagtaggtttgtttttatgagatggagggagtacttgctttccctcttctcaactctgcttatctacctatgggtacatggctctgatatgcttccatcattcatctccttccaccgtctatttcctagtgagtgcacttgtatgattatagatcttattattgtgtgttttggtttaaggtgcacgactggtaggacaagcaagtttaaatagcgagtgcctatgggtctctaggatcagtagctaggattaggccattcccaacccaaaacactagatataattttcatacactccacatcatcaataaattagtactagacactactctttcaatgcaaacactattattccatacttaaatttaatgctacttatctcacatgatgtcttggatgttgtgcagaaaccatgtctcatgcaagacatggttttcttctttttcctcatttattcacttgtcatatcatttttcatcataggtgacagtttatttaatgttatagacaccatcctagtcattgagttgggaatggccttaggggatcattcttttgcttggacatagatcatactcccttcgtcctaatgtatagcaaagactggacgagacatatcatagtacgaatttggagtcctctgtccagatttattgtactaggatatattctcacaaatcctagatttgttatattttgatacggagtgagtaagagcatcaccaatttaggaattcctaaacagaatttagggtcttaaaatatcttctccgacagattagaaaaacatgttaccatataatataagaagtgggaccaccaacaaaactaccgatgtttcctctccttgaataatgacccgaccaataggacccacatgttgttccctctttctttcctcttctcttcctcctctcgttcttctacctctcacgcagggccagaactagtgcacagcgagacaagttggcatcggtggcaggctccagcaagggtggctggaggagggtgcgagaggatcctggtggccggcagcacgaatcgagtctcagcggaggtactaatcaaggttgtgaatgactagttgtggagagctctaggtgtgacttggggcttgacggaggggagaatcaagcatgcgtgtactagctcgggggccagccgtgacgtgaatcgagtcgacgtcgggtgagcttgcgacaacagagacatttcagctgtgtgcgcgaattgcttgtgattggtagattggtaggcggtgatattccctacatgtggagaacgagaatagcggagaaggtatttctaattttttgggatgttgattggagatctgttggatctattttttgaaataaaaaactacgaaattttgagattgggaataggattgggcatgctctaactattaattattagtacacaggggatggagacaccacgcggatatcaaatcagggtatattgcacgggttatcagcagtatttctcatagtagaatctttcgctgacaactaatctagataatgttggtgcaggtttatctagtgacatggtgaagaatcatgtcaagaatgtggtgactaacccaacgtcgtcagtcgataacattccagcgccactgtgcgacctcccgtagacagagcgagaggaaattgtcaatgtaaatacccgattacttatcctctcttgatcttaactcattttgtaggagtagtgattctaatactttcaagaatcgcccttaacggatgtgattgggggcattgatcgaccactaggaatctgcctcgctccatgaggacgttgaggcacatccccactcagccattgccctcgcagcagtgaccgcaatatcctcaggcgttggctctagtggtgcaataggagtcaaaaggacactttggaccaaattcccagagccaaaggagcagggatgctcaggagggttagtgtctccgtggtaagtaaaacatcaacactactaggttctcttatggaatttgtcttagcgattgatgatttattaattggcagacttcttctgccaagaaagcctcctcgggcgaccgcggctagacctttgcttctgtcaaagcaaaaaagattctagtaagttgacctcttactttggttatcttcttgtttgattccttagaatctagttcgtcgagtttgattgatgtgtcttatagtaaagttgactctgccgttgtcggcgcaaagctcttagcctacctacacccaagctcttctccccaaacaaacaattgatggatcttgtgcacaatagttgcacctgaagctagagatggaggaattttggaggcaggtgggactaagggaggggttctcactttgaaggtgcggcaaaactagttgaggcattggggtcaaggattttcgtgggaaaaggggcgcagtatgcggcacaactaacatagctgaagtctatgtcagtatatggcatgggtatcacatgggtctcaatgggcaagaatagaagttggtagcaccgagtgaactgggctttatacttttggagtgggggagggggttgtttgctgtaatgtccaatagggcttgtgctctaaggatacatttagactaaatctaatggttgacataataattatgactaaatctaatggttgacttaacctagaggggatattgaataaggtaattagaaggggattatgagcgtcttgttcttgatctgctagatctagatccagaactcaaaggacatgcaagggtgaattcatcgttggggcttcagccccagctcccctcgatgaaccccaggtgcccctagctcctcagaggtagtagaggaaagggtgtgtagtagcagtagcaaccagaggaggaagactattatctgttggttgggttgtgacaatcctgcgtaataggtgtgttgacagaaaacacatggcctgggagatctgcttaactccagtgcaggtcgaaagctcgccttcggatgtattagcgtgccagttgatttgatcctgtaatcaacaagaaatagaagcaaagaaaccgtggttaaatctataaatgatagccgatcggctagatgccgatgacatatcacttatctttgggccgatgtcatctgtgtatcgatcggcagtcatgaataagtaaagaagaactaaatctactcgaccggctgtagatataaatgatatatactcctcatatcgatatatacttaaatcaagtgattgggatagatcggttatcatgccgagacagtataaatcacttagatcgaaacatatatcaataacaggactatatatgtttatagcatagccgatcagatagatctagcatgtatcggctaatactctgatactactccatatcaggatattaaagcaagaataatatatcaaacaaaggcctaacatgtttagatacggcaatatcttgatataaagggcagatttaacatatcagtatagcatatagaacaaatatagttaaatcagatacgatcggctgaaactccgatgctattctaatcggcaactagaaggcaggctagatatcgatattctaagcacgacttaatagatcaaactcaactgatatagtattaagtatgaaaagaagagtgatatctagacaatcaagctgctagaagtttcatagaatggtagatatcttatataatctagaccaacatcaagatctaacctaatcggctgccttctgcattcagatattggccgatagtagattagatgacgatgttgctagagattatgtaagatatatgataactcgacgaattatataaacaagattagagtgtcataaagatggaaacactaatcctaagaacgcaattcgtcataacgaattttacctcttgttgaagatcgaaatcgatgcagctcaacccgaaaacatgaactcgtcaaaacaaaactaaagcaaaaagggtggcgatgtgccaagattgtattgaacgtgtgtgttcaaaaattacataaagctcggggtctatttatacccgagaattacaagatatgcccataccggacacgaccattatctctaacaaactctaagatactataagtctttgcggcagacttttgcccacatttatctataaggaatttacataagatatcctaattaatagatacaattgccttcccaggactctatccgtgcgtggcaatcatcttgaaatacactaacttgaacccgatgtcgcatacaagttgtattgtcggaatcggctatatcggcttatttagcccgactcagacccagccgatcctaaccgtagccgatctggattccagccgattcctgctctgcttccgaactcgatctccgcctccaacttcgctttgatcaagtcctctttcccgacacagatgttaccaaatttggttgttaacacatgccccccaagtccgggatattcgataatgttccggatttgccgtatgccgactccgagcgagttttgcactccgccgcttttgaccgttattccagcgctttaaatactaaccgttacccccgagaaatctcacaccgtgacttccgttttcaccgctcaagcgaaaccttttctctctcttctccggcgattcctccggtgcaaaggtgattcctaggcgacctcctcttcgacgagatctccgcccgcggccatgtcgtcctccgccagcccatctggtgcaccaacagccgagtacgctgaggtaagttctcattggctaaatccccttctttagcagcagatcgatcttctcttatctcatattgcttttcctcttttggttgcttcaaatttgtagcatctttctcaccaagtcgcaattcccagtctgacgcatgaaaattactactttcttggcccaatcggcaatcctgaccccaccgagttcattgttggtgaaaccaatagaatcccctttagactaaccaacccagatctaggtcactggaagaatactttcaaatcttggccatctctagagaaagttctaccagaaaagagctggaccacatggttcaaacgtgtgttagccagcaagagggttcactgggatgaaattggaatcggccaagcacttgaccttactatagcaaactcagccaaggatgaacccctaatggcagctgcttcttacttctggtcaaacactactaatgccttcctgttcaatcaagggcctatgactccaaccctcatagatatcagtatgatcacaggtctggatgtcacctcatcagccaaccctatgagtttgaacacaaagaaccaatatgacttcaaaaccaaaagcgtaggaggttggtcaggctatgtggcagcatacatgggccagggttcggtcactcctcgagaacatgtggcctttctattaatgtggctagaaaaatttcttttctgtggatcaagttgcggccccacaaccaactggcaatttctggctgaagctctagaaacaaagagacaattccccttgggcaaaattctcctcggctatctataccatatgttgagcaatgcatcggctaagatagcagttggctcagtagttggagcaggtggaccctggtggctgctacaaacctggttaaacctgatagtcatgaaggttgtcaatcggccatccgtactagaagccgagttcccaagactagagccgattgtaggggatgatggagaagagcgtactcatcggagatgcacatcatacggagaatacgcttctacaccaactgatgccggggcaaaactatcggctgaactgctcaaggattggttttgtagcttctatgaaggctttcaaaaagatgctagaatctggttcctttatgaagactctgcacaacttgagcacccagtggatttcagattcgaagacatcaaccatgaagtataccaatcatccagggaaatcttctcggctgcaatcagtccatgcatccttcctgttggcattcatcaaggaagaaacatccaagcttcctatgaattctatcatccaatgagctcagctagacaactcggaatgggccaactcccaatcggcttattctttgctgacaagatccaatgccgaggagggatttcatcaaccctaatgatcgattggctacttagccttcaaggaccccctctgggcagtattgacaacatagaactggcaacattcagaagcaaaagctttgacaggtggtggggtaaatggaaactgcatttattccatcaaccagcttcaatgtatatgacatacctctttccagatgttgtccctcaagtaagtcttcaactttgctcaactctagttaaataactgttcagccaattaatctcaactaatcgtccttttgatttgcagacaacagagtcttcccctcctcatcaaagcaacagtggcaaagacatccgatatgccccaggtttaattcctaacggaggtaggctatctcctccagttattggctatgacgcccccaggacatcagctcttcttcaagggctcgtcaaagaaccagccgatgccggcaaaaagaggaaaaccagatcgtcggctgtaagcatcgtagccctaattaagaagaagaagaagacaaagaaaaccaagccagctaatgatctgcctaccctagatccatccgtcaaacaagctttggatgaagaggtaattgaagatgaggttgatcaggccgcagccgaggtaagtgatactgaaagaacaccatcggcttcgcctaagcaaacctctccgactccttctgctccggttcacttctcaagggtaagtgtttcttgttaatccctttcgttattattttgtcttatagccgatcattcccaagtcttataattgcagaaaaagaagactgcggtgaagaagaaatcggctgcaacaacatctaaaccaggtccactagtaagatagttttaacttttcattagttaattttttacccgattctatctggcacttgtttcctttctgccttcacctcctcctcctcctcctgttcaacaatcatcaagtgatcagaccccttcagcggcgggaagtcatcacgtcgaggaagaagaacaaccagctgctcctgctatcccagtaagtttcttttatcataacaagcattcaaatcggctataatcgtttaacctctaatctgcttctaaattgtcactgcaggtgttagctgatcttttctcttttgacatcagagactatcttgatgaaggagaagaagataccacaagcaaagccttggctcctttatctgatgatgtgaagaaaactctaggaagcattttagatcggctagaagcatcatcgctagacagcttggtggttgattgtggctcaattagggctcggctacacgagattcaggctttaatcccagatgagttagccgatatccttactccagccgtttaccttgagcaacaccaattcaaactggagaaagccaagttaagactagccgaacggcgagaacgtaaggacattgaggccactatccaagctagccgacaacttgtacatgaagagaagtccaagcttgatcaattatctgaaggcccaatcaagtctaacattgatcggcttgaggctcgcaagattgaactcttagcacaacttgaagaatgtaacgctgagctagatatggaacacaagaaactagccgatctccccaaattcattgaagaacagaaagtaagactcaaatcggctatcaagcatgttgttgagctgactaagtccctaaaagttatccctggaaccgatgctcaagatgcccaagccatagaagaagtagagtagattaggcaaaaggctatatcggctatccagcgatacttatctcaataatctttgtgtaataggacttagaattgaaatttgctaaaaaattttgcactgtatttaccgcattttgatatatatatgccccccctagttttacaatgtgaagagtattgataaaattataaaacaactaagggcgatataacaatatcggccattgtacatcggcaaaccacaaccgattacaccatgaaaaacaactaagggcgatataacaatattggccattgtacatcggcaaaccacaaccgattacaccatgaaaaacaactaagggcgacataacaatatcggccattgtacatcggcaaatcacaaccgattacaccatgaaaaacaactaagggcgatataacaatattggccattgtatatcggcaaaccacaaccgattacaccatgaaaaacaactaagggcgacataacaatatcggccattgtacatcggcaaaccacaaccgattacaccatgaaaaacaactaagggcgatataacaatattggccattgtacatcggcaaaccacaaccgattacaccatgaaaaacaactaagggcgacataacaatatcggccattgtacatcggcaaaccacaaccgattacaccatgaaaaacaactaagggcgatataacaatattggccattgtacatcggcaaaccacaaccgattacaccatgaaaaacaactaagggcgacataacaatgtcggccattgtacatcggcaaaccacaaccgattacaccatgaaaaacaactaaggacgatacaacagtatcggccatcttaaggtgatgtaaacacatcggctgtcatgcatcggcaatagtagccgatcatgcgttaacccaaacacttgggtaatatttcttcaaatatttgccattgagcgctcgctcataaacttcaccgtcatgtccttgcaacatatatgctcccttagacacaaccttatgaatttggaacggtccttcccaattcggcgaccacttgccgaatttactatcacgagtaccaatcggcaaaatcagcttccatacaagttctccttccgaaaaatctttaggtaccactttcttattataatgccgagcaacacgttccttatccctagtaaccttcgcaagggctcgcaatcgtgactgaaccaaatcctccctttcgtcagccataagattgtaatactcattggctgttaaatcgttttgcaactccgtttgtcgagagccgattctaacttcccatggcaaaacagcctcatgaccataaacaagtttgtaagggggaacttgaatctatccatgataagccatcctataagaccataatgcttcggccaatcgagtatgccattgccgaggataatcagaaattttccgctcgatcaacttaataaaactcttattagacgcctcggcttgcccattagcttgtgcataataaggtgaagaattcaacaacttgatacccactctatcagcaaactgaacaaactcatcggacacgaagattgaaccttgatctgtagtaatagtttgaggaagaccaaatcggtagattatgtgtttctgaacaaattgaatagcatccccagaatcaactttcttcaaaggaatcgcctctacccacttggtgaaataatcagttgccaccaatataaatttatgccctttactcgatgttgggtttatcattccgatcatatcaattccccaacctctgaacggccacggtttaataatatggttcatagctgacgccggtgctcgctgaattgctccgaacttctgacaatcttgacatcccttgcaatatctgaaacaatcctctagcattgtcggccaaaagtaccctgcacgccgaagcaaccacttcatcttgtgagccgattgatgagtaccatagatcccttcgtgaacttcgccgattgcaaccttagcctgatcggcactcaagcacttaagtaataccccatcaatcgtccgataataaagctcatcattcaatagtgtatactttaatgccttatatcttaatttcctagaagccgattgagatggattacttaaatactgatgcacatcatacctccaatcatcggctgacactgctgcaatttcaactttaacatctttgatcatcggcttataccccgatgccccttgggccaaatcattagcttcaagatattgttctcgagatacatgcttcaaagtaaccagtcgaaaccctttcattagttccaggcacttctcattataaaccatcaatgtatcgttcttgcattcatattcccctgccaattggctgattactagcaaggaatcccccatgatttcaatggtatcggctacaacttccttgagtaattgcaaccccttgagcactgcttcatactcagcctgattattggtcgcatatggtttaatagtataagcaaactcgaaacatgcccccctaggggaaattataactaagccgatgccacaaccatgagtgcataccgatccatcaaagaataaagtccatggtactatctcaaccgagccgattgaatcatcacgatgttctacaataaaatcggctatagcttgtcccttaatcgcttttggcgattcataccgaagatcaaactcagtcaaggaaaatatccactttccaactcgtccctttaatattggagccgacagcatgtacctgactacatcggctttgcatataacggtgcactcgttagataatagataatgccttaacctcgtacacgaaaaatacagacacaagcataacttctccacaggagaatatggagtctcagcatccaagagccgtcgagtgagataaaacacaactcgcaccttcccttccaattcttgaatcaaaactgagccgattgacttctcaccagccgataaatataacctaaacggtattcctttctgtggaggaatcaatacaggaagagagctgagatactccttgatattatccaaagccttttgctgctctgccccccaagtgaattgctgatcggcttttaatctcaataaggttgtaaaaggttccaaccttccggacaaattagaaataaaccttctcacaaaatttatcttgtcgatcatctcctatagttccgtcttattttccgagggctgaattttcttgatcgcattaacgctcctttgggtcacctcgatcccactttcatgaacaataaatcccaaaaactggccagccgacacaccaaaagcacattttgtcggattcatcttcaagccatattttctggttctctcaaaaaccttccttaaatcggctatgtggtcctctacttctttagatttaacaaccacatcgtcaatatagacttcaaccaaccagctgattaaatcatgatatatataattcatggccctttgatatgttgctccagcactcttcaagccgaaagtcatgacgacccattcaaacaagccgattgcaccgggacatctaaaagctgtcttatggatatcttcctcagccataaagatctgattatatcctgcgttcccatccataaaactcaaaattttgttccctgatgcgacatcaaccagctgatcggctactggcattggatattcgtcctttggtgtagctttatttagatctcgaaaatcaatgcataccctgaccttgccattctttttaataactggaactatgctagagacccattcggcatatcggcagggacgaatgaaaccagcatcatacaatcgtttaatctcggctttaacaggctcgagcatatcggctttacatctcctcggaggttgctggcgtggtctaacccctggcttgataggtagccgatgttcaacaatcgatcggctgagttcgggcatctcatagtattcccaagcgaagcaatctctaaactcttttaagagctctatcagcttggttctaaactctggagacaaatttttgctaataaatgtcggccttggccgatcgcctggacctatgtctatttcttccaaatcatcggccgacataaaaccctgaccttgcttgtcatcgagatcatctactgtatccttagcatagacattcgaaccctccacgacgctctcaaagtaatagcttgggttctccatcttcgattggctgtatatcagaatcggacacttttagaacatctccatcccagacttttccagataaacaatcaaggccatccatctcccaaagggctaaatcggcactagcaacattaactgacctgtcggctggcacaatctctatcttgtcgccttgccattgaatcaagcattgatgcatagtcgaagggatgcaacagttggcgtgaatccaatcccttccaagcaacaagctgtacgaacccttcccatcgatgacaaaaaacgtggtaggaatagtcttgctgctgactgtcagctccacatttagaacactcttggtctctgatggattaccaccaaagtctttgagcaccatatttgttttgatgagatcctcggcattcctacccagctttctgaatgtggcataaggcatcaaattcaccgcggccccaccatcgaccatcatcttagacatcggcttcccattgacgtagccatttatatacaatggcttaagatgccgattctctgtcccctcgggtttctcgaaaactgcatgttttggtgacaggaccca

SEQ ID NO: 94684 - DNA, 673 bp, Oryza sativa
ctgcagaaattgaagaagctatcaccacagattatgaatatcagctggttttccaaaacaagatcacaaggatttttatcagcaaatattacaaccaaagttatgaatacttcaagggagcagggcgcataattaaaccggattttggaaatgaatgctccaagaaaagttactacagaagcctggctcagtgatttcagaaatcagagccgtcagagattgacacggtgcaatcagcacccacgataatcaacgaagataatgaataaagatcttgtcatccccgacaaagatcactattcaagataaggaatctacactattccagataagataagtccatagtcaaaaagcgatattatgacatctttattaaaggtctaaagcgttatcaccaaagattctctccatgaagtctaaaggggtatcataaactctttaaggtcaagaagagatatcatgaagattctctaccgagcgctatataaggggctcaccatcacatttcacaggcatcgcatttcacacacaacacatctcactcaaccattcctctcacctctccaccagccatcacactccactccactccaactaagtgttagtactatagtagaacctaaataaaagactcatgagagtctaagtgtgagagtctatgtaagagtccttg

SEQ ID NO: 94685 - DNA, 675 bp, Oryza sativa
ataagatgtcttggttggttagatcacgaatagccactgatcgatctatagcctcgtgcagtagcgagaagtctgttggcactatgtcggtaaagaatgcttcatctatatcttttgaggatattgagaaaagtatttccaattggaagattcctaaggttaatattaaggaaatatatcatgtaggtactttttcgttacttagtgactactatattaaaacaattgaaaaaactattccaattagttctttgcatgaaaccctgcatcttctttctgaaagagaaatcaattctataagagctaaacatcaatatcactaccttcactttggtcttatacaagttgctatcagatccttgactagaaagggtttgaacgtctctgttctggcttgtctaagagattgcagaaataaaaggttcaaagattccttatatctctaattttaatgaagataagattcccactaaagcaaggcccattcagatgaatagtcgactttaagaaatttgcaagcaagaaataaaaaacctgctagataaaagcttaataaggaaacgttcctctcctttgagttgtgcagccctctatgtagaaaatgctgctgaaaaagaacgaggagttcctcggctagttattaattacaaacccctcaataaagttctacaatgg

SEQ ID NO: 94686 - DNA, 678 bp, Oryza sativa
gctcggtaccctggtgcttactcgcagcaacgggaatggccccaaccccaacaacaacaacaacaatgcagagaatcccacgcttgctcaagtcctggctcaacaggcacagcttatgaatctgatgatgcagcaactccagaaccagcagaaccagggaaacaaccatgcacctcccccgaataagctggcagaatttcttcgcgtgaggccgcctactttctctagcaccaccaatcctgttgaagctggtgattgcctgcacgccatagagaagaagttggacctgcttcagtgcacagatcaagagaaggtttcttttgcttcacaccagctgcatggccctgcctctgagtggtgggatcacttccgtctcaacaggactactgctgaacctatctcttggcttgagttcaccgctgctttccggaagacgcacataccatcgggagtggtgtctctcaagaagaaggagttcagggcgctcattcagggatctcgctctgtcaccgaatacttgcatgaattcaatcgtctggcccgttgtgctccagaagatgtgcgcactgatgaagagcgtcaggagaagttcttcgaaggtctgaatgatgagctttcttacccattaatgactggggattatcatgatttccagaagttagtggataaggctattcg

SEQ ID NO: 94687 - DNA, 834 bp, Oryza sativa
gagctaaccgtatcccgcctcggggggcttgacccccgttccctcacctcctccctcctctcgctccggcgagcaggccacctcgacaccgccgccgacctcctcaaacaggctgccacttcttgtcctgactccgtcacgcctctctcggcgtctgtcgtcgtcgacggatactgcaagtctggccgcgtcgcccacgcccgccagctgctcgacgaaatgcctcgacacggcgtgaaggttaacgccttgtgctataactcgctgctagacgcatacacgcgcgaaaaagatgatgatcgggtggcagagatgctaaaggtaatggaaaatgaaggcattgagccaacagtcgggacatatacaatcctcgtcgatggtttatcggcagccagagatatcaccaaggttgaggctgtgtttgaagagatgaagagtaagaatctctcaggggatgtctacttctattcttcagtcatcaacgcatactgccgtgcagggaatgtgcggagggcatcggaggtgtttgatgaatgtgttgggaatggcattgagccaaacgagcatacgtatggagcattgatcaatgggttctgcaagattgggcagatggaggctgcagagatgttggtgacagatatgcaagttcgaggggtgggaattaaccaaattgttttcaatacaatgattgatgggtattgtcggaaaaatatggtggacaaggctcttgaaataaagatgatcatggagaagatgggcatcgagctggatgtgtatacatacaacacactagcatgtggcctccgcagggcgaatagaatggatgaggccaag

SEQ ID NO: 94688 - DNA, 2284 bp, Oryza sativa
aagggtgtcaggccaaaccatgtaagctacactacgttgatcagcatccattgcaatgaaggtgacatggtcgaggcaagaaggctgtttcgagagatggcaggaaatggggcagaacctagtctggtaacctacaatgttatgatggatgggtacatcaagaaggggagcatacgggaggctgagaggttcaaaaatgagatggaaaagaaagggcttgttccagacatatactcttatgcagcgttagtccatgggcactgtgtcaatgggaaggtggatgtggcattgaggctgtttgaagagatgaagcagagggggtctaaacccaacttggtggcatatactgctctgatatccggcctggccaaggaaggaagatcagaggaggcattccagttgtacgacaatatgctgggagatggattgaccccagatgatgctctgtattctgcacttgtagggagccttcacacggataaaaagcaaaatgttaaaccacgaacaaattaagctctttggggcggcagtgtaagtcgtgccagctgaactgaataccaggatgaagtactcagcttctcatacatgataatggtggatctgataagttgtctctcagcagaaacgcagctgtgtgcggaacgcacagtgattataaatggattgttcagctcagtttggcacttaaccatctagatctacatgattcagagcatgtgcgtgtgtacaacttggctatgcagagctcttttaataatagagagtacatggaattgttacaactcaagcaattctcactacggcaaatatatgtttttgtttgtacaacagtacttcagtttgctggtactgatatacaaacatgcagtaggaaacttgcaagtatgcattcgagtttggcacatgtattttccaaaactcaacttcatatagttacggagcattttcgtgcaatacattgaatggaaccaaccgtctgtatggagcaccaattcatgcttccattgcagtttgtttttccatatgagcatcggtatcaaactcctgtgctggttctcgaggctgcggggcttggtttgtgtcttcgttgctctacaacagaagccaagtcattgcagattcaggactggcagcaatagctcagtatagcacatcgcacaggtactatttctatgaaacaaacataaagatggcattaaccttctctatatctgcaaactgagtctgtaaagtgcccttttcctcctgaattgcatacctgatttccttcatttcctagaatcatatgccagaaccatgagcagtacgacctaagaatcagaacaaacaaagcaagaatatgaaagagaaagagagagaccgatttcagcagctccacttcagaatttagccccttcttcagctccaaaagttcctgcatgagttgccatcacctgctataagatggtcccgtacgttttgcttcaggaaagcaggagtctttcttcagttctgtacagagagatgatgaaacagtactcacattctggcttgtcttgacctgtgtctcgaggttggagcgccagttctgcacctcctgcaaaagcacttctgctgctcattctccatcattttgccatcaagacagagaaattctccaataatccaattctattcccaatcacagcagcaacagaggcaaagaatttcgcagtacaattcataccagtttgagcttctggatcctgtccagcaactccccctgcgacgaggtcagctcctgcaatcgaaacgagacacaggataaaatcagccgaaaatctcaacgccaagaaccaacgccgccgcccaggaattcaccacaccttgatgcgcgcgtccaactgctcgaaccccgccaatctctacagatcaacaagaacaagcatgcataattgcatatcagcagaaattgaactctgaacacaaaaacacccagggattctgaattcagctgtcaactgcatgtacttaccggaggagtcgccggcgccggcgccggtgccgttagaggtggtggctccgccatcgatcagcaggagacaggtagaattgggccagatcaagcgtgagttgtatggctttattctgtacaattgtactgtacctcacctagaagaggacatttttcagatgcaagcaaaccagtcgtcgatcgggttggtggatggatgcagaggggtaaatctctcgcctgcaaaatcgcaaatgcgacgtgagaaaacgccctgtcagctggtggttgcagaacacttgtctcccggct

SEQ ID NO: 94689 - DNA, 620 bp, Oryza sativa
accataataaatatgtagatgcagtggtaagttcacatacaggaaaacaaaataaaactacaaacccctgcactgcagatatttggaaatgtagtaactcgcaaatacatgtccttcaactgacatatgtcttgcccaggtctttacaggtacagggttggtgatgtgcttcaagtgacaggcttctacaaccgagctccgcagttcaaattcatttgccggagaaatgttatcctcagcatcgattctgacaagaccaacgaggaggatctccacaacagtgtcaccactgctaagaaaatcctggagaaccaaaattacctcctcctggagtacactagctacactgatatttccactgtccctggccactacgtgctgttctgggagatcaagtccacccacgatgaaaggccggcccctcttgacgctcaacctctcgagagctgctgtgctgctgtcgaggagtcactggactacgtctaccgtcggtgcagagcccatgacaggtccatagggcctctggagatacggcttgttgaagctggggcatttgatgctctgatggatctattggttagccatggcagcttcattaaacagtacaagacacccagatg

SEQ ID NO: 94690 - DNA, 10482 bp, Oryza sativa
ttatattgatagagtagaaaaaaaatacaagattacaaccttggaaggtcgtaaccaggaaaacgaagaaaaaaataaccccacccaagcattgacaactccaacacacaatcctactaggagaaagcgcactggaccgaccgccgctagaccaacaaagggacaatagttaggatcacccaaaacccaaccctaacaaacggatacaaatctgcactctatccacaactatttctcgtgttttcttgatcgggcatgtgtgtcgttaacattgtgattgcatgcagaagcttgcattcggcaagtgggaagggtacaaatggagcagcggcgagaggcaacgagacgctgccgccggtgcaggagcaggaggggcgtggttcacggtgacgcggccgtgcagcagcatcctgttccagcggaggcgccggccgtcgtcgacgtgcgagttccggagcggcggcggcggcggcgacgacggcgggcgcgccatgcggtacaagatggacgactgcagcggcggcggcggcggcggaggtaagcagcaggcgtggtgcaggatcgtcgacggcgccaccggcgccgtggtggcggaggtgaaggggaagacgacggcgggcggcgtggcgctgggagacgacgtgctgacgctgacggtggagcccaacgtcgaccacgcgctcatcatggggatggtgctcgtctacggcctcatgaaccacaccatgtgaaattgtgaatgcgatgtgatcgatcgagcttgatgaattgctgcggtgaagatcgaagcaaatgaaaattgaagcatagagagacgcgcgtgataggatttcttcctcttttgttctggtgtacatgtatgtgtacttcggttgaggaaattttggtgaaattaataatacaggtttagttttgggatttttgagctggtgctttctttaggagatcgtttgagggctgagggagtcgggaaccaacccaaccaaactgacatagaaccaagacaagttgttagcaagtgaagactgatctctgagtaatttcttagtcggaacaccgctctttgatcgatcacctattttctttcttttgtggaaggcttacggtctaacagcacatcaccgatctgcattcaaatttttctagtaatattcgggcacagaagtttctttagtaatcggccaagaattcggacaagatagttcgggcactattttatcgcttaagattggccggttatgattttctcatttaggagttgatcttcggacaagatagttcgtgcactattttatcgcttaagattggcaggttacaaccgattttctcatttaggagttgatcccttaaaaaaaaacaaatctagaattgaatgcctggatctagaattgaacctgcagcactgaagcattaattcattgaacaaagcaaatgcactattttgcacgctgccatgaaaaccaggtaccacggaatgaagaaaaagaaacatggataaacggtatataccaattgaactgcagagatacgagcatcaattgattaaatgaattgcactggctgtcgacataaatcaaccgatctgatggtcaggcttacaggcttgatagttcaagttccaaaccggtttttctacgctacacttcggcctaacgaacttacagttgacatgaatagagagatcaacgactaatttgactgggtatcacctatacatgaacaacaacagaagagctatttcttgtctatctcccggaccgctttacgctaatgcttatgttgtatgtacataggctagcgataggctacatgaagtagcttagagaagtcttcttcctggacccgccttctccatatagatcgttccactgaataagctcagtcatatttctcgaatcagatgttatacttgcacatacctatacataaagtagtttatgttagcatcatatttttatataagtaatttagagactacaaaacatctgatgaccatgtagacatgaacatatgagttctttcttttctcctgacacaccactagggctgtaggcagcaattatacgtaatgtttgagatggaaatgaaaaccatcgatacgtttattagaaattgcgagttttgagacatcagatcttgtagtagcctgagtctctttttgtttttcccttttcctcattttcttttcctgaaaaaggaaagaagtggcagtaacattacctgctcatgtgcatgtttgaaatcgttcattcttagggaacgaacatcactgctagaacgagggggaggtaatggtttattttctgcttctgctgatgctctctcctgcaggtagacaaaaaatggtgaactgagttcatcgtataacagtaacaataacaaccgacaactaattgttcatcatattaatatatcaatgatgttctgtagacagggcatgcaatgatattatacacagtttttcagtggataaaagagcagttccacagtattgactatattttcactaggatgaaatagaccagaaacattcactcagtagatttttttttcttcaataacttggtagaaattgagaaggcacaatctcgacaaatcaaactaaccttcttctctctttcaaggatctcccttatggggcaatgtgcagcagttacacacagattctgaaaagtagttgccatcatgaacaaaaggaaaataaaatcattgttttatttcaacaaaatgaaatcaaataagaataaagagtcttcacataaagcaaaaataccttcatatcactgcctgaataaccatcagtcaagttagccagagcttccagatctacatcatcagccaaatcttctttggccagtattacgctaagaatcttttttctattggatgcatctggcaaattcaccatcaacctaaattgatatgtgatcaggcaagcaaccattagcatttcattgtaaaaataaaaggaataccacagcgatgtaaaaaaagttacctcctggggagcctcctaacaacagcttcatcaagatcaaatggtctattggtggcagcaagtactaatacgcgttctttatcttttgttctcagaccatcccaatttaccataaactcatttttcatcttgcgcatagcttcatgttcccctgggttctcccttctacccagcatgccatcaacctacaaaaacgaatggatagaaagtaagaaactcaacaggataaaccaaaatcatgctagcctgctgaatcataggcaatataaaaaagagtgattcacagctttcactttggagtttggacaaccctttaaccaatcttttcactttggactaggtaactttgcctttgttgcaatttggttagagaagagagttggggtggtcaaaagtgcaacaaatgtaaaattaccagtccaaagtgagaagattaggtatatggtggtccaaactgaaacattggtaatataaaaggtgggccaaacgacaattcattccaaaaaaaatgaccataagaattttgttgactgacctcatccacaaaaatgacactaggagcaattttgcttgcaagtgaaaacacagctttgacatatttctcaccctcgccaaaccactgtcagaatcagatatcagcaaaaggagtattcaagatgtgaacaatctggaactctgcatagctctataaagggagtacctttgaagcaatactagacattgatatgttgataaaattggcgccagcctctgttgcaacagctttagcaagcatggtcttccccgtaccaggtgggccaaaaagcaatattcccttacatggctggtgaataaatggtgatcagaactatgtttgtgaaacaagtggaaaaaagaaacaagagaccaaataaaaaaaacagaccatgataattagcatgctacatttagtttgcagggttttttttaaagggttagggggcacatgaatcaataattgatgcgtggggagcctactaggctacatgatacaaaatactcccaacatgaaagctggaataaaaattagtgctaatggaaaaaatagttgaatctcaaaagcacagaacagtagagttaatgggcaaacaatagaatcacaaggcaacagagttaatggtcaaagcatagctggacagaaggccactgctctacattaagtacccactcagcaagcccgcatggatatataagcgaagcaggagatatttacttgaaaggggtaaacagaaaaatcagaacatcaaatttctacaagtgatacggaagactgaagaaagatcacacagagtgcagaggaactgaagggtactaaataaaagttatgaagcttgagctaccttcataagttgtcctttggagaacaattcgggcctttgcaacggaagcatcactagttccttcaaagtttccttgacattttctagtgctccaatgtcctcaaaggtaacacctatctcatctggagggatcacatcaccaagaagccgtttttcgaattcattctctgtcgttacatcctaaaaataacagtgggtgtatgtaagctgtaagcacagttaacatgaatagccccaaagcccaaaaatcatgtcattactgtttgcttgcaaaactctagaacagtcaggatacaaacaagaagttgggccaggctgccagttgccagtctagtcataacatatatttggcgatctaaacggttaaagaatagaagttaccttaagtgatttttttgtgctcttctttttagggtcactttgcatgctatccaacagctcaactccatgcttaaggctgcaaatatagaaattttcagtaaagcagacatgagatagaccagaagttaatctttcttacacaacaatgtaaaatattacagggttagagagcatacctttcaccagaaagggcaagtaatccatcattttcacgagttgggattgtgctatgtttaaattgatgactcaaagcataaccaacgactttatcgacgcctgaaaacaaaacagagcaaaataagaaaataagaagagcagatcaattatgccacagaacaaaattatgcaggattacaaatgtaggactgtactcacattcatttgtaaggattcgatctttaacacatgctgatgtctctatgtcagcacattccagaccattgcgggttaagaactacatccagttgcagaaatacatacaatggaatcagaaatattaagtaagaaacagcataaggagttggcaggtgtgaaattattttcactttttcagttatcaagtgaatctcgtgtcatagatatgcaacatgcatgattcttaaaccaagggggcttgtaaccaaacaattatctggaaattgaagggtacatacatggtagcacttttgaaaagcctttacggatcaaatataatttcagtattaaacacacctggacccgtaaggccataaacataacagaataacaataactaaacagacagctaattaaatatacatatatatgtacaaagttgtctacaccatcgatacttaccgactggatctttgacgtgttagcttttgccttcagaatttcaacatcacggtctaatagctgtttccactgtgagagttccaattcatcctgtatttctcagagttaaaacttgaaagaggcagtgcctgaaagtaaatgtcgccctataataacacaaatgacacacctgcggtgtttgtattgtcactttatttgggaagagtttagtcagatgcttcgctatcttcagagcctctttgtttttatcattcacccgaccaaagctatcctgcattaattcatcagattgtaacaagtggagttcaatcacaataattcagataagaaataacctgtacttcaacaatgaaaaggaagttgagaatgctgtgttactagtaactagtgaccattgcaataaggaacatcagacatcttctgcatactgttataactattatatcctaagttaaccatggggtaaccaaagaaattcacaagaatatgagcacaactgtagaagaacaggatttggcttaatgtacacaaacatcaattgcaagatacttcagtaaaactagaaaaacacacctggaaggtgaggtcgagtattgcttggctgtatgggaattttgaaaggaaaggagagccactgtttgactgtatgaaaaaaaaattgttagctagatggaaacaagtaaaattatactagttataatgattcttacaagcagcagtaccttgtctttccgactgtcagtatggatctgggacccaacaataaaaacaccagctgggaaactttcaatcttattctttaagccatgataggagtaactgtttccacacattttctcaacatccttcaaaaatagtatcagaggaccatgctgactttcttcggaagcaaactgtagaaagaaccagtaagtaaaaagagaagaattggaacaccaacaaacatagccaaaaaggactgcacacacctcgtatattacatcaaatggatgtttagctctatcttcccatcctgggccatcgaggcaaagagaatcaactggagatacaaggaaacataaacaagtgaatttcaaatttacattatatcaaatatagtaataaatgccaaattacagaatctatgtatgatataggtataaattatttaaggcataggagcacaagagcaaacaggctcacctggacaaaagaaaccacggtcaacctcgcaattgcctccaagatcaatgccaccaggaatctttttatcaaatctgactccaactttcgaggattcattttcctcaaaaggaagcctaacttcaccttgtgagccataatctggagctctgcagatcgtatcatttggcataaaccgatcagcggatgcagatgatgacaccaaaagattgtttacaggaaaaaaggccccgaggtgattgcaagtaaaagatgcaaatggtaacattaagatggcatttgtaaacaaagggagataacagataattcagggaaaaaaacacgtagttcacccctcacacaccatcattgatcacatgccggactgatgatccgaaactaaaaccaatcagggtcgtttgttaaaaaaaaaaagagcctgcggcatatcaataccaactatataacctaagaatatacagtaagttcattataatatcacatgcaatgttcacaaaaaaaatggagctagagattattgtcatgattactacgtaagatctgcttttctgggtacgtttggaacacaaaattgccacaagaactgaaataacagtgacgtcgcttgaatacttcagaaagcttatgtttatgcaagacataacctactgggaaccatttattgtagcaccctttaaaaatgtttccagattagcactacagtagtaacttgtctatctaaactcctcactcttttggtactgtcacatgacaaaatgtactttaggtgaacacagaaatggaaactgcttcccataatgaggcaccgatttcaacagagaacattagaaagccaataatctatcttaatatgcctcacctttgtccctcaaggataatccctgttgattgtactgaaccaatgtatctcaccctatctcctgaaaaaaccatcagaagcattgacgttgtggttttattatcatcataaatattctgaaaaaaggaactacaatctcctgcaaactttactgcacggacaaatttaaggtcaccatactcaactcaatgattttctacttaaactaggcatacatagcgaccaaagcagtcactactcagtgagtctgtgcatataactaatagtacatgcatagtcttaccttttttgtacgactcagattccttcgactttgaagactgtccctgaaaagaaaaatgaaatatatccaagaaccatattaattcaagcaatagtgtatgtccctacatgcttaggcaaacattttgtctataagtatttaagcaggcacagaattatactagaaaaattatatatgcaaaatccaatttacaaatcaacatttaaaaagttatctaaaagatcaacatttaaaaagacaggccataaggaaattcagttattgcgatattagcaaaagctagaacttctggatgtatttgcatacggtagtagcaaggttgataattttgctatgaagttgtggacattatctgaagaatcaagatttgaataaaaattaagcagtgtagcacaaaatactacagcagaatgtaagaggaaatacatcagtatgacttgggtgtgtgttcttgtcagaaaactgtgatggctcatttgaataacatcagcgcacattaaacagtacgcacactttctctagagaaagagaccatggttatggttaagaagcttacactcgccagcaacgaaggatctataatgagcagcttagcaccaaagtgtttggtaagagccttcactaatgattcttggtatatctcagatcctttaaaaatgccaattattttagtcaacaatccatgcatagcattttaaaaaattagtaaatgccagcaacaattttcttttagagtgaaaaatggactctcttaaaaattactaattgagcagttaatttacattcagcgataagcttaccagctggaccagacaataatacccgttggcaaagagaagatatatgttttgtccatttgatggattccttgcaacataagtttacatacgctgaagacaggagagcatttttggtattctcactgcaaaaggttaggtcccattaaaagatagttcttaaccacatgagactaagcactcaacattaactaagaaacaggccgattagtacttcagttataaggtcttattagaacttagaactactcagtgctattgcattatgaccagctatcccattcttcttgccatcacctgtctacttactggctcaaaaatgaatccagaaaagagaggtgcaaccggtgtccatagcaaaagaatacacatataattcaatgtcaagatagagaatgtcatcactgtgaagtaaataaacaacagaaacatacatggataacactatcctagtacttgatgtcattgagagctatagtgaagacataaccagataagactaatggaatgaagtcaaccatatctggtgtcctgctacaccttatgatgttacacaattaaacaaactagggcaaattatccgcatagagatcactcagaattttcagtgataaaagtggcatatacaagagaaaaataaagggcaatataatgcacaatgccaacgatattgaacttaggagattatcctataccttaccgaggctttgcataataaaagcaaaacattggtggatcaagatttatagggactaaatgcaccttttgtgtcatcaaaaaagcaacattcatttatcttacattagcttctctaaattaagttccaaattggcattcatttgcagaccaaattactgcaactttgtaggttaagcagctagcgcatacctcagataatatggaaaactatcaaatgaatctgatatatcacttgcattaacgaccaccttcttcagatcctctttcaacagttgatgttgagcaacctgtaaattttcttcagaagcaagctggctctgttcctccattgttttacataaactgctgactatctctgtatctattgaagttgaaaacaaaataatatgaggcatgtagtttttgtcaaaagtccaagctcatttcaaagtacatgtgcatgcaattcttgtaatcagactattgaactcattcaccttccctctatatgcatttattactaaaatcatgccacggactaagaacttatgtgcaaagcatcaacataggaacattatgttcccatctgcaatttttctgattttataatccctacatccatgtgcctggtccagatatgccttacaaataaatggatggaatacatatactatgagccctcaaaaagtttacagggttaagagggggaacaaaaactgttataaaatagcctcaccatgaggaaccaacggagggcggccatttccaaagttaaagggcattactgatagcttggctcctttagatgatacatccaatgtacctttggtaactggatattgcccttgctgaaaagcacatgtggccgaaaatgttgatgtgcttgatctttcctctggaagttgctgaaatatctgcgaacatgttaaggagcttcatatacaacattaatacttttctgaacaatcaattacattagtggaacagatgccagtacaagcaacacttatgcaagggtagttggtgatgaaaggatacataagcatgtctcccaagtgaactaaaaataacttcatcgcctccaaccaatgtgaccttagcagtcttatctaataccttcccatttacat

SEQ ID NO: 94691 - DNA, 539 bp, Oryza sativa
ccttctcgggcacctcgccctccttcttggcggcgtcgtccttggccggcttcttcgcctcggctttcttctccttctccggcttcttctccgagctctcagtcccagcttccttcgccgcctccttcgccttcttctccgcgcccttcccgcgctccccggccggcgccggagcagcagctggtggcggcgcggcggcgacctcgtcgggcttctgcttcgccgcggcggcgaccggcggcgacggccacaccgtggcgtgcttccctgacttgtgcagccgcctgacgagcacgtcggcgccgacgctgctcgtcaccgtcaccttgtgctgcgccgcgtcgattgtcaccttgtacacgcctgcgcatcaccggaaaaccaatcaatcaccaagaaatcgatcaaatctcaatcaaacctgcgaaaactacacataccttcgatgttctggagcaccttcttgaccttcttcttgcaaccctcgcagtggatcgacactcggagcacggtggtctgcaccaacaagaacagcaaga

SEQ ID NO: 94692 - DNA, 885 bp, Oryza sativa
aaaaaatttagtgtattaatgatatccttgttaggtaaattaagatcttggtgcagtcgacaagtgcaaactcaccaagcaaatcgaacatgtcaagctaatgtcgacacgcatagagtcaaagaggttgcatgaaattgttggtttgtcatcatcgaatacgagagaacaatccccaaagagctccatagcaccgttgttcttcttgcttcttctcaagttcatgtagaaagccatcagctcacagagccatggggattgaagtatttcaatatgcagactctgggcttgagctttgaattcctgcccttgcttcgagtaatgtatctggaaaagagaggcttttagttaatagtcttacataattattaatataaccattgaggaccgtcttaaatccaaagacaagaacaatgatagatacgttaattctaacaaaaatagtcactagaaagattaaatatataaatacaactcaatcatcctctgtgtgtgtgtgtatatatatcctcgaagataccatatgagtatatgacccattgacacctatatagactagcattttgggcttcaccaaactcacatgcttataactaaaagtgtgtgaaatttttgtgttcctctctcaaataatggaatacttatatagttatcttcccccttcgttcggtttccaaaaaaaaatattccccctttgtccttagtaagctttaaatgtttctaatgcctttaagagataaagagaggtgccaagataaagtttaagggcatgccttgcatatttctttaaaatttcctcatggccacggcatttataaatgcataagtaacccaagtctttgccttgctgatcaatgccccatggctcttgggacccttgcttgt

SEQ ID NO: 94693 - DNA, 736 bp, Oryza sativa
gttccctaagaatgaacgatttcaaacatgcacatgagcaggtaatgttactgccacttctttcctttttcaggaaaagaaaatgaggaaaagggaaaaacaaaaagagactcaggctactacaagatctgatgtctcaaaactcgcaatttctaataaacgtatcgatggttttcatttccatctcaaacattacgtataattgctgcctacagccctagtggtgtgtcaggagaaaagaaagaactcatatgttcatgtctacatggtcatcagatgttttgtagtctctaaattacttatataaaaatatgatgctaacataaactactttatgtataggtatgtgcaagtataacatctgattcgagaaatatgactgagcttattcagtggaacgatctatatggagaaggcgggtccaggaagaagacttctctaagctacttcatgtagcctatcgctagcctatgtacatacaacataagcattagcgtaaagcggtccgggagatagacaagaaatagctcttcttgtgtgtgtcatgtataggtgatacccagtcacaatagtcggtgatctctctattcatgtcaactgtaagttcgtaggcccgaagtgtagcgtaaaaaaaaccggtttgaaacttgaactatcaagctggaagcctgaccatcaaatcggttgattaatgtcgacagccagtgcaattcatttaatcaattgatgctcgtat

SEQ ID NO: 94694 - DNA, 595 bp, Oryza sativa
gattctattggccgaagatgattaatgattgcttcaaatattataggggatgtgaggcttgtcaacggttcggcaatgttcaattggtgcctgccaccgtgttgaatcccataatcaaaccatggccgttccgagggtgggctttagatttcgttggtcaaatttatccttcgtcatcaagggggcataggttcgtgctagttgctacggattacttcaccaagtgggccgaagccgtgcctttgaagaatatgactcatacgaaggtaattgactttattttgaagtatattattcatagattcggtattccgcaaacattaactacggaccaaggtgcttttttatgtctaaggaagtgaagagttttaccgaatcttatagtattaaattgttgagttcttctccttactacgctcaggctaatggacaaaccgagtcgagtaataagacattgttgaagctagtaaaaaagaagattgaggaacacccaaagaggtggtatgaggtgctttccgaagcattgtgggctcataggatatctaaacatggtgccactaaagtcactccttttgagttggtttatggtcaagaa

SEQ ID NO: 94695 - DNA, 665 bp, Oryza sativa
ttgttttcactttttgttgtgaaaacagggtagtgcatgactggtttcaacttgccggaaaacttcaaagaaaatccagaagctttcttctggagcgtcaggccgcgagtcgttggtccgcagaaaactctaccgacaaagaaaccagccataccagcgccaccgaccttcaagactatggctaacaagactctccgcgagttcgctgctccctctgctgacaatgtggccattgggctgcagatcaacatggtaggtgtggatttcgacttgaagtccagcctcatcacgatggcgcaggcttagcccattctgtggcaagcctaatgaggatgccaatgctcatctgttacaattcttggagatctgtagcacgtacaccatcaagggcgtcagtcccgacaccgccaggctgcggctgtttccgttctcccttcttgggagagcgaagcagtggttctatgccaaccgtgttgctgtcaatacctgggacaaatgctctatggcattcctctcgaaattcttcccgatgggcaaaaccaatgcccttcgtggaaggatttcaagttttcagcagacaaggaatgagtctattttcggagcatgggaatgtatgtaggagtatgtggcccgctgttctcatcatgggatggacaactggctga

SEQ ID NO: 94696 - DNA, 1918 bp, Oryza sativa
cgggattagtgcttccatctttatgatactctaatcttgtttatgtgataaatcgaattatcatatatcttatataatctccggcaatatcgctatctaacctacaatcggctaacatcgatctgtcagtagaagacagccgactaggttaaataccgatgttgacttagattatataggatatccaccactctatgacacatccaacggcttaattgtctagatattgacttttttttcatacttatagctgcatcagttggatttgatcttatgagtcgtgattagaatctcaatctctagcctgcctttggttgccaattagggtagcatcggggtttcagccgatcttacctgatttgaatatatttatcttatgtgcttgattgacatgttaaatccgccctttatgttaagatctcgtcgtatttaagtatattaagctttctgtttggtatattcgacttgctttaatatctcaatatagaacggtatcggagtattagccgatacatgctagatctatctgatcggctatgttatgaacatatataatcttgttgttaatatatatttcggtctaagtgatttatactgtctcggcatggcgaccaatttatcccaatcacttgatttaagtatatatcgacataaggattatatattgttaatatcaacagctgatcaagtagatttagttctttcttacttattaatgtctgccgatcgatgcatatatgacatcggctcaaagatcaatgatatgtcatcggcatctagccgatcggctatcgtttatagatttaaccgcggtttctttgtctttgtctcttgttgattgcaggatcaaatcaactggcatgctcacacacccaaaggcaagttttggacctgcactggagttaagcagatctcccaggcctcatgtttttacatcaacaattctatactagaataggaagagagtagagtagaagaagttggaagaattccggagttgtcggtaatcttctcctatttcttttattctgtttattactctgaattcaatataatattcttcttgagtaatttagatttatcttgtgagaattatctcttggttagtttctaaatagcatacaggattattgttcactataatcaactaaaacatagtgattgctttggtgagttataaacactaaagtagatattaattgcttagacgtggtgtttaggtaattattatccagtaattgatgcgtgtcccacagtacgttgaggtaggtgtagaggtggtgacagccctcgagatcacttaagtccttcctgtccgggtacgtagtagagcgacatctgggaacagcgggttgccagtgcctgaagtattgtgttaggattaaagttaagctttccctagacactaattctcactagtaaatcctctctatccaagcctatcctttgcttggtgtccatggatgaaccggaggaagatctgaccatacacgttcccttggattcgatacccttgtaatactccataggggaagtgctacattggtatatccgtgcgcttgcgcattttatctgtaatcgtattaaataccaacagtggtcgaagtggagccacccaagacagacagcctggtgaaattcatgcaaattttcctggagaaggaaacatcgatgcccaggaaccgttattggaagacgccggtaaaaccacccatatcgccaagaagttagagcagccggctcagaagaagccgccgtccgcaccaaagccaaggaaggtgtggagggaaaagccaaagacgcccgctccatcacctccagagacgggtggaaaatctacgaactgaatcagaaggaggtacggtcttgcacgtcggactttaaatgacgcgaccttcgccaacaggtaaattggtat

SEQ ID NO: 94697 - DNA, 2898 bp, Oryza sativa
  unsure (1)..(2898): unsure at all n locations
ttaggcagaggcatgatgagcctgtgcaggcctacattcagaggagatgaggaataagtgttacagcttgagcttgactgatgcccagttaaccaatttggctttttagggtatgatagctccgatcaggagaaattctcatcccaggactttgatattttgtcacgtcttgcacagaaggtaaccttgcatgaacaaaggtttgcagaagcccggaagaactttanaaaggttaatcatgtctgtccctacatggatccgatgatgatgatgatgatgattctgaggtagcagcagccgagtgggttaggagtaagaaggttataccatgccaatgggtgaagagttctagaaaagaagagaggtatgacttcgacatcaccaaggctgataagatctttgatttgttactttgggaaaaacagattcaacttcctgctggtcatacaattccatcggctgaggagctagcaaagaggaggtattgcaagtggcataattctgggtctcattctaccaatgatggcaaagtcttcagacagcagatccaggcggctattgaaggaggcaaaatcaagtttgatgattccaagaagccgatgaaggttgatggccatccttttcctgtcaatacggtacatacagctggtcgaacagccgatggggggaaaactcggggttttcaagtgaacttggctaagattatcaacaagtatcagagaaaatatgataagcagcaggaaaggtgttatgacgaagatgacggcggttttgacgaaggtatgaggctgtcgtctattgaagactgtcctaggtgcagcaatgttacagaaatttcaaaccgatcgcataatagaggcaatccgctaaggcaagcaagggttcctgttcatcaaagattgggcccaatgaaccaagattgtgaccaagaggacaatgaaggcagaaagactcaatggtgtccttctggtatttttacaaagaatcagaagagaagggttcagaggttgaggaacagggagcgctttcaggaggttgagcaagaaatcaaccatcggctgaagaaaacgaagccgaagcaggagtggcgcgttaagaatcaagttcctacagctgatgaagccatggccgatgaggcaaaaatattggctaaagggaaaactgttgtgattgcatcggttaacatggttttcacactacctgcagaatttggggccaagcaagccgatgttgatgaagttgaggaagcatcagctaggttggttttatcaccagaacaagcagtctttgagaagccagaagggacagagaatcggcatcttaagccattgtatgtaaacggttaaatcaatgggaagccgatgtctaagatgatggtcgatggtggggccgcagtgaatttgatgccttatgccacatttaggaagctaggcaggaatgctgagaacctcatcaagacaaacatggttctcaaagatttcggtggcaattcgtcacaaactaaaggggttttaaatgtggagctgacagtcggcagtaaaaccatccctacaatatttttttgtcatcgatggaaagggttcctacagcttgttgcttggaagggattggattcatgctaattgttgtattccttcaaccatgcatcaatgcttgattcaatggcaaggcaacaagattgaaattgtaccagccgacaggtcagttaacgttgccagtgttgattttgctctttgggagatggatggccttgattgctagtctggaaaggtttgggaaggagattttctaaaggtgttcgattatgatatacagccgattgaatacggagagcccaagttattatattgagggcatcgtggagggttcaaacgtctacaccaaggacacagtagatgatctcgatgacaagcaaggaccgggtttcatgtcggccgatgatttggaggaaattgatataggtccaggtgatcgaccaaggccgacatttatcagtaagaacttatctccagaatttagaaccaagttgatagagcttttaaaggaatacagagattgctttgcttgggagtattatgggatgctaggactcagccgatcgattgtcgaacatcggttacctatcaaaccaagggttagaccgcaccagcagcctccgagaagatgcaaagccgatatgctcgaacctgttaaggctgagattaaacgtttatatgatgctggttttattcgtccttgccgatatgctgagtgggtttctagcatagttcctgttatcaagataaacggcaaagtaagggtgtgcattgatttcaatgatttaaacaaggctaccccaaaagatgagtatctgttgatggtcgttattgaccaatttcaaccgtcaatattatccaatatatgaagactagctatgcttgcaatgcataattctcaaataaaatagttacttccactatatgctttgctactaacatgtatgcaggagaagcactcgtaaatgaagagaacgaggtggaaatatatcgatcaatcagtcaaaagtctgccaacgatctacaattacatgagaaggcccaaaagtccaatttaataatcacaaatgggcctagaatgtatgtcactgatttaggggcccacatggaagtctccttgaggaagctaagggccagaagagcccatagggggttggccgaccccttgttgagcccaatccagtcacattttggcctggagataagggaggccaaggaggaagcagcaggccaaaaactaggcctattgggccactctagggttcggctgaacctagtaccttgatcttcagccgttggctctcccctttggcatggacgctccggatgaactctgatggcggttgcggagcatttccgacaa

SEQ ID NO: 94698 - DNA, 729 bp, Oryza sativa
aaatacgatacctaggaatacctcccggtgaaatactacaatggtatatccatgcgattgcggatcacatctgtaaccataatataccatgagtatttctagtgctattgctaggaattatatttccagtagtgtcgttaagaaataccaacaatatccaatgctagtagcctatcagctgattgatgctgcttcggggcagaagatattgagttttatggatggaaatgcaggatacaatcaaatctctatggccgaagaagatatccataagaccgcttttaggtgtcctggtgcaatcggcttatttgagtgggttgtaatgacttttggcttaaagagtgctggagctacatatcaaagagccatgaattatatataccatgatcttatcggctggttggttgaggtctatattgatgatgtggttgttaagtctaaggaaatagaggaccacatagctgatttaaggaaggtttttgagagaactaggaagtatggtttgaagatgaatccgacaaaatgtgctttcggtgtatcagctggccagtttttgggatttcttgttcatgagagggggattgagataactcagaggagtgttaatgcgatcaagaagattcaacctccagagaataagacggaattgcaggagatgatcggcaagataaattttgttagaagatttatctctaatttgtctgggagattagagccttttacgccatt

SEQ ID NO: 94699 - DNA, 786 bp, Oryza sativa
ttccgaaggcttctggactcctgatttctactctattcctattccaccatctagatattactaaactaagggcccctttgaatcaaaggatttatgtaggaatttcataggattcaaatcctatagaaaattttcctatttggccctttgattcaaatgattgaagctttccaaatcctataaaattcctatagaatggcacattgcatgtggattttggaggaaatttttagcaagagcttcaacctcttggaaaatttcctttgagtctatctctctcatccgattcttgtgttttttctgcgctccaattaaacgaccattcttgtgtttttcctgtgttttgcaattcctggttatttccggtcgtgacatttagcgatgtctgccctgctaaaccaaaggaaggggcttctttggcatatacccatggacaattcagggcatagtgtccttgttctctacaatcatgagaaaaggggacatgctcttctggcattggaagctcattgacctgggtggcaaatgctcgatcaaacacatactgattttggtcttgacttccaaccaatggtagctgtgaactaagcagcatgcttggaatggaccaagggtgtgccctttttaactctcttgaggctagtggtgctagtggtggattgagttgaaaacttgagttactggaggcatacccgctgacattctttcctttttctctgttaaacatctgtgacagggattgaggtgagagaggaaacaagccaggaaagaatagaccagaactag

SEQ ID NO: 94700 - DNA, 2613 bp, Oryza sativa
aaataacaactatacatggttttaagcatgcattagatgagatcaccatggttcataaacaattaattcaataacatccacttcttcctctaaagtttcatttggctcaaggaaaatctttaagtgttgactgtttaccttaaatatgttacctgaatcgtcacggagtgtgattgccccttgcaaagaggtgtcgatgacattgaacggtccttcccatttgctgcgcaattttccgtggccaaaaagctttaccctggagttgaacattagcactttgtctcctggctagaatttcttgatttcaattcttttgtcatgccagcacttcgtccgttctttatatatcttcgcattgtggtaagccttctctctccattcctcaagttcagggatatacatttttctccattctcctgctccctcaaaatccatgttccaattcctgatggcccagtatgctctatgctcaagttctacgggtagtcaacatgacttcccgtagactatctgatatggggacattccaatgggtgtcttgtatgctgtccggtaagcccacagtgcgtccggcaatctatccttccatcctgttcccattttgttgactgtcttttgcagaatattcttgatttgtttgttcgatgtttctgcttgaccactggtctgtggatggtaaggagtggccacgttgtgtttggctcccatttctcgtagaaggtctctgaaggttttgtcaatgaagtgagaacctccgtcacttatgaccattccggggtaccaaatcttgggaagataatttctgtgaacatcttcttggcatgcttcgcatccgtggcggtgcacggtatagcctcaacccacttggagacatagtcgactgccaccagaatgtactcgcagttgcgagacttagggaaaggtcccatgaagtctatacctcacacatcaaatatctcgatttgcaaattgtatgtgaggggcattgcatcgcgagcagtgattcctccttgcctctggtagcttgtgcatcttctgacgaattcttttgagtcttcgtacattgttggtcagaagaaaccactttgccaaatcttggcctgggtgcggaatgcaccgtattggccaccgtagggtgaggcgtggcatcgttctatgatcttaagtccttcatcagttggcacacatcttcgtagtaagccatcagagcagacccgatataggtatggctcatctcatatatgacggcgactttcatatttcagttttcgtttattttcccctggtggtatgtacttggataccatgtagtttactatgttagcataccacgggttagagtcacgaaccgtcatcagcatgtcgtctctcatgaaatcatttatcggttgttcctgcatgttagtgatctgcagtctagacaaatgatctgctacagaattttctactccctttttatctttagtttctaagtcaaattcttggagcagcaaaatccatcttaagaggcgtggtttagcatctttcttagtgagcaggtatttcaaagcggcatgatcagtataaattatcaccttggctcccactaagtaagatctaaacttaccgatagcaaaaacaaccgcgagcagctctttttcagtagttgcataattcaactgagctccggttagagttttgctagcctaacagattgcatgatgctttttatccttggtttggcccaagactgcaccaacggcgaaatcacttgcatcacacataatctcgaagggcagagtccaatcaggaggttgaatgattggagcaaaaacgagtacctttttgagaatttcgaaagattttaggcacgcatcatcgaactcaaagggcgcatccttggctagtaaattgctcagcagcctagcgattgtagagaagtctttgatgaaccttctataaaagccggcatgtcccaagaagctgcagattcctttgatgttcacaggaggaggaaactgatctataacatctattttagcacgatcaacttcaattcctcgttcggacactcgatgcccaagaactatcccttcacggactatgaagtggcacttttcccaattaagcaccaggtccttttcttggcatcgttgtaagactttgtctaaattttgcagacaatgaccgaaagtctttccatagaccgagaagtcatccatgaagacttccatgatgtcttcgatcatgtccaagaaaatatacatcatacatctttggaaagatgcaggagcgttacatagtccgaaggacatcctacggtatgcataggtgccatacgaacatgtgaacatagtcttgctttggtcctccggatggataggaatttgatgatacccggaatacccatcaatgaaatagaagaaggaatgatttgccagccgttccaacatttcatcaatgaagggtagcgggaaatgatccttttttgtagccttgttaagtttcctgtaatcgatacacatcctccatccggttacggttcgttacggaattagtttattttgagcatttgcaacgaccgtcattcctctcttctttagtaccacctggactgggctaacccactcactg

SEQ ID NO: 94701 - DNA, 765 bp, Oryza sativa
  unsure (1)..(765): unsure at all n locations
ccgattaggctctccaaccatatgcncaatgttaatgaagaatcctcgagctatatctgctgtgattgtgaccacccgttaaccttccatccactttgagaatttgcaaaggcccacaaagagatgcgtgtacccccggactgcttttttgaacggcccactcatgtcgagcccccaaccggcaaccgggccaagacagtgggattgtttgcaactccttcagatggtagatgcatttgtctggcganaaattgcaacttttcgcacgtgtgcacaattttgtcggtgtcgaatactgcagtaggccagaaaaaaccctgccggtaagctttgccgacaatggtgcgtgcgncggcatggtttccgcatattccagaatgtatgtcttcaaacaattgtctcccttcctctagagatacgcagcgttgcagaattcttgaaggtcttttctagtataactcggtttcatgaataacataaagcttacttcgccttgaaatccgctcggcttcatctttatcttgagggagttcttgagaagtaaaaaatcgtatgaggggctctctccagtcggtttcaatcatggctatgtcttgagtgtccgcaacttgagttgtttctttgtaaggtacggtcggctcataaaggtgttcgacgaatacatcggagggggccacctcgcgcttggatccaaagttggcaagtctatcggcggcttcgttattgtgtcggagaacgtgaataagctcgagtccatgatgaact

SEQ ID NO: 94702 - DNA, 672 bp, Oryza sativa
gatatgtaaaagcggctcttaggtgtccgagatttgtaggtttatttgagtgggttgttatgacttttgggttgaagaatgccggtgcaacgtatcagaggacaatgaatttgatcttccatgatttgctaggtattatcttagagatctatattgatgatattgttgtcaaatcggatggtatggaaggacatatggtcgatttgagattagcttttgagaggatgcgccggtatggtttgaagatgaacccacttaaatgtgcttttggtgtgtcggcggggaagttcttaggattcatggtgcatgagagaggagctgagattgatcctaagatgatagaaaaaattcgtgatttcaaagcgccgacatgtaagaaggaagttcaaaagttgctaggtaaggtgaattatttgatgaggtttatttctaacctggcaggtaaaatcgatgcttttgttcctatacttcgcttgaagaaagaagccgattttacttgggaagcaaaacaacaagaggcatttgaagagttgaagaggtatttatctactccacccgttgtgcgagcacctaaagccggaaagccttttcggttatatattgcctccgaggacaaagtcattggtgccgttttgacacaagaggaagatggcaaggaatatatcattacat

SEQ ID NO: 94703 - DNA, 622 bp, Oryza sativa
cggctcggcccaactctccctccctctctctcctctcccccgcggcccatcggcctttccccgcgcgcgcgccgctgacaggtgggcccgcccgccaccctcgctgacgggtggggcccacctgtcatagtctacctcgcgccgctcccgccgcccgcccgtgccctagcgccgccgccgccgccgaatccgccgcatcccgccatccccgcgcgcattaaagtggagggaaatattccccgcgaatccctctccctttccccccgctttcccctctctctctccctcggattcgctcggatttactcccgcaatcctcgccggcgcaatcaatggcggccaagatttccgcggccgattccttcctctccggccaccctctctccctccgacgctatataatcgttccccgtgcttcgctcctccgtttccgccactcgccgctcactctccccgtcggattcgagctcgcgccgttgtcctctctctccgccgtcgccgccgagctccggttcgccgccgtcgtcgctccggacctcctcccgactcggcgtcacctccttcggcttcgccgcgttctcgtcgacctcggccacccctccgcttcgctcgccgaccgccg

SEQ ID NO: 94704 - DNA, 849 bp, Oryza sativa
aggatatgtacaagacggcttttaggtgcccgggatttgttggtttgtttgagtgggttgtcatgacttttaggttgaagaatgccggtgcaatatatcaaagggcaatgaatttgatcttccatgatttgctaggtattatcttagagatctatattgatgatattattgtcaaatcggatggtatggaaggccatatagccgatttgagattagcttttgagaggatgcgccggtatggtttgaagatgaacccacttaaatgtgcttttggtgtgtcggcggggaggttcttaggattcatggtgcatgagagaggagttgagattgatcctaagaagatagaaaaaattcatgatttcaaagcgccgacatgcaagaaagaggtccaaaagttgctaggtaaggtgaattatttgaggaggtttatttctaacctagcgggtaaaatcgatgcttttttttctatacttcgtttgaaaaaagaagccgatttcacttggggggcaaaacaacaagaggcgtttgaagagttgaagaagtatttatctactccacttgttgtgcgagcgcctaaagccggaaagccttttcggttatatattgcctccgaggacaaagtcattggtcccgttttgacgcaagaggaagatggcaaggaatatatcattacatatttgagcccccgtcttttggatgccgaaacaaggtatgtttttatagagagactttgtctatgcttatactatgcttgtaccaagttgaggcattatttgttgtctaggacatgcatagttacttgtcaagccgatgttattaaacacatgttgcaaggccaattctaaatgg

SEQ ID NO: 94705 - DNA, 1123 bp, Oryza sativa
aaataattttataaactgggattcaatatgctcaaggatgatgtgacttgccttgctcagagggaacggccttccgaaccttcggcgacgaccacgaaccacgcttcgggaacctccgggacgacgaaagttacgcgaagcacacaagcaaagctacaagcctacaaagaagcaataacaatacataaaaagaaagcacagggttctttaggttataacaaacattaggagacttgaacgggtcgattcggagttcgtatgaccaagatatgatcatccgaagtttaatgctgttatatggggatttgcggattattataattaagctttgcaactataaaatatgtgtaagcgctagcctggaaaagacaggaaggctgcgccgttgacatgcagaccccacatgtcaacctaaaggaccgcggtagaccgggtacacagagacggtccacgggtcgatggaagtggaccccgtgtgtcaaccgaggcgagtggccgacaaacggactccactagacaccacacggcctgcacacgtggaaaccacgcggctaccgagcgggcacactaacgcggacactacacggtcaccacccgcacgcgtgaacgactaccgacaccggtacacgggtaccggggccgacaaccgcacaacgagcacgggcgacaccgaaaggacgaggacggggcagcgagggagagggatccttaccaccacgcgacgaggcgtggggacgacaacgacgaacgggcgcggcggagacagctcggggacgacggaggcgaaccgcgagggaacgacttcggcggcgatccttggacgaaggcgagacgcggctggcacaaggcttgacgacgcggagctgaggacgaagacgaggacggggctgccgcggcttgcttgactgatgcggacgacggatgagaacggctcgacggagggacgaacgccacgacgaccgggaatgatgagaggacgacgacgacgacgaccggggccggcgaggaggcgacgagggcagccggcagcggctgcacgaatgcgaggatggcgtggaacacgccgcagcgatgacgatgacggaggcggcgccgcgagacgacgagccggcgagaatgaacg

SEQ ID NO: 94706 - DNA, 655 bp, Oryza sativa
tcatacgtgagcatcagctttatgccaagttcagtaaatgtgaattttggttgtccgaagcgaagattcttggtcatgtcatcttgtctggaggaatggcagcagatccaagcaatgtggagtcagtcttaagttggaagcaacccatgacggtttcagaaattcgccgtttccttggacttgctgggtatttgtgacgaccagaaataacccaacgggcgttcctgacgtgcgtgcattaatacttgtgccaggaggcaacgtacaccaacagttgatacaattcacagtttaacaagcggtagcgtgaataggtcacttattacatgggcaccgaaggcccatcacacacaaagacataccgcgaacagttgacgactagggctacaaccacaggcgcttgacggcaagctcgagctaaacaccaaagactgtatctttaaagtgcttctcttcttggcttgagaaaaagttggcaagactgagttcaaccaccgttctaacaagacacagccacatatgcaggatacatgcaagggagtacatgggaattataccatacaggggacatggttgcagtctacaggatttaaagacattttgttgctcagaatatcttgttaacacgatcctaataactatacaaatgttatta

SEQ ID NO: 94707 - DNA, 6538 bp, Oryza sativa
attcagatcgaagcccccatgggcaagatggccagatccacttagggtcagggttggtcgctaccacttcggaggtgccagatctggcttcctgaaggttggagaccatcagatctagccatccacacagttttggtaggcggcgacgatggtgatggggacaatgactatgacagcggcgatgagcttcggaggggcaaagcgatttcattgtcatcatcgatatttttggttttattttcacgggtattttatatcggtgatgggccgtgttgtataaactgattttttttcctcattgtccacatcggcgacgggtcacaattaaaactaacacccttcagaaataaaaatcatcagtgatgaaaggggatccgatagatgaggttttcatatcgctgatcactcattgtgatcaaggcgtccatcccccgcatataattaagggttataacttgttatgaatgaccggctccatagtagtgtataatgtcatgaaaaaaatattgctggatccatgttagaaagtattttcttttactataataattctataaccgtaaacgagacagagtaagacttatttttgacagtcaagatacgtttaatgcatgagagagtatatatatagtgcccaagtgccttcgtcccgaagtctattatgcatggtgaactggtggtgttccgagctgtggtcgcatatatatcactctcactgccgacacaaggacgatctaccaccgggtgcagtattatccatccaaagggcaaacaagtcgctgccgaaaggcgcccgccggctagctacgctagtggcagtgcccatcaatccacattccagcccctcatatactccagtactccacatacgaacaatcggtcgaaagctctaactctagctttgatccatgcatatctatccatcctttctttgatcggtcgcaacgcccagaaactgatcgacgatgcagcagcagcagcatccggcgccgggcgcggagttcgtggcggaccgggacacggcgcgggcggaggtggagcgtgcactgggcgggtacagcttccgcgacggcggcgcgctgctgctggaggacgccctgacgcacagcgtgcaccccagggacgaggccgtcggtcggtccaggcaccagcggctcgagttcctcggcgacgctgcgctcggcctcgccttcgccaccatcttctaccgggacgacccgggcctcgaccagggggacctcacggtgctccgctccgccaacgtctccacccagaagctcgcccgcgtcgccgtccgccggcgcctctatccgctgctccggcgctacaactgcgcccctcaagaccacgaagtacgcacgaacctctcctctgctttcctctgtactctctctctctcgcggatccatactttgctagtatcgattaattaaagtataaaaaaatataggactacctattatatactaaaattttactgtattaaacttactacaaacgcttccaagatatcatgtgacactctacaaatacttctaaatcaccacatggcactccaatatattgaagaaaatcctataaattatgattaaaaaaatacaactaactattgattttcttttaaatagatggacccaatgattttaaccattaaatccggtatcacacccgcacggcggttgtgccaatgaccaaacggcccggccctgggccaaggtcagtcgggtcatcacggcccgacctacacatcgggccgtcccgtgccagccaatgggctatactcacggcccaagcacggcccaatatgactcgggccgtgccaggccagcccgaaggcacgacagtccatcgtgcttaataagtctattttctctctcaactctttgggctgtgttatatatggccgaagtaagtctgttttgtattcctcttctctttggaccatgtcttatatggctgattaagtctattttggatatttctactatttttcttcttcgaccgtgcagtaccgggccagcccaccatgcaaaggcatcggccaggcacggcccaactgtcgggccatgtagtgcttgggccgggccgttgggcctcaggccttatggccatcaatagatgtgcgtagtacatactctgtactccctccaccgtccgtaatctctcatattttctaactaacttctcatattttctagctaattaacacttaatatatatatctctactattataaaaattgaaaatgtttttgccaatactctgtacgtcatccgtgtttgtaatacagccgccagcaaaaatggatctttgctggcggctggcttaagacgactgccagcgaggatattgatattcactgccctttgttttgtggcggctccaaattccgctagcgaaaacctaaaatagccgccacgaaagatggttttcgtaggagaactaggacttcacgtcatgtgagaatattgaagcaagtcaatgtaaggggcctaatgggttctgtacctacgaggagcttaagtgggcacatgagtgtgggtctcaagaagcatgtcaatgctcgaaccagggtttcacggtgcatgatcatgtttgattttaacagtattatcctgctaagaggcaggagtggtatttttacaatacttctacacagatttagacaaaatgatacatgaaaacatattgccaagtttggagcaaagatgatttttttaatacattatcttgtattaggtttatttcggtggtataactgcaatttcctctatgaaaaggtgcctaactttcaagataataataataataataataataataataataataataataataataataataataataataataataataataataataagtactccatttgtcaaaataaatataaggcaccgtacttttagcaaaatcggcattcataagttttgactaatgactaaactaatatatatgtttagtatcatgtattccatattattatgtttatatctgaaagcacttttatgtgatgtgaaattcactttttctatagcatattataaaaaataagtcaactataatgttaaagacattgaaaagctaatacacgttatattttgagggaagtagggaacagtactggtagtgatttatgactgaatccaataggcatttttatcgttcggaagatttaagtcctttctctttttccaacacttatagcaaggcaattttgtaggtgtttttgtcgttcggaacattcaactatgttctcttttctttcttgtcaactccgttctcttttctttcctccacttatagcaagataatttgtaatgaaagtccatgagctattttacagggttataataagaaaatagataagaggcacgtgcatatgcgctggcttcttcctagttgtttataaaatgtgcatgttatctatcttttctttttctatggataatattcacttttatttaattttatatgtggatataattgtattttattattaagttcatttgcaaaatttacgatgtgataagttgggatggtagattcacactgttatcatcgttagagcctttaacgacacatcgggatgtaagatttaggttttctcttcataatcttaaatttcatatatacattcaaaaccttccccatgaataccctgaaattaagaaagctttaatgacctgtttggttggagggtgtttgtgatgggaatgggagtttatgatatctagaaatttaagtctgtagtttggttgaaagacttaggaattacagggggtttgggatggggaattaagaggtccaattcccaccaatctcttacctgggggaggcctgttaattcgtgagacttggagagaattcgatgtgaaaccaaacaacggatgaggactaaaaatgtaactcccataaccaatcccaccatcaactccctccttaagactctcattcctcgtcccttctcttgccaaacaaatcgtaattggatactcatattgtgtgctaagcatttgatatgcttaaataaacattaatcataagctcaaaataatatgttgtagatcgatccataattttatttggccagttaacaactctttgcatgagatgcaaactcgctccgatcaataatattcgactttgggatgtaactaaacttagcaactcaaaggagtagtactatatacaaaggtgaactaaggtattattatggaacaactgaataccgaccaccttcgtttaccgctaaaaaaatgttttaatttacaggcggtggaaagccattttcgcacgcgtttagccaccgcctgaaaaagaattttacccaagtcatctattttacctaagtgtagcagactagcacaatcccacctcacactcatagctgatagctggagtatcaaacaatttattattttttcagctaaatatatattcaaacgaatatttgggtatgatctcaaatgagaaataataaaaaaatttcaaccacaaagtccataaagttgtaagtgaaaactatttatttttttaaatatggttgttttataaaacaaaacccaatcggggacagattcagaccaaccgtaccgtgcactttgatgattggtatgccgtatgctcttactgactatagcatttgtgatgcaggtcagccgttttaccaagtcagttgaaggcccatatagtggtgaccccattgagggtccaagggtgcttgctgatattgttgaggccattgttggtgccgtctatcttgattccaagcttgatcttgaagtactccagaaggttaattttcagccttctttcatattgtatgtttgcttttattaatgtagatatggttcctatatattgagtgatgtatggtgtaggttgcgaagttgctgtgtgagccaattatcaccaaaaaggcattactagaagatcctgagtccatgttgaatgagctagggggagaacatagggaagatttggaaatcaaaatattggcgtggaggaaggtggcaaacgtagtcgatgatggccgggagcaagcgatcacaactagtggacttggcaacggctcagaggatgaggttggaaagcttagaacaataagaatagaagaagcttaacgagcagcacagcaagttacagtaaattggcgaccaggaaccaatcagtaagtacgattactattatctcctcgagtcaagttttgtttttcatcccaacaccttgggaacttgaaatttcattcctccaaagtcagggttaagagctaaatgaattataaaattaggaacacaggaattatagaaacacagaatggcatatgtgtaaaattaggatataatggcaaaaaagaggaatagaaaatataggaaacgcatgtttggaacatagaaaagaaaaatcaaggatgggaagtaggcccacctgtcaatcacttgcaaatcttgtcaaccactatataatgaaaatggagaggattgatatttcaactaagcaattggaattttgaaaaattgcacaactacttactttagtgattcccaagtccacaacaatggagattaattttccgaatcttcttattcattgttaaaccttacattcaggcattttgtaaaatttcactatgtcgacctagctatattcaaccatatgtaatgtaggtctgctagagcggagtgaacgttcaaccaattgcttaagatacacttaacacaccatgtaaaatttcactatgtcgacctacattcaaccattgttaaaccttttggatggttcagatagctgcttgattcggtaaatacaaattttgagtcgatgtcttagttttccctgttcttcttttcctgctgcatgaggtttctttgtgccacgtgaggcatcatcctatcgcgcaactaaaatttttctaactacaggtgaactagcagcccatatatagtggctggatctgaacttttgtgggtcaggtatggaacatattcatgtattgcgcaggcacttctatgctatgctagctctgaacattgatgcctggaggtttgtttcatggcatgttcactgctagatagtagtagctgtgaaatcaatgtatggctattgaaattgatgcagacctggtactattgatgtctggtaccctggttatcaggccaagcgtgtcctaatcttgtcgagcgatgaacactatagtgtattttgtcttatgtacaatggaggtttgtcatactgaatctgtgtttgtactcaaccaatgtatatgtagaataccatgtaaagtaatattattaaagaatgtgtgatgtttgttcatatggacttactctcagtgtcctagatatgaaagagcatatagcttttcaggtgggctcagctattcatttctcatggccttgcatgaattcttgttcctgagctaaaattttccataattcatttttcatgtgtacaaactagttggcataaatactctaagacaatcaatgttcttgcttgacaatgccgggaggtgccaacattt

SEQ ID NO: 94708 - DNA, 1253 bp, Oryza sativa
ggcaccgacaccgcggcgggaaggacgtgggcgggcctgtttccggtgggcctacctgtcggtgcagtgggcgggccgcgtgggggtgggattgaatgcgcgatgggccgtgggccagggacgctgcaggtgggcccgcgtcgtactactatttgtttatccgcgctgggtggagatctttccgttttggcccttcggcaaatccatattccacaccacattgctgccatatacgaggtggtgtttgacatatacggagtacgaagttgaggatgaagttataaaacgagaaagctgattaattatctcttaatactataaatttaaaaataaatttatttgataagtattatattcgtctaaaaaatatatgaatctaaaactagatatgatattttctagtataatatatctagacagcaatgtttagccgtttgaaaaacgtgccaaaaaatcaatgtaaaatcatcttaatcatttacagcaataatgcgatatttggaggacggattcgcagagaccctggatccaaccatttttggtctaagatttggccgctgatcagtttgtaattagtttaatccgaacgtacggttgtctgattaattcctcttctccgaccggctcgctcacacgcacaaacacggcacactccactcactccactagcccccaacactgctactctcggtgctcccctcccctccccgcgctagctgtatgccgcctttataacgcggcgaggcagccagcttcccccaagcccagagcgacgcctcctcctcctcgcagctccgcgagatccacccggagcccggcaatcccaggcgaggtaagatcccctcctccattgccgtcgcgcttgctcttcttctgtgtcggtgctagtttggtgtggatctatagctcagttttgtttggctcgttcgttcgtttggttgatggtttatagtgattcgttttcatggggacgatggttaatttagtttagtttgcgttcagctcgggggacacagatccgggttttgattcgagctagcgtgcggggtttccgcgtgtggtcgggggtgttttaatgcacgcgcttgattggtgtgggttggttgtttccatgtttgttcagacaaggggagatttgcttgctagggaagatggaaataatcgatttttgcgtgcaatggaatgcatataattttttccttttttttggggcattgttcaattggtgtcactgatgggcagatccagtgtct

SEQ ID NO: 94709 - DNA, 2255 bp, Oryza sativa
cgccgctgcgccggccttcccatcgccgtccccatcatcgccgagatcgacctctacaagttcgatccatggcagcttccccgtacgataatcctcctcctccatcctcccaatcatcaccaccatcaacgccgtcgtgaattgattgattgatttggtttgatttgttggtgttgtgtagggatggcgctgtacggagagaaggagtggtacttcttctccccgcgagaccgcaagtacccgaacgggtcgcggccgaaccgcgccgccgggtcggggtactggaaggcgaccggcgccgacaagccggtgggctcgccgaagccggtggcgatcaagaaggccctcgtcttctacgccggcaaggcgcccaagggcgagaagaccaagtggatcatgcacgagtaccgcctcgccgacgtcgaccgctccgcccgcaagaagaacagcctcagggtaagcaaaaaccacacccaagattccatcactaaattcattactaaatctgtgttcatcgtgattattgattaatttagtcacctaattattcgcccaaaaccgcagctcgattcgaacagctggtggtacttctagatggatactactatttagatatttgatatatttattttgcaacttgtttaatcagctcatttcgctttcgaaatgaattgggaggataagcttagcgtggcccacggctttgggccgcagaaattaattggagacgttggctcatctcatctctagggccgcacctacgtggtgcaacttgcgcagccacgatcgaatcgttcgagcgtgaaacccattgccgtcaccacctcgcctcatccctttcagggaccaatcggtttttagccctacgcgccctgcgatcgcgacgcccacgatagctaaatcccgaaagcaaataagcagtaatcggacagcgactcgaccgggattagttaaacaatggcttgattaattagatgctggaatttggagccttctgataagtttagggcctgtttggcacagctccagctccagcttcaccccttctggagctggagctcagccaaacagtttcggctccaccaaaacggggagtggagctgggtggagctttctcacaaaatgaactagagttgtggagttgggtttaggcagctccacaactccactccaaactcaactcctggagttaaatttaggagttggagctgtaccaaacaggcccttagttttgcacttggtactttaatttttttttgagtgagtgtaaatttgtttctaaactttgtttatgaatttgttttgtattggtgcagttggatgattgggtgctgtgccggatttacaacaagaagggcgggctggagaagccgccggccgcggcggtggcggcggcggggatggtgagcagcggcggcggcgtccagaggaagccgatggtgggggtgaacgcggcggtgagctccccgccggagcagaagccggtggtggcggggccggcgttcccggacctggcggcgtactacgaccggccgtcggactcgatgccgcggctgcacgccgactcgagctgctcggagcaggtgctgtcgccggagttcgcgtgcgaggtgcagagccagcccaagatcagcgagtgggagcgcaccttcgccaccgtcgggcccatcaaccccgccgcctccatcctcgaccccgccggctccggcggcctcggcggcctcggcggcggcggcagcgaccccctcctccaggacatcctcatgtactggggcaagccattctagacgaccaaaaaaaaaaaaaaacaaccgcattggcagcaatggtgtcactgaacaccgtgcaggctagctagcttcatggccggtgaactttgactcaggcgagccgccggagttgactcaaagataattaaaagaagtgttttaagtggattggattggattagacagaggagatgaggactcgagaaaggcggcgatgagaccgtggttggggggaccctggcctggactgaacgacgacgaggcagcagcagaaagatggtgcaattgcatcgggtggcatgtcagtgtgtgtgtatagtggcatgtacatagtacatggtgattgattcggtatacagggggctagctttctgtttctgtttcttcattggttaattattactcccattataaggtcttcttcagggttgctagcttaattaattaattaattagcccagtggttgaagtgtaagtcaaaattca

SEQ ID NO: 94710 - DNA, 505 bp, Oryza sativa
  unsure (1)..(505): unsure at all n locations
acaccagcaagagaacaccaacggttgtgcaggatatcatcatcaagaatgacaagaagatgatcacttcaaatgctacatctcctggttggggcaggacagaaaacccaagtagaagcaccctgataggaaggaagaaaagcaccgataacatcagcaaggaaaccctccttcgcagtgccttgttgatgaccaaggacaaaacccgagatccaacataggagacatagctcatcaggatggcgtctataagtcccaggaaaatggtgccaaacaatggataggtgcaaatatttgtgtccccaactggcatggatgtccggatgaagtatttagcaatctttttccttccatgtgtattgntctcatccttaacaaatgttggcccaacaaacacgagaagagcctgcacgaagaacaccggaacgcagaaaaccaacatgtagcctatggtcttncaattccatctttggttcaaagtgcccaactccttcttctgtaacga

SEQ ID NO: 94711 - DNA, 1136 bp, Oryza sativa
cgacaaagtttgataaataatctctaatcgcgtagacggcgccggcgccggcgatggcgtcgccgggcgggaaggggctggtcgcgtgcaacgcggccatctcccgctgctcgcgcgcggggctgcaccggcgggcgctggcgctgttcaccgagatgcgcgcgcggggactccgcgccacgagtacaccctcccgccgatcctcaactccgccgcgctgctccgcgccccgcccgcggcggcgctccacgcgctcctcctccgcgcggggctcgcgtcgcacctccatgtcgccaacgccctcgtcgacgcctacgccaagctgtcccgcctcggagccgcgcgggcggtgttcgaccaaatgccgcgccgggacgtggtcacctggacctccctcgtcaccgggctcgcccgcgccggatcccacggcctggccgttcgcgcctaccgcgacatggtcgccgctggggtcgccacccgacgagttcgccgtctcgggcaggctcagctcgtgcgccggctcgaccgcacttgagctgggccggtcggtgcacgccgcggcggtccggtccgggcacgagccgttcctttcggtcggcaactcgctcgtgtccatgtacgccaagaccggctcgctccgcgacgcgcgcacggtgttcgacgcgatgcgctcccggtgcgccatcacgtggacggcgctgatcgtcgggtacgcgcagaacggccggggcagggagtccctcgccgtctacgccgacatggcccgctccggctgcaggcgggactacgtcaccttcgtcggcctgctcttcgcctgcagccacgccgggctgctcgacgccggccgcgcccacttccagtccatgcaatccgagcacggcatctccccggggccggaccactacgcctgcatggtcgacctgctcggccgcgccggccgcctcggcgaggccgtcgacctgctcgaccggagcccggcggccgagctggacgccacggtctggaaggccctcctcgccgcgtgccggactcaccggaacgcggcgctcgccgagcgcgcggccgggatggtgtggaggctggatccgacggacgccatgccgtacgtcatgctgtccaacctctactcgcgggcg

SEQ ID NO: 94712 - DNA, 1024 bp, Oryza sativa
agccaacaaggttttgacaaaaaggtactattgacgatccttcaatttttgccctttaaagggatataagatttgcaatggattattggtatctttaacgggtatatgatttttactacccttttggtcttataaattgcattactaccaagtagagtcgttatactgagaccatattgccgttcctgtttgtttgacagaaaatgccatactggaatcatggaagaacaggagttggtagaaactaaccttcccaagacataaggcaagaacttcactgaagtcaagccatacaagtagttcccaagagagaaaggtaataggggactaagccgcagcagagtaacaaccttaaatccattttcacctattgctttgtcaattgccagaaacttcttgtttccttcaaccaatttgagaattcgctctctggcaaagtatctagcaataagaaaggccactgctgcagctagctgcacagttggcaaagcacaataagaaaatgcagctgaaggcagagttaacaacagaatgctgttgatgtggatttacttactgtcccgctgattgagacaataactgtaccagtaatactaccaaacaatagacctgctgacattgttaatggtatcgctggaatcgcaaggacctgaattcaaagaaaatcatagtattattatgaaggtgaagttccaatccagatgtcaagaatatatgacaaaagcctgtacaaatggttgacagggctaaatgtagatcgttagtttatttcagagttcaccaatatcaaacaaagaaagaaatggatgccctccatcaagaagtggctttatccaaaacaaaagtgcctattgcctactcactcatattcaaacattttggcacaacaaatttacaaagtgtgtgtgtgtgtgtgtgtgtgtgtgtgtgtgtgtgtgtaactgaaaggcaaaaatatcagccttacactatcactgtaattgactagctagtttaggtgaaaattatagaaacgaagacactg

SEQ ID NO: 94713 - DNA, 1315 bp, Oryza sativa
tagcacaaagagtatcaaaaaagaactccttttcactatagttgaagtttgtacaggaggtttacaactacaacattgccatcagattgcttgctagcttgacatttccccaatgaattcaacctttttgtctgatgtgtaaaacttcttaactacatcattcatacttggtctttggttcctttctttctccaaacacgacgtaccacctccagcatcaacgccacctgtgagtaaacgaagctaccattcaacctacgatccaccaagctgattacccatgtccgatcaccaatcttcaacccttccctgatcttccacaccaactgtctcatcgcaatctccgcatcaccaacgctatccgtggccaaatccgccattctggcccctctaaccagctccagaagcacgacaccgtagctgtacacgtcaaccttttcggttatcggaagactcgaaacccattccggagccatgtaccctctggtccctctgatgctaaacgaggcgggatcatcgagatccctcctctgttgcatcttcgcgagcccgaaatcgctgatcttgggctcgaaatcctcgtcgagaagtatgttctctggcttaacgtcgcagtggatgatccagtcgaggcactcatggtggagataggccaaacctttggccacaccaacggcaatgttgtacctttggttccaattgagagtctccttggcgccaaacagccacgtggcgagcgacccgttgtccacgtactcgtacacaagcagccgccgccggcggtggcgctccgagcagacgccgcggattctcaccaggttcatgtggttgatccggccgatgacgctcacctcggtctcgaactcgtcgtccccacgctgcggcgtcgcggccttgagcttcttgacggccacggcgcggtcgtcgccggcgccggcgaggacgcccctgtacacggagccgtaccggccatgaccgatcacgtccttgaagttcttggttgccttcctgagctcgccgtaggtgaaccgccggaaatggtcggtgaccaccctgtacccttcctccgccgcccattgctccgacgtcgccggccggctcctcgccgtgaaccaccacccgaaggcgatgaagcagagctccacggcgaagaacgccgagaggaacccgtagtagtagcgccacgacgacgtgtccggggaggcggccgagaaggagaggagaacctcctctgttcgcgcggcgtcgcaggcgagattaacggcggcggcggcggccggggcggcggtgtaggtgtctgactccgccaccaagt

SEQ ID NO: 94714 - DNA, 1105 bp, Oryza sativa
cgaggcacgccgccttgcatccgtcgacggagatggaggagaagaggttgaggtcggagccccagaagtctgtttgcggcagccgcgcgaagcccatctccggccggccaccgccgccgccgcaggtgaggttgaacgtcggccggcagcccttgccgcggtcgccggcgtcggcgggaacgtagcctggagggcacgagcatgccggccgcggcgtgtacacgcagaggccgttccagccgcagaggccatggatgccgcacggctgggagaaggccatccaagaaaccgaccaccccccgtcggcgtcgcgcaggctgtacagccggaggttgccgtcgtggtccagcgtcagccgccgccacgtgacgccgccggcggcggcgcccgtgtcggacgcgacgaacgtggtgttgtcgctggcgaggaacctgccggcgtcgtcgagcacgccccggcggctggcgttgtaggagatcctgccgttggcccagctgctggcgtcggggtccggccagtagatgttggagatgtccgggccgtcgtacgccagcgagaggaggtagcggtcgtcgaaccggagcgcgtagtggctcgtcgggtggagcacgtccgtcgtggacagcctcgccgtcgccgtcaccggctgccccggcagcagcgtgtcggtcgggtagtcgaagctctgccacaacacgtccccgccatggcttgtcacgacgaggttgccggagtccgtcagctccgcggcggcggcggcgccggagctcgagttggtctgccacaccggcgtgccgtcgtagtcggcgagcacgaggcggccgtctcgccgcagcgtgagcttcgaccccgcgccgtgcaccggccggtcgcggttggccgtccaggcgacggtccggccggcggaggcggcgaaccagatggagacggtgaagacggtggaggagaggttgtagaagccgaacgcgaagacgccattggaggacacgaggatgtcggaggcgcgttccgcggagagcgattcacctctttgaaggcggctgccgccatgagccggagaaagaagaagaagagcagagaacaagaacgcgaggagcatgatcaa

SEQ ID NO: 94715 - DNA, 1459 bp, Oryza sativa
  unsure (1)..(1459): unsure at all n locations
cttgatcgcggcgtggcagtcgccgcacacccggaggttcttgtacacgcggatgggcgcggcggctggcacggcgaggaggccgaacgcgacggcgagcctttcgccgtggtgagccagcccccataattgtcacactaaaaccattcagaaaagtactcatgattaccctgacaggacgtgcaagcggttttgcagcttgttctaccatgctcagagccactgcaaagaaaatccgtgaggactgggatgctcgtggattatttacaatctaaatcataccataaatgtatggtaaggggagacaaaggaaacaggaaaaccttttccaccaaagctgtgaccaaccagcacccgtggggttagcctgagctgcactatctgttgcattttggattaattagcataaggtgacagataaatgggaaaaaggctgaggtgaactgaaagctactaagatataaaataacaagaaatgaaagcccagtcccaggaaaaccttttggacaatgacatggcctccaaaatatatctttgactatgtttttctgttataatatgtacaataaataaaaacatttttacttttattatagtatcttgtaagacaaatatatatatattgtttagtgcctttaaactaaatattttaaaagttattgataatcaaagttacaaacgtttgacctaaaccttgtcctactaaggctgtgttctaaactcccatttcccaacttctatctcctcattttttgcgtgcacgctatccaaactgttaaacattatgttttttgtaaaaagtttctataggaaagttactttaaaaaaaatcatattaattcattnttaaagtttgttttagctaatatttaattaatcatgcgctaatctgccgtttcgttggaaaccttcactcacaaactcagcctaagctaactgacatgtgcatggcggcaaaaaaggtatgcaaagttctcaagcattttgagttctaaccattctctcaatgcaacaaaggcatataacacaactacccaagcacatgcatatatattttgtgattccatatattgatatttgatatcagtgccacagacatatttaactcagtgtgtagataatagaagctaagacagaaatagcagtaagacgaaaacacaaaccagctttagaacatcaagagcagttgaggcaacagtatgcggtcctcttttcttaattgacgctgaatctccatggcaacgcaaatcaaccaagaggaactgcatgaggaaaaggcaggtacagtttctttctttatgctgtgaaataagtcagattgcgagcagaattttagataaagtaacctgccacatcggaaattcctgagccagcctctttgcaaaagatccttcaaatcaacacagttaattaattttgtgattaaatgcatttatacagccaaaacagctttaaaatg

SEQ ID NO: 94716 - DNA, 2011 bp, Oryza sativa
agattaacaagcaaaatggtctccacttgtccatgtttccgatgcaagattacatgtgtgcgtccaactaggaagattcttccaaagctaaaacaatttgtgcgagaccaactagtaagtttttttttctaagaaacacagcataaacgcagccatacaggcatccagaacacgcacacttacccctatgaatgtacactctactcatacgaacacctccagaagattgcatgccttgttctagtatttcttccattgcgtcgttaggtccacacttgctcaaacgcatagtaattttttttcaaaaagaaagaaaaaataaatttgaaataaatggcacggtcgcagcagatgtctgaagaatttcgttaggaatttgggatcagagaaaggacattagaaggccctaatttgttttgagtgctagctgctgcttatgacgttcacttcgctttgctcctgtttgtgaagagtgtgattccaagagacccatcctgtaagagaataaaaagtgacacaagacggcaggcccactaaaattatgacagatcccttcaagccacacagatcacatgattgcagtactggcagcaccaggcaagtaacacaagtggtcgagtacccatattaccccaacctaaggaatcctatgttctactactactacaagcacaaaaaacatgacaggaaaaacaactgcagaggggaaaaattgccggagaagggagggtagaggagagcttgtagaaacaggacaaatgacaatcacaaaaacaggagacaattttgtcccagttgactatgcccagcaacaggggctttggataccaggcagtgtgcatctggatcatgctaagcactctatgcagggggaggaaattgtaaacaagctcacctgcccactgatcgatccattttgaaggagacatccccagatggacagatctatgccaatgtcaaagcatgtagggcaggtgagccatggaactttgcagagtacgagagcagccaatgagataaacatagtaaagattcatcttttagccatatatgaagcctcaggcccctcctccagctctctacttcagtatatttcatgggacatatattctaagtgggcaaaaattgatttgaattgagttcctatattgacttagtttggtcaaacatttgcctaatcttcattgctcacctgttagttggatagggatggagggcagactggcaagatggtggtccttgcttagcatatgctaccactgtatttcccccaaagctatttataactgacagcttcttcttggcagacctttaattcaacacaaagaagcaaatataatatatacttgcatagctgtcatggagagaagcagctaaggaatagaggacaaggctgaggcccattccagcctatgccatggtggaatttattagctaagatattattgtggagcagcaaaaccaaccaaaagtgaattccaactcagcctttccagccaatgccagatgcacagctcctcagcctttgcaacatccagctacatgccactttgataaatgagatttgagtactaaactaatgatgagtcaagctacttggaaactttacaaaaacctttgattgccacaaaactgttatcattaaggtagtaagaggaagaaagaggaagaagaaaagggagaacatagtagaagggcaaaaggaacaggtgaatacttcttagtatctaggtacttccttgagagggagcatgggcattgcagcacttggggatgaacctgaaggtgagggtgatccaatatgagcaccactacgagaggagaatccaatttcatcaacaccatcctgctgaagttggtcttccctgatcatagtgcggaaagatatggaaccacgcttcgttgaagtatctgagttccgttcaatttctcgaaagctctggttggctacaagcgatgcaccttcatagtagtaatcatcataaggaaccatctctgttatttccctctg

SEQ ID NO: 94717 - DNA, 1367 bp, Oryza sativa
  unsure (1)..(1367): unsure at all n locations
cacatcgtccagccaacgttgggctggagactccgggtcatgggcgacaggcgggtgacgtaggagcgcgcctgcagcttggagcgcgccctggggcgtgctgccgtcgccgtagacgaggaggcgacgctccccatctcgccgcccttctccacctcctgtggatgtcgaagtcgcggatccttcagccctctcgagcgccttctcccgcctaggactttggcgtggagggggcggtggagtacgagctcgacggcgtgggtttggctccccgtcgtcaccgctcatactcggggagaggtcgtgcgcctttgctggctcggccattgggctgaacaggaaaagcttggcgcacacgaaggagtgcgagagctcagaagatcactcgcagagtcccctacctggcgcgccagatgacggagcgtggggctcctcatcgggagaccgcgctggcccccctttgccggttcggccggggaccctgggtgagactctaagctcccaatctgtggaaggttcgcgagacaggaagcacacaagacgccggcgatgtatacaggttcgggccgctgagaagcgtaataccctactcctgtgttttggtggattcgtgtgtgaaggagctacaaagtatgagccagcctctcccttgttctgggttcctaatctggaaaagtccagtccaaaaaaacctcccatctaagtgggcaaggtcctccttttatatcttaaggggataccacatgcaccatttccctcttttttgtggggacttcccccaccttttcataaatggacggagatttgtatcgttgtcgtccgagtcaccttctgatgggacggcccacaactacctccactttcgccgggagcagatgcgacgtggaatcgtggccgcctgctgacgacatgaccggagtcagaccagtcacgtcggtcattcttgtccaccacatgtcagcttagcaatctacatggtggccctttttcacacaatatcttgcttgtaatggttaggataaagcttggcatatatctgatcaggactaagttgccatctctgggaggtaacacgctagctcaagttgggaacgagcgcctagaagccctcgtcctgacggaatggggcgaggcgtgcgtcagaccgcctgtcgccacctaacccgcgatctgaccggtctgtgactggtcacagaccggataaatgagtgcactgcactgcgttacatgcggcgtgacacgctcagccaaaccgcaataaatgtggttaggtgagccncactgtgctcacctaacccatacacgcggagcgaaaacccacgaggggtcggggcgcctcggccctcggggccgaggcgggtgcggcc

SEQ ID NO: 94718 - DNA, 942 bp, Oryza sativa
tgattaactgaaaaaacagtaggtaaattaccatacccgcttccatctccagtgttgccaatggtcacattagcagacttagaagtctgccctgcaggtgccttcatccccttgcgttgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggaagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatgggcata

SEQ ID NO: 94719 - DNA, 1502 bp, Oryza sativa
ataattttgtggattaacaagtagggtccatgagtcattctcagagggaagttatagttatgggcacactgcaggcacagcgaccacgggccatccactagtagtttgatggcgccgagaacaagaggagacaccgggctcatggcggaggacggtgatgatgcagcattgtgatggaaccgctatgtccatggaaaaggggacagcaacaacgctttggcaaccgtccataaggagaagatagcagcagcggcatgagcccctagaaataggcgctgccaacaggacagggaggatttggccaaagtcgacctcgcggcaacatgtgtttttcccgactttaggaggcagcgaagcaaggaagaggagtagcagcacaacggcgtcttggcgttggtgaacaacggtgttgcattatggagtgttctgactgacaacgatggcacaactacgagtgggcgatggcatggaagaaagcagcggcgctgatgttcattcacccgaggcggcattggtggatgtgatggtatagcatcacatatagatgaccaaaaggcccgcccggcacggcccggcccatgcacagccaggcacggcccaccagccatcgggccggcacggcccgatcggcacttcatgccgggctgtgccgggccggcccgaaggcacggatggtccatcgtgcctttttttaaataagtctattttccgtccctcctctttgggctgtgacatatatatagtgaaaataagtctatttccgtccctcctctttgggctgacatatatatatagctaaaataagtctatttgacgtccctattcttttgaccgtggtatataatatgtctatttttactccctattgtttatgtgtcgggcctggactgcggcccatcatgccgtgctagcctggtcgtgctgggccagcccaacgtgccggtggaggggcccaggcacggcccggtggttggccgggccagcacgggcccaacccctgacgggccgtgccgtgcttgggccgggccaaaacaccgtgccgtgggccgggccgtcgggcctcgggccttttggccatctatagcatcacaacagcaagatgaagagtcccagtgtgcacgaataaaataaaataaaaattggagggcaagcgctgctgtatagggaagccagagcagagagcatctcagcatgcgcgagcaaaagaaaaggattgcagaggtgttgttaaatatatatagaggagaaaaggggaaaagtacgagcagccataagatggagagatggtgaaaacagagctaaccgatcgacggtgatagtgatttagtttttgataaataaaggaggaaatgattataaaaagtggaggcagtgcaggtccttaccaaccacgatagtggagacatggcagcaacaatatgtgctagacgacgaggcagtggcgtctttatgtgcacacgacagcaacccgacatggaagaacagaagagcagcagagtgat

SEQ ID NO: 94720 - DNA, 520 bp, Oryza sativa
cccgtccaaggccacacggatcggtggtcttctggacggcaaataggaagacgcgctcgtctctttcctgcgggcaaacgctgacgtcttcgcatggagaccggcggatatgcccggggtccccagggaggtgattgagcaccgtctcgccgtacggccgggcgcgaggccggtccggcagaaagtgcggcgccaggcctcggaacgtcaagccttcatccgcgaggaggtggcacgacttctggaggccggattcatccgcgaggtcatccatctggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccacagcggggtgcgaccttttgtgttttctagatgcatactctggttaccatcagattcgcatggctagggaggatgaggaaaacactgcgttcattacccccatagga

SEQ ID NO: 94721 - DNA, 1653 bp, Oryza sativa
atgcgtgcatggcgccgctcgctcgagtggacactcgctctacctccgctccatccccgtgtgctcccccctcaaggcatgtcgcagccacgactctgcccacgtcgtccgtgtggcggccgcagaggcaagctctctcttcccccacccgcggcggctgccgtccccaccaccattgccgccacaactcaccgccatccccaccgccgctctggccaggtgaagagaaaggccgggggagagagagataagagagagggggaggaggaagaagggaatgagagaagatgacatgtgggccctacatgtcagtgggtaccacaatattatttttgtgaatggcaaataagtcatgcacattcttttttgattttaatgccacataagcgtcacatcaacgccacgtggaatgaagacccggtcaataccgtcaagtaggtgccacgtcagcgaaaccgctctctaaaaccaccaagggagataaaatgcaccggttttaatagttgggggcccggtatatgcgaaacagattcagccattagtgaagggagtaaaagtaaacttattctgaagaatttgagttaagcccagtgcgtatctggacccatatctgccactgttcctttttgttttgaactccaattttattgggcctgaaattagtaggcctacgatatgctgtgcataccattatacacgtgaaatgtcattttcgtactactgtagtactttacaaatatttttgaaagtgaaactgatcctgagtttcttctgatatttccaaacctccctgcgttgttctcatcctcaggccctctaaataacaaaatgttgcaccgcagtgatgactgcttgattaacaacatgctagtatatggttatttagctttatttttccaagaactatgtttaagctttgcactatgtataaattttataccataatatgcaattatccacaccatattatcagctattcctacatctatctcaacggtcaccaattctagaaagaaaaattctccgatgatcgatgatcatacacccggtcgtgcccatggcctacgcccactggctgtcctctccgccatcgccacgctgtcgccgccaaaatccaccgacatggctcccgctccagctcccaccactgccaccggcctcccgtacgcctgcagcaccagcaccgacgccgtcgtctggaagtccttggacgccagcaggtcgccgatcggccccagctccggcgactcgctccactccgccatccccgccgtcagcccggaccccccgggcaccttcccgacgacgaacaggtccttgttccccatggcctccacgctctgtatctcccccaccatctcgctcgcgttgaacacgccgcgctccctgtactccaccgtcgcgccgccgccctcgttcgccctctctaggaagtcacgcaggcacccctcgtcggccttccgctctttcagcgcgtcgaactcgcttgcagtgaagcttcctcccttctggacgaaccggagcaatgtcaggtcgatggtcgggttcctcaccatgcgcgtcgcaagcgccgccacctcccggtcgtcgctcccgccgaagaagagcgccaccacgcggtacccgccacccggcaccgcggcgaggccacgg

SEQ ID NO: 94722 - DNA, 647 bp, Oryza sativa
tgcgcgccgcgagggagtcgaggctgtgcggcaggtcgagatgggcgcgcacccagtcgaacagatccgcgagccggccgtcgcgcggattcgcggcgaccggctgttccacatactgcgcctggccgccctgccggtgcggggggacgacgagccgccgcgcgacccggctcgcgacgtgcgcgccgtaacgcttgcggagcacgtgcagacagcagtcgaggccggccgcggtgccggccgaggtctcagggtgccgtcgtcgacgtacagcacattcgggtcgagtttcacgcgggggtagcggcgggcgaattcgtcggcccatgcccagtgggtcgtggcgggacgcccgtcgagcagaccggcctccgccaacacgaacgcgccgaggcacaggccgacgagctgcgcgccccgcgcgtgggcggcgcgcagcgcgtcgaccagagcggcgggcggcgcttcgcgggtgtcgcgccaggtcggaacgacgatggtatgcgcgtcggcgagtgcgtcgagcccgtaaggcgccgtgatcgtgaagccgccggtggtggcgagcgggccgggttcgagcgcgcagacgcgcaggtcgaacgggggcaggccgtcgccgccatgctcgtcgccgaataccacgc

SEQ ID NO: 94723 - DNA, 537 bp, Oryza sativa
cattcttgtctcaaaattttgatatgaaagatttgggagtagctgatgttatcttaaacattaagctaattagaggtgagaatgggattactctcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacttctaatccgggagatgatcactggcgtgcgcttgagcgagtaatgcgctatctgaaaggtactgtggaattgggacttcactatactgggtatcctgcggtactggagggttatagtgattctaactggatctctgatgtggatgagatcaaagccactagtggatatgttttcacactgggtggtggtgctgtttcatggaggtcttgcaaacagacaattt

SEQ ID NO: 94724 - DNA, 1031 bp, Oryza sativa
gcttcacgttgcaaacagtgggggaaaccaccattgcgatctgtcctccccgggcaacgcacggtgggtggtcggtctggtcgaaagtgagggcaacctccgaccaccgcgcctggcgcgtcgcctcatgagtaggggccgcggccagaagctctcgcttcatggccttgaggctccggcgataaacgtgagcacacgctcccccatcgacagtggcaatggtggccccaggctcttggaaacctaggtcatcatcgccgtcatcgatgtcctcggcgggggccttctgcttggcctcacttcgccgattgccggaaggaaccgccggggacttgccctctcggcgctcctgcctcctctcctcctcccacttcctcgtccgctcagccaaacttttgactgcacggcagtccgcgaggtcgtgaagggaagtgttgtggacggtgcaccacttgccggttgggcgctccctgctgggagcgccggcctccttctttttgtctcccgcaggcctcccctttcgggtggcccgcggagcgccctcgacggcgaggacatgaccctcgtcgtcggtatgggctgacctcttcttcctcctcctatcatgccgccctgtctgagcggcggatccgggggcggccgaagctgccacaccggaaccggaggggttccaggtccatgcctcctccttacgagccactcggtccgcgagctgaaaaagctccgcggtagcctggggctctttggaggcgatcttttcgagcatgcggttgtgccgcacaccccccctaaacgcgtaaatcaccgcgtgtgcagggatgcatggtatggtgttacggacttgacagaaccgctgaatgtacgagcgaagtgactcatcatcccttcgctgtactgcgtgcaagtccgcttcctcacctgggcgcggatatgtgccttgaaagttcatggtgaactgtggcacaaatcctcccaagagtggacagatgcgggtggcaagttcattagccaaccccgcgcctgtcctttca

SEQ ID NO: 94725 - DNA, 646 bp, Oryza sativa
aacatggcacaactatgcatgcacagttcaaagattgaacatgatatttatgctacgccagcaaaagccttgctcacagctattattgattttagatacagattaacagatatggtcggatttgtgcttatccatgattttctgcagatgcacgattgcacgtagcattaattttatgtcacagtcaaataaactaaaagtttaggagctggcttggttccaaaagtttaatttgatgtagtctaagtttccgttagatatgttgttaagaaccagattatgtatttgtatgcaatattatcattgaaattgaccatctgaaattcataccctttaactgttacttatgattatcagggtatgtgtctttgcagtgtggctggaggtagctaatttcctttttctgtgcagattaccacatttaatatttcgttggttgttcatgggacaattgctgagaatatggactttatgaaggttacttactcaatacattttcttagaatataaagatgtatagcattgatcattaacaactgttacttgtgcacctatcaggatgatttaaatccatatgctgttccaagggctatgggcatctaccgtagactggagagccctttagacatcactactagtactatca

SEQ ID NO: 94726 - DNA, 942 bp, Oryza sativa
aacaaggggaatgctagaatgttgcgatggcacgctgaagagcgtcaacaggacggcatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctcccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaataggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcctcgattccttgcagcaaaccacccggtacggaagaaaagcaagcacttcgaacataaggccgaccaccgtacgaagcctaaacatcgcagcggaaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacataatgatctgaagcatatggaacaacgcg

SEQ ID NO: 94727 - DNA, 751 bp, Oryza sativa
ggtgctaccaaccgggactaaagtcccacccctatatatatgtcttcttcctcctccagctgcccgagcaagcttcaaaatttcttcaaaaaagaggggaggtcatgccaaagtttctattgaatttattttggtgattacatacaaatcggaggtgcctaaaaggtttgcaacttcatcctccaatgttttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatacaggactattcatttccacttg

SEQ ID NO: 94728 - DNA, 616 bp, Oryza sativa
atttctcactaaagtaagcaacatgctttttatcttgcattaaaacagctcctataccaattccattagcatcacattcaatttcaaaagttttagtgaaatcaggccaaaccaacaaaggagcttcagtcaaacatctttttaatttttggaaagcatccttttgtgattcaccccaatgaaactcaatacctttttttgtcaactcgttcaagggtgcagctatggtgctgaaatctttcacaaatcttctataaaaaccagcaagaccatgaaaagttctcacctgacttacattcacaggggttggccaatccttgattgcctccactttcgattcatcaacttcaactccctgtcctgaaatgacaaaaccaagaaagacaaccttctctgtacaaaatgtgcacttctcaatgtagcaaataattatcctttcttagcacatccaaaacttgttttatgtgactagcatgttcactcaaagacttggagtaaatcagaatatcatcaaagtaaaccacaacaaattttccaatgaatgttctcaaaacatggttcatcaatctcatggaagtacttggttcactagtcaaaccaaaaggcataactaacc

SEQ ID NO: 94729 - DNA, 593 bp, Oryza sativa
cacaatctcaatcttgtcgccttgccactgaatcaagcattgatgcatggttgaaggaatgcaacaattagcataaatccaatcccttccaagcaacaagctataagaacccttcgcatcgatgacagaatgttgtagggatagttttgttgctgactgttagctccacattcaaaactcctttctgatggatcgccgccaaagtctttaagcaccatgtttgtcttgatgagatcttcaacgtttctgcccaactttctgaatgtagcgtaaggcatcaagttcactgcagccccaccatcgaccatcatcttggacatcggcctcccattgacataaccatttatatacaatggcttaagatgccgattctctgtcccctctggcttctcaaaaaccgcctgctctggcaacaaaatcaatttagtcgattcttcttcaacctcatcgacatcggcttgcttgctcccaaactcggcaggcaacgtgaaaaccatgttgaccgaagcagttacaacactttttcctttagctaacctttttgcctcatcagctgtggattcatcggctacaggaacctgattcttaacacg

SEQ ID NO: 94730 - DNA, 1531 bp, Oryza sativa
tgccaagtcatcgtcactatggattttttgacgagggatacttcaactactttggatctgggaagtctaatctggccagagtatgcgccccgacaaggtcggaaccatcgtcatcaacaattcgatctcttgagatcgaccaagcctcaagataagcggcgtatcgaaagatgtcagaccgtatgatgtcgaacgagtacgcaacaaggtaattggtagattggttttttaaattaatctactaatttcgtaaatacatccggcatgtatctacaaaggtacgcaatattttatatgcaatttatcgtacctattcagatcatacaacattgtcagatctataatttattatgtttacctagagcatgttttttatacaatatctattgtgcgagtgcttccgatgttaggccaactacggtctaatgctggggactcgctctgttctcttctgtatgaatcatgcttgtctacgatatacataatgcctggtatttaatttgctcgttatatcctgataatactataagattcatgcagctttttgagtacatactcgatattatctgctatatatcttgtcttccagacgatatttttcaggaacaattgagcacgtgagtaggttgtggtcgagtacaccccattatcgagaacattctcgacaaatgcggagttgtcgcacccaacctaccaacgaagaccgacgacctatctcatagcgccaaccatggctgcgctattcgagaaaaggttgttaacggataaattctcgtgaacgttgtcagcttgatcacccgacatgattgcgagcggacatctggatatgctataagttgggtatgtgagtcatgctggccacatgagatgcagatgtaacaaaccaactttagcacccctataggtgattgagaggctcctactcctggttctcgaaccagtaggacgtagcgatctctcgcgccttaacttctgatggtcgaggtacgactacggcaatagcgtagcggtcctcgcaccacgacttcagatgacttcagatggttgaggaacagctacgactagtcttcgaccggcagcgtagcggtcctcataccacgactccaaatggtcgagagacacctactcactggttctcaaccagtcaatcgtagcgatctctcgtacatttacttctagtggtcgagttacgactactatctggtcctcgaccaccggtgtagcgattcgcccactacttccaccgggaatgctattaggcgagcgatcgccctcgctcgcccagggcgatcagttttgcgcacccccccttccctccctccacctctccaccttgtttccttttttggcaccgcattactttcctattttagtaaatttatacacctaaaagttacacatctaaaagttagagaccaaaaatttataagtcaaaagtttatatatccgattcaaatttgaatttgaattcaaatatttatatatatatatataggatttctatacatctaaaagttatacaccctaaaag

SEQ ID NO: 94731 - DNA, 3838 bp, Oryza sativa
ttatgctaatgtgcattccttcaccatgcatcaatgcttgattcagtgcaaggcgacaagattgagattgtgccagccgacaggtcagtcaatgttgccagtgctgaattagctctttgggagatggatgggcttgattgtttatttattttggaaaagtttgggatggagattttctaaaagtgtccgattctgatatacagccacttgaagatggagaacccgagctattattttgagggcgtcgtagagggttcagatgtctacaacaaggacacggtagatgatctcgatgacaaacaaggacagggtttttgtcggctgatgatttggaagaaattgatataggtccaggtgatcgaccaaggccgacatttattagtaagaatttatctgcagaatttagaaccaagttgatagagttgttgagagaattcagagattgcttcgcttgggagtattatgagatgcctggactcagccgatcgattgtagaacatcggctacctatcaaaccaggggttaggccacaccagcaacctccgagaagatgcaaagctaatatgcttaaacctgtcaaggctgaaattaaacgattatatgatgctggttttattcgtccttgccgatatgctgaatgggtttctagtatagttcctgttattaagaagaatggcaatgtcagggtgtgcattgatttccgagacctgaataaagctatcccgaaggatgaatacccaatgccagttgccgatcagctggttggtgctgcatcagggaaaaaaattttgagttttatggatggaaacgcaggatataatcaaatctttatggctaaagaagatatccataagacagcttttaggtgtcctggtgcaatcgacttgtttgaatgggttgtgatgactttcagcttgaagagtgctgagctacatatcaaagagccatgaattacatataccacgatctaatcggctggttggttgaggtttacattgatgatgtggttgttaagtctaaagaaatagatgaccacatagccgatttgaggaaggttttcgagagaaccagaaaatatggcctgaagatgattccgacaaaatgtgcttttggtgtgtcggctggccagtttttgggatttcttgttcatgcgaggggggttgaggtgactcaaaggagtgttaatgcaatcaagaaaattcagcctccggagaacaagacagaattataggagatgattggaaaggtaaattttgttagaaggtttatttctaatctgtctggaaggttagagccttttacaccattgttgagattaaaagccgatcagcaatttacttggggggcagagcaacagaaggctttggataatattaaggaatatcttagctctcctcctgttttgattcctccatagaaagggataccttttagattgtatctatcgaccggtgagaagttgatcggctcagttttgattcaggagttggatggaaaagaacgagttgtattttatcttagtcgtcggctcttggatgctgaaactagatattcccctgtggagaagttatgcttgtgtctatatttttcgtgtataaggttgaggcattatctactatccaacgagtgtactgtcatatgcaaggccgatgttgtcaaatacatgttatcggctccaattttgaaaggaaaggttggaaagtggatattctctttaactgagtttgatcttcggtatgagtcgccgaaggcgattaagggacaagttatagccgattttattgtggaacatcgtgatgattaaatcggctcgattgaaattgtgccatggactttattctttgatggatcggcgggtactcatggttatggtatcggcctagttataatttcccctaggggggcatgttttgagtttgcttatactattaaaccttatgcgactaataatcaggctgagtatgaggcagtgctcaaagggttgcaactactcaaggaagttgaagccgatgcttttgaaatcatgggggattctttgctggtaataagtcaattggcaggagaatatgaatgcaagaatgatacgttaatggtttataatgagaaataccaagaattgatgaaggagtttggctggttactttgaaacatgtatctcgagaataaaatattgaagctaatgatttggcccagggagcattggggtataagccgatgatcaaagatgttaaggttgaaattgcagctatgacagccgatgattgggaggtatgatgtgcaccagtatttacagaatccatctcaatcggcttctaggaaattgagatataaggcattgaagtacactttattggatgatgagctttactatcagacgattgatggggtgttgcttaagtgtttgagtcccgatcaggctaaagttgcaatcggtgaagttcatgagggaatttgtggtactcataaatcggctcataagatgaagtggttacttcggcgtgcagggtatttttggccgacaatgttggaaaattgtttcagatattacaaagggtgttaggattgtcagaagtttggagcaattcagcgagcaccagcattggctatgaatcctatcattaagtcatggccatttagaggttggggaattgatatgattggtatgataaatccaccatcgagtaaaggacataagtttatattagtggcgactgattatttcaccaagtgggtagaggcgattcctttgaagaaggttgattctggggatgcaatttaatttgttcaagagcatataatctaccggtttggtattcctcaaactattacaaccgatcaaggcttaattttcgtgtccgatgagtttgttcagtttgccgatagcatgggtatcaaattgttgaattcttcaccatattatgcacaagctaatgggcaggccgaggcatctaacaagagcttgatcaaattcattaagcggaagatttctgattatcctaggcaatggcatactcggttggccgaagcattgtggtcgtattggatggcatgtcatggatcaattcaagtccctccctataagcttgtttatggacatgaggctgttttgccgtgggaggttagaatcggctctagaagaacggaattacaaaatgatttaacagccgatgagtattacaaccttatggccgatgagagggaggatctggttcagtcacgattgcgagcccttgcaaaatttatcaaggataaggagcgtgttgctcggcattacaataagaaagtggtacccaaagatttttcggagggggaacttgtttggaagttgattctgccgattggaactcgggatagcaaattcggcaaatggtcgccgaattgggaagaaccgtttcaaatttataaggttgtgtctaaaggagcttacatgttgcaaggactcgatggagaagtttctggcagagcattaaatggcaaatatttgaagaaatattacccaagtgtttgggttaatgcaagatcggctgatgttgccgatacatgataagccgatgtattttcatcgtcttgagatggccgatattgttatatcgctcttagtcgttttttccaattgtaatcggttgtggtttgccgatatataacagccgatattgttatatcgcccttagttgtttttctaattttatcaatgctgttgacattataaaattaggggggcacatatgtacaaaaatgaaagtgaaaatttttttagcaaaatcagaagttatgttaatcggcacagaggattgttaaaacaacagagtattaaggtatcttagccgattacaaaaaa

SEQ ID NO: 94732 - DNA, 1666 bp, Oryza sativa
aggattatgctctaatttggtgggagcaattgatgaatgaatgagaagagaatggccaagatgaaatgaaggctgcaatgagagcaagatttattctgaggcattactgacgtgatctttttgatagattgcagaatttgaagcaagcaagttggtatgatgaggaatattataaggagatggagaatgccatgatccgagctaatatttttgaagatgaagagcaatccattgcaaggttcatgtcagggttacaccgggatattcagcgaattgtggaatttcagtcatatcgtaatcttgtccagtgtgtgtatcaagctagcaaagctgagcattagttgcagcaagatgccaaggcaagaaagtcgagttcattcagttccgggttaccccaattggtaacaagtttacgccaagagccaatgtgaattgaggtaccaccataaactcgagtggtggtttacgctctaatgtttctagtttttctaatggcaaagaggctgtcatttctagtgtgaagagtaaaccaacggtctcatctactacctcaattggctctacttctaggagtcgagatatccaatgcttcaagtgtggaggccgtgggcatgttgttagagaatgtccaaacaatcgtgccattattgtgattgaacatggagagtttgattcagctagtgaggtgtaagaagatgttcttgatgatggaaatgaagatgttgttggaaaaaaggatactcaatgtgagtttgaataaggtgctgcacttgttgtgactcaagttctgagtgtacaacttaaggatgctgaaaatggacaaagaaacaatctttttcagacccgagctaaagtgggaggaaaggtgtgcaaggtcatcgttgatggaggtagctgccataatcttgcaagtaaggatatgtgtgacaagcttggtctgaagttgttgcgacacccacatccatatcatgtccaatggctaaatgatagtggagatatcaagattgggcatcgggtgaaagtttcttttaagattggtgaatatgaagatgaggttttgtgtgatgttgtgcctatgacagtgtgtcacttgctgctgggaaggccatggcaatttgatcgatcatcacggcattgtggtcgaacaaatcaattctctatcaagtggaaaggaaggaattttgtgcttaagcccatgacacctcaacaaatcatggctgagcatatgcaaaagagttctgaagttaggatagaaagtgagaaagaaagagagcaaaataaatttagtgacatccacaaatcggtgagcaagagccacaagccaaatatgagtgataaaaagaaaagagagggtgagaactttgtgatgttagccaccaaatcagaaatgagagatgtgagaaataatctggctcaagtactcattgtacttgtgtacaaggaagtaatgatttcagctaatgacttaacatctcttcctaatgttgtttctaatcttttgcaggagtatgaagatgtttttccaatggaaacacctgctggacttcctccattgcgtggcatagaacatcaaattgatctcattcctggggctgcactacccaaccgagcaccataccgcaccaacccacaagaaacaaacgaaatacaaaggcaagtacaagag

SEQ ID NO: 94733 - DNA, 2116 bp, Oryza sativa
caaatgggtagaatttattaaacatttccctatgttgttaagtataagaaaggtaaggaaaatgttgttgccgatgctttgtattgaaagaatgttttgttgaatcaacttgaggtaagtgtgttgggacttgagagtataaaagaattgtacaaagatgatcttgaattttcataaccatatgcaaagtgtcaccatggaaaaggttgagaaaaatatcatgtgcatgatggtttcttgtttcgagctaacaaattatgtgttccaaattgctctattagactcttattgttgcaggaagcacatgcctgtggattaatgggtcatttaggatataaaaagatatacgagctgctgagcgatcatttttattggtcaaggattagaagacatgttgagagatttgcgcagcgttgcaccacgtgccataaagctaagtcaaaactgaaccctcatggtttatatactccattgcctactcctagtgttccatgggaagacatagcatggattttgttttgggtttacctaggactaagagggggagggattcaatttttgttgtggtcgatagattctcaaaaatggcacattttataccctgtcatataagcgatgatgcttcccatgtagctgatttgtttttcagggaaattgtgaggctgcatggagtaccaaagaccattgtgtccgatcgtgatgtgaagttcatcagctatttttggaagacattatgggcaaaacttggaaccaagttgttgttttctacaacttgtcatcctcaaacagatggtcaaactgaagttgtgaaccgtacactatcaacgttgctgcgtatgatgatcaagaaaaatttaaaagagtgggaggattgcttgccacttgtggagtttgcatacaacagggcagtacattctaccactaacatgtgtccttttgaaattgtttatgggttcaaacctactgcaccaatcgatttgttacctcttccattgtaggaaagaactaacatggatgcttcgaagcgtgctgcatatgtgaagaagattcatgaaaagaccaaggaagaaattgaaaagaaggcgcgcagtaatactgcaaaggtgaacaagcatagaaagaaagtggtctacgaaacaggagatcttgtttgggttcatctacgtaaggaacgatttccataaagacacaaatcaaaattgatgcctcgaggagatggacccttcaaagtgttagccaaaattaatgacaatgcatacaaaatcgaccttccgggtgaatatggcgtaagtgcttcattcaatgttgtgatcttacccattttatggttttgatgaaacagagttcaggacgacttcttttcaagagggggaggatgatgtgccccaacccctgtcacatgatgatgagcacatcccagctacacctgacgtaaacaagggtgatgtaaacaatggtgatggttcacatcataagtcacatgaggaaaatgaagatgacgtaaatcatgttgatggattatgtctcaacaagaacgatcaagcatatcatggtccaattacgcgcagccgtgctaggaaaatacaacaagaggtgaactcgctctttgctcaacttaatccaaatttttgtgagaattttatactacctaaatgctctacatttttattgctcaggtttacacccgaggagatcatcactacaccaagaaggatgggttacattgaggatgataagggttacgttgaggacgataaaggtacgacgaggaagaaccagcccatcccaaaccagtagctgtctacgccaacaagaagatggtttactctgcaaaagactcaacttccaaggcttgtgtgacccaaccagtcaactttctccatgcttaatatatatggttggaaagataatcaggtctagtttcacctccaacaaacggctcgtcatttcgacttcccactaaggagttatggacaaatcattgaagactgctcagaagccaaacagacgcgcgagtcttctcgggaattcacttattatgacctttgaactagcctatgtccagtaaactcccaagacttttcattctcatctaggagggttgttcctagtataa

SEQ ID NO: 94734 - DNA, 2984 bp, Oryza sativa
ttgtgccatcatgttcctggtggatgtcggttcgggttgtggtcctcgcttgccccggcgttggccttgcagaccgaggttgcgcttagcagggcagctacgacgagcatgtcggcacggtggtggtgggcaagctgaggtgggagattgcgtgggaagtatggatgtgttcgacgcggtgggtgaggaggaaaggcaaggcgacgacgcggccatcacctttataggaggcttcggcgcgcggtcaaagcatgtagcggggctggcgatgtagttgttggccgtcacagcgtcatcctcgttcctcaaggtttcgccggtgaggtatgggacacacatcggttgggcggactaagaacgcacggagtggtgcacggtgagcttgcatggcggtggctccctagctagggttagagctcagcacaacaattattgacggcaatgggcatggttgttagggcgtatttcgttggagatctcatcaacagaaggagtagcattagtcccggcgacttaccggtggtggtggtcaactttcgtcggggcgtacgggaacgagacgaggggaggatcagctcagctcggcggctcgactagccagaaaatgccacaattgggcaactaagctggtccggcctagctcggctaggcgagaaggagactgaaaggaagagaaaagggttgagggattggatttagaattataagggagttcaggaagatcagttgggaggtttgggtctcggtaggctaggctagacccaccagggagcaagaatagacttttgctgttaatttcataaaatagttccttcatgattttgttttacataaaggttttgaaaataatattatttgactttcaatgataagcgtgggcagaaagagaaaaattcggaaagaaccagcgtgatgcaagttttcgcaaaaaacgttaaagccatgatttttattttctgaattttatttatgaaaatttcatggtgtaacaggtggcgagggaattgggagagcgagtgtgcctggacagggtagtttctcaagagttcctcgacatgataagtagtttgcttcgggttagattcaaatcaacctgataagtagtgtgctatgatgagtttctcaagaattgttgggtacacttcactatacgtacatacgtacttaaagtatgatttatcttttatatttgcactaatttttcaaataagacaactagtcaaacattgtatgtagtgaccactaatttggaacggaggtagtacaaaatattctacttcaaattcgatagattttcacaaaagtcttcttgtgagaagatgtacgagtgattgatagacaggatgtacctgttgctaattgacggaatcctccctaacatcggagacccagctcaggcatggtggagtgtcaaagcatccggccgacttgttccacgcttcaattccatccatccccacgagctgtctacattccgatccccatcccgggtctccatcccaaccaatccatcatcgaaaataataaaatcaaacacagagatagagagagagaagataaaaattacgaacacgtatgtccctactgtccaagatggaattaggtgggcaatcctaattattgtgcacttgatccagacaagtcaaacgaaggtgggagggaggaagcagcttcgccgtgccgaactacttcgtacgtactattactagtatttccaatcaacgccacgctgtccccaacgaacgaaacgaaatatacaactagtttccaaggagagcaatcatcgcctacatgttacactcggctcgtcatgtgcggatttaagccttagaacaaaaacttgtatatgttaggtgctagctggtgatcgcagctggttggtacctctgggctaagcttctctcaggagtccttgcgtgatgtcgtcgacggcgtacacgcggccgtccaagccaccagggccggccggagagcggaggcctccgcggctagccaaggagcttggcaggatcgagcccaagaagctcgggattgggctggtcgccggctgctgcctcgctctcctcacctacatctcctttgcccgccttttcgccatctactcgccggtcttcggtgcgccacttaattatttcttgttctcttcgtgtgaaactctctttttttttcatacttactgctacaaatttttcgaaattcttgttagagagcacgtccttggtgatgaagaacgcaccacctgcgtcgactcagcagaaccctgtgctggctcaacaacagagcaaagaagaggacgagaaagatgttggtgaagatgagacggaccggaaagtgccaagctttgcggagacgacagaaaagaatgaagaggaggaaacagtaacgaaaccatgtgaggcttccttttttttatcgctgtttagcacctcgagtggaaaagaaaattgaacacagaacagttttaatactgacagcatctatctttcagaatccgatccccgcataaaaaagcgtagctctaattcggaattcggttctctcgtcttgtaatttcgttcatgtaggagtttcatccatagtagtactaattaagatgctttgtctgtgattccgacagccggggacgaagctgaggccacaatctcctgcgatgagaacggcgttgatgagggcttcccatatgcgcggccaccggtctgcgagctcaccggcgatatccggatcagcccaaaggagaaaaccatgttcttcgtaaatccgtccagcgccggcgcgttcgacggcaacggggagaagaagatccgaccgtacgctcgcaaggacgacttccttctcccgggcgtcgtggaggtcatcatcaagtcggtctcgtcgccggccatcgtgccggcctgcacgcggacccacaacgtcccggcggtggtcttcttcgtggccggatacaccgacaacttctttcacgacaacacggacgtgatgatccc

SEQ ID NO: 94735 - DNA, 738 bp, Oryza sativa
  unsure (1)..(738): unsure at all n locations
caatcgcccggaacggccgcgccatccccggccaccttccatggcaccggccgtgtttcccgtcgccgttccgccctctcctatgcccggctccctcccctcacctataaaatggaatcccctccttgtgttctctcgtttttgcctcttctcgagtcttataaaggtccctagccacctcaccgccgtcctcctctctctcccgtgccgccggccacctctaaccgcctctccctcttcgcccgtgcgccgaccggccgtcctgtcgccatcttcggccacgcagctgcctcctcttccccggtgtgtcctccgttttgcacggagaccaccggagacacattcctgccagcgtccagtggcgttgccaccattgcaccatctccanccgcccctgtcgtcgcgccagatcgccagccgacgtctccatcaccttccctggtactgcggcatcgacctccaccccggcctgccctcggtttcgtccgaagaccgccgccgcgcgccggcctcctcttcctcctcgttggcatccagtacctctcctccgggcggctactgttcctcaccggtgagtcagccgacgtcgccgtctcctcctccggcatcgcagcggcaaggtagtcctcgacctcacctcccctccatccgaaccccgccggtcttcgtcgtcgtcctctcgtcgttcccggttgcgctcgtcgtcggccctcccttcgtcaagccatgctcgttcgc

SEQ ID NO: 94736 - DNA, 1309 bp, Oryza sativa
atgcaagggggtacaaggagtaataatatagggttgagttttgaagcaaacaagcattcgaaacaattttagttgatcaaagccactttataactccaaccttaagtctaatcatgattattaatcaagcccatgaacccacacgaacatgccttaacccaaggactacgatgagttagaccaaactggcagccttgttgcgggaccccagctcatcccaagccaacctaggctaaccattctaggttttagttgattaaccaaattttaagagggaaaccactaacttgggtacattgtaggcttgcacataaccgagggcacggctattcgaatagattatactctaattagagttgtaaaactttacccaacaagacgcaatcttgacatcatgtcaaccatgaatcgtcgtacctttaaggttcgcgaaaaggccaagattgtgacatagttcttcacctatcctggccttgaacaaaagtaccgacccaactcctgcctatggctgggataggtaggttatgattgagccccaggacatcagaacatccttcgggagggaccacccggatgtccgtccagtgccatgacatctcgattatcgaagcacccgcccgataaccttcatttgtcttagagatatcctttacccgacttcatccatatctatcagtgtcctttcgttcatgactagactgagctacaaagtaagccttacccattagacatgtgaaagtacgacagtgctttgcaacagaggcctaaagaccggtccttatgatggccgaggatcgaccatcaaaaccctgcaccccgagcccagcttgaaaccattttggagattttgaataagggaaggggtgtttgtccaattccaacatgagctaacaattccataatgtctaggtgatagaatatacttcccaaagtctaagattataaagccagcaaaagttgtctagttaaccagcgaagcatctagctaaattcatactagtggagccatagatagagtatacattagttggggttttattttcctatggtgcgcaaggtgataataacaatagcaatggtaagactataacaaagattaataggaaaagctaagtaaaacaatgataacgcgggaatttaaataaagcggtaatacagtaattttaaataaattaatttcaaaatcatgggattcaatatgctcaagaatgatgtgacttgctttgctccgatagaacagtcttctgaaccttcggcgacgaacacgaaccatgctttgggaacgtttggaacgacaggagctacttga

SEQ ID NO: 94737 - DNA, 1946 bp, Oryza sativa
aaaaaatatttgggccattgtaattgaaaataaaaaaagcccatgctatatgggccgaatgtgaattgccacgtcatttgccacatcacccgccttgtcatctgcaacatcacatgtcatcgtacacgtggcgttattcggttcaatttgttatgacgaatttgtctcgtcattcatcaatgacaggagaactatcgtcactgtatcaatgacgatgtcctttggcggcacagaagctggttagcgactcaccttctgtgatgacaaccattttgtcactgcgggtagtcagtgacaggaaacaggctgttatcttcataatgtaatcgtcacagaagcccagaattcctgtagtgttaattctaatggctaggcttcgtggagaaggcttggcgtggtggaaagctgagtggtattgttttcttctccaaaagaagacgcatgccacatgttcgacgaaatgcctacaaggacagggagagaggaagggaaggtgggaaggctgggtggtgaccagggctttcctactggctggataccggggccaaggaaggctggacccagtggaagtgaaatagggtagggtgagagaaggtcaagttgaattttctcaaatttaaatcacatgctcacattatctctttgaccagccatttcaagtgggttactccaaggcgaaatttttggcaaaaatattgtgagtagaggaggtcatgatgaactacatgaaggagaagcaaaggcagaggagttatggttttactgtggtagattttgaaagaggactaagtgatatgctttaattccagtttttgactggtttgactaaataatttgaggtgccaaatgagctgataaaataatgccaatttaattgagggtatagcataatgtatagtaattttgtgaattttttcaggatttttgcacacacatattaattattaaaattattccaagctagtttccatgcatatgaatgaaatgacggatgcatgaaaaatccaaaaacgagcaaaataatctcaaaagacagaggggaccccatttcactgattataatatgtattcaaggttttacaatttttgggtcaattacaacctaccccccttaaaatgaatctcgtccccgagattcgctaggcctaggaaaagaaacttaggaactcggttctaggacggtcctctcgctcccatgttgcttcgtcagcggtatgattgctccactgcaccttgaccatcttgattgtacggttgctcaagaatgcgaatcgggtattcccgataagaaagacagctgagagacatggaagacattgtgcacatctgagagttgtgatggtagctccaattgatatgctacttcgcccgtcgagcaagtatactgtatggatcgatgtaacggggagccaacttgccgtgcacttggaagcagcaagtgccccgcagcggcgagaccttgagatagacaaagtcacccacctcaaagctcagttcatggcggcgacgatcagcatagctcttttgacgcgattacgcttctttgagccgtttgcgaatcaattcaacatgttcttccgcttctttaataaggaatggtccaaagaattgcctttcacctacttcagaccagtacaaaggtgttctacaccttctcccataaagagcttcaaaaggagacatttggaggcttgcttgatagctattgttataggaaaactcggcaaatgccaagcatttctcccaattggtgtttaggacaacacacaagctccaagcatatcctccaaaatttgatttgtacgttcagtttggtctccaatttgagggtgaaaagctgtgctaagaaatagctcagttccaagtagctcatgcaaacttgatggcattatcggccttgatttccccagtaggcgtcgcttcaattcacttgatgaatttgtcga

SEQ ID NO: 94738 - DNA, 828 bp, Oryza sativa
tgtagattttgatgagactatccgcagggaatttagatgaacatgatgggtgagttatcgtactttttgggattgcaaattaagcaaacacctcaaggtacttttgtgcatcaaacgaagtatacgaaggatcttttgagacggttcaagatggagaattgcaagccaatttcaacaccaattggttctacagctgtgttggatcctgatgaagatggtgaagctgttgatcaaaaggagtatagaagtatgattggatctttgttgtatctaactgcttctaggccagacatacaatttgctgtgtgtttgtgtgcgcgctttcaagcttctcctcgtgcttcacatcgttaagcggtcaagcgaataataaggtatttgaatcatacacttgagtttggaattttgtattctacttcatcttctatatgcttaagtggatattccgatgctgattttggaggttgtagaattgataggaaaagtactagtggaacatgtcattttcttggtacatcattgattgcatggtcttctaggaaacaatctagtgttgctcaatcaactgctgaatcttaatatgttgctgctgctagttgttgttcacagattctttggcttttatctactttgaaagattatggtcttacttttgagaaagtacctctcttttgtgataatactagtgctatcaatattgctaagaatcctgttcaacactcacgcacaaagcacattgatattcgttttcactttttgagggatcatgttgagaaggaagatgttgaattgcagtttttggacacaaaagtgcaaattactgatatt

SEQ ID NO: 94739 - DNA, 1743 bp, Oryza sativa
gcgccaccgcttgccgctgctgccgttgcttgccgccaggccgctccgccaagtacatcctccagctcgagcacgactacccctgggacgacgaccccaagtccatcagccgcctcatcttccagcagatgatcctcttcacggccgccatggaattcgaggaattcaggggagacgtggacttctgagggaggtttcgtggggtttttaggccagtgagggaccggctggcggcgagaggagtgcaggtctgttgggttgccgtcggcggctgcggcgagggggttcggaggccggccgctcgcttcgccactgctgccgccgccgccgcctcctgctgccgccgccgccgccgcccaccgctcgctgctgctactgcagctcgccgcccgccgcttgccgccgggccactccaccgctgccatcgaacaggaagaagaatggagaagaaggggaggaaggaagaagaagggcaattttgtccaatcttttttgtaaatgcatccaaatggtaaatagtggcatgtatcaaatatgtgtaaaattataatggcatggttccaaatacttgaatactagtggtatattttaaaaccagcatatttttaatggcatggatctaattaatcctatattaaaagagagagagagtatgatctattatacgagaaaagataagggatctagatcatactctcttggtcagcaagatccatcatttgtgcgtcactatgaaaaattgaccgattggttcaatagcaaagggaaaatgtcaacaatgataagaggagccagagaccatccttaatttcctggtccgtcgaccacatatctatcacatctaccctttataacttgaatgatattttagacatttcttaaaaagtatctacttcaatagcatattgtataaaaagaaaaagttaatagcatattatagagggagataaagtagatggcaaattgttaaactagagtaaactcagtggtatataatagattctcatagtaccagctgaaagtacagtgaggtttgccaagaggcccttagaagatggccaaattacacttggagcatataaaatgcaaaggactctaaaagaaagagaagtacaagtccttgactttgcagtcttcgcaatggtggcagccagattgacgagggtgacgacaacaggatcgtagaaaccgtggtgaactccagaaagtaaagcccagacacgaacccaaatagggcctctcaaaagtggaggtcgaggcaaccttgacaagcagtgaataatatcaattgtaactaaaagtgttgtcattggaaaccccccccccctccctcagtacaccaatgaggagccccggaagtaaaggagggtgacgggccggagagaagggtttttttttccaacttgctaggagctagttcgtgagatcttccggtagtaattttttttatagttcttaatttacaccattgagattgccagtcgagttgagttcactgataatgtggcctaataggtgagttcgaaaaccaaaatgatcaagaggcaaactttatggtagattccgaaaaaaatagaaagccagtagtggtcaattaaccctcgagctaatttggtcccatttcctatgagcatatctataatctatactactttaaaagccagtagtgatggtggcattgagactatctccaccacttccatctaacatgtgggacccaatagtagtggcaagaggagatgt

SEQ ID NO: 94740 - DNA, 664 bp, Oryza sativa
tgtccgatacaggaatgtcacgccgctttcaaactagagtctacaggaatacacgatcgaaaattcagataacaaacctgatatatattatacataataatgagatgggagctacaagaatcatctgcgctaatgtttcaccaacgctagagctaaagaatatgtttcgaataaacagaataaactcataagttaaacttctgaacaactgcctccatccacgcacggacagccaactaggcgtctaggccaaatcaacatgagatgaacttgcatggtcagaattgcctgcttccaccttagaaaccgcaagaatcaatcactgtcgtgctcagcatctgcagaagcatatggattttattgagaaaaagagatatggaatcgcttggaatgcgaaataacactgaacatgctgtaaatgccactggatattcccctggatgcaataactaatgagattataaatgactagctggtgacagtgaaattgaaataccatgtattattgaatcttaccatcagcagatccatcgccagcttttccaacatcattgtcaccttcatctccaccctccacattcacctcctcatcattgtcatcttctgcgtcttcttcgtcatcttcatcactatcagctactattttaaggcgtgggcaggggta

SEQ ID NO: 94741 - DNA, 1682 bp, Oryza sativa
cagaaagagtcttgatgtaattcggaggagataatttattcatttggtaggaattactagctaaaataaaatatatgccacatgtcctttttcttccatttatccatggggtagaatttttagattccagttttgtgtcattgtagattgatttttatgtatcaatctaccaaagtatttcaaaattctttagacctgttgaggaaagcacagataagagaagcactgtaggagcctctgaatatttggatggcaatcgatacaaataagacgtgccagcaagttcagtagtcaatttataatccagagaacagcaaagcaatgtaacattagatggtttgtgtgaaccaaattgtacacaaattcttcttgagcgagtcagtctcaagttacactagtcaagtagtcagcatcacctgaaaaaccgaaggctctacgggttcatttgttcagcaattcctgaaggagtggtacatgaagtggggaaacgaaaaggatgtaaccacagataggtacatatttccttctaacagcaggatctatgaaggttaggaaaacatatgcccacaggcatttccaaacacacaaccttaatgctgaaccatggggatgaatcttgtacaacttgattactcttgagctgttgcttgttcagaagattggtcaatatgctgcgaccgcacagatgttggtaatgatgtcacaaactctgctatcagctccgagagttcatcatacgcatcctcctggaattccaaagtaatgagaataatattatcaccatactctcattacctcaatttgcaacttagctacacaagaacttcatatacaccaatgcatgaacataaatggagacttaaaatagcagtaatgatgacttcctgtatagaagtacctaaaaaactggctttagttaaataaggatcccttatagcagggaatcaacacatgatatgagaataatatgggcagccaaataagtgagaaggtgaattattcagttagctggtcttgatgtttgcaatgagacgatgggtgttgagtactgctccgttctagagattatttgcatccttagccaatggacacctgatgcttgtgctactaattcttaacaaaacatgatggatcatggtgagctgtatcagaccagcgacattggtatgatgcatagtaaatcactagttaacttaaagtagagcttgaaggccaacctgcccaagcaatcttgcatgactgtctgtagtttgaacctttacatcagctaagctatacattcagcacaaagctaaacactctttacattttgaattgattatgaaaaagggaaccatcacactgacctgaggccattggccacccggaatggtaaaagaatttggcatccggcaaagccgcggccaccttttttcccttattggatcacctaacaggtcaaggaaccggccacaggcccattaatggccaatttcttcctggcttcaaaaaggcccttcaatcctttaggataaaggttttaattagagcctttcaatgattcaaccatggaatcctttttcccttcaattggaatcgccgcacgggggggcctaggcgcaacttcggggccaatttccgggggaagaacagcggaagaagtcccttgaacaatgcgggcaccggcaccaccatgctcccca

SEQ ID NO: 94742 - DNA, 3759 bp, Oryza sativa
caccaaaaccaaacccacaaacctttgcaaagtaaggaaaaggacaacatgtgatgtaatgcatgagaaatttcttaagtttaagatcagttaacaatagctgataaattagcaagttgtgtaaagtgtgctcacatctgatgatggtatcttgttattaacatagagccagagccaatgttaccgccactactaaccctccttagccagatttcgcaaagcgccaccactaagtaggctattgcaatcctctgcgtcaagtgtgtaaaatatcatgtgtaaaaagctcttatatattgctcacagtagggactgtttggaactttgtgtttgtacctgtagtacacccattaaccgaattttgcgaatatcgacaccataggtaagttcatggatgccatggaagaagccacctaacatgatcattccagtgggaattcaatagttattgtgctttatgctatatatgtggatgatatatgcttcgtacacctagatggttagatcccatatctatggctttatttcattcaattcctagattgatcccaaccctataagaatttaccttgcaatataaggcccacaatgaagagttttacagccctaagcatggcctttttggttgctaacattttgtctggcactttctgcacaaatcatgaattaaccagagttaggcggtttccgatttaatttgaatgatatgcacattactatttggttactataccttataggcaaaagctaaggagaccccaacgatgaagaggaagaaggggaagacaaagtccgctagcgtcacgccatcccatggagagtggctgatcgccgggacaatgccaccaacatcatccacgaggatcataagctgcaatattgtaggtgttttttagcatgatctacagacgatatatatagtaataactttaatcaataagttttatttagggcccttggaatgtaccgataggtaccaaaaaaatatcacaattttgtttgtcatttggggagttcaaaaagtagcaagaattatgggagtacagtaccagatagcacatcacttagtatctccaagaccgtaaaatgtataaattaactatatgtcaactaggggaaaaagctagtgtttcaaaagaaatatcttctactccaggtaattaactaaggtgttcatgcatggaaggaagtggactggttgaagatatactgtgcaagtactatatatgattctttttttctcagatcaaaagggcaaagccctattccatttcttaatttatggaaacaaaacaaatgttgagagcatatatatatttagaggtacctgtctatctttagttaaaataacgtaagatatcataataaaggtttgacaaacttcaccaagttgggaaagttcagctttatggcttacatatacttggttctttaacccaagagaaatcaatagaatatatacacatgtacatatgcatgttaatctattaggtgtaggtacacaaaagtatttaggtttatatttatgtacataatggattaatatattgatatccaccggttgccaaaaaaactcttattagttctttgggtggttcaaaaaatacgatggggctccacttgcaccgttttttctcaaaaaaaaaatttgatgtgggaattttaagtagatttttagtcagtttctgacctagcatggcaacaagaatgggtaatgaaaatggtgaacgccccccccccccccaaaaaaaaaagaaaaaaatcaattaaaaaataaaataagctatactgcagattttcagaaaaaaaaaaagctatacgagacaggccaaagattttattccctatggcaagggtcacggattgaaggtggaagctagtcctacaagtatgtcgaatattagctagtagctaattggtttattataggtcattttctatttagcttatcagccgaagcgaacatttaaatattaaagcttaattttagagttaattttaatattttttcaccaggagcttttaagtcacaaataacaaatatataaaatatttatgcatcaaattatttttttaagttgctaataagtattacgacttataatcaatggtagacgaaacgatgtgactattagttttttttaaaaaactctcttcccattaaagaaactatgtcaagcctccttttggaattaatggaggattttatagagatttttgtgggaattgaactacttatgtgaaagtcatacaaaactaataaattccaaaggagtcctaagtcatttgttattgtagtccatacctaatacatcatattttgagtaaaacataatataattcaaaaaatatcgaccgaagaaatggaaaatacaaattgcttacgatacaaattggatccaacgcgaggcgacctcgaatggccgcctgggtttgtcaggcaaacacacaatggattttgaatgtttttgttaattagaagcaaaatttagcaaaaacttttctctatgtgccaccgctagttataccttttttttaacatgtgggtgaattgccatgcacgtatatattcatttaggattaatcgtgtccaagtatggttgacaaacagtctaacacaacggctatatatatataaatattgttaccctctctctcctaaaatatatgacacaattgatttttcacataacatttgaccattggtcgtcttattaaaaatttagtataaatatgtaaaagtataagttaatattataattttattttatgataaaacaaatcactgcaaaataaatgatatttatataatttttaataagataaatgattaaatattatgtgaaaaatcaatggctttatatattttaagacggaaagagtattaggaattcaccgacgaccgcgacgcggctaagaaaaaaaaaaagaggcacccaactttctgcatggcgcgaatccggccgtccatttcggctggagctcgcgcgcgaagccacagccgttagttaattaagctggtagtgataccgagcatatatatcttctgttttatcctcttcgtgcccctattcgatcctcctgtgatggagaagcaacgacgacacccctcgtggatgataatagatagacagatatattatgccctcttcctctatcacaattctatagcattattctcctccacttatatctgatatgatatgatatgatatgatgtgataagcgctgtgcttaatcatgtcaacatgtcactggcttattaattactatattagtattactttctttagacgtgtacctttacttaattatacttaatttggcgcagtttaatttagctttgcgtggaatataataaacgtgattaatggtgatcgatgctagaagataaatggaattaatgattagagaatatgttcactggagatggaaatatcatgggaattaattaagctcaccgcgacggtgattcccctgaagacgtcgagcgacacgaggcgctgccgcgtcgtcgtcgccgcagcctcgccgtcacggccgaggacgcctgcctcgacgtcgtcgtcggctcccttcttggggtattcttctcgaccattgttgccgccatgacccctgctgctgctgctgatgcacttctccgtcgtggtcgtaattttcattgatgaattcacaagctagctagctatagctatacttgatggccaacaatccttagttgttgccgcgatttggcgatgagccgcagctgcatat

SEQ ID NO: 94743 - DNA, 962 bp, Oryza sativa
agctcgaatttgggtaaatgctttcgagcttttttttatgtcgtgttttcgaggtaaggcaaaaccttgttcgaaaaccgccgtcccccttacgtttcaaaggagtgacgaggtcgaacgtgtttccctcgtcgcaattactttttagttttcgagctcgaatttgggtaaatgctttcgagcttctttttatgtcatgttttcgagctaaagcaaaaccttgttcgaaaaccgccgtcccccttacgtttcaaaggagtgacgaggtcgaacgtgtttccctcgtcgcaattactttttagttttcgagctcaaatttgggtaaatgctttcgagcattttttatgtcgtgttttcgagctatggcaaaaccttgttcggaaaccgccgtcccccttacgtttcaaaggagtgacgaggtcgaacgtgtttccctcgtcgcaattactttttagttttcgagctcgaatttgggtaaatgctttcaagcttttttttatgtcgtgttttcgagctaaggcaaaaccttgttcgaaaaccgccgtcccccttacgtttcaaaggagtgacgaggtcgaacgtgtttccctcgtcgcaattactttttagttttcgagctcaaatttgggtaaatgctttcgagctttttttatgtcgtgttttcgagctaaggcaaaaaattgctcgaaaaccaccgtcccccttacttttcaaaggagtgacgaggtcgaacgtgtttccctcgttgcaattactttttagttttcgagctcgaatttgggtaaatgctttcgagcttttttttatgtcatgttttcgagctaaggcaaaaccttgttcgaaaaccgccgtcccccatatgtttcaaaggagtgacgaggtcgaacgtgtttccctcgtcgcaattactttttagttttcgagctcgaatttgggtatatgctttcgagcttctttttatg

SEQ ID NO: 94744 - DNA, 915 bp, Oryza sativa
gtggggagggaggcgtcgtggctatgccgacaatggcaagacaaggtggaacaggagaaaaacgaggaagggaaaggaagagggaaggaggagggaagaaaagggtgggagttgccatcgctagcggcggcgacgctagtgggacgtggccggcaaacctcctctcggggctggtcggctcccgtgtctatttaggagaacggcacgtgagtccttttttctctgcgtgtatagacaataaattgcttctttttaggcccttctatcatgcaactagtgcttccaaacaaatccctataacaccttgtaagccatagagacaagcattgttcatgtcgttctgtaggatcatcccaattccgtccgtgcaatcgtgtggtctgattgagtcaacaacattttgtttggtggaagaaaactgatggatcacctattcatttatagggataaattgagcagatacctattcatttatagaacaagtggttagtaaaaaatggtttttttaaaagaaatgtacttttagaaaagtgggggcaaatagtaaatgacaataattcaatggataatctgaaaaagaacagggccttaatttcatctaactgtgcagtggacatgtccccttctacttcaataggttctcctgttgaaaattaatgagtaaaatgcaccagcggtccttaaacttgtcaggaggtttcacttaggtccacgaacttgcaaagagcacatcgaggtccctaaacttggtttattgtatcatcccagtccaaagccgcgtttgactgtggtcttgcctacgtggcacgccacgtggacgatgacatggaatttttttatttttttctcttcttccttcttttttctctttcttccttgtctaaaagatgaaaatgcctcgtacacatcatcgtc

SEQ ID NO: 94745 - DNA, 1299 bp, Oryza sativa
ttttgttttcgttgtttaccatttccatatggcttggtcagtagaaataaaaaacgagcgtccgttggttgaaaatttctgtgaccattttcaaccctggttggcattggtgggtggccataggcggcagagcagaaatgttggaaccttgtcataagctcatatttggggctatttagaactcatgatattctttttccgcgagattaattttcaccctgtttagttcaattcatgtagaacttctttgaaatcctaccatttcaaactagggctttgaatattgcaataatcgacgtatgcttcatgcggggaacaagctaggggtcccgagatcgagagtaccccgcagctgtgcctatcaattgcgttgtttggatcctagctacagatcgaaaacatgtaccccactaagaaatgttcgtgtctacatacgacgaggagctcccatttcaaacacttcactggctcactgccgcattatattggtatactccctccgtactaaaaaaggaagtcgttttggacagtgatacgatttccaaaacacaactttaacttttttctataaaaatatttattgaaaattgatatatgtatacttttatgaaagtatttttcaagataaatctattcttataatttttacatttttaaacccaacaacttaaagagttattcatgatttatatttttaagatttgacttaaatattattctaaacgattttctttatgagtacggaggcagtacgcagctaggccagctgggaatacaaaacatttatgcatctgtcctgtcacagcgtttagcatctattgtgactgggtcctaacccctaattcctaaactcatctattgtcgacgggaaaagcaaaacgtggcgtgcatgtccggcagagcatatacatcggtatgtcttgaagaaccgtcggaatgctatgctaatgtgcgtgcccatcgtacgggatgtttgatgtctccgacattacatttcaggggtgcgtagagaacacgcgtccgtacgtggtggcgtaaatgtgatacatcttggtgttgtgtgctactgcctaatactagtaaagctagattgatgccaaaatataccatgtactccctttataaaaaaatataaccgacgataataaaaatttgaaatcacatattttatgaatctggacaacctcatatcatatccaaatttattgttctagatgttgtcaaatggttgtcttttttttacagagagagtattagtttaaaaaggtaaatggaatgattttggtttgaagtcaaatc

SEQ ID NO: 94746 - DNA, 1116 bp, Oryza sativa
tgtcagcggcaaccctcactacactgcagaatcctctcgtgatcagaggttgaagacgatgaatagtgaaatcgccaagtgttcgacacgggttttttggtgctgcgcaacaacttacagcgttttctgtttacttcatatataaagaagattacatgctaactgaaaaacgagaagaaaaaggaagtgctgaagtggcctccgctatgtgcgccagtactccctaatgacgtgcgccatcccccacgtcgaagcactagcgtggtatacacgctaaagacgcgttccagaccatcgtggccaagaactcacacacgacgctcacgccgcgaacaagccggcgcgctcatgcaacaaaccaaaaacaatgacaagatatgcaacagtgccatgcatgattaaaatgacaagctacgctacagtgccacgtatgattttttgacaggcgcaggattattccacctaacacacatcgttgttggaggcacgtcatcgccgccacccacgtacgtacgtcgccgcctccaccagcactaccacccagcaacatcgaggagccaccgtgcgacgacgccgccactgcagccacccacatgatcagcaacggcgaggaactccaccgtgcaccgccaccgcctcaccgtcgcgattcgcgcgtacgtgtacgtgcaacctagctccgcccaaaaaatgttatgggacgtgtgcgcgcgacacggctggcgcgcgcggccacagttgtgatcggtgatcggtctcaggaacgcagcaaaacgtacgtactgttcaccgcccgcgcccccgcgcggttgcgctcgcgcatgcatgcacagatcaggcgcgcgcggcgtgacatgccagtttttttttccttttttttcattctgtgccaatgtagcagcagctagcttagctttaggtagacgcacatgcgcgctccagagcgagcagcaggtgcgcgcgccgtgcgcggccggcgagctagcgagcaaaatattctctcgcgtttgtccggccggctataagcttgccgtggcgaggcacagattctcagtgaagctgtgctgcgccatagcttagctagctatagctcgccctgctgcgtttttggtcctt

SEQ ID NO: 94747 - DNA, 865 bp, Oryza sativa
gtttgttatggtcaacatctatgagcccatacattcccacaggaggtaaaccgttcgagctctgccattacagccacccaacagaagcagaaaccctagtaatggccaatgaggcagcgtacacagaggggtggttggcttggctgcatatacatatcctgatcgatcgaaaagcccaaatttgcagtcttttcagcatgggatgcaccgcagaaacaagggatgcattcaatcttccatgctgctctgttcattgtgtttgggagatttggagcaacacatgcatgtacaagggatgtgatcagagagcagttagttggcagtgtgatatatgtgtatatttatgcactggctgcattgtaattgatgagcttgatgtacacatgtaactacatgtgtgtgtctatatatatatatatatatatatatatatatatatatatatcgtgtatatataccctttctcgtggtttcataaaatctctctataatttttttaaaaaataagtatataataacatatgtactgcacaaaagatataccatttaatttcatttttatgagcttaatatagggtcattttgaggttatttaattgcttgagcatgccctctttgtataatttgcatttaatttgtctgcagctgttctcaacattgtcatccaaggtggtaactgattgatctatatcatgggattccatacttgattcccaaacagatgtcctcataataattcttgtcactttgtttagttttagagaggcatgcacatgtttatatgcaaccaaaaacaggaagctgtttaggctaagtaatgagccacaaccaaaagtctgttccaaaaggacaagtagggcccagg

SEQ ID NO: 94748 - DNA, 1081 bp, Oryza sativa
gtgcatgcacagaaaagtggaatcttttattaggcaacctgatctgacctgacctgctgcttgtactcctatttggacacatgaaaaatgaaaatggtaggagaagcaagggccatatctgggcttgtagccagtgaacattggacttggaaagattcatcaaaaaaaaattttgctttcccaaagctgctgctgacccagcacctttcagaattctcagatcggatgcttgtcttttgagttttgagccttgaccaggttaactacatactcctatgcaacttcctttctgcaagctatgttatgtacagtacatctgtacatgtatgacggccgctgtagataggactacagtgctatgttgccatgcatgctctgctgcaccttttgggctgagaattcaatgttgtttaatccttttctgctagggttggtactatagtagggatagcattcacaatgagttcatcagctggagccaatattcagctcaaattaaggcaaagcatttgcaagttaatccggtcgccagtaatgcatacacctttcatcctataaaaaaacacttgtataatatatatatgaatttagatatattcaaattcatgtttaaaagtgaacttattttgagacaaatggtgtagacactcgacgcattaataacaatgcactcagtcacactaatcaagcttttacttttcttgccacaatcttcagtatacatcagcccaacaacactccatagatcgcttatacatatatgctcaaattctggagcagtgcagactagtatcaaatctctctagtctactggacttccttgagaaaagtaactactccctctgtgaactccgtttcacaatgtaaatcattctagcatttaccacattcatattgatgttaatgaatctagacatatatctatatatctgtctagattcattaacatcaatatgaatgtgagaaatgctaaaatgacttacattataaaacggagggagtagtagtaataatacacaagatataggaatcaggtaaagcaaccaaactgagcaggatatcaccaatcctccatgaactg

SEQ ID NO: 94749 - DNA, 797 bp, Oryza sativa
attaaagtataattattttcttcaaacatatagcataaggccgggaggcgattaattgttgttactccatgagcgagcatccatgccagctcaatccaagacaagagttcgtttactcggttacgtttcagctttattagcctagttgccgcagtataggatccatcgatataattcctgacttcactggaaaactacggcggctggcctgctactctaattaactatatgtataaagttagtggaatttatttaattaattactctacgcatcgatcacaaaataatatgctacccaatccgttgcatgtagctagttcgccttccctctaatctaatctaagtatatatacatatttgtattcgggaaactaatgagattaaactggtcccttgcgtgcgtggacggacacgcaatggagaaagaaattctaattaaattaaaggccgatggagagcttatttctttcttcatttaggctgtgttcggatatgggaagtaattaaattaaaggccgatggagagcttatttctttcttcatttaggctgtgttcggatataggaagttgggaactaaactccccgcacggaaaacggagtgatccattagcacgtgattaattaagtatttgctattcgcttaaaaaaaatggatcaatatgattcttcttaaataactcttgtatacaaatcttttataaaacattcactgtttactagttagaaaagcgtgcgagcggataaatgagggagagggatcgggaaaatgggattgcaatcacagccttataagat

SEQ ID NO: 94750 - DNA, 948 bp, Oryza sativa
  unsure (1)..(948): unsure at all n locations
agggaagagtagtatcaactctggtgatctcggtaaaaattagtatcaatccaaatgactgactagttatactatatatattaaacccaatatatatacacacgtgacctttctaaaaaattctgatttttttatcatgactcactagcgcaactatttctgaatcttcttgaatcatgtttcggtacatagagcacatcgtcatattacggacaattttattcttgcacatacttagatggccaatattgaatatacccatgctttttcaggcatttggctttatccctactttttttgaaacgaatcaaccgtttgcctctgttccgttaattctggctaacggtgttaaatgtgggggtaaaaagataggtatactcttagatattttctcgcacttttgacataatcaaaatacaaatatctcaatgccattctatagcacgaatttaatttgtaaatttttgtgaaagtttaccaaaatttggatcaaatttgaaacataggaagaatcaatttacaacatgttcaaagttcgtgtcaaaatggcttatctcaaaatagggcaaatgtgcaagtggtgtacaaaagtacggggaaatatctaaggctatgcttgtcatttttaccctcatttaacaccgttagcaagaattaacggaacaggggcaaacgactgactcgtttcgaaaaattagaggcaaaaacgaaaaaaaaactgaggcaaaatcaatagtgtacattgaagcaggagcaagaacgaaantgccccttcatataaagtataattattntctttcaacatatagcataaggccgggaggcgattaaatggtggtactccatgagcgagcatncatgccagctcaatccaagacagaagttgtttactccggtaccgtttcactgtattagcctagttgccgcatataggatccatcgatataa

SEQ ID NO: 94751 - DNA, 664 bp, Oryza sativa
aaataaaagcaactttcaaattattattattgttcacaagagaatccattaactatgcctaaatggggtatttgtttccaaagctctgagtgaattcattataaatgaagccaaaggacctatttggcatgaaaaggttttcatattatccttttatgtgccccccatcaccgtcacgttgtgaatatctggtctataaagggcaggtcgaccaactgtagaatataatctatacccctacagacttcggttacacggtgtactatcctatcagctactccctccgtttcacaatgtaagactttctaacattgcctacattcatatagatgctaatgaatctaaacattattatatatatagattcatgctgcatctatatgaatgtggataatgctagaaagtcttacattatgaaacggatgaagtaccaaattctgcagtgagtaaatgaattcaaatctaataaatacaagtacaaagatcttcaaatctgcatcctatcaaatagttcacatcaagataaagaaaattatttagagtgaacttctaagcagtcttattgaaagtaaacattgtcacagtccatgtacctgctgccggtttggtggggcgggtgtgtgacccgttggtgcagcaggcaagttaagctcagaatctagat

SEQ ID NO: 94752 - DNA, 1159 bp, Oryza sativa
tgtccatgaagcttgcctcccttagccctttgatgtatgagtttggaccgggcattgatatgcacccagatgttcttcgacaggtaaagtaaaatagggaacaatgacagcatcaatccaaacgcaagcaagcatctctgaagaatctgtgattcagttttcttctgccatgcatgcgatcatatctctgactctcttagtacttagtataccttctttgtttgattaagcttgcaaagatgccacatgagatggtgcagtgcatgggccaaatggggagtacaggcatttcactccaaggactaggaggaggacccacaggctttgctcaggtcaagatgataaccatagtctctctgaatctgaactcaatctgcatgactgcatcagatgtgatgtcgcttctcctgtgttgaacacaaattattccaccaagcactcatcaagagtagtaggagtagcagataaggaaggcaatgtgacactgatcatgcatgcgctgtctgtgcttcacctttgcattgcaggatggcagcagccacattaacatggtggtgatgcaagttggagagcaaggccagcagcagggctctcttcaccaggtcgagatgagcagccactgcttctttcattagtagtagaacccatgcatattctggtaattgagatacaagcatgattgattagcaagaagcaaagcttatgttctttgcaaatggtgactgatgatgtgttaactgttgcatttaccagactaatgcagctatctagtaacatttgtacaaactaggaatggccacgaagcagcatcacatagaggaggagatgccgaatcaacaagtgaagtgaagtgagcaagctgaagaagaagagtggggcaagccgacagagttgaacctcctgaagatctcgcaaggatcctttggttgctggctcagctgtaccatctcctcctgggctccaaaatccacactatcgatatctctgccttcaccgtcaccaagactgcatgcagacagtaccaagacgaggacatgtactgttgctcctcctgcgtttcgcttcattcattcatctgctgctgtgctgttcctccccctcttctgtgtgttgcatctgtagatactctactcccttttcatgtgtttaatactccaga

SEQ ID NO: 94753 - DNA, 3121 bp, Oryza sativa
gttctatttgctttcttttttttttactattttcacctggttttggtgataaccattgtcagatggttcaattggaaaaaaaaaaggtactcctaaatgaaatcataacggtacgtagccggttggtccggaattaccaacaccaatttcaccattaataaaagccatgtcttattgttattattgctttagtcccgtgtcaaggtttataagtcatagtaaataaaaaaatcccagccgaatatattcaaattaacaacgtggagaggatgcttaatggaaaatagataaaataaaataattagtaataacggtaggagtactaatctatgtactttgtggctttcctaggtagtccggtgtcgtcttaggacaaatctatgtgtgacctacattttatggcctttcacagtggaccacgcggggcgagttgcttcatgcctccaccccacttgcgtgatgccgtggaggagggagggtgtgggccctattacctttgcataggctctcgtccctcaggtaagacgcgagttccttgcctcgaaaaaactagaaaagcagcatagcatccaaagcatcgatcctggaaagctcaccccacccccgccatgcctggtccctcacgtaccacacgcagtcgctgttgtcgaggacaccgcatcagcacatccgctaccaatgccaccgaatctgcagaggaggtgaggaggagatcgggaatggagccgccagacccgagcgatggaggaggcctccttgacctctttttttctctcttttactgtctcgtcaacaaaccgtgtgaaaggagaaagaagactgcatgtgtcatgaggtggtgtggctctaacatagtgagccgaagccacttctacgccgttaagccgtcacatgtatgtatgtatgtattgttacgtgccatacgcagatcatgttgtgttgtatgtattatggttgctgcttctaccatactatcccctccatctcaatatgtagcaatctagcatgggattagatctatttctcattctagattgatacatattggaacggatgggagtactacctaggagaaagaaaaaacaacaaagcttctgttggaagactgtagtacgaacaaacatgcacgcgtcgcgtcgcaggatgttactagttagctacagcagcaattactatcttacattttcggatttttcctttaatgatagaatttggatccaaaatctcaagatactactggtctctctctctatatatatatccatatacacgctcaagacagtagacaaaatccatagcatctagtacgtgccaaccatgaatcaatcagtaagtacatgacatcaacattactctatcatgcaagtcagctatagctagctcgagaacacagagagaaagatactgtatcgtatcaatcatcataagaagttttgattttggtcaaacttaaactactttaaatttaactaagtttatgtataaatatagtaatatttataataccaaattaattttattaaatcaacaatcgaacatattttcataataaatttgtgttgagttgaaaatattattattatgttctataaatttaatcaaatttgaagtagtctgattttaccaaagtcaaaacatcttacaaactgaaacggaaggagtagtagttattattattattattattattattattattattattattattattattataaggtaatagtagtggtttagttgtttgcggaagcataagatacacgtgatgtggacacgtgattttcgaagagattatttcttttggagtaatcaatggccaatatccacatgtttaagataaagatatgttcgccatcaatatgctgctgctgcctcctatactcctccatctaaccttcaatggatgtgacacggccgttgcaccatctcaaaatataacaaaatttaactttcgatgtggatattaaagagttaaatataacaaaattttactttcgacgcggatataaaagaggggatcatatattttatgcacaaaaacctcccgtacacacttcatacacactaactagcaaatatcacgaaaaattctataaaaaaggcatttactactaatagtattacacatatatgcaaagtctcatattcaaattcattatattttagccgtaacaaaaaaagtgaaaaatctaacagttttacaggtaaaaatctgtcaggattttgtcttttttattacggctaaaatataatgaatttaaagataagatttcacatgtaagtgtaatactattggaagtatgtgtccaattttttgtagaattttctgtgacaattgctagttggtgtacatgggaggctagtatacataggatatgtttttttaaaaaaaaacaatgtgagtaggatatgtttccataaagagagggttaaataaaattatcttctcaggatggattatatatagacctaaatagttagggtttaaataataccaaaagtactataggtagtttagggttaaatgtcacttcatacaaatattaagttgttatattttgaacaaaattaaaaatgcagaagttgtattttgggatcgaggaaataccatattatatcacctaccactaataaagtagaggttatataccatgaagataagtgtataacgccaacttaagagcgtttgaaagagaggaaatgagaaaatcgataagatacactaaacaaggtgataaattagcgtgttaaatattaattattttgaaattgaaaatagattaatatgattttttaaaataacttttctatagatttttaaagagtattttcaaatttatattaatatcactattaggcaggacacgggaggtgatgacaaccgtctcgcgtgaacgggagaggttacgcctcctgcattgcactttgctctcccaattccttattcaattccctccgccctaaaataaatttatctttaccttattttatttatttaataagttcacttttaatcatcactacatcaaaatgtgtgtaaaggtaaggaataattgtcttagagcaagttttatagtagatgtgactaccacctctaatcttaaccatgtcatctact

SEQ ID NO: 94754 - DNA, 5559 bp, Oryza sativa
acgtgttggaattaatgaatgggccttagcccactcgaagattaattctttggaaaatcacaaaagcccacctcatgggatggcatgcatgtggagtttagtaccaccttgcttattctaggagagggggacctccttaaaagggatgatgccctcctagtcgcttgaagcatgtgtggtggagagaagaggggaaacacacgcgtgcgctcgctcgcctcgcctggcagggcaggcggcgcgcgtgcacgacgtacgcgtcgaatggtccgaaaaattggctcctcacccttgcgcagatgtgttccgaaaaatctggtgcgtgcaaacggcgtggagtccggataagttatgcgcgacttatccggttcggttacgcgcagtagagatcgtgcgagcgccctgatcaagcgacccttctctatataaaccgacccgccgtcttcacgcagtatatacgcaaaatcaatctagggtttgcctcctactctgtactgcgctgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcaccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacaatacgtgtaccgctcctagccatacccgggacggcagctgcccccgcgccgacgccgtccgcgacctgtcacccaagcgcgcctccggtggtaggcagtacccgcgctggctgtgctggtacgaggggccccgccgtaccagcacggcagtcgatcgccgaagtcggagaagtgtactccagctgctgcctgctgcgccgaaatgtcaaaccggagtcgagcagagctgaggagagagagagagagagaggcagggcgactcttgcgttcgggaagaggcactctgccacgctgcttcaccttcgcgatcccatggctgatcagcaagagaagggtgcaaaatgtctgatccgtttagagcggactgaaagcagcacaccagtacgtggcgctgcaagcgtggatcgtcttcatgtcatatactcatatcctgatatccgtggtggatgtgattggtcaggaggaaaacgacgcatgcacagcttgatactgatacagtactgctagtatgaaatagcatcgtatcggagtaagatactatgagattttattttttaaaaaagtttaattaagatttgtattaattacaaatagccattcaataaaaaatacatagtaataatatatatcatgcaaatagagactttatcaagagaaatcacattagttttgatatatttaactgatttttatataaacttaagcatatatatttacgttatttttcaaaccatcttattttaaataatattttgtagaatcgtaagaatcgtagaatcaggatactatctataatttcgtaatatcgtgtcgtaataaatgaaaattaggatactatattgtttcgacttggtaattacgatacggatcgggatactaacaaccttggatatagtagtgaatatgtcgccatcacccctttcacttacgtgtgggcccacaatgctggcagtgttagtgtttcatcccgaagcaacataaatgtgtacctttagctcagcctaactcagtaagcatccaaaaattgatggaaaaaatggcttataggtggacatttttaggctttaaaatgaatcaaaatatattttttaatattccatggcaacacacgggcaaatcatctagttattctaaagttattactaccatattgtatctgaaaagcactctccttccaatcttaaatattattgcgacataattctcactgtctaaagggagggccgaatttattccctttatttaaaagatcacagttcactcacttaacacgttaatttacatgtctatagataattttcttttaaaaaaagataagtacaaatgcatgtgctcacatacacatgtacacgttgtgcacatcctatatctccgagagactggaccgatatatattgagattgacaaagttataataagtgtcttgctgttgacggggacatcatctatcaaaaaaatataattactcagaaaaatgatcacccatattaaatctggaatttaaattggaatagatataagaaatctaactagttgagttatatttgctggtatttatgaatcttgtttcaagtgaacaaggccacttgagacattgtttttaatttgtttaagtcaaatatcagttctaacaacttaggcagaacaaaaatctcaaatatatgagcaattttgaagcttctctgcagttatagcctggtttaattcctaactttttctttaaactttcaacttttctatcacattaaaactaattttctacacacacaaacttccaacttttctgtcacatcgtttaaatttcaatcaaacttttaattttcgtgtgaactaaacacacactatatatgtgaaactaagacgccgtacgtttggtctaatccatgaaggaaaggagaacgtggttttgagctttcatatgccaaatttgtcactatcgactcacggttggtgtttgaatgtttgttaggccacagcaacagaaaagggccggcaacttgttcgtaccactctagcctagtactccaacaatcttactccatctattctaaaatataagtatttttagatcatggcacggtcttcgagatgctatattgaccaacaatatttataaaagtaagatattttaaataaaaatagttgtatattatgatagtttgtttattgataaatctagtaacatcaattttatatgattgatgttctttactctttttttttttgctattaatagtcaaacttaaaaatgtttgacttatcactgtgctaaaaatgcttatattttaggacagaggaaatactattgagttactactggtattcctagtatttggtaggctagtattcataatttcctccgttttagaatatagcaatttaaaatcagatgagacttattctaatcatataaatttagagggagtatatccagattcatgctattaggatacgttctattcgatattgctatatcgtggaactgcggaagcacatggcaattgccaacagcccaaaccgcgggacacgcaagtagtacgtgcttgactacccgttttttttatgtgcatgcatgtgctgttgtgataaaagcaacgggtgcagatactagaagatatctgcctgtaccattcgatatcttggagaagtgccgtttatatatactccaggcagcatcacgaggtgcttttgtttcttcttcagacgtgcaggcgcaaatgggtgagatattctcgacgcattcattgagccgcctccttccggtgagtgggatatttctgatttctcgtcatgttttgatcactgcgtattcggcatgactgcctaggcacgtcttgcttttcagagcgatgcaaactcgcagatggaagatacacgggtgacgggttacggcccatgtttgatgggaggtcaccatttcgtagctttcccttgtgcgttgctcttcggctgtcacctgtcatgcacctgcatcccggatgtgttcttttccactgaaaacggaagataataggaatacgcgctctagctataatttaatgctgcgaaagttaaaaaaaaacgttctgcatatgaatctttaaggtgctattttaattctattttgttcgtttacttcctctatcccaaaaatcttgatgtttttagattcctcagcaaaattatcttcatgccaaaatgattaaattgctcccgtcaattcgattcagttgccattttatcaagtctacacgcactcatcaggttatacagaatcattgcatgcaattaattaataaattctttctaaaacacattgccaaataacttgacggaatagactagataaggggcaattgcaaatttaccactactttgaatcgttattgcaaaactgccactagaaaattgcaaaaatgccactagaactgtcattcgagtggtatccttgcaatattcaaaaaaccggtggcaaatttgcaaatgccccaatagataaatggtctcacttctccgatcaaatttactactccagcgactttttttattggtagaacggctcgtttgtagggtggatgaaaagaatcatcggttggccatattttctaataagttaaaacaactttattaagaaataaaaattaatttattggtaaaaaattgtatatttgctctgcgacttaaaagccaacataaaaaaatacattaaaaatatcttaaaatcaacttaaattttagcttttgctttagcttattaaaccaattgatagggcttgaaatatacttttaatcatttgaccatttagccatacaatgtttccttccattttattctgtccaaaataagcttaaagtactactatcttcgttctactatcttcgttctaaaatatagtttatttttaacacagtacattattccaaaataaagttatctgtttaatacctatctcctcccttctactattcacaactattttccttcactactccctccgtcctaaaatataagtatttttagttatgaatctggacaactgtgtatccacatttatagccaaaagttgttatattttaggacggaggtagtattttctattctcaaccaattacaaccatcctctaattcaaactatattgtccagattaatagccaaaagttgttacattttaggacggagtgagtaacatttttaatgcctatgtcaacaaaaaaaatgcttacattttgagatagttgtagtcctatgatactagagagtactttctctgttttagaataagttaatctagtactaactccgtcccaaaataattacagccgtggatattcgtgtccaacgttttaccgtccatcttatttgataaatttatgatttttttaaaaaaaagtcagacataaagtactattcatgttttatcatctaataataataatactaatcataaaaaaatcaaataaggcgaacggttaaacgttgaacatgaactatgcaaaactacactattttggaaggaataagttcacttcatgaccctcaaaagtgacccgaatctaatccatgaccctaaaccgcaaaaccggatatcttcacccccaaattattgaaaccggtgcaatttgactcccttggtggttttggagggcggtttcgctgacgtggcgctgacgtgg

SEQ ID NO: 94755 - DNA, 753 bp, Oryza sativa
cagaaaaggcggcatgacgaagttaactgacagatctgcatgagagaaaattcatgattaaacggttaagatagtttaaggccataagggcattgctcataggatggtaatttcatcaacaataaacacgtgtatagcagaggaaatgatgacacataactcattgcaatcctgcaaatacagaaaaaaaaagtgagaaaaacttaaggcaaccccttcaaaatctatcaaatttatatgcttaatgcaaacagaaatctagcttatcaaaggggggaatcacgaatgcttaccagaatagccttttgataaaattacacagaatgcattccatgaagaactatagtgaacttgtagatttagaacataaaagttatttgcaataatttgcataacagtagtcctccaaaaccattatgcttcagacgttaatatatatatatatatatatatcagcatttgaaaagattaaatgaaatatgaaaagaaccttgcctgaccatacagaattgaatatataaaacaaacagaagaaaatgttcctgaagcatttgacatggacactcaaccattccttgagctttgacaaataatatttaacatcttaacgctcaatgaatattgtagatagtagaatttataacatgaaaaaagggacttggcaaaagaagataaaaacactaagatctatttaatgtctgaataataaataattatgtatttcatgtggcatcacagtgaacgatttatact

SEQ ID NO: 94756 - DNA, 1710 bp, Oryza sativa
ttagtcccggttggtcatacaaaccgggaataaagatcatctagtcctgttgttcttataaaccgggactaaaaatcgtttttagtcccggttttaaatggaaccgggactattgtagatttgggtcgaccgatcaaagatggtttctccaccagtgagatcaacacggtgtatgttctattctgtttaattctcttatttgtttcaatctttgttcggtttgcaacctgcaccaacgatgtattgatgagagtgatctttgttcataactatcagatttttttcatggatattgttaattaatgctaattacattgatctaaccgagaattggccattctgatgatagttcctaattgttgcatatcgtaagcttaaaacgatggttatgcaactgtttgccaatcatagatggagatttaccaatagacaggaataatgttattttgtctagtttggtttccttttaattttggttggtgtgttagctttcatttggattacactcttacatagtgctagattgtaataattggctgtagctcttctgagcaaaggccgggatgttattttattctattattaaaaaaatcaattttttttcatagcatcggctcctgcagtgtgctcgacaaggttcggcaatggaaaagaagaaaaaaaagaacattcatcttcactatgtgccacctttgagaaacggaaacgcccatgtaaaacaaaccgtgaaggggcggatctacttattaggtatggtgggtcaaccgacacaactacaacccgtgtcattccagactctcaacaacccgtgtcattccagactctcaagacacccctaccccttatagtagtcatgtgtcattaaaatttagtataacaaggtgtgaacatccaacagattagtacatctcttcatagcacatgcacgccacaaacaatgatcaaacaatgatcgagacatttatgtgattaattaaattaaaaatatgatatatgttgtgtttgattactcttatcgagtgaacatctttgttctctgtcccatctatattttaaagctgcgtacacttcgcaaatatttacaagaactttatattccttccgcttcaagttacaagtatgtatgtgcattttccgtaaaagatcagttccataagtgcttatatacaagatcattttaatatacaggaatcttgcacattttaagaacacatgttacaagtgtttatatttttggatcagagagattagcattttcatatcaatcttaggtctaacaaaaaggaaacaaaagtccataggaccctatacccaagcatattcacattccctccgacgtccggccctacatgtcttccaatcttcaaccattggagcatttaatgatttgccatttttaaaacggaattgttaaatggctgtcgaatgatttttagcccaaaattatgcagattactaaccatgggatttgctttgcgattcgtgctccggcgacattagctcccggcgacaccttctccaactctggcgatcccgacgacagcaatggaattagggtttagggtcccgggttgggatgggggtgggagggggggtgggggagggggaagatgggggatcaccggcttagatggatggccgtgggaggcggtggcccggcggtgggtggtggacattggcgggcgacgaggcgccggtggcggcgccgaa

SEQ ID NO: 94757 - DNA, 1679 bp, Oryza sativa
aaaatgcatgggttgataaaattaatcaaatctaccaggtttagcagagtaacgacattgctttgtgaagactctacttcctcctttcagactaaatttgtgcatgtggtgcttgcagttggtcgggtgactcgtcacctctgtacgtgcatctatctcgcctacttgtcgcagtacccactcagtagtcaggagaagctattgtggcgcctccgcgtgagaaatccatgttgctaaagcataaaaagcccatcctgcaggcgtgaacaagctatatattcctgatgcatacgacgatgctgcatgtgttgcgggtaatagaactgtgccgctctattaatgcaggtacagcaaggattgttactcctctatatacatatccgatgtatagaggcaaccaatgttataaaaccagcaccgaaatcgacatcggtagctaaatgtggaagaaaacaccgtagtagatccaaacacgatgacgacaccaaggcactatatttgataacggagttcagccgaggcttacatctccgaagcactgattacgggcgctcctccccgatccagcatattacaacgtatcagagtgacaacgactcacgaccggtcaccgccggcagccgctccctctcgctatgctatgtcgccatgcggttacaacaggcacgcccttctatttatgagagatcctaggatagagtccgactcatactctagtcatacacctaatacaactccaagtcctaaactgtaaccgactacgtacacatattcgacacaaactctaacaaccaagtgaggatcgcgtacgcatagcacggccggcagcatctaagagtgactgagcgagtgcatgcgtgcatgggccgctcggtgcgccgctcacctcggtgacatacaaaaatcagacaacagataaagtactattagccgaaacaatatctacaatcataatcatgaatcattttaatcattgttcatgtactacaactgatattgtgtatttgtcatcttctaaactgtaattgccatctgtcataaagaaagctgattgagaacttatatctagaaagtacttattggcccatatgccaaagagcccctatttgatgaacatccatgtgcaaacagaaatagcaaacaccttattttctctctatctgtcaagtacattagttcatcacttccttacttgcttcgcatggcttgacaccacctcgtgcctttacacaagccatcacgtcacatgttcctgttcctcaccatagcaagacaccatagctacccttcctcctcctccctagtgacacggcgtattacaagaaaaatattttgtagagacatttttctaatactatagagacacttttcaaaaaatacctttacataggcattcaaaaaaatgtctaataagtgtcttatggtgaattatctctataaacgaagagacattttacaaaatgtctataagatggtagagatattttctagagacattagattgtaccacaatcatatgaaaccaatgaaaaaaacaataaaatattttcccttgtttttgccaatcctcgaaacttatgatcaattgcacaaatcattcttatcttcaaggtactaaccaactcaaccccaagtcattacttatatgttgttgccttgagttacttatatttagtcat

SEQ ID NO: 94758 - DNA, 1035 bp, Oryza sativa
accatatatgagttccagtattattttttaatagaaatactccctctatcccaaaatataagactcaccactcgtaacacaaagaccaagaaataatttaatcaccttcttgattggatcacatacatacatgcaagcaatgtgattggaggatttaatggtagatgattcaaaataaaacaaatttgaagaaccaagaggtgatggttaatgtatgcatgccttatatcatgagacgtgggaaaaaagtggttgtgccttatatttttggtagagggagtatgaatgaagactcattttatttgataaattttattgtgaacaactaatgttatattaatattggcatgcacaatatatcgctgtaactaatctttagtgcagtttccttacacaacatataattttctgtttatgtttcaaaatttcctgcatgttttttttttttgaaaagtctttctatgtggcattagagagaaatctcctacaaaaaaaaagaacaaaaatattttgtgtagcacatgaaagatgatttgtataaaaatacaaacgatgtagaaaagtagtctttgtaaataacatacatattttattttacaaaaaataataaaatgcaaaagcatgaaacttatacacacttatattcttatatcatgtgctaggaggctaattttttaaaattgttgatttttttttttagttttgtcaattaactgtcaacccttatatttttaggcattataagaaattctttgtttggttgaatggtatattgtagaaacaattaaaaacatagtcgatgggaaatcattgaattggtgtaaactcaatgtgacatatatatagtatattattttatatttttttaaaaaaatgctgaggtgcatatgtaccaagggcaagccttgctgcaagagggaattttgcgctgcactcttgtttcttggggccttcaccactccactggtatcctacacggcagtggcactcataatcccctgggaaggtggtgcagacgccgtagcagggatattt

SEQ ID NO: 94759 - DNA, 2483 bp, Oryza sativa
gtgttactaaccgggactaaagatcctagggccctgacacggcctgacatggaatcaaccgggagtacaaatgaactttagtcttggttggagttaccaaccgggactatagatgatttttagtcccggttggtaacaacaatcgggactaaagattttcctcttattaaccgggactaaaaatgatttttagtcccagtttttaatggaaccgggactattgtggatttgggtcaaccgaccaaagattgtttctctaccagtgacgaacaatcaaacatatttaaaaaagtcaatgtcgttaaatatttaaaagcggatggagtatatatcttcccgaattaattgctagctagcacaagtagtactatgtattaattaagtcaacctgaattatttgctaattatgtttattgctgtacatgagttgtctacagtataattcttagtgataatgacgtggaaatatagagacaatatctaactttacaacatgatatagtagtaaactgtttaaaactgtacatctctacttctgtcaatgtttaagcatagtcctcctcctatcctctcccctatcatgcgtgtgggcatggtctcgctccttcgcgtttacctaaccatcttaggatccatttttctcaattcattaaaataacaaatttctaatgatattatatggtccgatcagttggaaagcacgaacgtgttagtatttggaagagagcgcacgacagatgtatccatgcaaccaataatccacttctgcatgaaccaaccaagaattgctgcgtattggcagcttgcaatgaatggcattgaagcaggagaaggagttgctatcaaaatttgcattgtgttgccttaatcagattgtcgcctttcaccatgaatttaatagccatatatatatatatatatatatatatatatatatatatatatatataggtccagattatatatgcagaaaagcaaaagcacatgcagcctcgtgttaggtgaatatatatataaggcgccgaacagattgatgaaacagcaaaaccaagtcaggatcaactaattataaatgtttttaggcgactgtttatccttaattgagcaatgaacctatatgtataattatataaagaatggtcccatggattggctgtgacaagcgaattgatggagcagatgcatcatatcgttgccattaattaaatgagccatctggattctgaacaaacacaatattgttaaaaaaaaaattggttgatttgtttatggtttgtagtttgatttcatttgttttagggtgtctttagatcagattttatgccctttttttacagaactaaatctgatttttcctaaaagtccttatatacttcttaattgctccacatgcccttgttgttcaatggacccaaatgactttgtcatgtcagagtgcatgcaagtctaatttgatcagtttagatccattaaagaaaacacagaacgaatacgatttagtaaaaatcatatctgaatcatgctgaatcttaccaaaagctccctgcaacaatgacgtcgatctcctgtttgtgtacgaggtgatctacaaaaccaaactgggatcagtagcctctcataaattaggccaaaacaggttctgcctcccaaatccatggtaacaaaatgtattaaacagaacagaagatcaggaaataccaagataagacagaagccattatgtcactatccaccagtgtgtcatcacatttgaggtaaatatgataaaaagaaataaagaaacaaacagacaaggggaaagaacaaagtccaggtatactagacacaaaataactgatgaataaactcagatgacatagactgggttcgacttaataccataaaacaaattgaggcaacgtagtacttaaaatcctggaagtacttaaaatcctggaaccaggacaattggaaaatattagcaggttaataccataaaaaaactgaagcaaataacaaccatgtagtacatctggaaccaaatcaattggaaaatactctctgtttcacattatactccctccgtcccagaatataacaacctagtaccgaataggatgtatcctactactacgaatctagattcatagtactaggataccgtcccatccggttctaggttgctatattctaggactgggggagtaaaacattttggcatctccattccttttttcagtggcggacctacggtaggacatgggggtacagttgtacccccaatttttttttaacaatctactgttatttaacaagtataatattgtctgatagttcaaaacacctattcttacgcacaaaatcatgctttccaatagtattataatttttttcttagttatttttttattttctataataatcatttttatttgcactactaatccatgttagcacttcatttttttctcactggacgatgcttttgtaggtctgtaccccca

SEQ ID NO: 94760 - DNA, 645 bp, Oryza sativa
tggtaaaggttaaagatgaactcattttaaggtggtgtgggaaaactacatgcatggaatgacgacacatcatatggatcatagcatagtatgcagaggcgagtgagccacactgataacgatggtacctggaactttactgcagcccagaatgtcacaaactgtgcacagcagcacaggtcataaccgggacctactgatactgacctactacaccacataggcgatgcatgcatgcatggctgcaagagaaaacctggccaaaatgccagcaaacgacagagataatgtagctgcactgtataacattgatactagtaggtaaaaatacagtgtggcaacagtccagtgagaagggtctctctaattttgcaaagtgatgggagggagaatatgaaaatgctggtgctacagtgactacagacaacgtgcactagacccacatgatagatgcggatcagacagtagggagacaattgaacatccatatcacgccttacaggtcatgtaatcccagacctgggagcagacaacgacaaccgctcacagcctagcaatgataaaagcatatgcatttgcctcccgacaagaatcagtatgtaccgaaattctgaattcatggagctgtccctaaaaccacaatta

SEQ ID NO: 94761 - DNA, 699 bp, Oryza sativa
atgctcacttaataagttccatgcactaaatttacacgggcatatcaagttgttgcactagcatacttacttcttaagatttttttttcactaaattacacccacatactaaatttatgtaatgtgaatgtaatttttacacatattccccatccacccaaacctagccctgtcagctccttaatttgccattttgcctcaatcctctcctctccctctctcgctctctccatgtggcggcgagccacgcctccctgagattttaacaaatctgactgagccacctgctccgtgattggtagcaagagtttaacaacggtgatcagaggctgacctcctcaaactaggtaaaataacactatatttactgtaattttataaattttgaaagattagtattatttgccctttccaacaaataaaatttggagtttttggttatgtacactctgtcatcatgcaaacaaaaatcaaaatacccttaagcagtaagcagcgaaaaagcatctaagcagtatactacatgcatgcttctcgaagatatataattattatatactccctccatattttaatttatgacgtcgttgactttttaataaacgtttgaccttttgttttattcaaaaaatttatgtaattattatttattttattgtgacttgatttattatcaaatgttctttaagcatgacataa

SEQ ID NO: 94762 - DNA, 802 bp, Oryza sativa
attggcatatgcaccaactcagtagctatccgaaccctttcaagcaagcccatgtaggcgcccactcagtaatcattgtcctacagttgtttctgactttaagtgccatgtcaatgcccacgtaggcgccatgttagttgaaatcgtcgttcaaatcgtcttgtgatcttatttgcattggttttaggagttaagagatgcgtcatatctggtattacggttatagatgaattttggactcgacgataagttgagagaccaatagtgaagttgtttcctttgcaattcgctaagggccatcccgagctgtttaatctgtattagttgtggtttgggcccaagtggcctaggtgccatatgcactacaggccagactaaatcacaccttaacatggaatgacccgctacattccatgtaaaatggcccgctatattttagtagactattcctatggggtggccttgcgggccagtaaaatggcgccccatttgcatttctattgtaccctgagaaaaaattaagttatatcatcacaaatcagtggattaaagtcacatcataaccactgtccactgattgatttttctcagattgatgtgaatcagaaataaaccactcgcttatttcaggtttaagtcttccttctaaacagtgcgtgcggcaaatccattggttctgtgtggaatttacccaaacaacgcgtcatatgtataatgcacaaaccgtatttactgattaattccttccacacttgaggaaaaccaaaacgtcacaacaaaacttcaatcttcaatcacaata

SEQ ID NO: 94763 - DNA, 663 bp, Oryza sativa
acatagtgtgcaccatgttgtgggttagttgtttgatggaagtatctgcccactttttgtatcgtacttgctttgctttgcaaattaactcatggagctgttattttttgacaagtaatttatcatgatttggtaacacctactccctccatttcacaatgtaagactttctagcattaaccacatacatatagatgttaataaatctaaacacataatgaatgtgggcaatgctagaaagtcttacattgtgaaacggaggaaatattattctcagtcatgtttgtgcgcatgttttaaacccgcaagttattatagtagtaaattgaaaacttgtgaacctgtggcatgaacctgtagtgatttccccctctgtaccatactaccattacaccattactacaatttgtatatttccacgatggaaaaagtagcttgcagatcgaagcatacttaaatcttcgatttagaagcatgattaatacctaaaatatctaaatatggaggtagtgatgaaaaagatatttaagttttctaaaagggttaaagattttcaatgttgccaaattacgtgaaatgttttctttggtaggatttatcctttgttctaaaaggatcatcacgtccgtccggacctggcagcgaggggttttggtctatttg

SEQ ID NO: 94764 - DNA, 707 bp, Oryza sativa
tcacgatcctcacgcgcggacgcgtaaaccttcacgcacttctcgcgcgtacaacagcactatgcccgaggtgtgtgcattacacctacatcgggatttcgggacgtaaaaacatagagcgtactacctacaacacggtttacacatacgtgatggccgatatgctagttcgcgagtcgtgcccgctctacgcatacatggggatcgctaagtgcctacaaggttcacccccatcgctgcccgcggatcgaggatgatgccacatccatcctacgctagctcacagtgtcgttgtacgcgtgagaggcaagacgtacgtgctcggtaaattgagatgcggtgaccacccactctaatctctcgcccgtccgtagacccagaggctaccactgcagaggaaccgtctggcctagatgacgttatccactcgatcgcatcttacgatcgcaaatataattaacctgtaacagccctaaaatttgataactttttaaaaccgatttagtttgctttgattctctaaaaatataaccgtcgagttaatagtttatttaaaatattattttccatgtttattttcgatgttcttttctcgtttaattttgttgcaaagtgcatatcatccctcaaataattcctttgaatccgatttaaatctatcctgaatgtcggaccatctaaattccacatcaattcaaatattattt

SEQ ID NO: 94765 - DNA, 699 bp, Oryza sativa
caagcggtgttaacaattttcagcatgtagccataaatagttccataagcatgctttcagatgcaataataataatatccatattaaatcaatagcatgtaaaataattaacagctcatttaggtgttcctcaaattttatcctaaacttgttagactctagggctcattaaggtgtccataatagcaacagaaagtataatgcaataatagcaatctaattaatttaaaagaattcgtgcagtttatcgtactccaaaggacgagtacgctaccaaaataactctctaactactgggattaaattgttcaagggagggtgcatgtcttacaaccttcgggctcgatgtagtcgtacaaaccgtctcctcctagcgcggagatttcactcgctccgtctaccggaccaacgtcaacgttttctatttacgcaacaatcatccccccaataaataccagaaaaacaaagatacccaaaagaaaatagtatcacaaagtgcaacaatgggtgaaaaggatttaaagaaataattttagcgatttttggaatttcggtgaacggcgaaccctagggctaaaattagggcctcgacaacgggtgctcggattgcaatgaaactgatacggatggattcggaataattctaggagggtctcggattttgttttcgagatcaaaaggatggtcaacttaatagga

SEQ ID NO: 94766 - DNA, 693 bp, Oryza sativa
tcactcttctaagggtgatttttctacatgtgtatcgaacgatcgttattgtccctgaaaagggtaaatatatttggatcattcatgcatttatgtattcaggaccaatattattttcttaagatcatagatttagactgtatacatgggaaatggtagcgactattgaataaaaatgtgtcttggttccagtaactggataagattaacattaaaggtaacttgtctaagcaaccaatggccaaataactcatgaactcaccctttcttttcagaatccttctttgtgaataaatataactgtctcattatggtagtgcccgagttgtgtagttactgataaaaaacatccaaactgaatttggatgctgcatttaggatgtcatcggtatttcatttttttattctctcactgatttggtttcatttcatttgggtagatgttgtgttaaatttgttccaaataaatcacaaacacagactccatccggatcgtcctgctcaccgctctctccaaggtgagtactggaaaccttctctcttgtggcaatttcatttagttatgtatttcattcagctgatgaattatcctttgaccatggccattataaatgaaatataagctggattgcactatgtacatgatataacttatatgcttggacaaccatgttttgatttatattttagggg

SEQ ID NO: 94767 - DNA, 739 bp, Oryza sativa
cgtagtagtaaaaaaaatggaaatgatcaggacgttcgtgcggggtgaacgctcacccgtaattttttcgattgataatgccctagtatagagatagaaagagatgacacgataggtaaacacgaacaagcgtagccgtctcatttgtatatgtacaacggtcacaatagtttatttgtcgaaggaacattatgttctttattggactatgttccgccgatgttctgatgtacgtacatattaacatatggagtgggcacaagtcttttatggagtattatctttggggattcccatgtcctattttaagtaacatttaaaggtagagctcggtataaactattagacgatacatattcatttataaggtattctaaccattagtccaaaagataatttttattgctactcttttcattttttcataggctaagagtcgttattaagtcattgtgttaaccgaagtaatgatatttctcttctttttttttttcatgtcaacaaatatttctaattagcatagctatgagttctattattgaccattgtttattttcgtatgttttcatgtaccggaaaagtttgactcaatatcccgatgcttcattcgttctctacaacttgtaataagggatgactagttgaaaaaacatttttctaaaaatgtgacgcccatgttttttttttactgcaatcactatttttttcaccatgcatgtgattgctaaatattctttag

SEQ ID NO: 94768 - DNA, 1718 bp, Oryza sativa
tccctggaattaacaattgcactttagtgatttttaattggttaaaattatttctagggctctgaaaattccactaaaaatcctgttaatgaatttcgacatgtagaactcaagaaaaattccacatgtcaattccgattattatttgcattaccttcttagggttttctcctgatttcctctgcattttcttggggtcatttggaatttacaattttgaccagggaggaaaacttcggggtgtgacagctaaggggggaaaacggcccacaacacccgagggaggtaaaatagacttttgcagggaaagctgatttggagagaattggagtttgtatttggattcaaattcgatattcgaactcgaggtttcagggaggaatcaaggaagactcaaggtagggtttgatatttttcggaattgggagcgagtatctgccgaggattcaaaggacgcgattgaatttcggaatttgatttggagatttgagtcgaaggaggaattacgaggtggaggattttgatttcgatgagagggaacaacgggattgaattgagatcctggcacgacttagactctcacacaaagaacgaaaattttcgcaattaggattttgccgaattagtttttaacgtctcacgaaaagcggagagttacaaaacagggccggccaaaatatcgcagtatggttgcttctaagatttagataaagatgtaaaaaagttaaaatattagcacattcattcgatgtgtattgactttttttgaactccatcatgtatgttactattccaaatcgttgatcgaattaaagatcatgtattatcgagtgcataaaataatcaattatataaagcatgttccatgatgatccacagttaagtcgtttgctttatggctgataaggtgtaaaaaaacaaaactttgtatatatgttcttagcaaattaaaaaggaaaaaaagtacgatttaccccctgaactatcgtggtcgaccgaattacacccttctactcgaaaaccaaacattctacaccctcaacttttgaaaccggacaaataagcccccgaatattgttttgagtggttttgacttgaccttgcacacgtgacgccaacgttgcaatccaatcagccaaaaaaaaaaaatccctggcccacatgtcatacctcttctcaacccattccatctctctcacgctggggctaggtggcggacgaccattggtgggcggctgaggcggagcgggcggccggcggtggaggcagagctccccgtgcggcgggcagctgaggctgaggcggaggcggaggtggagcttcccgggcggtgggcggctgaggctgaggtggaggcggagcgggcgaccgacgatgccgtggaggagggcggcatcggcagcgatgagggagcaggcctccgtgccgtcgcgcgcgccacctccgtgccccgcacgtgccgcccctctgcgtcccacgccgcagcccattgcccgcttgctgttgcgcgcaagagagaggaagaggagaaagagatagagtgatagtaggacaaaaccgctctagattgggtcgaggggggtaatttgtccggtattgaaagtttaaggtgaacgatgtctggtttttgagtttacagacgtacatcggtttaagtttcaattctaaatttaagtttcaaactttaaatttttgttgtagttaataagcaaaaaaaa

SEQ ID NO: 94769 - DNA, 1529 bp, Oryza sativa
gcagcagagcaaggcaagtcatgcttgtcacttgaacatgttgatcctatattgcaaatgctctattgttttctttcaaatattgcattgtttataatatcactatgggatggatacctattgttacagccatgcttttggatatcatgctcctttgttagcttgggttataacatgattagattttggactaggacttgcttagccatgcttagttcaactagcacacattggggatctcatttaaaacctagactatagttttatttgataatgttggtttaataccaccgctctggtgttggttaattaaaatgaaccacatggtgggctgtgggtgcatggttttgctagtcgcacccatggcagttaaggaccggttcgcgggatgccctggaagaatttaccgtgcttaccacaagccagcgtgggcaacggctgggcttgtagtgtagctttcctctagccgacgcatccaggcaagggtgggcgtgatggagtttggatgggccctgcgacggcttatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgtagaacttggatagtttaggtggatggttgggcctgtcgcaacgtgggttagcgttggacagtggatgttaatactgcttaattattacaactgttttcgcattaaattcctgtttataaatgccagtatttatgcaaatgaaccactctagctctcctttgttaattccctgcatcatacccccattccggtatgacttgctgagtacagtgggtagtactcagtcttgctctacttttccccccaacctcagagctcgagtatgtgtccgatggcgggttctccgaggagtaggcttcgtccgtgccgtcgaggatgcctgtggagtggtgttcccgctgccgttcaagtcaaggcttagctccagtttcttttgtttttccgctgcatttctgtaagactttataatgtttgtaagacgtggatctgtatgtcaacattgtcgtttgtgtaccccggctggtcctggacggggattttaatgcacattctgcttgggattccatccgggaatttctgggcgtgacattagcccacctccctctctcagccgtttctcctccctcagcctcgcacgtgcgttgcacgcgccgagccgaaccgagagagagctctctcgctctctcgttctttctctctcccatcttcgctctctctctctgctcactcccctcccggcgccgattcccgccgccgcctctgaatt

SEQ ID NO: 94770 - DNA, 2254 bp, Oryza sativa
tatatatatatatatatatatatatatatatatatatatatatatatatatatatatatattaaaaattgttcgagaaatgaaaacgtgaaaaacaaagagtaaggattgaaaagggaattgctatacacacccttcctgcagcctccagcttccctccgccaatccaccatcgccgttggattcgtaatcgtcggacacctcgaatcgccgcaaaaataaaggcgagcacccaaccgcaccgcaacctcctttcgatcggctctcccctctcttctccttccccccttcccctcctgcaagtaaaacaagcgagagactccccccctcaatggcgtcccggatcgcgaggctgctacagcaccagaaccgccgcctcctctccaccgccgcggaggcctcctcccgccgtccgccgcgcgctcccctcagcggcgccatccccaaggtaaccccgcggcaaccggggaggttgtaaccctaaacccgcttaaacccctgcgcgcctccgaggtgttcggcggaatgccgacaccggctcgcatgcctctgtcgctgtttcattgatagcttcgtgtttaagtgagctttccggtaatgtgatgccctagttaggtccctgagccggacctaacgcatgccaggcgcaggtttcactgaagtattaattgttgcttagggcaatgggttatgcggtgagctcatctggagtcttatcgccattgtagcatgtggttcctgttgaatctatatacttagagcctaaagcaatgcttgatttgttactctaatagtggtaatgaatagtgcctttttatttttctatatagacacaccattatctccgacctttttattttctatatagatacaccattatcctgaccttgtttcaacttttaactgttcctaatccgagactgaatagatccttaagaagattgttgaatctgttcattgtgtgataaactaatagttttttttgtgtgttttctgctctaggtgacatatatgtctttttttacctttcgtcttttttttttcagcatgaagttgcaaaggctgaaggtctaagctcatcttcaatcctgaagctctctactttgttcatcaagtgtctatttatgcaagtttcaaattttcttatatggttgcatccatgtttctaaagatgttctgggtattattgcatctaagaaatgaccgctgtttcttgtgctgagtggcacaacatctcctacactacatgttataaatgttgttacttactttgctttaatttaactgcaaataagcatagaagctaaattgatagtgcaaataagaataacatgttagatgtatctgaatgctcactaaactcacagtgtggtggcaaatgtactcgcatccctataaatttcatctgctacctcaattttggttccttcctgatcatacttttagggacaatctacatataattattttatctgcctacctgctgcttgtcacaattttttattcaaattcttgcaatattttttcagctacatcaaaagaattgctagttgctgacatataatatgctttctttatgaaacatatattatctgctgatcaaagattttattttttgtttttttaatgttttaagcatagtatgacagagagttgcatattctaatttcaaatattgtacgtactctttcatatactggtttagagagcattactgaatgcactgcccttgtaatactaagtcaagcatactcttcatacatcaaacctactagactgaaatgatttaagttgttgcaaaatgatagtatgctatttactcaaaattgaaagacattagtgaatcttgtgttgttggcttctctaacgaaattgtgctgaatactcaataggcattaaacctcagatcaatactcaatagacattcaatgaagttcatatttacagaaaattgtttctcatctgtatggtctcatcaagtcatcataactttattaattttcagacatttaatagtctcacgttcatgttcttttttgttggatcttgaccaacaatgctttgcaagttgcaacatcttatctatatttatttagtgctgagtgaattttcttttgggaaactttgcagcctcatctttaaaaaaatcaaggtggtacatgatcaagtcaaacccttcaagtcctctcacaacacagcgtgaaagccacaaagtatctactcatttagttaggccttttgcatcctactccaca

SEQ ID NO: 94771 - DNA, 2985 bp, Oryza sativa
cttgagtcccccctgcacccacgttggatctgcccctgccaaccaccgattgtgattgttcattgttagtttgtttttaacacgtataggcgctcagcgccaaatacccgccacgtcaaatccactgccacctcagctaggatctcggcgctgacacgttatacctcagcgcaaacctcgatgacgctgagcgaacggcttatttctgcaataagttattggcaagatctaattttaaaataagttttcttaaagggtcaatttgtcaaaattacagccaacaccacccaggaagacaaatactcctactcctactataaaatatatactacgcgcgtgcacgcactgggcgaatgaacgagtgaacagtcacccctgtcccctactaaccagcaccagctctcacaggttttggcccctgctgcatcatcacccatagatgcctacaaaatccatgaggctttattaggttaatccccccaaaaaagatagtattgaggaagaataattttacatacaatagacatgaaataaatcctcttaattcttttatgagagaaattaaccgaacaagatgcgacggggcggtcacatgtgtccttgccccttcacgatcctgttactccgtgtgtataggataaaaacactaatgtcaaactagctacaattggccatcagtttatcacagtgctttaagtcgagctggatgcttttttaacgtttttatcgagcgcgacagtgcaaacatatcgtcgtcgtcggttggttgattatactcacaaacttgtcgttaagagaaaggagaagcgacatggctagacgtgaccggcccatcatcgatctgatcgatcagatggttggttagctttacgtcgttgttttctagtctctccctctgatcgatccatgtatcgtcggtgcaaacggccatatggaggagtacctatggtaacgggtggcttatcatgtatataatgtggctcttatcctgtaaaatggctagtggcactgtgttagaaatagattgagatccaatgcagttgctattgccactgcacacaatttgagccttttatttcttgatccaatggttcaaattgcttgccacagtgaattctgaaatatatatatttttttcagaaaagcgctacagtacttgctacagtattgcggtgcatctggatcattcatttcaaatccagtggtgcttgtgtgactgcttaatttatagtcacagtagcaactgcacctgaaccaaatccgttagaaatccaacggggttgacatgtagtacaccctaaagcctagatccggggaacatctgtacgactgtacttacgtaccttaccagccaggggagctgtaagcctggagaaaatcatgacttcaactgcgagctggttgacttgttgtctcgccgacggccaatacggccaggattcatgtccgttcttctacgcataagcgtaggatatgcaactgtttgggtttgtttctaacagtaacatgatcatttcccgtataaattacaatacagaaaaaaatactaagaaaaagatcaaagaaaccacttaccactctctaccggctttatagataaagttcttttaccatattactcgctccgtcttatagtttactataagagattttgattatgcaattatgggatggaggtagtattagttatgctagtatatagttgaaatctaacgctctttattttgtaacaataaaataatttaaaattgcgcaccatgctattgagaataatttagtccataaacgatattttcttttcctatatgagtctctcgtcgattaatacaggaatgaaaaaggaacaattccggtaggcagtgatttctgtgactgaatggtttcgcaaatcatgattccggatacatgtcctagtaattagtccaagaccgctagcccgttcccactaaacctcgattcttcttttaatgtatatattaccattcagctggttccagacttgcaattatcttatacccgtagcactatctactctatcttgttgttggtgatttcagtcaattattcagctatgcgtttgtctaatgccctgcccatttgttttactccatggttagattgataagtcagtggacagtgggtcaccgaacatcaatcttaaaggaagatgttactagtactatatatacttgcaacggcaacatagacagagcgtctcaggatattaatctcatgctatttcaggcaccaaagacaatcagtctgcgcttgcaagttgctactaaataactagcttatcattccataaaaaggcagggaccaatatcctgatggatcgatgtattgtcacctgtataaggattaggatgtacagcctaccgtaagtggacttagacacgcaagatattagattgaagtgtattgatgaattgatctagcgcatactgacggcgactcgtcaccattatggaagatacaaggagaactgttcttttatgccaaatcacgacttcatgagcacccgtctgcttatcattcctactgctgccccgtgctaaaatataaaaaataatctaggttgaacataatattaaaaaagtattatgtatacatatttttagaaacgcagtataaacgcagaaacttttaacacgcacacactcacccctataaaagcacacacgtacatcccacccgtacgagcacatatgaaagactgggctggcatattatgagattcacgaagtcaccacggagcatctcgctgtctgtcggtgacatgggaccaggagtatcatgactagaggcttgaggcagacacaatcgcccacgtggcctggcaccctcggggggcgtcgggcccgagggtgatgtgttcgccctcctctttgtctccccgagggggtcgggccgcacccgcctcggccccgagggccgaggcgccccgacccctcgtgggtctttgctctgcgtgtatgggttagg

SEQ ID NO: 94772 - DNA, 1526 bp, Oryza sativa
cctgcagcccatcaagcattccatgcattaattatatctagctaaggaccagtcatgacacaaagtatttgtcacacacaattaatatgagagggaagaaatagaataatatttatagcctttcaatgtgaagcccagtaattttctggcatcgtagaattaataactgatctacatggtacccaaaatatataattggacatgtcacaggacactggatcaaaggtctatgtgaatctagatgtactcaaagaatattgcagagacatacccacaataaagatgaagaaaaaaatctcacaagatcagaagagaggaggaaaataaataaggatgggaaaaatgctgggttataccgtgaaatgagcagatggcagttgactatgttgtccaagcagagatgggcgacggttggtgaggcgttgttgcagggtcgggtcggccgggttcaacagagatgcactcccaaattttataagaacttgactaagtagaaaaataaccgaagtatcattggagcagtaaagaataaaagaaattattctttgcatgatgagagcaaaaagtctgatttttatctgcgacaacagtttaaatatactgaaataagtagcaataacttgaatgtcatgatcattgtgagacaaattatgcagatatataaattgtataaataatcaatttgatttgattcatgaacataaaggagggcctctgaaactgttagttgctgtatttttttagggagagtgaaactgttaattgctgttattgttttcctggagcatcaatcagttcatgacttgcgctccttcatattcagttttatgcaaatttgtacacaccaggcagactcactttgaagcagtccaataaattaacttctgctaatcctaagtaataaacttaaaataaaccatgattagcaattttacagaagtgaacaatgttggccgatgtctgaagaaactgacaaaatcccattgctgttttattgttccagttaagcgaagaaggttgatgtgccactacttcagaggattcttcacataattcaccaggcaagcattatagtgcttcggggaagattgcaccactccagacattttttttttagaaaatgggataaacccggcctctacatcgccaaaccactccagataatgagcgatggtactcgattattgcaattgtttgactgaaaagttaatttgggacctctgctgtatatattaggccaatgtatgattttccactaattatgatatctgattctctactatattcagcacctttatgatatacatgcttcactggtaaaaaaaattgagcagattttcatgtggcagaagggagggggcctggcggcgaggcctaccccggcaatggactgcgggccgagtaattagggttgggtagagagagaagagggagggggggggaggttggggtgaggcaggaggggacctgtacctatagagggagactgtggcgtccaggacggaggcggaggcgacggatagacc

SEQ ID NO: 94773 - DNA, 918 bp, Oryza sativa
ttgctcaacagatccttgaatggttttgcttactactccttccttccatgaatgtttgacgctgtttgacttttttaaataatgtttgacgccgttggcttttttaaacatgtttgaccgttcgtcttattaaaaaacttttgtgaaatatgtaaagctatatgtatacataaaagtatatttaacaatgaatcaaatggtagaaaaagaatcaataattgctgaaattttttgaataagacaaacagttatacatgtttaaaaaagtcaacaacatttagggaaggagggagtacatgtgaaattatcgttggagattagacctcgagattgtttgcactgaaatgtatgcattccaagtgccaatccagatgctccaggtgacccggtcgagtctcctctacaataattgtcatctaaagttggtactgatatgtggtgggtctgccgaatatggggcttttatatgtggcagtactcccaaggtctcttgtgtttgctagatggtattggtagatatacaatgtcacgttctttgtcaatgctagtgctacatgcttacattcttcaaccgtattgatatcgttatgtaaaaaaaaagtttttgattgtttatgaatgtaaaatttagtttttctaatttttgcgggtatggtattgaagttgtcattaaatatactatatgaatataaaaaattcccaatcatacctgtactgttttcttaaaaaataataagagtaaattttacaaaactacacgttttttttatccaagttacagaaaaccacacactgacacttagcgtttaagtacatatattttggtagtgtagttttacaaaaccacactatcaatgaattgattcacctgtgatatggcgtgactgttccacttatgatgaggacatggcatcctat

SEQ ID NO: 94774 - DNA, 1862 bp, Oryza sativa
aaacaaatatatgcaccaacaacatatatcatacaagtcttggccactaatgctttgtcatttgctcctacatatttattagtctatagttatcaagctaaaagaaaacaaaaccatccacacatctaagcaatgtattttaggattagggctgtcaacatgttacaaccaagtgagccaatcaggttttgcttgagatcgatttacgagtggaattttagtggtccaaaaaatacacttaattagcttgtttataatataataataaatttcattgttccattcatttcaaattagttatcattttagtattgtcctaaggcaaacgtatctattcttgacaattaatttctagaaaatcgtataggttaacaccatgtgaattatatattatgaaagtatatatcaaggctaatctacaaacataaatcttatgatattaaactacatgaatgtctagaagttgatggcaaaatatacaaatgtttaaattaaaacaaacctagaataagaagtaatttgaaacagagggattacttaattaaaatgaataaatatttgacttgagtggttagtaactaagctgattactgcttataaaaaatgcaatggttgacttgatatgtatcatgggtcttgttggcatattaattatgattggttaatgtaggttttcttgggcacaaaaacgccaacatgcgtttttctttccaggtaaatttacgacatcactattatgcataagtaacaaaaaatcatcattgctttaatagaccacgtggctggttaaatgcaccaagtcttgagctttgtgatagttacctcgtattttgattttatctggatatttatttctatcccttaatgttagtgatttatcaaaagtagtgattagtgggtgttggatgctccttcatagcttataccaatacacgattaattgtgaaggaaccataactctgatctttctattgtttgcatcattgttgtctgccatcttttcgatgtgttctcattgttacatttttgtacgcaggtgaccaaatggtgttcttcattttgattattattgaatttttggaactcatttggaccttcaaaccatttctgaccatgccatagcaattctcttcaaccccaagtaatcaagctttcagatcatcgataagttgggtggcatgtcatgtttatactgcacatatgcttgtttgggtatttggatggtagctaatgaagatttatgcatatttgaggagcaatacttatgtatcctatcatgtaattgtagataacatactaatacttatccaactacatgtgagatgtatttaaatgacctttctcctttggtttgtaaaatttaaatactcgatttttcacgaagatgaagcataatatcacgtaaattgcaagtgtggataaaaacaaatggcaaggtaccatataatattatatagatttatatttttccatgttaatttctaggtagtaatataggcatgacacattttaaacgatattaccagataaaatcataaagctatgaccttattatgctttgtatctgtatataatgtatgcttgttgtttatcacagtggcatttgattaattgtagcttaatcgaatacgtgaaatttgtatatgttacattaaaccatgattgctaaagatggctaaagaaatgttagtatacatgagaacattcttcaattgatcagtatacaaagtgatttattgctaactgacgaaaacgaggcaacatctaagccactaattaaacatcattactgttgaccaaggtaaaataatgagtatagtactggtttcgcttacacaaagatcgagggttgcactctgcac

SEQ ID NO: 94775 - DNA, 692 bp, Oryza sativa
tttaagagtttttcaaatacatccccttaaattatcatccaacataattcacataatatttcaatgtatatctgtattatgttttatgacattctatatacttatatagtttatcctcacttagttagtgcttaaatgattaatatatggttcaagttatctttctccatttttttcctcaaattaagtcatatcacagcctttagataattaatctacggtccaaactatttccctacttttctttttccataaagtcataccagcttactttttacgtttaaatcaccattctacatactatttaaatttaaattatcataaaccacattaatttacttaatctgatgttatctagctatcttacacgttattttttttattgttatcatacagcaatgcgcggggtttcacctagttattgataaacgcaagcccaaagccttgaaaacgtcattagcattctgccaaagctaagttaggacaaggcggcgggaaattgaaatcatccctcgaggagatatcccctcgtgtcatcaaaaaatatatgaaaaaaattaacaacatagattaatataaaatatatcactccacaaatatgtaagtttctcatcgatctttgattaatataaaatatatcaaaaaatataaaatagatcctccacgaacagggtaccgagctcgaattcgcc

SEQ ID NO: 94776 - DNA, 730 bp, Oryza sativa
tatataaattaaaatcattaagctgattaaaaatcaaggttttaaatttaaataaatagttacgaaaataatttggaactttcatagtgatgtcatccatggctttaccaattttcaacttaaaatacgatttatataaagagaaacaaaatattattaagtattaaagtgaacgtctttaatattattttggaaaggtaaaatgaccatcatctcctatttaattggtggtttattgtcggatcgactcaattaaaggtatgtagtatgtacaaaaataaaatctaatatgggctctatgtattaatacatgtcactatactattatatcctattatatcctataatagtagaaattatatcctataatagtactataatagtagaaataacgggatcttttaattattagtgctctatttttttctattatcattctttcgttttctccactatcgtgcaacaaaaaattccgttaataagtgataagaatcgactataagccattgccatacgcaacaacaatgttaatttctgttttatttcctttctctcgtcaccaaatttacttgatgaaaactcgttattgaacaccattttgctcaattgtcatctgcatactatttttgaaactgaccaatcaggcaatatctttgtgattgagatgaagggatatgctaagatgtccaggggaattgtccaaatgctaagattgaggcaaaaggttaca

SEQ ID NO: 94777 - DNA, 728 bp, Oryza sativa
aaaaacaataaggatatgatatttgatttaaatattacaaacttgccaaatgaatctatttgactttttaaaacaattggcccctttatataaattgtcaaattttttgtggcgttagaatttgaaaatattttgaatttgtccattgatgaaagaatatgaattttaattgtaaattcaaattttatctttgagctacgtaggatatataatttattgacagcgtcctgtatatagaagatataatttgctagtcccgtaggagtaactaatctggcttgcctttgcttagagatagatttggtatcttatatggaagaagcatcaaactaatctacataagatggatgcatcgtgcgggaatgcacatgtgggccctcgctttctatacacacagatacacgatacattgagtggggctgcaaatgtgggtccctatatatatcttgttgtgccatgtggcagcttgagatcgttttgaggatgtcacatgtcagcttgagagtgtttataggaaatttaatggacttttagtatataatagatagatagaagatagatagatagatttgttggaactgaaaaaactagacaaaaaaaattgcagaaaggaaataatgtgaggcaatcaataattaagtaatcatgcgtataccgtggtatgcgggcggccagtacagtactactgcatgcatggcacgtacatgtccattaactaatatcgctat

SEQ ID NO: 94778 - DNA, 801 bp, Oryza sativa
tattataatttaaaaaaatgagcaggacccatttgtatcacacaaatataaatgtgggccccacaagtcagccgtcttcattcttcgtcctccctctctctctcccccctcatccctctctttctcaccccctttctcctcccctttggaggaacacaacgagtagggacccagccgccggcggcggcgggcaggggccggggcggcgccggagctgcggaggaggaggaggatggactggtcgaaccttggcggggaggggccggtctctcatcgccgagcgcgtggcgggcttccttcctcggcggcagtggcggcggagcgtgcggaggaggatggattggtcgaaccgcttccttccccggcagtagcgcagagtagcgacgccgtttgccgcccgccgaccccgcccgagatgctgtggtgggaaaggagtgtatggaggcggagtaatgttcgcggcggatgaagagctcgagctccgcgacgtagaggggcgccgccgccacagctggggacgcgcggtgcagagcgctacggagtccgggagggaccgacgggcgggaggatgcgatcaagctcgtcgtcctcgccggagggggccatctcatcgggtgaagcctcgtcgcagaagttgccggcagaccccgtcgtcgtcgtcatttatggaggcatccaacgaagctcacggctatcgccgccactcccgcctctgccgccgctggttcccgccgcatgccgggagagacagacccacatgtcgcgcgcgccgacggctcccttgttagaaattaatcttgt

SEQ ID NO: 94779 - DNA, 991 bp, Oryza sativa
agcaaaaggaatcagattccggccgggcacacgggaactattaatttctccggctgctcgatctctcatcgatcgatgaaaggttcgttcgctagcttcgccatccaagacaccgcactaggaccagtccatccgtttcgtattacaactcgttttgatttttttatcagttaaacttattccctccgtttcataaagactgcattttaaatttattatatgtccaacgttaattgttcgttttatttaaaaattttatgaaaaagttaatcacatatgaaatactattcatatcttttttttatctaataacaataaaaatactaatcatagaaaattcttaaataagacgaatagtcatacattacatctaaaaactgaaaaatagagtatttgtaaggcagaggtagtataaatttgattaagttcataaaaaaaatatagtagtatttttaacacaaagatattataaaaatatattcaattcttgatttaatgaaattattttgttgttttagatgctgctaaacttttctataattttagttaaatttatagaactttaacttaaaaggtagttaaagcgacttaattataagatgaagcagaacggatggattaattaatatcccaggtcgatgcaccgtgacatccatggctcgatcaacgcgatgcattcactcatctgcgtgcagtgcatgcacccaacgtgcttgtataggattttttttggaaataatacgattttaaaggaaaatcgcaaaaatataggtcggttagacgaaatcgcaagtttggcactctatcgaatatccgtggttcgacagggtacctatcgaacaaccgcagttcgacagggtgccggcagttcgacagatgataaaataatttttaaaaagaggaaaaacactgtagcacactgtagctgagaccctatcgaacttgggctgttcgacatgccaccctatcgaagtttgcttgttcgatatgt

SEQ ID NO: 94780 - DNA, 1586 bp, Oryza sativa
gtagccatgaacctccaagcggacacggtgaggaagctcgccactgagcggcgaaatcgtcgtgtactccggcgcgttgaggtagcccaccaccagtgtcatacgtgccaattctgccacgaaatcgatcatgccttctccgcggtggttgggtgggtgaccggccatctagagaagacaaaggagtaggatcaatgcatgctcaaatccaaatttaaataaagcaataaaagactcaaataagagaatcgaatagaagcgaaattttatgcatagatcattttgcatgagagcgaataaataagacagactcatataacgacaaagtaatgagaaattagatacatattaataataacaaacgaagcataaacaccttgcaacccatgttatagagctaggacctaatgcatttcacccatcaaaccccaactgactgacgaataaatcccaataattttactaaaaccctagactgactcgttttgaaaaaccccacttaaacgagcgaccaagatttttcccttgaaccacaagaacagatcccaattttcccggaacaaatccaattgcaaagagcatatgcaatgaaaaggattcagagggctcttaggtttagagggctcttaggtttccatttggcttgtcctacggtcaaggtcggctctgataccaacttgtcacgcccagaaattcccgaatagaattccaagcagaatgtgcattaaaatccccgtccaggaccagccggggtacacaaacgacaatgttgacattcagatccacgtcttacaaacatcataaaagtcttacaaaaaatgcagcggaaaacaaaaggaactggagctaagccttgactaaactgcagcgggaacaccactccacaggcatcctcgacggcacggacgaagcctactcctcggggaaaccttcatctgacacatacccgtcctctggggttgggaaaaagtagagcaagactgagtactacccactgtactcagcaagtcataccggaataggggtatgatgcagggaattaacaaagaagagctagagtggttcatttgcataaatactggcatttataaacaggaattgaatgcgaaaacggttgtaataattaagcagtattaaacatccgctgtccaacgctaacccacgttgcgacaggcccaaccatccacctaaactatccaaattcatcagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacatcccggaaagaggctgtgacaggaccattcgcataacccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacactacaag

SEQ ID NO: 94781 - DNA, 937 bp, Oryza sativa
tttacttattttcttaatactcttatctaattttaaaatctctttggacggaagagattagctagctttcttctttctcctgctgctgctgatgcatatactgtcatatactgtatgagcttgttttattcgctaatgcgtttgcttaagccaatcgttagacagagagacagcagccaagtggacagaaaaacagcagcagcagcacacgcatgcgtgatcacctggctgtattctctcctctctcctctgcgctggtcgcagttgttgccagcagggagttcagatgattgttttgatctgaataattcagatttcaggctggtcttaaacattttggagatgggaagtttacaggaaatctttgctgctgctctcttctggatgatttgtccacttgtcagaagtgaagcaacatctagcttgaagcataagcgcaggaaaacaaatctgaaagacctaattagctgtaattgtaaggcataataacttcgaaaaggtaaatcgtaaagagacagtaagcaatggcttaacagatacccattctatggatgtcatcttcagtttattcccaaggaacaaagtatgtgcatctcatattcttatgccattatgtgctcatctttactttctttttcaagtatatggccccatctttccgttcaagaaaaatctgaaaatgtttatggcctcgtctgctgaaacaggagttgaacaagagtggccgaaaaccgaggcagtgaggaagcacatgggcttgtacgaatgtacaaccagactatgtttcatttaggcctgattgctaagcccatttatttaaattggattatttctgggccttctggtggagcacatgggcttgtacaattgtccaacacaagtttagactagattagtaggatgcctttattcatccttcttttttttttctgtaact

SEQ ID NO: 94782 - DNA, 766 bp, Oryza sativa
actaagatgaccggcaagacgataaaaagtactgtaacctttgaaactgtgtgcttcttcagcttcctacgagctttagacagtcaaaccaagaatctcagagacgctcgtgtgtgtgggttctcctaccgattttcctcatctttctgcgaaatctttcatggcagtccaagatcattgccaccgagacaaggacggggcaccaaccattcggaagcactcacgtaagcatcgatcccctcgcgcaagaaactgtccattcccagcgatcaagcgacctgttcgtcgatacactgtttgttcatcgatcttttcagtttttttcgattcattctccactggtgtcattgtcagattgtcaaattgtcaaatcgatcgatcagcactctcattctctgaactgtccctagaaaaagaaacgactccggcagcgttcataattacggcctgatcgaatcactgattagttcatcatgttcttcttttcctctctcgcggcagcagccggactaacactgatcctatctgttctcttagtgtactgatgacattgtcatgcaaagctatgattgttgagattttagtggcacgtggagatttattaattattatcagtcttcatctccagcgatacgtctcgatcatcgaatgaaacaaattcaaattcaccatgcatcgacatttgatgcgaaatctgaaacttccgggaagcactagacacgtcctgttaattttaatctgtggaagaaatgcatgtcaggttcag

SEQ ID NO: 94783 - DNA, 4593 bp, Oryza sativa
aaaaagtggaggagggaggaggggtttgtgtgtgttgtggttgaaacttggaagtgtggggtctcgaggccgcgtccgctatggaggaggctgcggcgaggggaggagaggaggctgccgcgagtgtgaggtggacgacgagttgggctgcacggcacggttggagacagctcggctgcctgccgcgaggcgggcgcaccgcgcacgcgttggattgcgggagagatggaccaaaaatcggccgcgcgcctgcgccacccgcgaaactggcacggtgccacggataaacatcggttaccttcaaaatcatcgtgtgccctgtttatctcgttttctattaacacgttaaacgatacattttttaaaaaaagattatataagttgcttaacaatcgaataaatccatctttcaagtttacaataattaaatatttaattcattatgtgctaacaagtccttttgttttgcgtgaactatgaaatattcttccctgggcatgaaaagaacgaagactttgttactgatacgtgagtttatcattcatcactataaagtatcctgatctcggttgcacgtgattggagtcttattgttttgctaatgttttcttttaccgtttattagtaaaaaagctaattgatgagcaaaattttatcgtgttcttaacgatttaaaattaaatattgtaaataaattatgataaaaaactataaaatcaatttctaaattaagttttaaaatttaaacgcataggcgaaacaataagggcacatgtgtttgatgctgctgtggcctgtggctgtgttttgtcaggggatcctaaggttgagttcctgtttagccgcgtgagtttcaccacaattattgttatcatccctgatagtaaaacgctgtttcactctcacaaattttatggccaactgctggtacttacctgtactgttgtaccctagcctgaaaccagtactaggatgctgttatatcaaaactgaagattttgaatgtgataaactaataactagcagtactactactgtactagtactgtacaaattatgcacgcatgtatccatgggtgcactggagacagggatgaagaactggcgtgcaagcaacgtagatgtgctgcacctaaccggacagggaagaactgaatccacactctgctactagtggagtatttatacagtagagtagagtgtatactactactagtagtacaatttattttttgataactgtatttgcatttaaggtgtcagtgctgctgttgccatggtggtgtggtcaagtgcatcactggaagttggttggatctaactacggttatttatggcctggttggtgatcaccagcaacacacaatgacacaaacacttcttcttcttcttcatcttcttcttcttcttcttcttcttcagtttgtacttagttttctgggctcaaatcgcaggtcggggcgtgagatttggttaactccacagagacgatgatgcgtgcaatgaagtcacacgctgcgaccattggtcattggagtagcttgcatgtaaagttttttcttgggctacctgaatttgacttctagcacagtgtacgttgcatatgcagcttaatttcctaggtcgttctaaatacattatggttgttgactaaacatatttagtactatactagattgcttacaagattgcaatagtacatgactcaaagaaatggtgcagttgctgtcagtacatggtttgatcatgtgtatgcagaacttataccagaaattcaagggtgtatatgtaccgtataaaaatatatttttttgtaaattttctaccactgaattttcatgcaggtttatcttctactccaccttttgaagtgtctggaagacagatacatggctatcttttttcttggtcttctctaccgatatgatcctggatagctacacctcagcaaaaatgacactgcctagtgcttctggcttgatctgcacttggcattcagtggaatgaaatgacaaggcaattgcgtagtactctttcttggtctattgataattctcaaaagttgcctgcattatgcagcatccagagactcttatattagtaattcagaattgacaacggaaacagttggtttgcctttttcccttgtggatgcacctgctaggcctatctttatcttcaaaagaagaagcaccaaaggggaactatgagaatgatcagctctaaaaggctattttatggtgtgcttttttaaattggaatcatcgtatgctttcaaatcaaaaaagaagaatcactaaggctccttttttatgaaaagaaatcattaatttgctgagcagacatgacgcatgaggaaagaataaggaatcatatacatgctactacttcacaaggaattctttgttagggaaggacagttttgacaaaattgatcaaattacaattgtacttcttcttttactgccaggcaagtaccaattccaattgtgcctgtaatgtctaaaaaaaaatgcaaaccttgctatcatgattaagaaggagaacagaaggcatttcagggtaaaggagccagtactacctttgttaacaaagaagatagatgcatgaatgaatgattaattaagctgcagaccacacatgggctacctcaatactgggggcacaaagatccccatcacccatatccacatgctttgcactgccctgcacagtaattaaacagttacaagctagatgcaacagctgtcttacttagtagcactaagcacgaagcaaacacttccattaccaggtaccactagctctttctcagtagtaatctactgcataattgagtgctgacactctcaattctcagaaaaaagaatctctgggaccccaaaaatgtgggtccctgactccctgttacaagcttgcaagcaaaaacagaattatttatgtcggaatagggagattgttatcatagcacagtggactgaagcagcactttggcatgagaaatgcagcttttagattctttgctgtgttattttaaacgagctgacctgataaaccctctgattgcaattggaccgttgagcacatttcagcttaacacagccgcgccgcttgggcccacaagagtatcaccaggtgggccccatttgttcttggaattttcaggggatggcaatgaatgggccccaggacccacagaatgaaacagatgttagcaacaccagtgctccactagtactaataatttccagtctcccagttcacaaacaatgggatgaagatgcagcatagattttcagtcacatgtgctgaagaagataacataattaactaacaaggcatattaattatgtatgttaagacttaagtagtatcatctactaactaacatgaaacatgatagccgaatcagatgacattactagtccaacatgaacagaatttgattaccacaacacaatgcagaaccctgtctttttctagactgaatcgtattgtcagttttcttttgtcacaggttgcaggtaagctatctatctttcctgcagagagtagattgcagagtttgtcacgatgaagaggcaggggatggaggctgcagggacaaggacatacatgttggtgatggacacgcctaccgactaactagaatcatgtcgcatcagttgatgatgcgatatggacgtagccctggtcctggccgtgttttgccatccaaaccaccggtactgacaaacacctctgatcaactcaagagaaagtgaaagcctcagatgctcacattttagagccatttctccctcaaaatctcatcttttggaggtttcgaattctgaattcaagcgttcttactctcgaatgcagtgataaatatgttgtccccaagagaaacgattagcgatttaaaataagataccggtagtgacaaacactgaaacacctctgatcaactcaaaagggagagccctcacacacctatatttcaacccatttctccctcaaaatttcatcttttcgacatttcaaattctgaattcagacattcttactctcaaatatgaatatatgattacacccaagagaaatcactagcggtgtaaattaagatagttctttttcacatgatgggatatctgtgtaatgcagaatgatcaaacagactggggatagtatatcggtgtacagatagtccaagaaatgtcacaagcatgtacttcggtagcaggtcactggtatgacagaaaagaacatggaaactccccccactacttcatcaggcttttcaattgaatcggacagcatttgggatcatcaaagcatttgggagtagtactttatttcgtcggctaatgagacaaatcggccctgaaaatctcgaccattcgtgagtttcagagatcttaacaacagtagatgcagaaaaaacaaaactcaaattcagagtagctgaacacaaaacttcttctgtttgacttgtgaaaatcataacactagccagcattgtgatctttctgttgatcaatgcatacgcatgcctcaacagctttgctaaacttcaggccatgcaaagacgcaaaagtgcaggttttccca

SEQ ID NO: 94784 - DNA, 1776 bp, Oryza sativa
tttaatgacacataagcgccacatcaacgccacgtgtaactaagacaaggtcaacaccgccacctaggcgccacataagcaaaatcactctctaagaccgtcgagggagtcaagttacacccttttaatagttgtggttcaaggttatgaatcagattttgtcactagttaagggagtcaaagtgaacttattccttttaggaaacgaggggaatttgctgggaaaagcggcccagtcgaagacagaagatacagacggcccagtctggcccgtgaagttggcacccatatatatacggacgggatatctcttttttcctcgttgctctcctccccctcgagcctaaaccctagccgccgccacgagcgcgcgccttcgagcaaccgcagcaaggccatggcgcgccatggccttgctgcccaaggagatgcttcgtttggccttggccaggcgttgcaccggggtcttcatggcgaggcgtaccatcctcttcaccgcagccgatggaggggcgtcgatgatgctgcagagggcgaggagctctcacgccattcgtcaggctcatgtcagccgcgacttcgtcaaaactactatatatataatacccatatggggcaccatggtgcccgggcaccatggtatcaaaacaactcaaactcaaattcatttgtatgaattcgattcatacaaatacctaacaacaaaacaactcaaactcaactttatttcacaattcattattatatacctaacgaattatatgtttggatgttatatacctagaaccaaaatctaacaaaaaaaaagttcaaactcagttcaaacttgttagtaaagaagttaatgttcatatctaaacatttaaaaaaatttcatactcattcaaattgggtatatactcaatttgaatcttggagcccatactccatgtagccccagttatatatatatatatatatatatatatatattggtaaggatcggcagcatgccagcatcaacatatacgaagatgcagaccaattgcacaggaaagctatgggccagttgtaatcatagctagaggcccaataagctccaagccaggcccaataatactgtgcgcggttggaatggatagagcggaggggagggtagtataggcacatcagcagcagtaagaggtctgctagggtacggtatcccgtccaaacaagatactttatattgatgatgtcagctccgcctcagctttatccactcatgagtccacgacttagcaccgccctacacgctcacgccacagccggtggaagagcacgcgtgaggcgctaggagaaggacacgacactaatagtggattaggtgacaaagttggtccctgcaatagcatgatgacccttgtatcaacaccacattgagaagaaaaaggatggtgatagtgaaaggaatggaagggagaagacgagacaaaacgctggtggtagatggctcaccacccagccaagaggcaacaacgtacgttctctcccgataccttgatacctcgtacttagtacctatgggttatcggttagcacctataggtatcagctggtacccgagacatcaaccatgataccataggtaccaggtctgaaacctgtaggtatcaaccatgataccacaggtaccagatctgaaacctgtaggtatcaaccatgataccattggcaccaggtctagtacctgtaggtatcaaccatgataccacaggtaccagccctgtgtaggtatcaaccatgataccacattac

SEQ ID NO: 94785 - DNA, 1401 bp, Oryza sativa
ttttaatgtaatagaaaagttaagggtttaaagaaaaagttaaaaactaaacaaggcctcggtgattttcttcacgctctctgattagggacgaagagggagtagtattgacttcagtccttgcatatcccggtaccgccaagtctatcttggccatgaagaaaaaacatctgagcttgcaggtgttgataattgtagtagatcgatcttgaagaggacgagcgtggcctcggtgcacaatccgaggagcacgagagctgccgacaccgcagagcgtccagctcgacctcccctggctcgagatctgtggacgcatgcattgcccagcacaaaatggtcactcaactttcctcgcgataacattcatctctagcttcatgttgcttaattaacttcccgtgtaatgttagtattacttaacactgtcagttgtgaccatttatacacgggaaaagctactttccaaaaccgccagggccggggttacagcaccccggcggtaagcacggttactgcgcggtaattgcggtaaccgtgaaaaaccgtatgaaatctatcaaaaatttaaattattttttaaatttatttaaatttaagaaggttaccgttgtatttatattaccgtaccccgcggtaagcgcggttatcgacggtaagtcgaaccctccatccatgtcatatggtctcattcttttctaattgatgcatttcatgaaaaatattttttatatatagaagcttcaaaatatcaaataattatatctttcaaatttagtagaattaaaaacttaattaatcatgtgctaataactcatacttaatcatataatcgtgcgctagttagacacataaaagttgatttcatttgaaacaaagagcatgtaataagtacgttcgtgtagcacgttgtgtgttgcatgattccatagaaaaggcagaagcatcaaacacatccgcacattcagttgcgtgagttcttgtgcgccatacacatatactctccctccgttactaaatatttgacattgttgattttttaagcacatgtttaaccgttcgtcttattcaaaaacttttgtaaaatatataaaactacatgtatacatataagtatatttaacaatgaatcaaataatagaaaaaaattaataattacttaaattctttaaataaaacgaacactcaaacatatttaaaaaagtcaacggcgttgaatatttagaaacggagtgaatacatacgtacagttccaaggcgagagaaagctatgatgctcgttgacattgtgtatttttcctttctggaatcaaatacgagaagactaatttagttttgtgtcaacgcgttgacagtgcaccgccactgaacgaattcgacggagtttagcacgtgccagctgaa

SEQ ID NO: 94786 - DNA, 2922 bp, Oryza sativa
atttctattgaagtgtaggtagagtacgtatttgttttacgagccagacgacaagcctataagcaatggcctctaatgatgttttgtattatgatggaatagcccagtatgtagaaagtctagatagctacatagcaatggcttctaataatgttttgttcatcatgcttgctcgggaaagcgtacgtgaggcgcggcgatgagggccacgccaaaataaacatgcagtatagcacagcgacccacacaaattaacctcagaaaaaaaaagttacatgacatgcttaacacatgagtttaactagctataccgctattagaataaaatgtttcaaaatatacatcacctaaacttttaatatagcatattgttatatcgctgttttagtccaatatatgtactgttaaaagctttctctaacaaatattgagcaacatgtaatggtatattaattaataactagcactaaggatctccttttacataggcaagactagtcaagtaaccaatgtgacgactatactaggcagatcagatcaatcggttgggccatttaaaatatgagtattcatccaacattgtttaggagaactggtaccgtcactttttgacaactggcataatgcaagaaccttcattgccacaattctttaacccctcttctagaacttctctaaacttaacatgtagtagctagacactgccagttgcatcacatgaagatgtgcatatacacatgtctaaagagctccaaagtcgaacggcgttggagctgagactgttgggtggacctcagaagacaaggattggacgactttgtgtctatttcagttagatgtataatttcatacccgcggcactaaactgccccggccaaatattattttgcaagtaatatgactccattggtgtgtagtactagctttaggtgatcaaattgcaatattcattttacgctctagctatgacgcatgaattccgtgttcaaccaagggaaagaaagctccttgttgacgcaacctcctctatatgccatatcaccaccggagatccatcacccatcaataaatagaccatgaaccctagctacgatagtgaaatcgctgaaatctaagttggcatcttcgttaccacggccaattgatgcttgaatcattcaacccaccaatctagcaaccgattgaaatctctcctatgattttgagttgaaattgaggtttttgtgtatgaacgcaaggtgcctgagtggaaagatgggatgatcaaaatatggcaagatgtagaaaaaaggtaggacgaaagaatgacatattagtgtacaaccattatgtggtatagtgatatatataaataaactccatgaatatgatatgaaaatatgtttacaaccacctcaaaacaatatattccgtcatcatattgtatagttcatgtaaaaagctggaagatcctcgctaaagattgtatttataaaagttagatccatagtgaaaatcaaccaatcaatattttattgtgttgtgattcgaagaaattatacatgtcacaaagatcaacaaatcaaccaaaattaccaaaaaaaattacatgccatatctcttaatatcatgtagaatgtttttggtttacaattagttaatcgttcataaataggaaaagttagggcccatttggtagggctccaatttctaaatttaactccagcatttaggtatggagtggagttgtaaagttgtttaagcccagcttctttcagttcattttgtgggagcacttcaactagctctacttttttttaggtggagatgaaaccgtttggttagatttcagttttaggagagatggagctgaactgaagcggtgtcaaacgcacttaattagatcatataataacagctggtgcaggcccatcaaacacgtcactgtgctatatagaaagtttattgaaccattcccctgcataaaataagcaattggcgcgtggtgaccacggtgtgggaatcgtttggtccatgtggtcagagaggactctgcattgcttgcataacaaagaaagcaaatattaaaagtatagatctaattggaggcagttttggctttcttgggtgtgggaaggtttgccttcatcctcctctcctcgagacctcccaacacacactggatagatacgccaaagccagcctcctctttggccgatgcagctgtagttagtaataattaaagaactaatatatgtttaaacaaatctctggacctaattggtgcggtgatcagctggtcgcttgttccttcatttagtcatgcttgaatttgttttctcggatggcatggcatatgttttgactttatatgtcaatggtttaatggctcacggtttctgtggcatgcatgtcacaaaactttggctgaactttgactcagctgaaacgatgaccaattaatttgagaacctgaaaagatatatatatatatatatatatatatatatatatatgggcaattgcttatttgaccccgttttaaaccctaactaccaatttgaccctactttttgaagtttgcttgtttgaccctccttttctaaaacgaagctcccgtctaaccctgtttccactagtccgttaagttttgatttaaaataaaaaagaaatgcaactaatattcataatatccagaatacccttaggaaaccctatccatccacccaaccttatccacatttctctctctttctccttcctccttcctgctcgctcgacttgtggcggcggtgctagggggcggcggcggcgactgagggggcggagggagggagcagcggcggcgacggctgaagggcgtggagggagggaacggcggctgttgaggtggcgccggtgcggcaactgaggggcccggagggaggaaaggaaggagggagc

SEQ ID NO: 94787 - DNA, 745 bp, Oryza sativa
cacgtacgaggggtcgcaccatcacggcccgcagccgctcttcccgccgcacatcgcccagccaccgccgccgacgtcggtagtgggcttctccgccgcctccggcgctggcccgccgccgtcgtcgcccgcggcggcggcaaggaagaggaagaactatgtcagggcggccttctcgccgacgacgtccgaggacgacggcgacggcgccggccggctacggccagagtggccacaagacgatgggacgtcgtgtgacgtcgccgagttacgacgacgtggcgacgcggagcacgccgcgccgcgtcgtgtcgcgacggatcgctcgtgcgacgatggcggcggcggcggctcgacctcggcctcgtcgtccgtggcgcgcgctgacgccgctacggcgctgtcctctgactcgccgccgaccatatggtcgtgcctggactggccgtggtcccaggaaacactgtttctgtagctgaagtgagtggggagttgacttgggaagatgactcgatagtacagtactggatatctacttgcaaggtgtaattagttactgatggatacgtataagtagtggacaggtcaaaggatctgaacgtagctacgaaaaaagaatacaacttgtggggttcgcccgacgctggaaagaccaccgagctagctataaacaggttgcacaactaacgaacttaattgctaatacctgatgaatattagaaatatactagtttgccacttaatt

SEQ ID NO: 94788 - DNA, 1262 bp, Oryza sativa
tttagaagcaacttacaatgtcttttgtggacagttagtattttttactactgtttggcctgctcttgtcttgatatgtttgttggacatgtagatcctagttactgcaattgagtatcctaattacagatcaacagaagcactccacaagcctttgaccagtaggaaatatgcattagtattatgttatgtggtaggcccttaaatttgcatgcatgagtgtttaggtagtggtcatgggttggattcccactttcccagcctgtaacctccttttctctgaatgcttcactatactattgaactcctatttttcttatgtgcatttcaaaaacatgttaatctaactagcccagtaattttctattatattcttctgcatatttttcctttttttttaatttcaatattttctgaaaatacatccaacacatttcaataacatgttagctaatgagtcaagttcttttttcgagaaaaaaaagaatttgatactgtatttttcttcactttattcttttttgaattagaaaagttgcaactttttattgatggcactattttttgggggaccgttatgcacgtctcaaatacccatcttaaaagtcctgtgtccacaacttctaggagcctgggaggtgtcctaccatatttccttaaaaaagaggagagagggagaggctactgcatgaggtcaccaaactcgcatcgaccagacttattagtgtgggaatttgataccgatgtttcagctgtattaatgcgttcagatttggtactgctctatttcaacttcaacagtacccaaaccaagatttgataccatcttgtttcaacagtattataccttcgaatgcctcttcaaagagatattccttagccaacaattcctcttcacctcttgttatgcatctgaaagtaactctgaaggaatatcaaaaaaaaaaaagaaagtaactctgaagcgaagtacttgctttattgtttttttttaaaaaaaaaactcaactatagaaattgggccctgtgaaagggtccagttaattaatacccaaaatacgctttcatggcccagtcgcaggcacaaattaataaatcaacttgccacctaacttgagcagttagaattcttaaaaactaagaatgtttcagagtaaatgggaagcatctgtgatactattattcctgtaaatgaatgagcactattcttctctactattcttctcttgtcctttttctaatagtgaggatcttacatacag

SEQ ID NO: 94789 - DNA, 1469 bp, Oryza sativa
aaatgtagtcataatatagtcatgtcggatctactttggataagcactttttttctaacatcatggtgcaaacggtttttaaaagtagtacatgatgtgagagatattaccctacaaagattgttttttaaaaatttaactctctacaagcagtaatactatatcatatgtattactattgtctgctatgtgttactgcaatcacatcatacgattactacatgatgtagtaacgattataagtttcacagtaacatagtgtgttactgcgatttcttgataacgttactgcacgaatgcgtatagtaagaaaagaagtgcagtaattggctcggtttaaggtgcagtaacgttctatatgttctacagtaacaacgtgttttactgcagttattggatagtgttactacataaacatacggtaatatgtaactgtcaggtggtaacatgtataagccggtaacgtgtataagccgtgcagtaacacttttactttcgtatagtaaaaagtatatggttagcatgtgagactttgaactcatatattttttgtttcaattcctgatttaatgcaattcaccacaatattattgtcaaaagtgtagtaatgtcatatacattcatgcaataacactatattggagggaggagaccgattttcttgagaagagggaggaagaacggtttcttgaggaggggagtatgtagatgcattttgaagttctaccctccacatgcagtaacactatagcatcattgtgaaaacggttttgaaaaataatacttatcttgtgagatattgattttcgaatattggcattttaaactttaacccttcacatgcagtaacagaatatgtaatttgcagtaacaagggcatatacatgcagtaacttagttttaccaaatgtataaaattgttcaaaacactcctacctcaatcagacatcgctcaaagccacctgcagactttacctatagtccacctattcgatcttcatctcgtaaaaatgatatagtaaaactacaattatcgtgcagtaacatagctacttggaagtggtaacatgcacctattatgtagtagcacttctacttttatgcagtaacaagtatatggttagcatgtgaggctttaactcatatatttttgtttcgattcctggtctactacaattttaccatgatgttactgccagaagtgcagtaacgtcctatttgttctacagtaatgtggcatgttactgtacttttacgataatgttactactggagcatagtacatgttatgagtttcgtagtaacatatctttgtttttttgttttacgatggtagagaaagatattagaattgataatcatattactttctcacaaaattcttgaaacaaatagcaccattagataaattggttagaagaatgtgctttgacctatgaggtcatgggttcaagtcttgaatttagcaa

SEQ ID NO: 94790 - DNA, 3145 bp, Oryza sativa
gtgcatgagagggaatcttgctgtgggcagtgggcacaccaaagtgcaccccgtcagtccccgtcccggttgtatttacatgtatgggtggatggagtagggaaagtaagtaggattggagtgctagatggatcggtataccgatctgaatcattctccagaacggctttaatttgcggtgaggttgatgaggttggggggcccatttccaggtcagttttatttgtctaattatgtttatggtgttttgtcaggtctccagtggaccagttaagtgcagtacagtgctgttggctgctgctgcctgctggtggtccccattcagcaagtggaggaatggatggagtcttgttgccgcaaggggtaagggacgattgatgaatagcttctgctcactaatctgatagtggtatcagatggttgtttggatctctgaattttttttggtactcggagcaaattaaacacatgtcgttatgatgctgtatggtacaacctcatatgcctatgagatgttagacgtagaattaatgtcaataattttgttgttgagtagtactgggctactggcaattaccgttaagacatcttacataactcacacgatcagtactaatgaatcagtatagggtttaaatgaaccaggtattagtcagatattgtgcaacaatttcctagattaagtgcaaatttttgccatggtaattggtaggagtaaatactaaatttctcaggggaaaaacaacactaactccttgttaattttaccttatatgaaatcagctccgacaaaatttgaattttaaaacttaattttgaaggttttttaatcaaagcttatttttcaacattggctaggaacatatatcaaaagttttacaaacaaattcatttgctaatagtcatacggcttgcatatgcccaaccgataggggctaaatataatagctcttccgccctactatgtttgtcctagcctcctcctaggtgtcaagcaagaccaagtgaaaatctagcaatagatggaagctagtgatgcaagcgttcaagttcacactgatgattttaagcccatttcctaatagaaattataatagattattgcaaatattccttacaaatgcgaataaactttgagttactttttaagttactttttctaaggatgtgtctcaaattctcaagttgatattgcacagtagaacactttttcaaggatataatgagcaatattaactaatggtcttgctgtcatcttatcacatctttgaacacatttgaatcagttgaccttgtccttagatgtgttatatgttttcacgtgcagctcaaaaccagcatctatttaactctggttagttcaattttgaaccaatatcatctaaagagaaatgggttctcaaaaaaatctaaagagaaatggagtattacgcgagtgcgcggagcaatatacctttcctatttcctaagcacaaacatgttgggtactcgtcagttagcttcagcccagcgtgtatgctccaatcttaattaactccaacacaaagtagagtattacccatgttgtcttctgcccttaattagttgctgacatcctggaaacccatttgttttcttctgaattctgatgaagtttttctcggtactaagaaacaaatctgatctttcttgtccgcagcctggcattcacaagtttcttgtgcatgcagtagctgaatgctgaattccgacgacccacacagcttacagaatgccctcactggaaaggtagctaagctaacaacaaaacaataacagtgccagtgccagtgcagaaaatgacacaacacataagtaaaacaaacacaaaggcgctggattactagctcattgagctctgcgcctctgccccatgtgtgcgtccaaattcctgtgttgtcccaaccatgagatttgaaatgctcgctatgcttgaagtttcccggggtgaaagtgaactgtagcagtagaaatgatagagaaaagagatatgtgcttttaccagtttatcaggatttaagagtaactgtttccctggactgaagggagaaaaaggtgtgctgtcatgcgctttgcattgatagatgtctgcaatgcagcaatatacggatttttagtcttttcttcccgattaatgtagaagtttattgtctttttactccctctgtattatatatagtcaaatcatagcattccaaaaggcacttaagaagaaagacaaaggcccaaattgttagaaatttggtcataattcgacacattttaatccaaaatattaagacaataaacatgacatacacaatgagaagcaatctagtgataaggctaaacataacatatgagcatgcttaaggtaaaataagtataaacatcattgatattcacataggattgaagtcctatggataacattatgaacatgtaaataacaagaagaaaatcaaataaagttagaatgttataccagagaacggtgcagaagatgttgaggcattcgtattgcctccgttgatgttgtctcctccgttctctctagtagaagccatggtgaagcagaagcagggtgtaacaccctgaaaattcgaccaacgaaaatcaaaactctaaaactatgggccttcaaattttttttaaataaattgcatcatgccgattttattcgcccatttcattggaatttggtttcgaagtttatagatcgcgaatagagaataattgattaggaagaaaacctaaaattaaacgagcaaaataaataattgaaatataatttggaataaagattaggtgatgttggaaatgaataaaatattatcgcgaccatattagtaacaattgaattctagcgcgattgaataagaattaattctaattaatttcaaagaaaaaaattatataaaaataaaatatgggtactattaatctagagtaaatattttgattgaaataacacaagtattatgtaaacgtcatttgtggaaaattaggaattaaaggataggatttataaagaaaaggttaaattaggctagcactgttcattgcactctaggtgctcgacgaggttccctagcccttccccctcccctaccgtgcgcgcctcgcgccccgcgccgctgccgcgccg

SEQ ID NO: 94791 - DNA, 2951 bp, Oryza sativa
agtcccggtgaatgcttaaggagcaatcggttttgatctcagctcgttcgttgccgccgcccgccgcttgctcgtctttcatctggtttgggttttgatttgccgattcctatctgctgttgtgttcgtttctgaacacatgaacgaaccgtggctttctttctctaggctcatgtgcatatcacgcacaaatggtcacaaggataatgtgcacttttgatcatacactttagtatatgcatgcacagttaataatttgatttatgagatatagcatgttcaacaatttctctattgtactagttggctataatatcaactctaaaatgagatggagataagtatagccgactgtactactgaccttgctctgagggcaaaaatggaaggcagccacacccacgtttgcttagcgtgcgaggtaacgtgcaattgcggccgcgcgtgcaccacgccctcccctagtcccctcctctgcttttgcttccgaccaatcagcccaagcgctagtgttacggaagacactgaccaccacggccccacctatgtggttggagcaggtacaatagtagactattagccacctataaatatattttaatgagacaaaagatgagagaagaatagcgggctacagatctgtagccagctacagcacgaactccaagacgtaatatatgcatgacaggtgtgaccatatatattaatagtatagtaagcaactattgtatgaattggctattagattggctatagatgaattagagctagcaatgagctatactattaaacttgctcttactttctctactccacctaggagaagagccattactagctccaaataatctataactaatctaatagcccattcatacaatagttaactataaaaatatactacaccattaatacccggtcccacctctcatacacacataacgttctggactctgtgttgcagctggctacaaatctgttgcccgttttcttctctcttctctttttttctcgatagatatggttatagctggtttataggctgctattgtacctgctcttaatatatactccaaccatttcatcatttcataggggcattttatagagccattaacatattataagtcgtttgattttttcctaaccaaatattttaaaatttaaataaatttataaaaaatatattatgtattttcaacgcaaaacaaacatattatacaatgttagatttactaaaatcaatttgatattttaaattttgttaaatttttctataaactttatcgaacataacaaagtttgaataacgacgtgtagtataaaacgaagggagtaattaattaaatattaactactataaattttaaaagataaatctatttgatttttaaaacagcttttacatataattttttttcataaaaacatgtcatttagtaatttaaaaacgtgctaacagaaaacgtaatatacttactcggttcctttgatcgagttaaaaccgaatatcaccaatgtgcagactttgactatttttattttcaaaaagtacactgcatgctcaatataactatattacttatgtttcattgtaatataaaagatttttgctggtggactgtgaagggaacggggagagttagctagtctgatagtttaattagcttctgttcattttttctttaggaaaagtgttttcgttccccaagtgttcgctagctagctctcaatataatatatttaggagtacaatcgtatatatacgtaatacataaatatggttcgctagctgcgctgcgcagcccaattcggatagaatttaagcaccgaatacagttacgtaacgaaactatcgcaaagtatgaattcgaaggatagttaacagatggatcgtcactcagacattgggacatgacgtgtcggcaactagagcgagttagttacacatgtcacttaaaaaccaattatccagcttacgcactgtacccgtccacctaaattaatttacgtgtcaggtatgctgtcgcatagctgcatactactggttccctaaataaaagagagagacggagttcagaaaaaaaaaagagtgagagagtgaaattaaagagagagtatcgtgtcgttgcatatgcgtacgtgaaaatacctaacacgggtccatgcatgcatatgcatgaaactcgatcgatcgacagataacatacgcaatctcaaatctcatatactccctctagtagatgtagttgatttttttaaatatatttgatcgttcatcttattataaaatttaagtaattattaattattttttttatctcattgttaaatatacttatgtatacatatagttttatatattttacaaaaagtttttaaataagccggacgaatggtcaaatatataataaaaagttaacggtgttaaatatttagaaacggaaggagtatatacatatggaatatgtattcctacaggtgtggatattatctccacacttctttaaaaaaggatttatgtcgattggttgctaaccccacatagttgttggatttggtgaccggtatctagtaggcgacacttagttctctcgagggtgtcagtaactcaggccctgtttagttctgtagcgcccgttccgtcgtggcgcctagtgggaaaattatctcctaaaaaccctagttgcgaaatctgtttctttgcttgttgtctagtgtccgtgccatctcaagatctcaatccccgatctatcgtcgagttaaattccgaatccaaatccttccaaatcaattcctccgcaaaagtctattttgcctccccggggtcgatgggccgatttcctctcggcccatctaccccggtgcggcggaacttacttttgcggaggaattgatttggatggatttggattcggaatttaactcgacgatagatcggggattgagat

SEQ ID NO: 94792 - DNA, 2941 bp, Oryza sativa
  unsure (1)..(2941): unsure at all n locations
tggcaagtactctgttgtatcaattgttctgtgagcaatcgtgttgttggagctgaaaacattcatgttgtagtttgagttagaatgctggtgattttagtttaaattgggttaacgtttatttaaaatttgccttgtctatcattttcaaaaaagaaacaggaaatagaaaacaaaataaacaaatcctcaagggcttaaatttattatacaagtagcaatggatgaggttcagggccggccctgaggcagtgcggacggtgcgaccacactgggccttcaaaaattagagacctccaaaatatgtatattacgatatcaggtctgatagacttagaggaaagacaagactaatcggtgatcgagcatatcgtgactgcttgattgtactttaaacttgttagtgtgaaattcgttaatgacaaattagattttaaatattatcttgtatttttatggtgaatgggggccttctttttttttgcaccgggccacaaaagtcaaggccggccctgatgaggttggctatgatgtttcagcctaccagttacgcgatcaaccaattgtagcagctacatgtttaatgcgtcagctatatttgcctagtgataactagttcatccatgcatgaatatctctattattttaaaagcatagtcattctccctccatcccctcccccaccatgcgcagcgagcttgcacgcgtgaagtaacatatgtacgtaaccaccggatccactgttttattttacaatcacacttacagtctatttttatttatggttctatcctattataacgtaagagcatgtagtgtttaagaaagggtgaagctattttttctaactccacaactccagcttcatatcagattggaagccttcggccttagctagatattatgctacaaataattgaatttttcatcttcaaaacagcacaaaacaagcattttttaaaatcattttgaagcatcgttttattttggtagggcaacacatgtggccatggaatggcaggccacagagatcaaaggaggcagattattggagccaaacggcaacccaactctgacgtggcaacagagctagggcggtggaagggccccacatgcgtcctcacaatgaacagtcctttgcacgnngagtacttatngnggngtntttgggggnnncccccccccccaaaaaaaaaaaccccccattttggggggggggggcccccccnnnnnnggtcgcagtaggcgtgtatccagctcattttgtatgctagataaaccataaaccactttagtatcggtagtcaagtcacnttccttcttnnnnntctactttcgagcaatctatctgtcaagctancttgagttgtattctatccgtcccataatataagaaattttaagtttccgtcccataatataagaaattttaagtttttatttatactgtttaaccactcgtcttatttaaaaaatctgtgcaaatataaaaaaaataaaagttgtgcttaaaatacttgggataataaagtaaatcaaaaaaattctaaaattttttaaataaaacgagtggtcaaacaatacaagtaaaaactcaaaatcccttatattatgagacggagggagtaagttgtaacataatccaactgggcgttcgtttgagcgtaaaggttttgatttttttgctagtaatacgagatgaatcattaactcataactaattaacaattaattattaaatattttgaaaagtgatttaatttaaataaaatcactttgaaaaacttctatatagaaagattttgaagtagcttggcgtgaactaaacttcataatatataatttgcatgttattaaactctataaatttctataaatgatatcaaagatagaaatatttaacttaaaaggaaactggagtaacaaataacttaaaacaagagagtatgatagtatttttaagacaaatctcccccgtgtcatttctttctttttaagcctagctagcatttgatagaatatcgacgaataaagcttcaaaagtttgaatcaaatatttctcaatagaggtgtgtaattgttccaggcttcgggacagtctggacgagacttcaatttcctaccggataagtctattttacctccctctatcttgatcctgattaagtcgcatccctcaaaaacaaattgtataacacatatcccatctttaaaaaccagtgcaaatagactccttcgacgatttggaaagcagtttctcctgacgtggtaggttacccatggttaactcgctgaatcagcaagtgggtcccacatgtcagtgacttccaccttatcccatcttcttcctcacctctccatctctctttctttcctttcttactcctctcccaccttccattagtaacaaaggctgggcggcagcgacggtaccaatctttgtagctcgtaggggagtagcttgccagtcggctgcgcgcggaaggaggagctcatcgaccaagtacacaagcggggaggacctggcctgtcgggcacgcacaggggaggtttcactagccgcaacttgcgcagggaggagcttgttggccggtcgcgctaggagggaggacttgctggctggcagcatgtgaggggaggagacgtcggccggccgtgcgcggatggggggaagctcgttgtgtcctccaccaccttaacgggggcggtcaaaaaaccaatccgcggcaccaccactgtgtccgctaactcccttcagtgtcgaggcctcgttgccaccgagcgtcgcctcctcgtgcgagtcaactcgccaagacgaccatcgtcgcttctgcatgagtaaactcagccagtgtgtggtggttgtggatgtgtttggcggcggcttcctctctctccctcaaaggcctctcaacgacgacgatatttaccaattggggca

SEQ ID NO: 94793 - DNA, 1815 bp, Oryza sativa
agctttgcttgcctttgtcctggtgtaagtctagcatagcaagccgcttcaaaaaatattttcgtgctaaataaattcattgaataattttaaaattttaattttgaactatatatgtcattagaaaaagaaaactcctggttttaagtcgatactatttgagctttcttcctgttccaaaacttaaaccgatgtaagggtacaatttgtaggattgtatctttttcaaaacaatttattaccaccaccgtgagtgtggaacatgtattcaatacccatgcaaatgtaccattattaaacaaatgtaccattataagaatgtttgctaggagggcgtggctttactgaagggtgaaagaaatataagcacagggtgtaagaatttatattagcatatcaacgagatgtgccaaaagctagcaagatgtagcttgcactcaagtattatttagccacaagttgcagtcaacaattctactgtgtttgtccaatattttgtcagtccacatccaacaattctattctattgtgcagctacagttccttgtattattctttagtaatcatgactgattaactgttgaggtttctaatgcatcatcatataaaaaaacactaacattttttttcataatttataactttttgtgagggcagttccatatcatgagtaaaaattacaataaaagcaggctcttgttaattgatcgtataagagtgctcagtgggaaaagacactttatccaaaaaaaaaaggaagaataacaagcagtttaaatcattttgtttttcctcaaaaaaattagagtaaatttcacaaaactacatatactttacaaaattatcacaaaactacaaatttaaggtgtattacaaaactacagatttagaaataattttatcaaagaactacaaatttaagatggataatcaccaaactacagatttagttttaaaattatcacaaaactatatgttttataccatgttaagtgcaaatttacaacatttataaaactctataacattagtggtaagtatttaaactataaaatctataattttgtgataactctagtattaaatctatagttttgtgatattttactttaaatcagtagttttgtgaaaagcctcgtgttaaatttgtagttttatgagactgtcttaaatatgtagttttacaataatttggtcaaaatacctgtagttttgtgaaattttactcaaaaaaattatcatttgctccaacagctagatagtcaaaagttttacttgtttcaaattgataggtcaattaccaatagagcaaaactcattagatgccaccaagactaagcatatggactggatgccatagaacagactaagggagtgtttgaggagaaggggattgaggagattgggaagatacgcaaaatgaggtgagccattagctcatgattaattgagtattaactattttaaattttaaaaatggattaatatgattttttaaagcaacttttctatagaaattttttgcaaaaaacgcaccgtttagtagtttgaaaagcgtgcgcgcagaaaacaagagccaatctccccttatcaccccttatcacccctaaacgaacgatgcctaaatggctctgtttttgtcatacatgtaataggattgtacagcacaactacaaatcagtgtacaaatgatgatatgctaaatcgcttctgatgtggctaaaaactaaaatggcgtgaattcatggcaagtgaaaaaaattcccactgggtgctaaggataagacttccctaactttgtaccactgacatgtg

SEQ ID NO: 94794 - DNA, 1298 bp, Oryza sativa
tttattatgtcactaatttctactaatcttgtttttatcacatatttttttgtcagagagctcttccactttattgttcaaaacaatataatatcaggaaatatttgatagccatgatgcaaagcaaatattactccgtggtccgctaatttatcaggtttgccggttcaaaattggtgtatgagaattccaatctttggttgaagaaaaaaactctcttcaggatttgtacggtttcctgccgatcaaagttattacaacaggggtttctcaaaaaaaaaagttgttacaacagggaaaaaaagggacacagtacagaattccttacatgtgactgttcatcctaatgtttgcatgagtgcaacaaaaactagcattcatgagcccatatccttgataacgattatctaaaaaaaatatccttgataacgactgagaaaattgactgacagcaaaagtggagaatattttaattttttttactggttgatccaagctagcccattcaactcaaaagctattccttaaatgatgaagatttcctttaaataaaagttgaagtgatggaagcactaaatcccattcatcacaagaaaaataatgcttctatatgtgttgcacaaaatgcatgtttttggcaactagcaaactagagtgagtgctctatcacctgcaatacagatatataatagctgatacttaatgttgacttaccctaaaagtgacaacttgcaaaagtgctccattgatctatatatttatgtgcatgatttttacgatgataagtactacctccatcccagaatacttgtcaaaagttttcctattttaccctcaataaccattccacttctcatcatatattatttaataaggggtattatagacttttgtattaaaccttaatagtatattctaaacaaattgtgggatggagggagtatataagaaaagaatgatggaacatatgaagtgcgaaaagaaatctgatagtaatttctgaatcgattgtggggttgacaaaacatttcgacatacttgacattttagcatttttttttccgaatcgattgttgggttgacaaaaccacgagctacttgcagaaaggccacaaatcgcatcagcatgcttacttgcttaagtactgatggattacaggtagatgccatggtagtgctgagaaaatgccaacttttcccttttttttcacttttcactttatgcacagaaataaatctactttcgcaattgcagtgcctaaagaaatgtaggaagctgtcattttcgggctgcagga

SEQ ID NO: 94795 - DNA, 3029 bp, Oryza sativa
ccatctgtaccgccgctattgtctcttttagtccaggttggtaacatcaaccgggactaaagatcccctctctttagtcacggttggtagtaccaaccgggactaaagatgaatatctttagtcccggatccgtactcccggttggaaaaccgggattaaagggggttcccaaccgggagtaaagatggtttctccaccagtgacatgtgcatgcagtgcagtgtgataccgaaaccttttttcaggaaaatgtgtagttttcatgaataaatctcagatgtatatttttttatttaatggtagatatctgcaggacatatatagcagacttttctatcttttttttatttcgtgttgaatggaagtcaagtactactctctccgtttcacaatgtaagtcattctatcattttccacattcatattgatattaatgaatatagatagatatatgtgaaacggaggaagtagtttacaattgttaaaaaaacgcgtctaacaatcgtgaaccctaaagaaaaggttcttgaaaaaaaccctaaagaaaaggaagtcgcgtgggggtcacatcaaaattgaacagaactttgtaaaaaatggtgttaattactactccctccgtcccaaaaaaaggcaaaccctgggtttccgtgtccaactttgactgtccgtcttatacgaaatttttttataattcgtattttacttgttgttagatgataaaatatgattaatattttatgcgtgacttgtctttttaattttttttcatatttttttcaaataagacggacggtcaaacgttgggcacggaaaccagggtttgtcttttttttgggacggagggagtatgttgcacgaatgatgacatgcatctaacatgagtagttgtaacatctatttttaatgtgttggaatttagaacatgctactatgtctgtttcatattataagtcatattaattttttttctaaattaaatatttctaagtttaaccaaatttatagaaaaatatagtaacatttataatatcaaattagttttataattcttataattttcagagtatatttattttgttttaaaaatattgctatatttttcggtagatttagtcaaacttaaaaaaatgacttataatgtgtgatttatgatatgaaacagaaagagtcctaaactatttgaaacatatagtaggaatggcttatcttttgtgttactgcgtatttctttgtaaagaccagctaactcaagacagcgttgtacgtacttatatcaggagtaaattaattcatatggccaagtggttaattattaaaaaaaccattgcaggcaggcaacaggcattgacggcattgaaattaattataattaatataatcaagactgattaaggcagttcgtatgtattcttgctaatatttttgcgcctcacatgctgtacatttttatctcgtccaaaatccctattattgatgtacacttctgcaggtacgcatggtcaattcatcaggattcaggacgaagtgctctttgattaatttctctccttcaagatttcctgggtgatcagtcaccaagttaaatagtaaggacatatttcaaatcttttgctcatatatgtgtactggggacgacgacctattgagaaggagcgaatgtgagattgtgagaggtgctccactatggattatggaaagacaagatttggataagcccgacatgcttttgatgcaggctgcagggacagaacagccgggagggtccattatgcatgcaatgtcagtttggactggaatcggtcgtacattaattactccttccgtctctctccgttttaaaataaacacataatatgatatatttagtaatcataaatctggacagcattagaatatgcatacacccctaataagttgtacaacattctagcggtagctcttaaatcatataatatatataggtgttattagaagataaaatattgaatctgatggttgcgtacttaaaatattggaactgatggttgcgtacttactctacatgtgtgtgggcatgatggaaggaggggcagaatcaagaaagaagaacaactccgcttttaagatagtagagaaataaatttattttcaattagtcaaacacatattaagaaaaaaagttaaaagaataccttgcttttattaatatggagagaaaatgttaaaagactagtatatttttaataaaaactaaaactatacttattaggaaggaggaagaagcttattactattacaacaatcgtcacattttctttctcttgaaggcaaatttgcatcagaacctcaattatattataatatatattgttcacgtgaaatcccagaaaaagaataaattcagcgaaaaacatgtgagagttttatttcctgcaggagattgtgatatcaatccccagctgctagctactccccccgtttcacgatgtaagactttctaacattgcccatatacatatagatgttaatgaatctaaacacatatatatgttcagattacttaacatcaaaaataaatatgaacaatactaaaaagtcttacattgtgaaacggagaaagtacttggttaatttgagatgaacatattgcaaggtgtgagagtgagacgaaagcgaaaaggagacacgaacaagtccagcagcatcaggatgtgtatagtagataggagtatactataggagactatagagtgagatgagttcacatattacgtgggcaggggatgagttacgtgtgcacacgtgcgcctctcatgcaaaatgcaaactgcatctgccatgcactccaacgatccatctgatatgaatatgatgcctccacctacgtacatctccggatcttctctgcctacaattacaacgtacgttgaaggggttttttttcgcttgtttagatcgatgatattttcgaacattctatttgctaaaattgatagttaaatggctacatttagtttgttatcaaatattgacaacgtgtacgaaa

SEQ ID NO: 94796 - DNA, 2863 bp, Oryza sativa
aaaaaaaaaagatctgctccagatgctgcaacatagatccatgtaccagacggccacgacagtgtggggagaggaaggtagcgagcaacacgaaggaagaaataaactgtgcaggaggaggacatgcaccttgttgggggatgatgtgcacttattggcggcggtggtgcaggtggggaggagatccgatggcgacggatcggagtagcggccgaagacgcggcgatgagatcgagtttccggacggcgcgacttgggaggcgctgctcgcggcggggaaggggacgaggagacctccgggagattaattcctttttgttgagacgagactcgagacgaatcggatattgcttagggcaaattccagacggaattttgttaggattcgttgattccaattccacgtgaagccaaacaggttcaccctcccgtttccaattccaatcgataaccacggtacaacgggacatttaacttttttttttgccactttttaaaagtgacaattaagaatttatcgggatatttaactttttgccacttttaggatgtagcagttacttcctccgtttcaagttatacggagtaagattctgtgtcaggattcattaacatatatatgaatgtgggcaatgctagaaagtcttataacctaaaatagatgtagtaattatttgtcactcattgtttatgacatgtgggctattatgtatctatgacacgtgggtccagtggtaaatcctttatcaccatccgtaagagtgtcaaataattaatttttttgaatttgccactcgatgtctatggcacctgggccctcatgtgtctatgacacgtgagtccagtggtaaatcctttatcaccatccgtaagagtgtcaaataactaatttttctgaattgccactcgctgtctatggcatgtgggccctcatgtgtctatggcatgtgggtccagtgacaaattatttatcaccacctgtaagagcgacaaatagttaattactcccggtataataactagcaaagtgccatgtgttgttacgggaaaagctgtaccaaatcctaactcgctattttttttttgagaaaaggagggaaactcccccgttttcattaaagaaaatgcaaatgattacaagagttccagagaggaaaaaaaatatcaagttcttacagaaaagacgaggaaaacaaacagttataacaggactagaacattggaatttcaagcatcaaaacacaggtttccatcgtcgtcttcaaaactccttgccattagttttagcctgcttctgtttcccatcctattctttgtctgccgcccctccatccaaattttgagtgaaagatctcatttgctacctgccttagtagctgcgccccccactgcattcttcctctgtcttcctccttgctctgcaaaatactccaagagtttaaatttgagcaaatgttgtaaattatttctataggatcaacaggcagaattccatcaaagcaggctctgtttcttgctttccaaatggtccacaagactgctgtagcccccatcatgatcaacttcccattctctttgccaaatttcaaaacccaggagctaaacatttcccccacattcctgccaggcttcacattgagagcgcattcaacaacactcaaaaaaaaaaatcctaactcgctagagaaacgagaaaattgaataatactacgataaaaataaatgagaatcggattgacgaggatggacatatattattgtttaaattcagactcaaaattagtaagaaacatatcctatacacgtaagtttctcgtgcacaccaactaacaaaatgtcaaaaaaaaaatctacaaaaagttggacatttacttgtagtaatattacacatatatacaaagtctcatattcaaattcattatattttagccataaaaaagtgaaaattttaacagttttaagggtaaaattatgtcggaattttaccttgttacggttaagatacaatgaatatgtgtaatactattcgaagtacgtgttcattttttttttctaaaatttcctatgagatttgctagttgggtgcacgggaaacttgcgtgcacaatatatgttcccaaattagtaactacaccacatttagctacttacatcaaactacgcataaaatatcaatagtcaaatcaataccgataattgatcctgaaacgcaagttagagctattgatttttctgaatttatggacctctgtcatatgtatgatggtagtcacggatggaccatcgacagaagaatctcttatattattaaaacaattttaaaagaaacattcgatccgtttacaatctaaatagggcctcgtatagaaaaatctgtaattagtagatgagtttaattcaggagatgttcagttgtactgctaacatttgggtgacaaatctgaatcacgtaattgttgagccgtatgtcatgaacatgatgagcacgttggatctgaaccagccatgggctcatttgggagccaaaggaaaaagggttaattggatccatgccactgcaaatatggcaaatcaaaaaaatgccactactattcacgttatcggctgggtgccactgaaattttgcaaaattcgagctatgccactccgtcacagcaactgccaatacctccgttagctctgttattgcagatccctttcttctccaactcaggtaaaaatctgggggcgctcaggctcatcgacgacggggcagagagggcttctccggtgagggtggaggggagcgccgagcgcccccgcgctggaggaggggcggtgacgagcaggtcggcgaggaactgctgcagctccacgctcgagc

SEQ ID NO: 94797 - DNA, 1530 bp, Oryza sativa
cacaagagagttcttgaaaagttaagagcacatcaatgagtctaggacatttcactgttagaatgcagatttcttgacatttttgtcatggctaagtttgctatactagcacaatttattttatgatttgtattgtggtgctgcaagccggcaacagtagtggagaaccactgaaatcaacttgaaagtaacaaaatggcatgcagctgaatgcagcgagtgtgacttgagagctagttcagacatcgttttttttttcatggaatcactgcaccagtcgatcgaggccgcactctgacttatctgcatttgttcgtggaagtcagacatgcatttttgatgaacttctgcaattataactattactgttagaaattagaaatgtgcatgattctgaattctaatgagtgatgacagtaactgaatgttctgagttctgaatcactggacccgatcgattagcaatccacggcagctagttctgtaaactgggtcgattgaatcactggatcctcctaattgtgtaaaaactcacagcttgaaaggattggacagatttgttttgtttgcagcagcgatcagaagttcagaactctgcattttgtatatgagcaattctatggttcttgaggaggtactatgagataccaaaattttagtgtaaaattttggtactttatggtacctcgtagtacctaggtatcaagaggtaccaaatttgcaatagaaaaaatggtacctccttaataaccgtaaaattgctctttgtatataagatttgcagagtccactgaaatgcaatcccgaacctgcgccgcgtcatttgagcaaattctgtaccacgaaatctgctgcactcactccctgtggtcgggcccacccgtcattgactacggttgaccaaagttgaaacggggacccacctgtcagagagcgacctgcgtcttctcgcgacgccttcaaatgccaccgcctccctcggctaacaaactcttccacggctacttgcctctctcgtcttcctccccacgccacgccaccgaggagtagccactcgccgccgcgcgcgcgctctcgccacgccgcgctctcgcctcgccaccgcgcgtgcatcgatcgctcgcggcgctcgccatggcgtggagacgtgggacgtcgcgcgggtatcgggtggggatggaggttttcgacgacgtggtgttcgcgcggctgcggagccatgtgtacggctcgtacctccacgccgacgaggacgggaggtccgtctaccacggcagcctccgcggcggcgcctcgcagcacaacgcggtgtgggccgtggaggagttgctcgtacctgctcttccgtggaggagttccgcggaggaggaggaggccgccacgcggtacctgctcctccgcagcgcctacggccggtacctcggcgccaccgacgcggcccccggcgaggccgcccgcaacgccaccgcccgcgccgccgccgccagctctgacgtccgccaaccacacgaccgcgagggttgctgcggc

SEQ ID NO: 94798 - DNA, 1522 bp, Oryza sativa
tgccgagaccccatccaggctccgaatggcagagcaaagcactccactccaagcaaggagataaggatctggagagccgcggcagcgacctgacctgaacccctgaacttggtggcaagagggagacgaggcgacgcgagaggaacacagtagcggcgagcagcgagccacacaaacccgctttaaaatcgcggggccttcgctgctttaatttctcgcccagcttcggtagccgcctcccagccgcacaaaccccctccccgccacaccaccacaccttaccctcgaaccgagcaagcagcacagacagcacaggttactagtagttccaactcttcaatgcacagcgaccagcaaagctctcccctgaaaactgcctagctaccgccacagcccacagaccacactgctcctctgctcctactatgcaccaaaactcaccggaaagctccaaaagcgcgcgcggagagatatagacgacacgaaacaacgactcttgacgccacatacaacacgtcccccccttgctcatcatcaccacgggaaagaaaagggaggagaaggcgatggagtaggcgcggccactggccaccagctagtgcacgccgctaccacaccacacacgccattatgctagctacttctcccttctccggcggtacaccttcattcatttcattttaaatacagtcgtgaattttcgtgtttaatgtttaattatttttttatttaaatattttatagaaaatataaaaataaccatatataaaatattgttcatgttttatcgttaaataaaaggactaccctgttgccagtattcaacactcgcaggcgattccgaagaagatttgcgccgaacacgagggcggaaaaaacgaaagcatcgcggagtaaaaaataacagctgagctgacccgaatgacgtggagctaccaataatggaaacggccgggccgccgaagacacggagacccggacgcccgtctgttgaccgcccaccgtcgatgacagctcggcccgcgcctccagggtggcccacttgtcagtgaccttctagcacctcgttgcgcgtgagaaaccagcggggtaggagcggattaggaaagccgcttggtttatccaagagagtggcgacttgctggcctttttgtttaataaccactcactccggcgtgtacggggtgcagcattagtgttgattagccagcggagtgttgaaacccaacttaaattacccatcgatcgggtgacgggtcactgtcggtggggccggcgtaacgcacgccactcatgggcccacctgtcagggagcgctgggccggcgagcagctagcgcgcgcctttcggactcgtcttcgcagcgggatacgtggcgcgacgggggccgcacgtcagggttgggggcttcgaggtggctcccatgcacgagccacgtatctacgtttaaataagataacgtacggtttaaaatatggcgtgcaggggagcagatgaacagggcattcggcgtgagttcttc

SEQ ID NO: 94799 - DNA, 1364 bp, Oryza sativa
agagtccatatagaaatacaatttagaaatagctgaaattcggaattaaaaaataggaatattagaagaggagactagagtccatatagaaatacaatttagaaatagctgaaattcggaattaaaaaataggaatattagaagaggagactagagtccatatagaaatacaattaggaaatatctgaaattcggaattaaaaataaggaatattaaaagtaaagtatagagtccatatagaaatacaattaggaaataaccaaaattcggaattaaaaataagaaatattagaagtagagtataaagtccatatagaaatacaattaagaaaaaaaatagaaatttggaaataaaaaaataaggaatattagaagtagagtatagagtttatattggaatttaaaaccaactaaaattcggaataaaaaggagcctccacgttcgctctcatggcctagaaattctcacattaatcagagaaaaagaaaaagcagagtccatatagaaatacaatttagaaatagctgaaattcataattaaaaaataaggaatattagaagaggagactagagtaattattacacattagtagttttgaaaagttattgcaaaatttaaaattatgttgttattgtaatatattttaataatataatgagaaaacatatatgctattatataagagaaaatataatgatgctagccgcgcaatttgcgcgggccaccatgctacttttcataatctcacgagaaaaccctcatatttagggggaaaaaaatataaatatacttttttttcatcgatataacataaatatacaagtttagaagtaaatggcaaaaatatatcattatcacattattagtaattaattaattactaattaggattattaattacgtcgttccagccgtgtctcttcggcaacaagtgagaccgaacggactcgcactctcacctgggtacgcctaatgggcgatcgatcgccgtagggatgcggtagcgatcagaattaagatgaaaccttcccccctccctccctccctccccctggtttcctttttttggcaccgcattacttttcttttttagtaaatttatacacctaaagtttacacatctaaagtttagagaccaaaagtttataagtcaaaagtttatatatccgatttaaatttgaatttgaattcaaatatttttttatatatagtatttctgtacatctaaagtttatagacctaaagtttataagtcaaaagtttatatacccgtttcaaatttgaatttgaattgaaatattttccatatatagtatttctatacattgaaagtttatagacctaaagtttatatacccgat

SEQ ID NO: 94800 - DNA, 2139 bp, Oryza sativa
cgagttaaaggttaactcatggtgacgtggacgaatggcgacgtccatttctcgatccaacggtgtaggatgagagttacattattgcaccgaattaagtgattgcacgagatactttcccctgttgacagataacaatgtatattcttcctcctgtattagttcctcctctttttgattatttaccgtatagctgactcgccggcctcaggggctccgacaactgggagaacagagatagacacagaactagttcaagtgcagcggcagcgtgacatttttatctgtttggtttgctaataacctaataaaacttggtaacaccaaacttttgataaggtagcaaagcaaacactccatcaaactatctatctatctatctatctatctatctattattatatactaaaagtccattaaaattcctataaacactaataaaccaccacatggcacatctataaatactcctagaccgccaagtggcgctctaccaaattaaagaaattccaagaaaaataaaatatctaaccattaattttcatttaatccggtggacccaaattttttaaccgttagatctaacataaaagataccaaatagatttatatttagaaagcggcacgttctttgtcgatccatcccgtacatagttcgtacgtatgctcccttcccttcttttcttttttcttttttttcactctcatgggataaaaaccaaattaataaattcagccaacagttgtaaaaatatatgttattccgagttgtattctagcacaagtccattaaacttcctatgaatgcacaagtcgccatgtgacatcctacatactctcctaagccgtcacgtgacactctaagaaattagaaaaaatcttaaaaattatgagaaaaaagaaaaaaatctgaccatccgttataacttataaatcggtggacctattatttctaaccgttagatatatctcaagtatcggtttcattttcagtaaaagaaatctcctctctctatatacgtactcctccttctgtggtatgtaggtgaatttcctattttatagctagcaaccccatataaaaacataagtgatcataattgttactaagttatataataaaccacaatgatgcagagaaatcaaaatattgaataggttttcaacgtgcgtgctgcttgctttaatttggttatccaaataggctaacctattcttgctaggattatcaatgcaattagcattaggtctactacaaatgagggtgtgcatgcacgtgttttcatcctgctaaactctactagatttatcttttattggctaaacaacaagcaccctaaataatcaacaaatttgcgaacacatctaaatttagatccatggtgtctttaaaaaatttaatgattcaaccgtgtaaacttctactgaaaagaataatttttagggcatgtcatcctaattaccatttaaaaatcaaaaaaattatatactaataatccattaaactttatacaaacacatatatactaccacgtggtacgcctataaacactactaaaccgccacgtggtattataataaattagtgaaccatctattttcaactattagatttatcttttttttcttaaaaaaaccacaatccacatccctcacccctctcccaccggcacaactctcctctccccactggcccacccttcccaccaccccccacgcacgtaagtatacatacatacattttctttatctccaataattctttctcatcttcctattttataaataacaattttaattataaaaaatattatgaagaaaacaaatctaaccatcaattttcaattaaattggcggacttataatttcatcaattttcatttaaaacagtggagttataattttaacaattggatttaaagacataaataattcaaacagatgaacgtattaaatctacctcaataaaaacaaaatctccttaccaaataacaacaagacattgaaaaacatgatatatatattcttgaatcgttttacacagtaaagatcgattaaacgtgctgtatagcactcttaagtcaccacttatgatattgtaaaactttgaacaaaaattgaaattcaaagagaaaataa

SEQ ID NO: 94801 - DNA, 1061 bp, Oryza sativa
tatcaccaggtaaattattctattttcacaacaccctgatgaaaaaataattgaaaccggaccatgacacagactttgagtcgcacatggacacgatctcgacgggacactcaaacccaacccactcaaatctctacttgaataaagaaaaaacaaagtcccaacgttcgcacctatgatgctgtaatcaatcaaaatatgcattgacattgaaaaagcttaagacgaaatttaaaggattagaaagtaaagcgcaaaggaaataagaacagaagctgagggtgagggtgtcactcaggtgatcaacatatcgcatattagtctttgattcatagctggttgatgtgcggggacacatgcatagggatactgacatgaagctgaatcggtaacgcgcatgaaatgaaataaagaaaaatcggcaagacggacaggagcgcgagcgggcgggagacatatggacgaaggacggatggaccaaaattggagtcggactaagttcgaaagtttgctggttcccacgcggttgacgacggatataattaaaaacctactcaaactgacgtaccaaaatcttggcaaaaacatcttaaatttttataatagtagagattataacgagggagtaagagagaggaaattactgcataaaatccaaataggatttctgttcacgcatgcttattactgattcacagtagtatttgttttggtgcactatcttggttctactcggattgttttcccgtaaatatatgagggccctgtttggaagattagcccagggctaatgtttaatcataaattggtaggctaaacattagtctagggtggtatgtttggatccatgggctaattcaaagctaaaaggtggagagagagagagagagtagaaagagaggagagagagagctgctttttgatggtcctcacacaaaattagccccattagcaccccatagagaggctaatgttttgaggggggctaattcactttagcctcaaattagcccacctgtttggatccttgagggctaattcagggctaaaatgtgagggct

SEQ ID NO: 94802 - DNA, 2950 bp, Oryza sativa
ccgattcttgctctgtttccgaaacgatctctgtcttggattccgcttcaatttgatcttcatctctgatacctagattaccaattttggtcattaacagaagctacaatacaaaagtcatcctataatttctccatagatttaaatcttaataaaggcatggaatttaacgagaaaagtattggaaacaacagaataagcaataccaacaatgaagtaacagctcggttctacaggaatgacaacaacaggagcgacaacaacggtagcccatcattgtctgcccggaggatggttgcatgtcctacgaggatttaaaaagcagtgttaggaaagccaagcaaatcaatcgacgttgtatgtataagagcaagtataatagtgaaggagagaggtaacaagaaattaagggtgttggctttcatgcaagagctagcttaacacaagctccaagacaaatacattaaatgtataagtgagagatagagagaggagaagaaaattatagccaattttatagctactctatcggtaaatctaattggagaggcctagttttaaccagagacacccacgtgctagtactttaggagttttggttgctattagtatatccaatagtgcatatcttgttttcttcttatagaattttctcttaaactagttatctaatatacaatctgattacaccattacgttcgttgcaattaaatctttacaacaagatcttacatgattatattacgatgaaaaaaatatttatatttataaattacttttattatatacgtaagttacttttatcatatatatatataagttacttttagatttgactaaattacttctatacattcataatgctctaagttgattatttttattattgtttttagttaattctatattttgtggactttataaatcttctctatactttacttgtgaatctactctacatagtttcttatttcagctcactcacaatataattatttctactacagagagttactctctccgtttcataatgtaagtgtcattctaacattactcatattcatatagatgttaatgaatatagacatagttctatgtctagatgaactatgtctagattcattaacatctatatgaatgtaggcaatgctagaatgtcttacattatgaaacggaggaagtatttcaattgcataactaagttacttctgttgcatataattacttttactgcagaaagttatttctattgcatagataagttacttctattgtatagctaagttacttctgcaatttaaatacattacttttaaattaataaattatttgaatatatccaatatggatcttgcattatcatatgtagagtataatgatgcaaatagatcttaaaaataatacgtgatttaaaatatattagttattaaagagtttaaatctaaatgaaatttatgtatatgataaaaataacttacatatataataaaagttatatatatatatatatatatatatatatatatagaaaaactattctacacctgggtatagaatagctattctatacccccctccctaccaagggtcacacccacctccccctccttaccaaggcccaaaacccacctcccacctcggtcaaaggcccctcccaccggtcaaacccgcttactaactcccccccccacccacctcttctcagctctcgtcccaggacggtgcagtaacacgacgacctctgtgcagtaacactgtgtcttatgtgcagtaacaacgttaaaatatagttgaaatatagtcatgacggatctacttttgataagctctttttttctagcatcatggtgcaaacggttttaaaaaaccttacatcacttgagagatattgttcttcaaagcttgactttttgacaatttatctctctacaagtagtagtaatactatactattacttactattacttgttactacttgtctgttgtacgttactacaatcgcatcacgatgttactacactgcatattactgtattttttgggtagtgttactgcataaacacgtggtaacgtatacctttcatgcagtaacacttttacttttgtgtagtaacaagtataaggttagcatttgaggcttttaacctatatatttttgtttcaattcctgatttactgtaattcaccacaatattactgtcaaaagtgcagtaacgtcatatacatgcagtaacactatattggagggaggagaccgattttcttgagaagaggggggaagaacggtttcttgaagaggagagtacgtagatgcattttgaagtttaaccttccacatgcagtaacactatagcattatggtgggaacgattttaaaaaataatacatatcttgtgagatattgcttttcaaagattagcattttgaactttaaccctccacatgcaataacagaatgtgtaacttgcagtaacaaagacatatacatgcagtaacatggttttaccaaatgtataaaattgttcaaacaactcttacatcaatcagatctcgctcaaagccacctacaggctttacctatagcccacctattcgatcttcatctcgtaaaaatgacatagtaaaactataattatcgtgcagtaacatagctacttgaaagtggtaatatgcgcctattatgtagtaacacttctactttcgtgcagtaacaaatatatggttagcatgtgaggctttaacctatatattgttgctttgatttctgatctactacaattttactatgacgttactcgcagaagtgcagtatcctatgtgttatacaataacgtcacatgttactgtacttttacaacaatgttactactagagcatagtaacatgttatgagttttgatagtaaaagatattaaaattgataatcatattactttctcataaaattct

SEQ ID NO: 94803 - DNA, 1709 bp, Oryza sativa
tggaatgcgtaatcttgtagaagtaatgctggaaaaaaaataccagtcaacaaatggtgaggagcaggaattcatgtatctatctgaaagtttcctagacttctatcatgtcaaaaactctgattctgcctaaaattccatgacagaagtgtaataataataatattataggtgcaaaatgcctcttactggcgctcatgagctcacaggctttgtgacaagtaatccaaatactaatggcccatttggatggcccaggatcctgggctggtccacggtgaactaacttgggccgttaggaataggccgggttcagagtttcggcctccatatgggccctaacactgaaacagtggcgagctctgtgtacttttccattgggccgagatgtaactttaacgggctgggccttgtaacatcattggtgggtctggcccatctaaagaaaattccaaacttctgggcttttgtttcggcctaacttttttcttcttctgaaattccagcttctacagaagagaatgcagtagtagctgattagctccttttgttttgttgcagaaggtgacagacgattatttctactgtcaagtgaagcatctagttcaatctacgcgtctggctaatctgctacagcacctaatctcaaatcctttttgtattcatcattaacgaatactaggaatcaatcacctggcattgcctgcacagttactgatgcattcacgacaagtttctgaatctgaagctagaactttcttcagacaatccatgtgacaaacttacattggattattattattacttctccgttcactgttcaacctctggagctgtggagagagttccagattgtctacaagtacgaatacctgaagatatcagaaaacacaaaagattctgcttcattatcttgaaaagaaaacaagagactgtttaaattgtagctaaaataaaccttatcaaattttagtaatgctaaaattttagcaagatggcaatattgccaaaattttagcaatatttcttatgtactccctccgttttacaatgtaagactttctagcattacccacgtacatataaatgctagtacatgtgtttagattcattaacatctgtgcttagattcattaacatctaaatgaatatgagcaatgctagaaagtcttacattgtgaaacggaggaagtattgattaaatttgataacaaactaaatgtagactaaaaatagtatggttaaaaatgacatcaaagtgaacaactgagacttttgtgtcaccggttttggaaatggactgaaccaattcgggacgatcgacatggtgccaatcatatccacaagtaggtccttttgacatcattctcattgaaaatgagacaaaaagcaaatcaatgggtagatcatgatcgccacacgtactggcaggcactggttgccgctaagacttcagagtaaagttcaggaagattatgcatacagaaagtttaaaaacattcatcctttttgcatagtgattaaagtgggtgatatcatcagtcagcgcgagattttggaagggcgaagtgttcttgcagttataccattttaacgtaattgattgagttcaataaaaatgattattatacaagttttctgaagaaactaacatgcattatctgaataaccaggtgctatatatattattcttccaagcaccgacttaa

SEQ ID NO: 94804 - DNA, 1575 bp, Oryza sativa
cgtgaacgttgtcggcttaatcacacgacatgattgcaaacggacatctggatatgctacaagttgggtgtgtgagtcatgctggccacatgagatacacatgtaataaaccaactctagcgctttcattgttgttcgagagatgattctactcgctcgctggttctcgaaccagtacgtagcaatctcccacaccgcaacttccattggtgttcgagagatgattctactcgctcgctggttctcgaacaagtacgtagcaatctcccgcaccacaaacctccattggtgttcgagagatgattctactcgctcgttggttctcgaaccaatacgtagcaatctcccgcaccgcaacctccattggtgttcgagagatgattctactcgctagctggttgtcgaaccagtacgtagcaatctcccgcactgcaactttcattggtgttcgagaaatgattctactcgctggctggttctcgaaccagtacgtagcaatctcccgcatcgcaaacctccattggtattcgagagatgattctactcgctcgctggttctcgaaccagtacgtagcaatctcccgcaccgcaacctccattggtgttcgagagatgattctcgctcgctggttgtcgaaccagtacgtagcaatctcccgcaccgcaacttccattggtgttcgagagatgattctacacgttcgctggtcctcgaaccagtacgtagcaatctctcgcaccgcaaccttagatggtcgaggtacgactacagtaataacgcagcagtcctcgcacgacaacttcaaatgatcgagagacacctactcactggttctcaaccagtcaatcgtagcgatctctcgtatatttatttctagtggttgagttacgactactacctggttcttgaccagaggtgtagcgattctcccattacctctacttcaacaaagttgatatcaggtacacaatatctccaagtgttttacccagagatcccttaccacaaaagacacctagcgttgaaacctatcctaatgtccctttacaccgtcttgacaaagcctctgaggaacctaagggaacttcggctggggaagtctagagcggataaggtcttgtcggatcctttagagacgaaagaccatgtaagatctggtcgtgtaagagttcttgccgtgcgtattaaccaagccgtgtaatcggaaatggattttccaacctcacggctgggggctaggatcagtgcttgttcaaccgaggtaggtcaaaggtccaagagccttatcctccgagaacgattctacgacgacaagggtgggggctagggagagtgtataactaaacaaattgactgatcgaagtcggtaaaagagtagatgctcatatacaaaacattggtttgtaaacctaattcattttcagtttttcatacattctataacatgttaccctttgagcactcgctcgggggctatttctatctaatattcttttttgagtattggttttagaaaattctattcggcattatcaaagactccatgtctctatggttctacaccaagggggtgc

SEQ ID NO: 94805 - DNA, 4645 bp, Oryza sativa
tttggatgagggagtatattttattctctctagtaattatggagttagacttagggcctatttaggggagtttaagattctactaagcagctgcttggtagtcaacttctaagaatatggaaaagctgggtttcccagcttatggcttctagttcatttcttggattctacatctatagcttctcagaatctggaccaaaagctgaattgtttggaggagcttttgattttgggataagctgcagcagctagaagctctcccaaacaggcccttagaatagtcttcggtcctctagtcttctcggagattccggtatgtctttagtaccttactcttctattaagactattagtgttcatagttcatatatagtccattagtcatgtgttcaatgagtagattatacttcatctatatgcttcacctaattaggctagtcgatctatgctacaataacggtgcaatgatcttaacggattgcactagttttaacttgtccaccgaagggtgggagtcatggagaaactagtgacattatttattaacataagcatggtgtgtatgttagttagatgccattggatgtgggtatgcccccacggaaagtgaggtaggcaacaagtggtgatagctctgtccgtccgttgtattcctccacgttcaggtatgatgtaagagttcgtaaaatttcacaaccacactggcaaactagcatggagtggcttctcggtagtacctgggtgtctagaattaaattctagccttgcaagcatgtatgtgttcagtgtaaactaaacattaataatatagaagtacatatgaaccttggctttctatagttcttctccactgcctagtgtatatttataagagataaatctcctgtgtgtaattaaacccattatcatttatcaattaacccatatttagactatggcggcgaagcaattattgtttgaactatatctttacaccgccacattccccgcggaaatataaatacggtatccttggaatactcctaagtgaaatgctacaggagtatccgtgcgcttgctgatttatctgtggccataagaaataccaacaaatatttatagcatgttgccaggagaggcactggttaaagatttagtcacatatattcataatcatactatgattagtgaaccttagtccaaacaagttaaccttgatttgtcatggtcttccgtgcgtgcatctgcaccatgcttcctccgccagcgcacatgcgcgcgcgcatcaggcatcaccctacaaaggtgttgtttagaaatgtattaccactcaagtttttctttaatgtactatatttttttcctccaatacactcgaaagttgtatggtattgaaatattaatatcttatttggcatggaagttttggtatcaggaagagaccttgattgggagatctttctgccatctatatatagtaatagaatacggaaaatatactagaaaaaatctaaatagcctaggttttttaaattttaactagctatagttactcaccaattgtttcttgtaatctctactttccctgtacaagacctgaaccgctccctttacgttcctacgattaataattaaatgtgcacttcacaaagtgtctttggaggggcactccaataatgatcggttgtgttctgtagcaggcgtcatacgccatgcctgcaggctgcaacttgtatatatagttgtatttacaaaacaaatgggacagctatttaagtagtcaatcatcccaattaagtagtggggattgacttcaacatgtcatatgcatcatcaatatattccaaccttcgtggagtagtacaatattccaacttccatatgaccatatcctagttttaaaaaactcaagttgtcaaaaccaacttcaattcatcatagcacaaagaatatatcagcaatacacgttatttagatatgcggctgcccagcctagaatacagaagatgacttttctcatgggtgtgttttatgcgagatgtcaaaactcaaggaacttaagattgggacccatcaaatggtggtgtgtatgcatgttcgtcttacatctgttccgatcggaagaaaagggaagagagaaaactcaagattggggcacatatattgatagcgcaaatggaaacgcttcgacaagtgtatagagtagtacatttgtgtggcagttgtaaaatctctggggagaaccttcgaatagaacaagtatcctaaccaagttcctccagctagccagccagttggcaaagtgtgtggtgactcggcgcagtcatatagtccacggtgaatggaaatgttcgcatgaattcgaccgacaaatggacaaggcctcctttcactctctttgatgtgggcattcgttgggcgtttgtgcagtgtgatttgggaagaatggattattcaaacttggctagctacagctgataatgagagttttcggtttctttgcctagagggaatgcattgtgcaaaaaaaaaaacaattttgagtttttctaagggtgactgaaatacatggtggacgtggtcacatgcaaactgaaattgtgctcactttgtatggaggatagaattaccaagacactgatgtaaaacatgattcactacacctttagttcattatcttaaaaactaatgtttaactcaatcccttcgttcatgtcacttgctgattaaattatactccctctgtcccatgttagttatccctccaaagtattacttatcatatcaatcacatctctttcaaatttatccctattctatcctcaaccacccttttattctcaaccatgcattatttgataagggcactataatcttttactctaaacctatgcatatgccaaacaatctagaatactccctccgtcccattttaagtgcatttgcggggttttttccaacgtttgaccatctgtcttattttaaaaaaaattatgaaaaaataaataaaaaagtcacataaagtattattcctattttatcatctaataataataaaaatactaatcataaaaatttaaataagacggacagtcaaacgttggatacgtatatccacaactgcacttaaaatggaattgagggagtaaaaagtaatagtaaggtttaaagtgttatagataacaaaaggtaacagcaatcatggataatgtttaaagtgggtagataatagccatgcattacacatcgattcatttatactttaacaaagtttgtctggttttttccgataaaaggccagaacacagtttatcacgtgacaaccaaattaacttgaatgactctagaataaacaaaattatataatttccttagattccgaaattaattataaaatggagtaatgtccatctgatatgcaagaacggaatgagatatattatccattaatagcaaaatgcctaagctttgctatgggcagaagaaaaaaacatcataatatgtcatagtaaaatatattcttttatcaaatatcttagtatcatttgtttgcttatttgactatgtagtatttacttgtttgaatcaaatgttagactatttcacaatattagaaaaatatataggggcaatttgtaaaaactgtaaaatcaatagtgggagtgatatattcaccaccataccactggatgcttttaaaggagtatatatatgtatgcctccagcaccttaattacaaatctcaattatttcataaaagaaattggagatgttgccttctccatgtgtaccctggacttgaaaagtcaacagatctcaaaataggaagatataggacatttacaatagaaaatcataattcacgaagtagatgattggatggaaatagagccaaaaaaaaaaaaaactctagggaagcacaaaagcaaagtcttcactgtctttctctgctggaaaacgctgggaatcttctgaggggaagcatattccattccaatctgcatttcaaaggaaaagtacttctttttttagataatgaaggaaaagcacttctacacattcatttcatgccaaataggacatcatagactccaatgcatatatttgatcattatttatttgcttatatcataaaaacattaactaaaggaaagtgtttttcaagagaaattttgtactaccattctcccgtaccaaaaatctattttttttcataaattagtaaattaagattttaaggtttcactacatgcattttaattcaacattacttattttctgaatatttgttgtactatagtgcatgtattttctgaataaatagcaagtagactttaggttttttttttatcattctaatttgaaaacatatttagttttgatatttattaaggatagctaaccatcagctgatgcacggtctagttttttttactatttatgttctacctctgtttcaaaatgaagatgttttgttttttttaagtaaaacttcttcaagtttgctcaagtttatagaaaaatgtagtgacatattcaacaccaaaggagtacttcccctctgcaattcctgatgaccactattaaaaatatttttataatacgtttgtttagcattaaaaatattgctatggcctatggtttctataaacttagccaaaaagaa

SEQ ID NO: 94806 - DNA, 1465 bp, Oryza sativa
atcagtccagatatatagattagcacggcttgtcttctcagccctgtaaaaagaagatgggggaaatcgagagagaccactactccctccatcccacaaaacctaatctagatagggatttgaaatagagaaaatctcttaactactcattgaaaactcgtccaattcctttcataccatcaatttttactcgatcctctccatatcctcaaaatttctctttgatcccttctatgtctctcccaataggtttctttatttttccttttatgtgtggttgcaaatgcccataataccattgtagatggaggagcggcagctagattggaaaacaattgaaaaatgttgactgcacagtatgtgtatttcatgagactaaattaatgagtgtataaaaaatttattatggtattgaaaaaatgcaatactttgaaccttttgttttgaaaaaaaaaataatagtatcaggaaaatcaaagtaactgtctgtatggtcgtcatcagtttccaacatacatgaaattggttcctctatagaagaagttctggtacatttacattagaataccagatcttttggctattaaacctctcattatacagggtgatagagaacaatcatcaggaagcaaggacaatggagaaaatctattgcagaacatcaagagcatccatacaaaaacattaggaccattgacagcaccaattgacaagaaggaaatgaaaagagcacccatacaaaaatttctgaaataaaatacatctggatcattaagagcatcaggagcatcgtacaaatcagtagcatcctgtatagaacacttcatatcatgcacacaccaaatttcatttccaccatacatacaaaacagttcatatcatgcacacaccacaatttcatttcaataaccaaaccaactttccattccatacacaatagtgcaatcgacaaaccaaattaactaaatagtacatcatgagcataatgacataaggtccataacagtacatcactacatcatgatgaagcaatccttacaatagcaaaatatgtgaatgtagctatgtctacagcactttgttgggcatcacaacagcaaaatccattaacctccacaagataaatttaggggcgaagccaagatttatggttaggggggtgtgggcagggtgaacaagtcataagtcagagtaagcaatgccgataacaaaacaagatatcatgtgttctgctataaaaaaagcttgaatctagctctttagttgtattattggatacttgacagtttgagacttgaggcaccatgctcgacagcgagatgcaataggaggacggagagacgtgtgaagccgaagcaatgaagacgatgagttgatttgcattgtctctccgtctctttcttattaattaattaacatgctaatgcgctagtcagtatagcagggaggggggtcggataggggg

SEQ ID NO: 94807 - DNA, 1732 bp, Oryza sativa
  unsure (1)..(1732): unsure at all n locations
gtctttttatctctaacttcgggaatcttgggggttattccacgcccgggttttcgatttgttttttatgggagtgcaccgggtttttgaggacgtagtttttttaggtacgattgtacttggcgacctccaccagttctatggtcccacccacacccggtgccacgcataccgaacaggcccccggtttgtttgctcccgaagatttcacctgaatagtggggtgcatgcatgctttttggtgtcaaattgagaggacgctaggtccaatgcagcaaaacgacgttctccctagcggcgtcaagtcaaacatttttaactttgactatcaatagtaaaaaaataaaaaaaacttaatcatgaaaaattgatgttactagctttaacattaaacaaactatcataatatgtaactttttttatttacaatatcttattttatagatattgttgatcaaagtagcatcttaaagactgtgtcaaaaatccaaaaatacttatattttgggatgggggagtatttccctagtcgaggcagggctcacctcttcacctcccccacctagtctttggccctagtggtggcctcccagagcccaaccgatggtggctgcctctccttttaatgtagatgaatttttacaatcctaaagaaggtaccacgaggtaccaggtaccgatcgaatctggtcattgatttcataggggtaagatagggaaaagtacattctgtaaccgatgctatccgctcatccttagagcttattgatggtccttaaatatcaaattcgactatcaattcctaaataaaaacaatgaaagaatacaataaaatgacaaacttagaggtagttattattactaaccatttccacaagtcttggtgaatatttgtatgcaggtgaaatatggatgaaaattacccaccttgcgatggaatacacctccgtataataggacgcgagtatacatattggagggcccacaaatcagtgcataactgacatattcaagggctaatcaccgtgcactgccgcaaggacccaccaggcagcttcccgaaccacctttacgggcgctcattcccaccttcacatggagtttcccaccgactacaagacttcatctgggccatgcattggtgaagacggtgaatccaagggtcgcccaaactcctagttcggccaaactgtcattggcgcccctcaccatctgctttcatgtggagggctaatgttcactctcaatgacggttgtgggtgaaaccgatgtccacaaccaccataactgccctataaaaggatgtgttcatctaaatctcaaatggcacaacaagtgaagtacaactgacttacacatttagtctactctatagtagagttctaatataggaagagagtgaggggaagcttcggaaggagtgcccgaatggcggctttctctctgggatgttctagagatgttggcctacattcgggatagttctgaaggagcgccagagttgttggtcctctctccaatcttgtatctcgagaatgtttcttcgatataagttatttgtgatatcattttagtatttagtttacttacttaagtcagatatattctcatcgttgtggtttcaccgcttagtttatactgagtgctctagaacaaagactctagataaggaagaagatttttgcccgaggctnnggtgtnnnttgtacagtcagtttgctgtcaaagccca

SEQ ID NO: 94808 - DNA, 2484 bp, Oryza sativa
aaagtattgtcaaatatagcaaaaaagacctattcaaagtcaggaaaaaagatgtgttcaaaattcaaaatgttttctttaaaatttctgagagttttcctaaataacaataattgtttgtgtgatgcatcagtacaagctcgtgaagagaagaaccctatcacaagtccatttgcaagtctgattggtagacgaacacaacgagcggcgactggtgcgggtgatctcggcgttagccacatgcgcagtcaacctcctcctgccaccctctctcacactgagccggcctcatgcctctttcactgatagcctcgcctgctccttcactcggctacagaggataatgggatgggagagaggaagagggtcgtgggagagggaaggagaaagaacttgataaaggatgacatgtggatcttatgggatatcttttatcttaatgactaggagaccacgtaagcgagaggtgactaaaactgtccgaggttatgttgagagatctaaaataaactatttgaatagttgatgggatgtgtagtgttctgttttgggtggatctagctttgggccagaggaagggctcattgcctttttcctagctcctccaaccccctactctcatttctctccccggggtaggaggaactcgagtccccctacatccacactggatccaaccctggtttgaagtgtgtggtggttttagactttctctaaagcttagggtgtgaaatagacttctaccattaaaaacgatataaaagtttgaattcatgagttggaaattagggttcccatggaaattcaaaatttttactagaaaagtttagaaagttcgagctgaaagtttgagtggtattgttgaaagttttacagtagattgctaaaggtaaaaaactcactgctcaattatccacagaaaataaaaaaacaatccctctatttatgtgttagcgatgctaaaaattaaggctgtcaaaagagaaactctaggctcgtgagccacttgagctcagctcattcaggcccagttcgggctcagctaaaacttcaaacaagcttaactttatatgacttacgctatttatttagcttgtttatttgttaattaaactaataggtaaaatatgtattagtactccctccgtttctaaatatttaacaccattgacttttttaaatatgtttgaccatacgtcttattcaaaaaataattaattattaatttttttcctatcatttgattcattgttaaatataatttatgtatacatatagttttacatatttcacaaaattttttttaataagacgaacagttaaacatgtgctaaaaagtcaacggtgtcaaatatttagaaacggaggaagtatatatgtacataatgattcagtttgtgtttgtaccatttttttattgatatgattagaaaaataattaattttatgaaaagcattcttaaaatatatgttatacacttatatactatatactacttactgcccagctcgactgcatgagctcaaattgagcctgcttaatagggaagtggattttttttcccttgagacaacatccccttgttttgtgcatggcgtttaaaaagttataaaaaattttaaaaaattatcaagatggatcaatatgtgatatatcttttcgcaaacatgcgagttaaaattaggcttatacaattcaaaacaaaaatgacaaatttgaccgtgaattacatgttctattaatagttaaatttgttatttttgtttctatttgtataagttaaatttgaatttgcatgtttataaaatgacatatcacattttgatctatcttattaattttttttatgaggagatatcttttttaagggatgaattgagttttaatagctccaatgcggaaataggccggacctagaactagggtttaatatttcgtttttttctccatttgtatcgaaggtgacaatattccaaaattatttttttaacaaaatttggtgaaatgtgaacaaataccgccaaattaaaaaaatcggttaaaataatatcattttttatgggggtggggttggggggaatttttttgaaaataatacgattttaatggaaaatcgcacaaatatatatcagtcagacaaaatcgcaagtttagcatcctatcgaacaaccgtggttcgacatggcacctatcgaataaccacagttcgacaggtgataaaataatttttatgaaaggaaaaacactgtagcatcacacctatcgaacactacctgttcccttgttcgataggtccctaccgagtactgtagcacgtactttttttttttgaccactaacccgtcaaactgcaacagttcatgaggtaagttcgacaggttccctgtcaaaccacggttgttcgacagtgtattaaacttgtaatttcgtccgaccgatctatatttgtgcgattttccattagaatcgtattattttcaaaa

SEQ ID NO: 94809 - DNA, 652 bp, Oryza sativa
cccgtgggtggatccgaccgagaggatctgcccgctgccacgccgctgtcccctcggctggatccgccggtgttgttgattgtgtatgttgtttgtattgtttttcttatgtgataatgatgtcgttgttgtgattgattttggggtttttatgcgatgatgatgttgctcctgttcacccctccatctcctataatcatctcttgatattttggatgattttgcgatgattctgattggattgagattgagattttgtttttgggtcggattatgatgatgtgggatttggagaggaggtgcgcgtgatgttacagacggacgaaagatcggtgtgacgaaaggaaaaatacgaatcttttaattagttaagatattgcatagtgcccgtgcgttgcaacgggaaaaacttccgtttcatagtgtgacacctcgagaacctcaaatcagtaaaaatcaagtctaatttgatatattaccaaattggtagaaccgagtctaatttgatgaattagcataggatttaggctttagtcttagatttacattgcaatgcggtggtttggcaacaacggtggcacccgatctagctgcatgggaatttttggatatatttgtgtgtatatgcttagttttccctatctttgatcat

SEQ ID NO: 94810 - DNA, 667 bp, Oryza sativa
tagaaactcaaacgttgaattttccatggtctgctcaacttgacaattactgcgtgtcaagcgatcttatacgcatactatgcgcacaagtgattgtatacggatatgatgacagtataacgtgtgatattgatttttttaataaaaaaatgatgtccctttccttgatgaaggaacaaagactttttttaaaagaagggtattactaaaaccaaaaatgacaaaaacaaaatatcagtgcacatggcaagtgtgctcggcaattttttctctgtactttaaacaaaaatacttctatatgttcttttttataagggtggcacaaatcttttaaatgagccaaatatctacattggatttattaaaaactgtataaattataatttatactctgaaaggttgtgtgcatctctcttggagaaaatgtataagttgcaaacaaacattaatccacgttatgtaactttttttcgccggaaaggccgaaggaggcctgacggagcgtggggctcctcaccgggagaccgcgcaggcccccctttgccggtcggccggggactcagggtgaaattctaagctctctgtatgtggaaggttcgcgaccgtcgaaagagcataagacacgggcgatgtaaaaaggttcgggccgctgagaagcgtaataccc

SEQ ID NO: 94811 - DNA, 664 bp, Oryza sativa
tccatcttcgatcgtcatttgtgatgactgatttccgacattttgaaattgtgattagctattacttttcattctaaagggcagtccaacccatagtattcataagcagtgtctatagtgccatgtcaataagacatcacaatagaaactacactctacaacccatggattcttaaagtatgccattaataaatacatcatctcttttctctaccaatcatatttattcttcatctattatgaagacactattctctccaaatgtaaaacttgatagtgtctagtgcataggttctcgtgttgaagctgtgtcttgcatgagacccagtttcttcctctctccactctctctctcttaattaatatagtgtcacataaactaaaagtcctacatgacaatgtagttaatgtcatagacaccattctaggtggagggttagaaatgccctaaatatagtaaactaatcagattaaagacaacgctcaatcccctatacaaaaattcactcggtcgtgtctcatttattactcggtttctattttaagataatggtaattacatctttaaaatagtcaaggtgaggatcacgaatgccttctccccttcttttattgcaaatgtcttgatttgtttgcaaccatcaactgtcagtcaatcaaaatt

SEQ ID NO: 94812 - DNA, 2322 bp, Oryza sativa
ctccactccagacctaactcctggagctaactttaggagtaggagcttttccaaacaggccctaaggatttgtttgggagtgcatttttctccaatgtgtacgctagtacacattaaggacttgtttgggagtgttttttttctcatatgtgtaaaaggaaaatagtagtgagagattaacccccatattaactgagctgttttggtaaaaccagtcatatacccgtgcattgcaattgcccatatcattataaagcaattttttaatcaactacttgtttttagtttttcttaagagttttttctcttttttttttttttgcagagcgatcagcaaccgcagttttctgttttttttatttaaagtgtaaccgctaattttggttctcttatgactttttcgttttctctcgctatttttattccaacaggcgatgcacgctagcgggagaggtggaaagtaggatgattcctaaaatactgaacacccagctcaatgatttgcacagagttaattactgaactatgaaccatttttttttagaaagagatgcattcttctcctgttcccattagagaaacacaacatttttttttgaatgactcgcacgagacagtgcgaagttctattgatagagcagaaaaaattacaagattacaaccctggagggtcgtaaccaggaaaaaaggaaaaaatataccaccacgaaacacagcattacaattgttcaacgaactgaaaacaaaagacaggctacagggtcgccatccggagcaccaccaccagatgccatccctcagccaatcagttcagaacaacctaggatctagttaagcaaaaacagaatttaggcatccccaggcacagcatctgggtttacaacttcagcaatacaaagactttcactctaggtggtattttgattctccacattttcttataggggaattgcatgttgtgcattttcaaagccctgtaaaaagacttaactgtgaacacaccattctttgttaatctccaactcagcttgtccttttcttttgttagggacagcctatcagcaaattcttctccactttaccttcttttctccatacaggcatcttctgaatctaacttcttctaagcctttttgttttacttttgcaattgttatgtttttttagagttatattatacagctcaggaaagctttctgctagaaacttgcccctacccaccagtcttcccaaacgtgtattttctccaatttccacttttttttctcacaaaaatttagaaacagttttttttttttatctccatcagacctgatcagaagtacagtatgaatcactcactctgtgtatttctgtaagagtgttttgttatttttttaaatatttgtttctcaacacctcttgccataagccatctgtggtttccaacttccactgaactacgagcaataacatccatcccgaaataaaatgtttgacaaccaataacaaatgcagatcgaatcaccatgaaatttgacaagagaacattcaaatagcacaaaagaacaacaaacccattattctccttccccatcctgatatccccaaaccaccaaccaacacaatgacaaaccagagcgaggaagagagcagcagccgacgaaggccacgcatcctcgcctgaagctccccccgtcggcgacggcattattcgcggtctccagtctccaccgcctacaggccgtccctgccgacgtcgccccgccatgggtcgtctccgtcccccgggcgctcctctgcatgaggccctccgctctccgcgccgcagctgctgctactgaggctttgagggagaacggagaaggcgacggtggcggtggggaagggagatggcagcggcggccggcggggattgggcatgcggcggcggagttagaggctggactggaccgaaccttcgttggattgggccataaatgggtgtatgttacacgacccatcaaagcgtgcgtttgagcccagagcatggagaaaatattatgggcctgtagtttacaccagttttgggccaaatactgggcttctaagtgggccctaagtctttcagcaggatcgagtaaattctggtggaataagttcactttgtgacccttaaaaagtgatcgaaatttaatccgtgaccctaaactataaaaccggatatctcgacccccaaactcttaaaactagtgcaatttgacttcctcggtggttttgaagggcggtttcgctaatgtggcacctacgtggcgatattgaccgagtctttgatacacgtggcgttgacgtggcacttacgca

SEQ ID NO: 94813 - DNA, 1399 bp, Oryza sativa
  unsure (1)..(1399): unsure at all n locations
tgcccctttatccttaaaaaaaacttaggatccgattagacattttctaatataaggtatctacacagaaaatatcttatctagtaataagttcttatattttaagatagatgaagtaataaattacaactgtaacgttggagaaataaattatatatatatatatatatatatatatatatatatatatatatatatatatatataagacttaaatgcctctcgttaaacgagtggtggctaggggtaagatgatggtggttgtttgtttttttttctcgtcgtctctataacatgaataagaatgtttttgtatttttttcgtgctagatgatagatggctgctactgcgcaatgtcgagcccatctcaccacgctgctacatcattccatgattccatcgttgactaccgctcgccacccaattgccctctccactaccagtcacaagacatagaacaaccgctctatccttatagcaaaatccagcaaagccaccaagatccaaatttcatgatggatttttggctgaatcatttttttattttctagtgtgatttacctgcgagtaattntatcacttgtgtgtgattgagcctgtaattttttcattcgtacggccattttgtgatatagattaacaatactcttagtataagtttttactcttatattgtgtattgaacacatcagtaaacatattactacatggtggctatgagatcatgggctatatcgagaggaaggtgtaattattttactcgcagactatgaaatgtaaacaatatttataacactagtaaaagaattactagcattgtaagctagtagtaattcttttacgaccatctaggagtgtcgtataatgttggggtatttatgcaagtaaatttgttacttttgaagggggcattcatgcgagtaaatttgttacttttgaatgagcagatgtgggaggctaggagtaaatggaaaacttaacggagtaaattcgttacttttgaaacgtgagacactagaaaaatggaaaactcggaaagaaaaactagacggtaaatatttttctaaaacgcaaaaactgaaaaactggagagaaggaaaaaaaaggaaaaatctggatggttaatattttactgggccctttgatgaagcatggataagatggaaaagtgaaaagaagtatggaaggtgatgtggtaaaaaatgaaaaaaaaatgaactaggaaaggtgggataagaagtaaacgtggggtagtaaaaaaaggaaaaactagaaggagggagcgttatgcggcactcgaactaatattctgcgcgcaacgtgtggattagcgctaccactaaaatataaacacttttatcactatttacagtcatgtctgtcatccatcaatcacat

SEQ ID NO: 94814 - DNA, 804 bp, Oryza sativa
tggcccctgatggatggaagaaaacaaagcaaattaaacatatttgactgatgatatatataggttagatggagagggcagggcaggtatatgatggcaaatgtgcatcatgcatgctagcatggtgtaatttgcatcgagtgaaaaaaaaggagtttactaaaccgtctacgtacgtattactggacaataaggagtgtgtcgagtgagttgctgcacagatgttgaagcgtaggggggtcgatattcttacagtgttcattattgttacatgtgtacacatatataacttgacattctcaatttttttgtttaatgatatatatatatatatatatatatatatatatatatatatatatatatatatatatgttgttctatacaaaaataatgttggaattcaatattgtacattgatcgcttaaatataaggacttgctttttcataaatataaaaaaaatgttatgcatgtgtaaagtatcatttttcttattatttagctagacaactagtaagaatatcccagcccaaacaataattctctattgaatttttttcttagtttgacaatctatgtataggtataggaagtaatattttagtatctagtttattaagaaacaaattaacccacaaattcaagacgataaaaagatccacattcttccacctgacagttaaaaccaacatttcccaccagccaagtgagcccaggtgagctaggctcatgatcagagtagtcactgtgggagtgtgttgcaatcggtctcatcgtctttctcgtttgtaccaacaacatc

SEQ ID NO: 94815 - DNA, 1871 bp, Oryza sativa
aacttttgaattctaaattagattcagtcttctatttaattaggatatgctaaacagtgtcgcttagataatttgtgttgccaattggcctgaatactcaagtgttccctagcccaacaatcttccgtggatgcatcggtgcactgcaggcctgccacgtaagaaataaaaaccgagatataatttagaaaatgtgtcgaatcatcatgtcccttattttgttttttatcctacggctatgtgagacctaagaaaaaaaaatctgtcgaaagatatctaactagtcccatagctaaaagataaacttattctgaaacagtagttgttggccatttataaatgccccccatgtgatcaatctgaaccgaaggctttggggcttggacctttgttttgagatcgagtttaaccggcaaagcccaaatgagtctcgcgagtcgcgcgagtcatgagactcacctaacctatcacctatggcatctcgtcattcttttatcccgtcgtacggctttgttcatatgtggtggtctggtggaccgtctctaaagttcatgctcttcagattggtgggtaaattgaacaggaacgtttcatctgaaggaatcagacccaacccttacatagcctgtgtttagatttttttttctaaaaacatcacattgcacagtttgcatgtaaattgcgagataaatctttttagcctaattatgccatgatttaacaatgtgatgctacagtaaacatttgctaatgacggattaattagacttaataaattcgtctcgcagtttacaagcgaaatctgtaatttgttttgttattagactatatttaatacttcaaatgtgtgtctgtatacttcaaaaaatattttggccaaggtactaaacacatccgtagtactcaaaataataaggctgtgtttggaactctaggttcccaacccctctatctcgtattccacgctcacacttttcaaactgctaaacatcctaaaatatagcaacctaagatgggatgagacccatcagcatgtccagattcatagtcctaggatgggacccattctaggttgctatattttaggacggagagagtagtacttaattaatcacacgctaatgaatcgctccgttttccgtgcacaccgtgcgtgttgggaacatatgcttccgaacacagcctagtcctaaatatgtcgttctgcactggcattgttggatatgactgtaaggcgtcttcctctatttccgcctcagtctaagcctggttaggatctgatatatgccaaaaaaaagtcacactttgtttagacttataaaccagcttatggggtaaaaagtctgagggtctgtttggcacagttccatctccacccctcctgtggcaggagctcaatcaaaaagtttcaagctttcagctccacctaaagtgggagtggagctgggtggagctctctcacaaaatgaactagagaagtggagctggattcaagcagctccacaactccactccatactcaactcttggagttaaaattagaagttgaatctctaccaaatgggagcctggcctgtttggcacaactccagctccaactccacctctagaggtggagttcagccaaacagtttcagttccacctaaaatgggagtgcactattaagtcactatctaagttgaacaaatctttttggcttatatgaggtacataaatgatggaactctgtcattaaagttaggatttgatatccattagcttataaatcatataagaaaaaaactaacttaaaagtctatgaaaataaactcaatcaatagccatgtgagaggagagaggaaagataaattatttttatttatttcataaa

SEQ ID NO: 94816 - DNA, 701 bp, Oryza sativa
gcccgtcataggtgacaaattacctgtgacgggcctcggcctatggtctcgtctattacggcctctagttaaagccatcacaagtgaggccttatgtgacgaggcactctggcccgtcacagatgagccgtcacagatggaaagatctggtgtactctattcaattattgccgatagaacatggacattgcttgaatgaaaaataaaaataagaaaagaagagagattctgttatcagtacaccactttgtcgtaccaactttgttggaaaggacgtgatccactcgtttaaaatcatcctgacttagcacgtgcgaagtagctagctactgttttggagtggcaaacaaagcaaaagttcgatttaaaaaaacaaagcaaaaacaaagcaaaagttggtgcagaatatatgcctttgttttcttctgaaattattctgatgatttattcctgatggggaacccacctaaaaattatccgtgctctgtggatttttcaacctcacagaatgtcgccagtctgattgctgagtatatatagtttcaaaacttgcgtactagctagataaatttacctattctagaatgctctcttttatacgctttcttctgtttaatcttggatgaactttggattgacttgctttaacccacattcaggtctcaatatataatatgaaaccgggtaatcctaatgggcgg

SEQ ID NO: 94817 - DNA, 1157 bp, Oryza sativa
cctgttagctgtgtttggatcatctgaattttgtggactctagaattgatataagccctgacattttactattttatttcccattgacagattatgcaggtgacatgccgagcaacaaaccggcacactatttttcttctttccggatggagtcacgatcgctgctgcacggacattttgtctatgacgcggtaagagggagggaaaaatagcagtacatattatgcacgtttgcgttgcagcatcgcagttgcgggttagcccgttccttctgcacagagacaaaaacatcactggagccacaccagcacatgttctaaccttcaggattccaattttttaatgtggaggtaatagccattcgcctgcaggtaatcacttttttttttctgtgcaagcttctgttatatgagtatgttttcgccgggtgttttatgagtatgtttgctttttttttcttttttctctctcattgtttttttagaaccaacagtaccagtgttgaaattgatcttgtttatttcgtttgggagaaacctgttagctgtgtttgagacatctgaattttgtgtactctgaaattgatatatgccttgacatttactattttatttcccattgacagattatacagtgacatgccgagcaacaaaccggcctactatttttcttctttccggatggagtcacgatcgctgttgcacggacattttgtctatgacgcggtaagagggagggaaaaaaaacagtacatattatggacgtttgcgttgcagccttgcagttgcgggttagcccgttccttctgcacagagacaaaaacatcactggagccacaccagcacatgttctaaccttcaggattccaattttttaatgtggaggtaatagccattcgcctgcaggtaatcacttttttttttctgtgcaagcttctgttatatgagtatgttttcgccgggtgttttatgagtatgtttgctttttttttcttttttctctctcattgtttttttagaaccaacagtaccagtgttgaaattgatcttgtttatttcgtttggagaaacctgttagctgtgtttgagacatctgaattttgtgtactctgaaattgatatatgccttgacatttactattttatttcccattgaca

SEQ ID NO: 94818 - DNA, 670 bp, Oryza sativa
tgcatgtcaactggtaattattattgttattacatatatattggcttctcgcctgcctagatgtaccatcaggattgatacaggctatcatcatctgttgaattgattacttatgatgcacttgtttcataatgtagggccacactacaatcctgccggaaaggagcatggagcaccagaagatgagacccgccatgctggtgatcttggaaatgtcaccgctggagaagatggtttgttctttttccctttattccgaatttttatttgttccatacctgttaatgatttaacataaccatattagttgtggtcttgtagtccttaactcattgtcaatttgtagtaatactttattccgaatttttatttgttccatacctgttaatgatttaacataaccatattagttgtggtcttgtagtccttaactcattgtcaatttgtagtaataattgttgctgagagtttatttctctgctgtcaggtgttgctaatatccatgttgttgacagtcaggtaagtaaacattcagaaaaagaacattctccgtcatttgatttatggaaccaataccacacatccccttattattctgctgttaccttgtcttttccttctttctttttcctgtgtgttaacatggataaccatttatctgtgtcagatt

SEQ ID NO: 94819 - DNA, 2044 bp, Oryza sativa
caaaaaaaaacatgtcaagcagcaggacaccacgtcgccgatggcaaactcccgagcccatccgtgcggagcagcagccgccgccactccctccaccctccggctccgctgctctcaccctccacaagccattgtcgcttcactgtgcaccgatgctcccttcctctgtgagccgccgccgccagtgctccctccctcaccgaagcaccaccgtctccccactaagtcccgccaccgccgcgtgcgtgcctcggtgccactagatccgtcgccgagcctccgccggatccaccctaacgctgccgcccctcctcctcgtcatcgtcaagccatcgccactgctcctcttcgtcaagccaccactcctcctcgtcaagccgtcgttgcccctcctcctcctcgtcgagctgccgccaccactcctcctccttgtctagccatcgtcgcccctcctcctccttgttgagccgccgctgcgctcctccacctcatcgagccgctgccagccttcctcctcgtcgagtcaccgccatctgtggacctctccatttgcccccatctgtggacctctcccaattcttgttgacagtcaatgtcaagaaagtggggtaataactgggtgtgtaggtaagaaggtgcttcatgtgggtaaaattttcgtttaactttatatattcatttcattattaaaatatagcaatttagaatccagattagaatattctagtactatgaatttagtttagacagacgattgtttactagtggtatgaaattgtatgctgcaaatagaagaatatatgccaatactatcatatttgatagactaatttctctctaggcttgcatattttctggttcccgccataattaatcctttttaataccacaattaacttgtaaaggaacttttaacaaaaggcattaattaattgtgtgtgtataaacctaaagaaaatatcaaaacggtgatactacccctatgtcttagaattattatttttaagagaaatactattagacctcgcctagtagttatatataatttactcatttgcctcagacatttatttgcttttgcattcaaccaacttggcaccctgaattccgttaaaatgtgctgccaaacagcaagattattcgctagacatctgctcggaaagataaattaactaataatgcttctacacaagccacatgatctagttgaatattcttctaaaaacattagtgtcagctgtctcactatcatgctagacatgagaatgcacacctttgattccaatgtggactacggagcaaactcggccacgagaatctgatcctctttctctctcttcgtttgttttcttcttcttcttctttatgggattcttcttttgtttttacaaactcaaaggtttccatttttataaataaaataagtccctttcatatgaatatatattgccaaccactaattaatccctgagagtaattgattggtcaatgtgtggttatttctaccttgcccccacaaaagatacaagctatcttttcatctcgcttttggcctagatcacgacatacatatatatttggtttataaagactgaagagaaacagaatgattgctgacaggtgcttctcctagcttttctgaaggaaaaataccacattatacagctgaagtcgagctatttactcaccatttgccacaactgtaagccccaatatctgtcaattaatgtcaacaaggtgggggtgagcaggcaagaattaaggcgcttcatgcgggcaaaactttggggttgcagagcttctatactgtttactgcaaaattgcatgctatggatatccctaaatagaagagtatacggagttactgtcctgcttgacaatagtaagatagtttagaagtatgaaaactatatatagatgttaatttgttgagcaacaatagtaaaatgcaaacaggaaattttgggttgacatgggacttttaaatcctttgtgaatatctgaataagaaaaggccctaattaatcgtgtgtgcacgtaaat

SEQ ID NO: 94820 - DNA, 1681 bp, Oryza sativa
gcctcgccatccgcccgatctcgccgcccactgttgggctgcctcctcccccggactatccctctaagccggcaaactcctccccttcccctccccctcccaccccctcccaccccaagatcttaactcatagggtgtcgctggcgctggagaagaagaggaggtcaccggagttggaggagaaggcctggagcatgaatctcaaagctcatccggtggcccaaaatctgtaaaatttgggggatacaatttctgtcggcaggaggttagcaaatccgttttatcaaacctccttcgtcttcgcgtcgtcttcttgctcctgatcatcatcccagatgccgaactaagagtcatcgttgatgcccaggtgctgcttgccgcggtgccacccggaggagcagcctctcccgcactcgatctgcatccatgcctccagtcccgccctctcgctgccacccacgtgatcctccgcttcagccgtgccgtctcatcgatcattgccgtcgctgccgtcatggatgtttgttgtcaccgtcggcggctcgtccgtcatggacttggtggtggtggtgcaggacgggtttgtcgtcgatggacacgcctcttcgccgcgtgtcgtggccgacatggttttgaagcgaaggtttcgacggggtgacgatggcgacggcggtggcgggtttagggttgtgagggacggagacgatgggggtgaaggacgacagcgacgacgggggtaggagtacagcggcggaggcagtactgcgccggcggtggcggcaggatgagggcgagggtggaggcgctgaggcgagggaatgatggaggggatcgagggagagtttggggattgggggtgggggaaggatgttttgcagaaaaatccttatactttccatgtttacagtccaacccctgaaagcggaattttctctatttctatgaaagacaaggggtttcctggataaaacatgacaggggtatcagttggttcaaggatttgtgcgatatttcatgcaaatccaaggagttttttttttttttgctaagtagaccaacacgcgtccatttctccaaggagccaaaaacatttgcaaaaaatgagaaaatcgcagcggtaaggagtgttatgaacaaagtatgtataaggaaggccctttagatgtactgtaggttgtttcatataaaagcatcacatggcattttccccctccttttttgttttaagtgttagaatttggaaggtacaagaaattgaaagtgctatgcatttagcatctgaacttagaacaaaactgtatgtatttggatgtcaagtgtattactcaaacttaatctttagttgtatctttttttttcttacagatctaaatatggcttacaataacaattaaaagaatcagctaaccacctttgttttaacacgtcaaactttcatagtacaaagtttaccatctatgatgcccatccaccatatgatggagctgttgtctcaaaatgtctgagaaagctagctcgtgggcgccgccagtgtgcattttctcttctcctgtaactaactgagttaatttaggataacaatcaagggaatatttttcttttttcggtgatttttttactaacagattgaaaagaaatctatatatatgtgaaagaaactttcacgtaaaatttaaaactt

SEQ ID NO: 94821 - DNA, 670 bp, Oryza sativa
ttgatttagtgcctcgcacttagaaagtgatcaatatttcagtgctgggcatatggcacttgcttgtccttaccaccttgaccaaatctgcaaaatagagtaggaaacaaaacatccaacaaagatataaaaaaaatgcagctaagatattttacttcgtttagctgaatcaaatcaaacaaaccactcatctaatttcttcttttaatctttgtttaatgcaaatactatggtaggaacccaattgtttgtttgacataagaaatcagtcatctaatttcttctttttatcttttttatgcaaatatggtatttagtaagaaatgctagagtactaatagtccctctgctcaaattgatcaaatagaactgtcaaataaattcaatatgttgttttggcgtcgttaaatggcatggttgttttataacacacagtaaatacaatgttagacacagtaaatacaatgtgtagaaattaattcgagaagctcaccatcaatgttagatacacctctgaaattagagcaataatggcagatattagatcaatgcacactataggggtcttggggtcttggggagatcgacggccccggtgtcttggggtcttgggtttggttcctaactgaatattgttgtttcaacagctttcatttttgcatcttcccca

SEQ ID NO: 94822 - DNA, 5223 bp, Oryza sativa
aaaaggaggggaaaaggaaaaaaaagaaaaggaggaaaagaatttccctgggatttaaaaaaaaagcaagctcgattttaaaaggttaaaattatttcgagagctctgaaaattccactaaaaatcttgttagtgaatttcgacatgtagaactcaagaaaaattccacatgccaattccgattattatttgcattgatttaatagggtttactcttgctttgcaccggtgtttttttttagagtctctattaattcaattttaggcttaggaggagaacttcagggtgtgacaagagtagactagagtccatataaaaatataatttataaataactgaaattcagaattaaaaataaagaaattagaagaagagtataaagtccatatagaaatacaattaagaaataatagaaattcggaattaaaaatgagaaatattagaagtagagtatagagcccatatagaaatacaactaaggaataatagaaattcggaattaaaaataaggaatattagaagtagagtatagagtccatataggaattaaaaactaactagaattcataataaacataataaaattaaaactagagtttagagtccgtataaaaaaaatacagtttacaaataactaaaattcgaaattttaaataaaacataggaagaagagtctaaagtcaatataggaatataatttagaagtaagtgaaattcgaaattaaaaattaaagaaattaaaagatgagtttagagtccacatagaaatagaattataaataataaaaatacagaatttaaaataaataatattggaagaagagcttagagtctatatagaaatacaatttacagataacgaaaattcagaaattaaaaaaaatattgaaagacgagtctagagtccatataagaatatgatataaaaataactaaaatttgatattataaataattaataagtaacacgtatataaaatacaatatgaatattacacattagtagttcataaagttagtacaaaatttaaaattatggtgtcattttaatatgttcgaataatacattaagaaaacatatatgctattatatgagagtaaatataatgatgatagccgcgcaatctgcgcgggccagaatgctagttgtatataaaattaaggcaggacaaagctttttgtgcttgttcgaaggtggttgcccatgcataacttaaactcgttcaaataatataagtcttgcatttttttagttgaattttttgtcaaaattcgttggaaaattgtagatgaaattaaggcagggagagaaagctttttgtgcttgtttgaaggttgtcaacttggactttaaatcttaaaactgagatcactctgccacttgacattgatgcagtaataatctgatctatattcggatgattaattgcattaattggtagaaataatttattcatcatgacatttacgtgatctattaattgatgcgattgaaattcccaaaataaaccgatttacatgggaatagctggtgatatcaaaccttgaaattcccaaaataaaccgatttatttgggaatagctggtgatatcaaaccttgaaattcccaaaataaaccgatttacttggcaatagctggtgatatcaaaccagtagggcggggtcggcccaccggccagctaagtgctgcttgggcagagggcatttgccaaataaaataatcgggactgttacaaggtgctaacaaatcatgtgcctgatttctttttggtaaaaattggatgcaatttcaccaagtagatcggaattgttacactaagtatatcgaaaatgttttattattttaaaaaagctgatacacaaccaaatcacctcgtgaaacattttgctacaacgtatgaaacaacggttccaaacaaatcaggcgttgttttaccttatataaaaacaatgtttcaataattagcgaaataatgtttcaaatcactgcaatatttgatccatacataatgaaacatcacgagtatacttactgaaacactattggtagaaaacaaatgaaacggattcccttaataaagcgttctataatatgcaggtgatttgttgcaactacctgtatggtggggcacgtggagggactgcactgaggcgtgggaggtgcgggatctctcactggacacataagatgcggcgggtgccctatttttctccctttgatcgggcgcccaatcgctggcattttccggacggttacaacgctcatactatctcttttcgttttccttttccctagtgccacgcgtggctgattcggaccaataaacagctggcagaagagccaacattagatatattttgactgattgattttttttatcaaatttctttagatttaaccaaattaataaaaaaaattagcaacatctacaatacgaaaatagtttcattaaatctaacatcaaatatattttgataatatgtttgttttgtattgaaaatattagtatttttttcaaacttggttaaatttaaagaaatttgagtaagaaaaagtcaaacgacttataatataaaacagagggagtatatgaaaataatattataataacaaatatcaaatatttcattataggtagataaaatcattctttttaaattaataataccaactaactctataatcagtggatttatatattatcataatgcgtgacacggtttcaagaaaaatgttgaaaatgcaagacttttccttagaaaatttgttgtaattttaaacataattaataaaataagggtatgtgattataatcaaaccgttatatttctttctgcacgcacactgtgtagcatgtgtgtcctatttagaattagtttacaacacataaattccaaaatcatattttttttactgtaaatttttttatggattttgtttattttttcctccttagtcattacattcggcagtcttcctgtttagctgcctgttctgtggcagtaccacaaacacacgacgcagttgggaaggaagtgaaatttcctttcaaagtagcatatacttgtactcgctactgtgtcagttgggaagcttctagcatatgctagatgtgttgctcaaaactttcttttcttaggatttttttctctcatataattcctaaatttatctcaaagattaatactgccacttggcccaagcggctggcagtgtgcgccagctttaaaagtacttatttattgactgatctgcagaagcagaaaggtgatcaaacttaaaaagtcgagacaatgtacaatgcccattttccggtattttgtcgaagctcaaattctcatatgtatttcctcggtttcataaaaaataaatataggaaggaatatgatagattattcgtagtactgtgatgtgtcatatcttgttttatgtttggtttttataggacggatatgaagtacttggattgatgagctacaaaagaaaactagttttttcagttttttccttccccacgtgacaattgaacacttcaaacgcttcactgtcaggtagtaatacactacatctgaataggtcaacttacagtagatcaaaactaaggtcacgaacgaagaaagaccacaatagcgacgcaatagtccagcagtcacttccagccttccagggatcaatatcccgtgaagaattaataaactacagggaaatctcgcgaggtcgggcaaaatcttgttgagagaagttgatttttttaatcagattttatttgaacttgaagcagtttgaacaaaatttaataaaatttagagaaattatattgtattgaactcgaaattttcagccaggattataatatatagcgatggctcgagagcgaaatttcgttgagaaattaattaatccctggtcacatcacataacacaaccgtgggaggaagtcatcacaattgggaccatgatagcactccaggtgagtacatttcgttaattgaagttttcaaaggtaagtgtagctataattttctatcacatgtttgaattgaggagggatgcaaagttaggtgcagtattggcctgtgtcatttgctcataactagatgataccccacgcatagctgcgggacttcttgtttctaaaaaaatattatccacgctaagaatgctaaaaacaaaattaataatgagagcaaactcaaacatatgaagaaagttcaaagttgtaggataaaaacatgtactcatgaaaaaagagcaagattacatttacaaattgacatgtgcacctcttacagctcgcagagttaattaatatggataggactactatataaactcaaaagcactcaggaaagcatggccaaatatgttttcaatgtacaatgagttcagcaagaatgaaactgcttattatcttcactttttaaacgtacacgctgatatgtttttaggagcagtcttacttgattaagtaccaagcatcttcataagatcagacttcccctagcaaacaacatgatcaatggagccacgatgtattaggctgcacaaacccgacctatataggacgtggcattgcaaaatggcatgaaaatagataaaaaaaaatacatgcaaattctaatattgaggcaaggaaagcattatatggtttaaaaaattattgtattcaaattacattttagcaaaaggaagtgaaattcagtattcaaatccactgaaacatccatttaactcatactgcagtattgcacacttcatcagctgaacagatgaaaatatccatcggctgaacagatgaaaatatcctggtagagcttatatctcttcgatgaacccaaaaaaatatgcaatctttgatgcataaaatcagtaaggtaaagggccaatccacatagcataatacatgttctttctcataaggtattcatcaagaacaataaccatgctcagtgaatgatggtaagaaaattctgagaaaatagaaatcgattaaaagaagttctgaacatgccaaatatcaaatatataacagtgcgctgttgcaaatggttatcagttgcagtctttcttatgcttgatcaaatcacttgatgttattatatcattacgatgaaaaggaatgatattgagctgaaagaaatggaagatagagcaaatccttgaatcttctgaaagcaacgttataatattctttagtgacgaacaaatgaaataggaagg

SEQ ID NO: 94823 - DNA, 1896 bp, Oryza sativa
agcctaggagagagaaccaaggtttggcccacattgagagaaaaattaatgactcggttaaatattatattatctttaatgatatagaaatgacatgtaagctcatctaatagatggctgcttactctcttattaaacttgcccttatgttcgattctcacatatccaataattttgtatagtttttacactaataaaaaatatgaaaagtcggatttggtatgaacaacggattaattgtatgtttgccatatacaaaagatagacgcagataattcaaaattccaagttgtgctgcgcaactaaactaatcgatcaaaattccaacgaccgccagaccaaatcccaaccctttaatttgcatgggctcctgcctttgccatataggaattcccattgacgacaaccgtgtccggatgtgaactcgaattacgtatatacgtacctgcatgcatgcaacattccagttcacaccatctacaacagataccgggatcaaagattattaatctttagtcccggttcaaaagattagagctactttttgatctttagtttcggttgggaacaccaaccaggactaaaaatgagttccggttcgaaaaaaaatagcaggcggtgtcaaacccctctattatttttattatttttagtcccggttatttcgagtctcgattggtgttaccaaccgggaaataagatcggcatatgcggcagagatgacgaggcgtgcgcgagacccagaggcaatatcagttaataagttctatctcctcctccctcaccttaatttatctctttctcctcttcacccctatctcttcctcttcctcctctcctcattctcttcctcttcctcatcttctcctcccctctcctccccattcttaggcggccgggcagcggcggaggcagcctcgtgcgcggatccgggatctagcgcggccggccgggcggcggcctagcgcggagggccgcgcccggtggaagccggcgcggaggttggtgcggcggtaggcagtggaggccggggctgctgcgtgattttttttttcttttttccttaatgtgtgattcgatctgtgttgaatgattcgatctgtgttgaatcgatctgtgatgaatgtgtgattcgatctgtgttgttgttgtgaatgattttgagaatgatctgtgttgtgaatgttgtgaatgattggggattaactattactgtgaatgatttgggatgaactatataactgtgaatgatttgagataatgggcgtgagatatacaaaatagaaaaaaaaaagaaaaactccgattgaaaaaccgggactacaatgagttaccaatcgggagtaaaaagcatttctctaccagtgatacttttatgtatatatatagttttatatatttcaaaaaaaatttaaataagtcgaatggtcaaacatgcttaaaaaaagtccacgacgtcccatatttactatttagggacagagggactacgctatatagaaatactcgcaacattttgaaaaaaaaatcaaacaataataagaccactggtggagaaagcgtttgtagtcccggttcataaccccctttagtcccggtttgaaaaccgggactaccaatccgggactaaagatagatcgctatcttttgtcccgggtgaaataaccgggactaaagatcgagctgaccttttttttttcatggccctgttgctgcatggtttatatatatatatatatatatatatatatatatatatatatatatatatatggatatatatatatatatatatatatatatatatatatatatatatatatatatatatatatatatatatatatatatatatatatatatatatatatatatatatatatatatatatatata

SEQ ID NO: 94824 - DNA, 685 bp, Oryza sativa
  unsure (1)..(685): unsure at all n locations
cattattacttaattattgactgatttaatagtttaggacataatttggttaggattgaataatctatctggggtcctgtgaccctgggaagctcaacataggcactccattgtatttggtagttgatttgtgtgcacaaccaacctggtctcttttatcctttctgcttctgggatttacacaccatcttacgcatggaataacttgattgcatgaggcctgtgatgaaaccgggcaaagcagccagtgacctttgtaaccaaaatagagaggtcaaaagttccttaagtaggtgaagagggagaattttagtgcctttattacggatataatagaagctagaagcaaccaatacttttgtgggatgtgtggaaagcatccatctggaactgtgagaagtattgtttgcatacttctctgtttagcagggtatatggcaaatgggcacatcgcctgctctactcatttgtttgagatgtttgttatgcattctaccttcactccatatctcctatcactatattgtacaacaatttgtaccatttttttcctctttctagntttccttggaaatgaaactgtgcaaagggagtgagaaggatgactaaagccttgtagagacatcaatttgcatccatttctttcttttcattttggtggggtcaatgggctattaaatgatag

SEQ ID NO: 94825 - DNA, 740 bp, Oryza sativa
tcattagtattgactgtgtatcccactaacgatcttgaatcactgccagtcatagtattgactgtaacttaaataattggcagctgttgtattggattgaaattaacgggtactacatattagcttggcaatgtagcaaaaactgttatagtataaaatattgttttatgtactactgtttgagtagtggagcggtaaatatgagcttttgatcattaaaatgaacggttacaatacatgcagtcctatggtgcagttgtgtctgcatcggatctcaatccccactaaacaactactccctccgtcccataatataaaggattttgagtttttatttgtattatttgaccactcgtcttatttaaaaaatttgtgcaaatataaaaaacgaaaagttgtgcttaaagtactttagataataaagtaagtcacagaaaaaataaataataattctaaaattttttgaataagacgagtgatcaaacagtgcaagtaaaaactcaaaatcccttatattatagaacggagggagtacctcttggagtatggagaaggagaacattagacgcatcagttaaacatttcaagtatactgagcatggacctctaaaaaactcttcattccctccgtaccattatgtttgggttctgttgtgctcccttttcttctcctaacgcaagcgggacacgaaaatcttttacatgtactctagaaaatgaacctcttaattcaatagcat

SEQ ID NO: 94826 - DNA, 698 bp, Oryza sativa
  unsure (1)..(698): unsure at all n locations
ccgagaatatttaaaccgctccccacgggccacctcgtcggtttcgtcaggtaagaganaaccgtttctttttttggcgaatcgcattcgcgcactaccaaacacaacgcgagctcggaaagctactgatggcgtctcacatcattctcccaaagaagaagaagncggcgctgggcgtgccgttgaagaagacccacgactcgcgggcggcgccagggtaccagcatcagcaggggccgccggtggcgaaggcgctgccattctcggccacgtgcgtgcggatctcccgcgactcgtacccaaacctccgcgccctccggaacgcctccgccatgagcctccccgacgacgacgccgcttacgccaagctcgaggagggcgactacggctacctcctcgatgacgtcccgcacttcacggactacctctccgatctccccgtgagcgccgacacccctcctcttcccactcatccttgtctcgcgctggttgttccgctgccagattcgacgcctgcggtgaaaaaaattgcagtatgcagtgctgcttgagattttgatggttcttttggagacgcggatctcgtgaaagctttagatttagttctgccatttgtgtgaggtggagctttatttggatggttcctttatttttggtgtttttggcgtgtcatgccggggatgggttctggaatgaga

SEQ ID NO: 94827 - DNA, 641 bp, Oryza sativa
  unsure (1)..(641): unsure at all n locations
aaatagcacatcctctacagtccacaacagttgactcaaatctcttagcaccaattttctctccttcctcccttggctaacatgcacaagttcattgggaagagaaaagacaaaacaaagagagtagataccagcacggggctacccacatacgacaagaaggaagcaaccgtagggcggcgacatgttggcggcgttggggaccccgacaccggcggttgcaggcattgaaggaagcaggagcaggacccgaccgacggtaacggccatagcagaggctgaaggaggaccccaacgggtagagtcggcgattgcgccacgggaggcacgaggaggggcctactcccttggtcggcgacaaggcaggcggagcactgatgtagattgagagactcgcatcgaccacagcgataaccaatgcaactagttggagtcagcgttgacgagctgggcgacgactagtactcgagggtgacgacccaaatctagatcccgtcgagggagaagcgactaagagcaagtataatagtaggctacaagccggctaaatgctgaggtggaggagagaagagaggagagagaggagaagcggacttgtaacttacagccgacttggacacaaagaacaaganactctatgg

SEQ ID NO: 94828 - DNA, 731 bp, Oryza sativa
attgcccatagaaagagggtttgattttgttaaggaatttttttactgattatgggaacctgatttctctcaagaatatttttactcaccgtgtgaactgatggagtgagaaaaggggcttgaggagggcacgtggagaccgggtggcagttgtgcaggaaaaaaacggaaaacactcttggtgggaggaaaaatacgaaaaacccagaaacagaaagggaggaaggagaaacggaaaaacaggaggagatcgctcctgtgagaggcgctacgtagtttcctagcgtgctacgtctgtgtgtcgcgctacgtagcatgatcgtgttatatatatatatatatatatatatatatatatatatatatatatatatatatatatatgatatccataggggactttatggtgtccgggctctaaggtataaaaaacacaaattctctcaaatttttaaaaatttacaaattgtaagtagatatctaggtatatgaatttaattcatacaaatacctaacaacaaaacaactcaaactcaacttcatttcacaattcattattacatacataacgaattatatgtttagatgttatatatctagaaccaaaatctaaaaaaaaaagttcaaactcagttcaaacttgtttgaacttgttagtaaagaagttaatattcatatctaaacatttaaaaaaaacatttaaacattcaaattgggtatatacgcaattt

SEQ ID NO: 94829 - DNA, 1279 bp, Oryza sativa
ccctcctcctccctactaaaggagttatggtctaatttttcgataaacagaaagagagaatccttgatcaatctgcaagaaatacaaaacgagagaaaacgggatggacataccagaatcactcacctgggaatatcccaacggtgcaaaagccgcttatgtcgatggaatcacgccgccggctggcttgacatggattcaagccatatatatatatatatatatatatacacacacacacacatatatgtatatatgtgtgtacacatatatatatacatacatatacatacatgtacatatacatatatatatatatatatacatacatgtacatatatacatatatatatatatatatatatatacatatatacatatatacatatatacatatatacatatatatataacatattgtcagggttatggataccacatatctaatagtcgtcgtcgccactgccggtttccggtgaggaggttcgtcgctgccgtcaccgccggtggcgtggtttcgtgtgtaatttattttaatctattcttatattttggcggggtttcggttcaactgtttcgcaggttgagtactataacaatttttctttgtttgtcaagaccttaagacgggaatggatcctactaataagttgttggttcatcctcctagtgatccaataactgtacacgtatgtatatatgttgccacaggatgatcgggagaaaatggtctggtcgtgggtagaagaagcaccagttggatgcacgcgctaggagctagtaggctgttattcacattatgtgttcgatcgatcgagacaggattagttttttgaactgatgttcttagacagtgtattaactttaaaactaatttgaatacaataattctagagtatataaaaagcttgtgtcggataccttgatcgcatctatatgatcacagatttttctagaataagaaaccagctagttttaaacatttgtgttaatcacttatcactgattactgaaaaataattttaaatgtgaagcactaatattaagtcgaatagactcagtcagacaggtttcaccacactcaattcgcaaaatatccaatcatgctttcaaattttagcggaagtttccaagttccatatgcttcaattgcatcggaattaggtatatttgtctggatttttcacattttgattcttttgaaaaacttatttcgcaaatagacccttgaaaaaacttatcccagaaatggtcctttttgggcaccagagtggctggc

SEQ ID NO: 94830 - DNA, 1213 bp, Oryza sativa
aattataatttattttattgttacttgattatccgtcaatttgttctttaagcatgacataaatacttttatatttgcacacaagttttgaataagatgaatggtcaaacgttgcttgagaagtgaacaacgtcacacattaaaacattaaagaagtagtttctttataaaatgtaccccacactggctccggtgacatggaggagaacgaaagaagggagggtcggagcaggggagaagaggacgctggagagtgatgaaacggaaactgcagtggtaggagacagctgtcatcttcgtcttttccccctctttctccctctccatttttcacccttcgtaagcttttctttagcgcacttaatagtgggttaacttattttctttatttttttaaatactcccttcgtattaaattttaataaatgtcgtcatttactttttatcaacgtttgaccattcgtattatttaaaaaatttatgtaattatgatttattttattgtgacttcatttatcatcaaatgttctttaaacatgacataaatacttttgtatttgcacaaaaattttgcataagatgaatggtcaaaagttggtcaagaagtcaacaacgtcacaaattaaaacatgaagggagtagtttctttgtaaaatgtatcccacactggctccggtgaaagagaagagaacgacggaacggagggtcggagaaggggagaagaagatttgagagacttggacactggagtgatgaaacggaaactgcggtggtaggagacagttgccgtcttcgtcttttccccctcttcctctctctccatttttcacccatctttagcttttcttcacttactgttaacataacagtcggttaactaatttttttcctccagttttgataaaaaaaactccgaccgtattaaattttaatgtatgtcgtcatttactttttatcaacgtttgaccattcgtcttatttaaaatatttatgtaattataatttattttattgttacttgatttatcgtcaatttgttctttaagcatgacataaatacttttatatttgcacacaagttttgaataagatgaatggtcaaacgttgcttgagaactgaacaacgtcacacattaaaacattaaagaagtagtttctttataaaatgtaccccacactggctccggtgacatggaggagaacgaaagaaggg

SEQ ID NO: 94831 - DNA, 715 bp, Oryza sativa
cctctcatcttcttgacgaacttctccatctggatgaacacgaacttgggtgtgtttcagcaccaagtcttcgagctctcggtagagggcgtaacggttgttgcgacgccgctcccgcttgcgttggttctcggtaggtgcatgttgaagtcttggtggaattggtggtgttggtaggagaggaggcgcaacttgtcgtgcggctgcggtagatgcatatgtttcctgtcacctttgtatttggactcctcgtcttggagaagatggaacgtgaggcggcgcctgaattgggggagcccctcgaactcgccattcttgagcagggcgtgaagatgcgtgatgatcttggcgtcttaaccaccggttccagcgtggtggtggcgccgtctgcctttgcctcgtcacttgggctggcaggggtgtatgccgaggagccaatgtgcggctattatgttgaggacgatagcttggttggtatcgtcttgatctgcccccagcatgtgttgatggtgcctcatggtcttgtagccgccttcccagttgagccatccggtcttgcaactcgtgaagttcttgtcgtaagtcttcacttcttggagcaggtgcctcaggtctcaggacaacgaacctgttgttgttgtagtcgcacgactcctcctaccgcggacaagtggaggcatggctcccatgtgctctgctggcaaggggcgtatgt

SEQ ID NO: 94832 - DNA, 1107 bp, Oryza sativa
cttttaattgagccacatgagatttcttgtttttggctcgaaactttcttcttcaattactggtgtgattgcaaacttatcccaccatcttgcataatagtttcgctttaaggttgctgggaactccattctttgaatattgagatcccactttagtatccaaggcatccgtgtttcggcacaaaattgcataagaaaaaaaggatattccttgagatccttttttgattcttgtgtaataactttgatgatttcttgtggtaggattccaggaatggcccctgctttcagccaccatttgctgaaaaaccacagtggtatctcctcacatccttctttgaagcgaataaaccatgaatgcttcatctgggaattttgtatgaggagtactctttctcaggccttctgataatcccaatagttatatcttttatttgcacaggatgtagaatatatattcctggctacataagaatttgatgatttatcccaatcatcgatacttataattttttggatcaataattttgtgaatcccaattcatcaccattccttgtatggaatatctgtgcacttcttgtctcgcataatagtctcataataattttgatctttccgtggatattcagggataaaatattagtgttgtgggaaatactttcccataatcttgataatattgagatcagagtctccaaattctaatggcagaattacttcctctatattgaggatataagatgaattattccaatacttttctcgaactgtaggggttctaggaatgatatttcctagttcattatatttatgcttatttggtgaactttctgtagttctcccttgggctgataagtcccttttaggtgccatagccctgtaaaaattcacgagataagaaatctggtagggagtttaattctcccttgatatgttctatttcaaagtcaaagcatgataatattgcttgccatctggcaaaaatttgtttggagactaagttctccacatccttttggaggacatcttttgctgccttgcaatctatacgcagcaagaatctttgattcaataattctccttggaattttgatatgacctttact

SEQ ID NO: 94833 - DNA, 871 bp, Oryza sativa
actatagggcgaattcgagctcggtacccccggctcttttttttttctcgagcaaagctaaaggtgcttggatagtgcataatatctgtggatgtttgtatgattgattcgacagtgcttctgtgtgctgtgggtgcattcatgatagattggtgcttggatgctatgctgccgcagctagttgcttcgccaagcagcaagcgaagtagccgtgcacagacacctgctgcatcaagcagctgagcaggaggtgtattgtctaatggttaattaatcattttcctttgttcggacatgtattgcaatgctggaattttcttacaccaatacctgcagaatagctgctgaagccacttaattacatttagaggcaggagcactagtttacttacatgatatatgtataaaatatgtgcgagcaaacacgaacggtttaaagaggcatctatcttactctcttaggacctgcaatatcacacatgattagttctagatagtcaatgaacttacatagagtagcttaggtttatcagtatctgtgtggctcttatatcttaagattacaatgcaatatattctatctgtggagctcaggttttaaacttgttatcaatccttgtgtatagatatttttcttattgtttggatcaaggctatataatcttagctaagccacagatatatttctctttaatttagctcagtcagatctacctcttgttttttggaacctcacagaaacatctagtttcacaaagtgtataatttgtggatgctgatactggaaatgttctatcaagtggcaaaggtttggtttcaagattttcttcaaacaacaaagatttgtgtgaaatatggttacttacttcag

SEQ ID NO: 94834 - DNA, 1232 bp, Oryza sativa
tcccccgcgacgcgcatgccccctgggccccaccatttgtcctgcctccacctaccacgtgtccctaccaaatatgtttcacctagtatactcacaatgtttcactatatataaatctaatgttccagtgaattgaaacattctttgcaacaaatcacccacatatttttgaaaccctctattaagagaattcgtttcattttttgttccaccaaaaatgtttcacctagtgtactcacaatatttcactatgtatagatctaatgttgcattgaacgaaacattattttgcaacaaatcacccacatattttggaaaccctctattaaaggaattcgttttattttttgtttccaccaaaaatgttttacctagtatactcagaatgtttcactatgtatagatctaatgttgcagtgaactgaaacattctttcattatttgctgaaacattgtttttatataaggtgaaacaacgcccgatttaaacgtttgaaacattttcgatctatttagtgaaacaattccaatatacttggtggaacatcgtgcaacatttaaaaataattcaataataggctaaaaaaaaattccgccggaatatatccatttgtggtcttgttttgaagatttaattgcaacgaatttaatggtgcaatcggatcatgatttggataaataatttaagagaaaaattagttttaaatggttttgcacgtatgcgtggcgctgacgtcatgctaacgtcatcgcccgatttttgcacgtatggatcgggcacccgatcggtagtcccctccataagatttatatgtgtaaacttgatgtgtataaactttaggtgtataaaattactaaaactgaaagataaagcggtgccaaaaaaagatacagggtgaggcaggggaccgatcgcctggggcgatcgatcgcgcattagcagtttcatcaatcaatgaatctctaaagttgccctaagcctcagagcctcttttagctcggtagggagaagccctgccgctgctattagagggcgagtgccctatcccccggtcttaggatcctttaccctagccaatacataacagtcggtgcttcccactttgcagttttccgtaaccaaccatactgcacaacatgaagtcatgatgattagttaacaactacgaaaaaaccaacaaccccaagcctcaaaaccacagtacagaaacaattgtcggtgaaagcaaaaa

SEQ ID NO: 94835 - DNA, 739 bp, Oryza sativa
atcgtatgatgcgacagcttgtgtagtttcctttaggaggatcaattttgcaacaagtgaatggcatttattctttcgccacgtatatgcgcatgacatgtggtccctggacctgattgtcatgtactcgggccggggccacaaataagcaaatgcgactcaactatataaagggtacaagagcacattttcttttcgaaaatggcacgatacgtaatgtagaatgatttcctgaaaccaaaggaaggtatttgtgccaacactcaattgccctgagtatttagggcagtcctagtggtggtggagctagaaaatttttcatggttatttatgtagatttggatggatttatatgaaaatttaagagtctaaggatgaatgcgaaaaggctatggagtcagctcacacatggcagcgccaccaatacatatattactaatcaaatgtgctaatttaatatcacatctcttacatcatgttttcgatactccaggtctcatgccaaacataattccatcatttttttctcatttagtatggagccttcgatgtgcatactccatgtagttgggttcccaaacggggaaaaattctccacgcgtgcatcacttctctttgccatggtgctcacttgtcatattgtgttttgtgacacgctgaggtgctgataaaccttcttttgtgacgctgaattatcatacaaaaaaccattcatttcattttacgcgatgcgagagtt

SEQ ID NO: 94836 - DNA, 664 bp, Oryza sativa
aaactgtaggtcctccttgagttgcaaaatcgattattctaatacgtggcaaagccattttttctaataatattctgcccctggtggcctggtgtgaagttgtttttagttgcatcattttagagcatcacgcacaagtggatgattgagaccgatgtgtgctgttggtccagcctttggttgagacaagtcgtccttgcttgtcgccaccctcgtgcttctattgcctattgccaagtcgtgctagtgtgacatctctgtttcaggtcataagacgtttttattttggttaaagtcaaacagttttaagtttgactaagtttataaacaaatatagtaatatttataatactaaattagtttcatcaaatcaataagtgagtaaaaaactttaaaatcctaagttgaaagttttcaaatatgagtaaaaaaactttaaaatcttaagttgacagttttcaaaatttaagtcaaaagtttttgaaatttgagtcgaaagtttttataatttaattaattttatttttacttttcaatttaaataaagttgtaaatatttcaatagaatgttgtcattttttttaaaaaaaaggagttgacactctttttgaaaaaaaaagaaagaaaaatttcattttttaaggaaaatgatcaacgtacacgt

SEQ ID NO: 94837 - DNA, 697 bp, Oryza sativa
cccttactgagaggtttgggaaactgagaagcaataggtaatggggggtgaggcatcccacagcgcaacataaagtggactcttgtgctctgaataagaagtaaatcgctagcacagtcaatggcaagcactgttcctattacatactccctcgcaatctgattgttatgctggagctcattcaggtacgcttgctacatatggtcacagataatatgaggttgatacagaatattaatatcgtctacatctattggctgctcggcattgaacactgggcctagtgcatgtgcacatgtcaacacatgaatatgcaagggatcctgtagtaatggttctatcacgaaaccagggcaatgcacggggactaggcagtccgccaccctctgagcaagctgatcatccgcttctggatcatcaggaataggaaacaaatgattctgccagtctaaaagaagattaggttctggtcggagctccacacaaacgatagagctgacacagttgcggtatacccatctctctaatgcattggagaaattgtctggtggtgccatctattgaaatagtatacagataattaaaccttaatcagacaaaccagagaactatgaacataagcaattcagccatgtggcgcattgaaatttacagttacaagtctgactaggtagaagcaattccagcacagcatatt

SEQ ID NO: 94838 - DNA, 870 bp, Oryza sativa
atcaggaaagaaacaaaaattctccatctgtctttttaagaaatgcaatatattaagacaaaaccttcctctttcctgctcatatatcccattctctgatttgttcctttaattgctgattggaacaactggctttttcctcactttcttttcttactaatccttgttgaagtgtactatgatttccctttttttttctgcacaaaggatagtatttgtagattttgatatgacaacaaataaatgttattggcctcccatgtgattttatctaatatagttcaattcaagatgcatggcttaagtttaaatccatataaatgtttctgtggagggattctacttgtttggatctacatcccctgatttattagatcataagaaaaatcccggcatctttactacgaaatttgaaatgatacatttccttaaaattcttagagtaacaaataagtggccaaacttttcttttcaggagtcccttatggtcattatactgccatgccatccaaagaatgtcacatggcaaaaggtaagagtgatatactgaagtaacttgataggatcatgggattcatgggagaatgtaaccgttggattcatctaagattttaggcataaccacatctttatgtgatggatgtcctggatttatgtcgcactttatgttagtccattacttagccaagtatcaaagcagtaggagtgatttaacatgaccttccaaatgcctgcctttcatttcttttatgacttttagggagatactgcttatttctgatcctatttcaaatcatccttttcttttcccctagtagaataatacgatgatatttcattttatatttgggaatgatagtttaatactat

SEQ ID NO: 94839 - DNA, 1502 bp, Oryza sativa
cttttataatatatgtcaattacttttaagctttactgaatttacttttgtatgtctaagaagtaacttagcgaaatctaaaagtaatttagacatatcataaaagtaatttgtgatttttcatcaaaatataatcatgtgagatcttgttgtaaagatttaattgttacgaacacaacggtgtaatcggatcgtagatcggatgagtagtttaagagaaaattgtatttgaaatataggtggatggtgtctcttatagatggagtggtagacaaaccagctaccactagctgtgtagtcacgtctaatcaaatagataatccgccaaaataatgtagtagtaatcaaatagaccaagatcgtatatctcctattcatggcccgagcttgtgagttgtgactacgggtatgttcactttgatatcattttcaaccatattttttttggcaaagttaccaaaaaaaatatctacgtttagtttgttaccaaatttggtcaatacataagaaatcctgccaaattttggtaatattgtcatcttaccaaaattttggcattgccagaactttgtaaggtttattttggctacaatctgaacgggctctacatgtccatacacctgaacaaattttcaccatgctaggatctttgtgggctaaaatagtctagggtggtctgggccgtaggccttagcccaagctctaatctatccgcatctatctctctcctatattgtccatgctaaatttggagattttacttgcaagatcgtatatgtaacttacgatgttgaaaacaattgtgatgatcggtcatcacaaacaatttatatgacgacaagtctataagacattgttgatggtttagaaatggttccacgtacaaaggctaacatgtaaagagacacacattagtgtgtaaatctgacttttcaacaaatatgtgcacttgttcattgttcaaaatatattccatgtacccacagaaagttcacatttacccccaacagtcactgatgcaatcctagccgttgatctccgatcctgtggtgctgcgagcacagcacagtagaactgtggaacgaacgaacacgaacgatgccgagaatcaccgagtcctcttcctcctccaatacctcttcttccccttcgtggcttcgtattttccctcttgttcttctcttccctccgccaattccaggcagttctagcaaaaaggtgcctcggatgaatcgggggctccagtagggagaggagatgatcactcgagcgaagctggtggagcagctgagagagcaccatatccggtcggcgcagtcctactccgccgccctccccgtcttctcccccagccctcacatgatctccaggtaaaggtccctcatcttcttgttcctgctaagatctgatgcgacgctgctacaaacatgatgcggttagggcttttacttggattgccctgattttggtggtctccctctattcactgtaatgatcaaaat

SEQ ID NO: 94840 - DNA, 1173 bp, Oryza sativa
ctctctggcgccgtccccctgccgacgtggcggggcgatgctgaggtggctagggggagtgcgccagagtggctgccccctcccccgaatttttttatttttgttttatttgtttgatatttttttcacgcttagagacacacaagaaccaaccatagaaaaattgaactcaaatggacgtaatatgtgacctgtaaaatttttcctctcctctcctctcctctcctctctctccgaactagtgcagaggagagatgtgcaacttttttatttttattttatttttttgatatttttttcacacttaggaactcacagaaaccaaccatgtaaaaaataaactcaaacggacgaaatatgtggcatgtggaattttccaaagctccaccgaaaaacttctctcctcgaaaacacaatcttgcaagcggaatttggaggttttaatatcgccgaacccggcgaagcgaggagaatcggatgtaactttttctgtagatgtccgtgcatatattatttgcctgattccgagtccgtaagataaagttacgcctgttttaatagatgacatattttgtccgtttcgatagagttttggaaaattctacatgtcacatattttgtccgtttgagtttattttttatacggttagtttctatgttctcctaagtgtgaaaaaaatatcaaaaaatgaaataaaaataaaaaaaaatgcatctctatatactgtttaacttatatatgtcatttcatgtggttatattttgaattagattaagtaatttcatatagtggtagagtgcattatgtttaacatgctgatcaaagggttttacttaaggagttatggtctaattttagtgaaggtgcaaagtaaactaagtggtatgctagctattttcagatttagctaagtgatagttcgagtttaaattttttttgtggttggttgtatcgtgatcctgagtgtgaaaaaacatccgacaaaataaaataaaaatgacaccgttgcaactccatacagaaaaataggaatggaggcggcggcgccagccatgctggcgccctcctcctgccacgtcggttcgcgtgcgccacggtggcaggaggacagcgccagagaggctggcgccgccgccttcgttcctatttctctgtatggtgttgcttcggtg

SEQ ID NO: 94841 - DNA, 15061 bp, Oryza sativa
caaccggaattaaagtggtgatctttgatcatttgatttttagtcccggttgggaacaccaaccggaactaaagtggtgatctttagttccggtggactaaagatcctcggcccctgacattaatttgacaggggatgaaccgggactaaagatgatttttagtcccggttgataacaaccgggactaaagatcatagaatggctctgaggttttcaaccgggactaaagatcatttttagtcccggttctttttggaaccgggattattgtggttttgggtcgacccagcaaagatcatttctccaccagtggacgtgggacaaatcaatccctagctccttcactaaaaagtggccagctgaattaattcagctaacaaaaatcacaaagattggcaattaattctagatgtactatgccattcaatacggagcaaaagactcttagctagtactaccaattttatagtttagcctgctcccgtgaagcaagctatcaaacataaagataaccttgtattcccaccgtactataaaaaaaccaacctagtaccgatgtgacacatacaagtactacgaattcagacatacctctgtctagattcattgtactagaatatgtcacatctagtactagattcctttttttttgggacggaggaagtataggataagacaattttttatatttttaaaaactttatcattttgataataccaaattgaccagactaatacactaactctaaatattttttttattagcactctccttcaccaattttctcaaaaatatttttatattttcgataataaaaatattatttttggttttttatcaaccaggttgtgcaaccgtacaatcatttatatatatgtacaataatctacatactcatggtacatatcaacggctaagtacatgtttgattacatatatacatcacaaaacctagctaattaattaggtttcactatatgcaacatccaaaacattattcatatttacccaagaaaatagtacagctatatgaatcacaaaaggtagtatttctttctttttacaggagggagcactacattaatcaaatgatgaagggattgatatcctgccattattgacgactcagctgtctacttctcagatggcaaacagcagaggcattgagcagtagctggacgacgaaaattaacaaaaagttagtacttgcccactatcagcagcagcaacccccacaaaattttggccattcaccctttgcagttttgcactacgccattcccctaccgatcatccccatccgtggccctacccggcctgcctcctcctatatcgcttcagcagttcaccctttcctctcagcacaatgctagctttgtcatgatatacacattttcacccccttttgttctacatactgcaatttagcgagagtgcttctccggccgtggcactgcagttgcacaattggctgcatttactttgcaataggtaccctcaagaaaactttttgttgcatcatttttaggtaggtaggtatgctagatgcgccagcccccaataggcaataacacagaagtacatcctctgtgcaagaagaaaattctagtagtaattctcttagtcaatcgataggagcagagtatagaatataccatgtcatactatctttttttcatctaaactatactaccttcgtctcaaaaggaatctaccaatctaaataacactatatccagctttgtaaccaggagttgatttattttaagacgaagggtataggctatagtgctgaagattgatttttgaacacaagagttcaatataatcttataagatgtttatagtatacactgaattttccagcataattttctgcagtgatagacattattaaatatataattgaatttgatacacaaccttgcttctatttttataaatactaccgtagttcgtacataattaaaaaatatacctctttgtaatctgggcccatcacaaactcatgatagaacggtgcaactttgtttattataatctttaatttaattttataaagtctttaaaactagactttgagacttaatttctcatctttatctttatctttacttacttaaaaaaataaaatatgcttccaacaaaagaaattagtttgtccgtaaaatatttccatatgtcatgagtacgtgtccgatccgatccgatcccgcgctccctccccctcccgtggccttctcccttgcgccttccctcccagtgcccctttcctcccctacctcctctctagcagccctctccttccaacgccactcttatccctgactctcctcccttctccccggtgcatcctcgtgaagcacgtcggcttcaccgttagggaagacgatgaatagtgttagttgatttttctccgtctttcgttcctcctgcgcattaagaaaaatggaacccactcattggggaatgcgttttgacacaatcacctgaccgttttcaccatcagaacatgttgttgtttgtctctcagtcagagccatgtcattgccatccgtgctcggtgctcttgttgttctagttttctttgttgccaaacgcagcatgttcaaggaaaatggacccccctcatcagggaacgggttttgacacactcaccggtccgtgttcaccaccagagctcgtcgttaccatttctctgccgagaccacgtcgttgtcgtccgcgttcctgttgttttggttttcatcattgccaaccgtagcgtgttcaagtaaaacggaaccccctcatccgggaacgtgtttggacgcactcacccggtcgtgttcaccactagagctagcttttgccgtttctctctctattgggtccacatcgttgttggccacattttcgttgttctggttttcttcgttgccaaccgtcgtcatctatggatgagtcacatcatatggcacatctagccaccagccttgtcgtcgtttggtgaattgaaaaattttaatatatgttgaagaaatgggtacccgtccagaactaatggatctaattttatttatgggctaaaataagttttcttttttttaaaaaatatctagctaattttcaattgttttttcatttacactattagttttactatttgatccactaaaaaattgttgaaacttacaattttccttcatattgaattatttatagctaaatgaaaaaatgaggactttagcactatattgaattatccttccggccaaagttatttatagtttcatgcttatttctatgattatatttccttcgtcatttatgtcccgttgtaacatatggtttaagattttaatgtatatcgtcggtgaatgttatttagaacccgttgcaaggcacgtgcattacgctagttgaatagttgaaatataattcggatagctacgaaaccaatattgcagggcttatatcgatcggccagccggtcggtcgatacgtggtgtagttacgtgcatgatccaacgctcgatcgatctctcgtgatcgagactacgctgcttgctgatcgatcaatgtcgaaccagtcgatgagaaatcaagaaaatccccaaactagcacacgacgtatcggacctgtaaaattgatttggaccgaaccgaaattgattggcaaatcggctcggatccatgcgcggagagccagttttactgacgtgttatcttcggcaaattaaagcagaaacctagctaataaagtaagtgtagtacttgactaaccggctgttacttgttgcccctgcacgtttagcttaatgtcgacattgtcttgtacacttgctcttgtgtgatcagattgattcgtgatatgctgataagtagaattaaacgtgtgtacatgcttcgctgcagggtaaggattacagaaccggcaaaagacgtgttctagcgtaaatgtgcaatcgatgatcaggagttctcgaagcagagagaggtgttttttttttccttcgagaggaagtcccctcaatgcaaattgcttatcaatttgtcgcaagatgtgagctaggaggatgcacaacagagatatttggttgacaggtagttttaccattctagaaaatatactaagaggtaccaggtatcatattttaatttgtagtgtaaaacttgtgtctttagctactaggtatcttgaggcatcagcaatgtaaaattttgatatctacatgtacttttttcagtaccgtaaaatttctatttgttgacaagttaggctagctccggtaacaatttgacgctctatgatttaaacctggcattcacacgtacaaatcggtctacttcaataaagaaaagttgtgagatttattaaatttatccatgcttcgtttgttaagatcgagtacatactagctagggttaacaaaaccgataaaaactggttggttttcatgaaagctggactatttggacaagctcaagaatacaaattgccaggctttttggtcaagttctaaagaaactagattttaaattttttataacatttgacaatattttattgggagtaaatggttttcaagtggtttccacgaaaactgagaaaactgttgacatctggattttggcacggaatggtttagtcaatgttatattgccatgttgcccatatgttagacaacttgggccaagcatgtgggaaaaatattagaaaaaaaatttaactatattttctaaaaataatcatattaattataacggtttggtggtacactttgaaaaaccctggtcccaatggacttttctgggaggatagcagctagaatttaaggtttgtgttatttctcctttgtttcttccatggacgttcacttctatgtaagagttggtttatgtattgctctataatattcgtcgatgcgatggctcccacttttacggtgtgtaacctattactccagtatttttttatttgacgtgagatacttttagggtttcgtgaaaataaaatcttagtaattccctgatattaaggaagcgcgtgcaagcaatcgagtgtgagctgatctttcatgtaatagaaaaaaaatggttactcttatgtttgatactatgcccccatatttttttccctcaagataaagcattattaacaagttgttgtgaactgacttgtcatcacatcacaagctagcttgatctttttagcaggataacgagataaagaaaaactcaatagaaaaatctctctctttcactactcgaggggaaaaagatagaggcgcatcatggagtaaaagcttttgttatcgaacggatggcttgagatgaactgaaggtcaaatgatatactaaaggtatgtacgtcacatgcatggatcgtatataaaaactatacatactgtagtggttagactaccgttcattgtcgcatgagccatcacaggctacaaagctaatatactagtgttagactgcgtagatagatatagctgggttattatcataatcacggccaaaccttgtgattaagatgttaaaacggtcctttacgtttccaccactttacgtgttaggccaaaacgaaattaaagcttgggaaaacacatacggaacaagaaggtaaattttgaaccgtagacctaagtaagtatcagatgcaaagagtacatctagaagccatgaaataaaaatctaatgaaaatgattttcatttgaaaaagctctaaatgcttatctggccggccaggggatgcatgcgtaccctttaatttattcctttttgcatgccctttcattttcaagcatgtaccgaggaattccgccacaaaaataaaataaaatagggaatatgtcttgacctcccaccatgcaaatttgcaaaagctttctgtctgagaaaaggaagcaaatgaagagcatatagtatctttttgtcaggccatcacttttcctctcaagttgacacaatgtgcaccatccaaatgcaaaggaggaagaaaaaaaatatatattctcctgatatatatttccctcctgccaacttgtttatgccgttggaattatgcctgcgccagagattctcccatcacaaaaacaaggagcatccgctgcctgaaacatctctctccatctctctttaaatttttttaaaaaataattttcaatccagatgctatacctgagaatgaattgcaggtgtgccagaatttacaaaatggattgaccaaaagcctaattaattgtactacgtcgacatgtctcctcctcgccgtcacctcgatcggcccgtcaatctgttctctcaatccagaaagaataatatatataggagcagcacccgaattctgatcatgcaagaattcaccatcagcaagttggtgctaatcaagaataaaatgttcggtatacggcaagttgaaatcgatcactgatcacgacgatgacgacgagacaaagggaaaaaaggaaaatggagaagaagaattaagcatgctactactgccacagcagactggctagtaattactactccctccgtttcaaaaatatttgacagcgttgactttttagtgcgtatttgactattcgtcttatttaaaaagtttaagtaattatttattcttttcatatcatttgattcattgttaaatatactttcatgtacacgtatagttttacatatttcacaaatttttttgaataagacgaacggtcaaatatgtgctaaaagtcaatggtgtcaaatattttgaaacggaggagtaatttataactgctgaattcactgaatctctcgcaggctcttagttcacgtaacagtagctagatagctctccacttttgcatggatccgattccgtgcacaaggtaattaagagcttatcgtaatgtagaatttacacttgctgaaacatatgcacaaactaaagctgtcgtgcatctgaagccatcaagagaatgttacggtagtaataaagttgagatagtgagtttggcgtcagatgcacattctcattgaaaagtaaatagtcgttcggttgactcgttgtaaatgtgttatatatatatatatatatatatatatatatatatatatatatatagagagagagagagagagagagagagagagagaggggggggtatatatgtgtgtgatctctcatctctgtgtgtgtagcatcaagactcaagagactaggtagatgtagcctagaaaaaagacgatcgtacgtgcagaaaagcatgagactgacaagtcaagcttgggaggataaaccagagagataaggcaaaactaaccatacagaaatatactcctttaattaatttgtagtttggcattaagttttatcttatagcaccgactttatggatgtggaataatggaaatatataggacgtacggggcactagctagcagcagcagctggatcttatactaagtaccattaatattgcatatataatgtatttgcacttaatggcatcgttagttagggtggcatgtgcatgcaccactagtggtagtactgccatccaattcagcaggctatcccccactatacatatggttgctgtatagagcgaatacaatagcacgttataagtcagctatatatatatgcacatgtggagaagataaaagaagagagaataacagagggctatagatttgtagttagctgtagcatggactccaaaacattgcgtgtttataagaggtaggatcatatattaattatgtagtatatatttataagtaactattgtatggatgaactattaaaatagctatatagtatttgaagctaatagttggctatactagtattaaacttgctcttagcttagcatgaaggactaattaatgagtagttatggacgtagtttaattaacgcacaactgccattatctctataatgatgatggattgtacttttcgtgtcatgttgacagttggatttttgtcaaagctggttctaaggttaagtagagcaaggggcttaacaaagactgggaatttacaaaaggtaaattgcaaggggcactatcaaatagaacacactttgggctccatttcgcattattgcagttgatttttttttcattattgcagcggatacgataatatatattaatccatttaaaatattagcatattcaaaaatctatatgataatattaacattttttatctaatttctcatctcaatcaatcatagtcatattcaatttctccacctaatcactcatcttgacccatcacaatattttttttaactcaaccttaacttctgctaaaactcttgaatgcttctacacattaatttcctttcatatttcaacgcacatggtaagtgtgtcaggaatacatttcttcagcagataaattaccggcccaagcacgtttgtacgtacggtttacattgtgctaaatattgtgcgtacatatattcaaatagaatcaatataaaaaagtaattgagttttttagatatatcaaacaaaaatatataatggaataagttccgctcttctacattataagatgcacacatttataattaacataaaattgagtaattaattgaatggcacaagaataatgtgtttagagcatatattgtactgtttgaaatcaatttaacacaaaacaaaaggttagcaaaattattggaaaaaaagttatctttccatctcataaaggcgttatgccattagaaacaccccaccagtacaaataatttatgttaggggtgctttagacattattaacaattatttagcttaatttaataattaataggatcaaattaccgaccaaactgttagtatagttttcaatatctcttacattagcttccacgcttttaaaagaaaaggaattaactagctcagctcagcacagtacatgagactagggagcatgtggccaaaaggataaacaggacaatcgaacacaaatattattaaaaaagtatcgtcatcatcgccatgataaaacatatattgatcaccacaaccctgcatgttattgcaatacacgcgcatgaactttttactaagacagccactaaactagtttggagataatgccatggacgataggtgtggtgccacgtgtcacactgcaccaaccataaaagtgcagcggattaaaaaagttactagcatcatgtagtcagatgcaaccatgggccgctattggtggaagaatggcaaatggtgagtactagtgcttgtcgggacaaagggagatggagaatgcaactgtaaaatagtactggacaaatagtccatgatatgaaaaaacaattagtggagaaattaggagtaagagcctaattaaccaaacaaacgtcggtccatttgtacggcggcaagccaagagctagctggctatatacaagcatagcaagagtgtgttgctaccactccactagtagtagtgtgctaggagtacttatcatctcttcatcttttatgtaccaaatgtcatgtcaagagccctaggtaggctactgattgatccttatcttcacccaccccatcaaactcttcccacaaaaagagagataatgatccttatatatagggtcaatgtagtttccaaacaaaatttttcatactgtcacgttaaatgtttagacacatgtatggagtattaaatgtaaaaaaaaaccaattacacagttcgctaggaaattacgagacgaatattttaagcctaattacgctatgatttaacaatgtggtgctatagtaaatatttgctaatgatggactaattaggcttaataaattcatctcacagtttcctggtggaatctataatttgttttgttattagattacgtttaatacttcaagtgtgtttccgtatatccgatgtgacatgcagaagcaaatttttttgccaactaaacatgcccatagtctatactagtattaattaattacaacaaatgacatgatcaatattgtcatattgaggattcaaaggaattatgctttgcttcccatcaataagggtgacctatacataggttttagggtttgaagcaccatgcattgcgttacatgtgttcatgagcataccgacaaagtaacagtggttagaaggcggccttcacaagtattctttacacttgtgagctcttatcataaaccggccacttcatgtctccacgaggctaggagaaccttagagcttatgacaagtcaatgcaactttgtatatatacacaccaaccaagccaattatgtaaagccttgaggccagtgggctccatttgtctataggcttcacagcccacgtttgtatccatatgtagatgtgttggaaatccaagcatttctgagcaaggttagctaggctccaatactttgcttggaaaatcaagtgtgttttttgcactgctcgatgcatgcacgtacgtcctcttgaaagggaaattctctgtgaatgtttgctgatcactcgatctctatcatgcatgcgtgcgtggacagtgaacatgtactaaaagttgtctgaaaatttggcatagaatatctaggccatgtgtcaagtccaaaagcaaaagggcctagccacatctctggctcctagatacttggatactcgtgcaacacactcagttgacacgttgtttatatgtatggcccccacatggtcgagatctacacacttatcatttgcaaaagctggccaaaactttctccgatagttagttggatatgcaagcatatgggtacaatccacacattacggacgatattcacatcagcatactgcctcattacgctactaataattacctttcattgacccaataacgcatatccaactcccaagtaattttatatgggcaaagcatctacccaaccacccactacatacacgacgcacaagtgtcaatcttggtcgtaagatctccaatgcattgacaaaaccgatcaaattctccctttctcccgtcagtgtgtggcgctatcgacgaacgatcgatcgatctgcaccgaaatgaaaacggtggcgaaaagaaaaacatatccgtttcttgatgaagcaaagctagggtttagaaagatgtaaaggacggccggacattgctcctttttcaagctccttttgatctctgctgctgcaagctacaaatagcatgagatcatagcacatcgatcgctttggagtttgaacactgaaagtcgcagcaggccaaaagatggccggcttggagcagaccgaccaacagtaatgtgattgggataagttaagctgatcgtttagggcatcgatgcgccatccatatgactttcttttttaccatttttggcaacgtgtgtgcaggctgcaggggcgtcgtcgttggtgagctaattaaggtctttgggctgtatctgaagattctgaacgtccatgctttgtttaacatgtgtgcaacccctgctttcggtttggtttgtcctaattggtggctgtctttgtttcagagaaataaaaaggaaaggaactaaaggaagaagaggatgcttagtatgaagcaattaagcagatgctctgttacaagcttacgtggttggtttaggaaatcacacaccaaaaatagaataacatcagacatatagaatttagctttcatatattcagctatatatatatatgcatgttgattttgatagaaaaatgttgtgcccttgattttacataatattaatagcatataagtatataaccaactagttagtacataagcttgagcattgataagaaaaagtaaacaattcaccgatatacttcaacattccactttgaaccaattttatacgtactccaccctgaacaattctcctccaattagattaaagtactaatgctcgtttcaggatttatacgactgcaacttggttttttttagaacagagaggcactgtctcgcttggtttcgatatctttttcatctttggaaaaggtgcttaaagggcttgtagggcttgatcttctactaatccatcattgcttccgtaatagtaatatgatatacatagttctctctttgttgtcgtgtggccggaagggagggaaagactggctagggacagtacagtcggtctcaccatgatgttcatgcacttgctggtggttcaagttcccaaaccatcagccaaaagctaggaattgaacagtttaattagaagtttgcaagcttaagctcacgtactcctgcatatcttaaagtcgatttgagttgttaagcatgttctaaatcatgcctttctgatcgatgcatgtaaagcttgatgtgtgtcaaccaagaatcaatcttttttgctaaccataaattaatattatcatttctgtttacagatggggatcaaagttggctccgagtcagatccacccgggatctgtctgtacctcaacattttggttcgggacctaattcagagttcgttcagtgtcataggcctggtttctgaaggaattcaccgaggatcgcactttgacagtagcttccatggcacgagaaagaatttcgattagctttgctttgcatatgaatcaatgcctcccatggtggctggcattgtgtggaactaacaaaaaacgtggatggacaattactttcacctagccatcacagatgtcagattcattgcaagacgtatatttcaaggatgagcatatatgtagtaggtcaaagaaaacaacaccaccacagtactgcaactccagagctctgaagctctcgatactgctacgaggaaacagacatacagagcttcctgtatttgactacctggagaaaagaaaaaacagacacacagcgcacattccatcgagaccaatggaataattaaccagtttcgcgcaatgcgctcgcgccactttgggctctttttttggcaagaagttggtcaaaatcaaacacggaaaggcgagagaagagggggggaatgaaggaatggaatggtggtcgccgaagcgaccgaatccacacaagccatagaccatgcatgtgcatgcgccgcaatggggaaaaagaatctcctctccttgcagcttaccggcatgcatgcaagtgagtagcaagcaatagtggccatttcaaactagtgcttggactagcccactcacactaactcccgggccgagatcgatcaggacggcgggcgcagtggggatcgaagaagaagggcaatgcaaaggcgggaccggcctttttctctgaattatgatgtggatcgatggatcaaccacgcagcggctgaccgtccgtccagccgtccggcctcctccgggctctgggtgcgagcccgtcggcgtcagccagccgacagtggcgcaattcggaccgtctcgatcgggaaacatcaaacatgtctccgaaagcaactgctacagatacaatttgtgacacaaaggtagtagacgtatgaagactatagatccttttcttatgcagcatatgccacacattgttgaaaatagtggtgtcgaacaagaggtgtccgtagcgtgccgctactggccatgcaagagaagtgtgccttgctggcgtaatggtgcctgtcaatctgcgagatgatgaatgcaaagcatgcgacggccggtcaaagtttcatgctttcagctagagctcaccgtgtcagtcaaactgaagattaagtagcacatattcgaaagtacagctcacctccaccgcgcgtgcagcaaaaccagctgacgcgtacgtacgtagcacctgaaaatccgctagctacgcacgagcgcgcgagacggatcggacaacgaaacggaataatcttgtgagatctcggaccatatgtacacatacagcgatagcgatccagacggcgagacgctggaccgtgcacgtcgcgcgcgcgcggcaataatccgggcgagaaacgcattgaccggcgcaccgaggcacgcgcgagcgcgacaggctcgatcggtctcgcgcgcggaacgccgcgatgacccgatcgtcgcgcgcggcatgcaggcgctacgtacgtatgtctcggcgtcgcctgcggcccacgcaaacgtgtggaatctgggcgattggaacgaacgagcccgacacgagtctccgcgatcccgcgaattcaagctagtggtggtacgtgactacgtgcgtgacgacgtacggtgccgcatgtggtgtgtgaacccgcagccggcgccaccctactactaacccactcgcgagcgcggggcggccgagtggtgtggtggtgctacgcataatatgcaccaacgttggcgcgcgccgtgttaggctccaactcgacgtgcggtcgtctcggttttcgccgggtcgtcctttgcaacacgcgagtacgcgacggcggcattacatctgctccgcatcaccgatgacactcttcgccggcccggtgaaatcactggtgacgatcgacgaatgtgttcgttgtctacatgggaaaatgggcctgacgatgatgcattagtttacataggaggcccagcatcagtcacgatacatataagcccaatacgatccaagaaataagttggttgaggggagcccattgctgggatggcccacggcgaggcagagcaacggaggaggatagtttttttctttcggccgtttcataatacgattttctggagacaaaatggatcaattagaacggtccatagaagagccgtagtatctcgcagagttaatatggaagtttagcacggaaaaggtcacagattacttgaagttgagcacagattggtcattgtagaaagcatcctaagaaccttccaaatttcatcacaacaaattggaaaggcaggggcggatttgccatgggggcgggggggggggggggccccccccccccccccccccccccgccccccacccccccccccccccccccccccccccccccccccccccccccccccccaccccccccccccccccccccccccccccccccccccccccccccccccccccccccccccccccccccccccccccccccccccccccccccccacccgccccccccctccccccccccc

SEQ ID NO: 94842 - DNA, 16044 bp, Oryza sativa
cccctcggggggactaagaggagggcgaacgcatcaccctcgggcccgacgtccctcgggggtaccaggccacgtgtgcgattgtgtctgcctcaaacctctagtcatgatactcctgatcccatgtcaccgacagcacccacttgtcaagttgttgtacttggacgttcaattctcaaattcttatactatattgcacccacatgtcaagctgttgtaccgtgggtgcaatttactcaaaatccaaaaatacactcctctttttctttcatcgctagctaataatattagtagtataatattacaagtagtgaggatagaagcatctctctatgtattaagccagaaaagaaattttaatttctagtttaagatcaaccccatactccagcaagcttggattaggggtgacttactccgcaccaatacgagtgtacttcactaggtccacgtgttgaaatgggccaaaatggttcgttaaaaaaaatgggggccaaaatgtccgtctaaaatataaagttctcccaaactataaaccgtggacttagacggttaccattttcttaaaaaaaagggggtaaaaatatacacatgtctcagcagtatatcctcatgtgtagcctccactaactaggacaatatggagctgaagagtgcatcagttattgattatagttaaattgtttgtcaaactccgtagcacatatccatattccattgaatagatctgataaaatattatgttttgttgactctgtactcacccatcataagatgtcgtacaaaaggcacgctacattctacttgacgggacaacgctagtgcagtttattttttataacgttgacaaaaataaacgaaacaaaaaaattggttgagctgaagttgataagacgtagagaaataaacggcacaacacaaaaaagtctggtaactttttgtcggagtggaaaatattatataaaatatctcatatagatatattttctagacgaaaataccactgccatgtcatataaatagatcacgaatagaaatactcctaaacgggggatgaccaagacttcttggattcgtatccaacttgccttcagagttctatatggacaatgttgatggtataaatataggtatcctaagaggggagaaagatacaatgcactctatcgcaagctaataaaagcccatcgagtcgacatctatagaagtcaataacacttagctgccggctttatgctgacaaaattataggctagagtagggtcaccaacctatactttacactcttgttattgataaatagtggaacacaaatctcccgccaaatagaatgtatagtcattatctatctcgggaggtcagaatatgtataaaaaatcactatctctcttattctcgttctatctttatggcacccttacacttatcttaccccataacaatgatatactaatgaaattgttcatcagattattgttatgaggtaacaatgatatactaacttaaaacaatgataaaaaaacaagttatctaacaatgatatactaatgaaattgttcatcagattattaccacaaattatctaattgattatatgataacttgaatatttttttttaaaaagaaagtaacatatactaacttaaaacaagttgtctaagcaatgcagtagaaaaaaatatttaagaaaaaatatattttattttaaagcgcagagaagataatctgttctaataatcgagtaaataatctgaaaaggggtcttaggttccatttgatttatattattaaaaagattactggggcagaatattgattcgattatagaaataaaatattttacgaaataaacttaataaatatcttaagttctaagcaatgaagtagatattttttagaaaataacccgtctcaataatacgatgattaagctcaaaagtgccggatgaggaaatcctgacacgtaggcaacaaatgctattttattttattttatttttctaaacaaaggtcaaaatggcaacaacctcagcttctagaaaccgcggcgacgtactcccccgagttacaacccgtgtgccctgcgaaaacgataacatatgatggtccgcgatgtcatttcctttttacagtcagccggggagcgaaaacggaacacgtccaggaattatcgccactggccgcggccggggcacccaccgaagattagcttgacgcactagaaacaaacgatgcgaaagcggccgggcttgatgtggtggtggtgtgggtgagagaaggcgagtgacgtcgtccggctcccgggccgcgcggggaggggagaagagaggagaggagacgggagatgcgaccaagcacccgtgcgggtgcgtccccccactcgcggcgcgacacgtgtaaagccagatgatgatgtgacaacgtgtggggcccacggctggccacacgtgtggggatgtgtcatctggtcgtgccgttgaatgggccgtttttctttttcctttttttttgcttcgttaattaatactcctatgggttggtttccatttcccgatgctaaagttgccgaattggctgctgttaacgtaaatttgcagtacggtgataaagacacatgtagtactcctggaatgctcaacgtcatttggcccggcctactgttcatgtcttttccgaatttttgataggtgcttacttcattttttttaataataaaataaactagcatggtggcccgcatagattgtgcggcagcatcattatattttccctcatataatagcatatatgtttcctcattatattattaaaatatattacaatgacaacataattttaaattttgcaataacttttcaaaactactaatgtgtaatgactactctagtctaatatttcttattttttaattctgaatttcagctatttctaaattgtatttctatatggactctgcttttttttctctaattaatgtgagaatttctaggccatgagagcgaacgtggaggctcctttttattccgaattttagttggttttaaattctaatataaactctatactctacttctaatattctttattttttaattccaaatttctattttatcttaattgtatttctatatgaactctatactctacttctaatatttcttatttttaattccgaatttcggttatttcctaattgtatttctatatgtactctatactttacttctaatattccttatttttaattccgaatttcagttatttcctaattgtatttctatatgtactctagtctcctcttctaatattccttattttttaattccgaatttcaactatttctaaattgtatttctatatgaactatagtctcctcttctaatattccttattttttaattccgaatttcagctatttctaaattatatttctatatggactctagtctcctcttttaatattccttatttttttaattctgaatttcagctatttctaaattgtatttctatatggactctgccttttctttttatccgattaatgtgagaatttctaggtcatgagagcgaacgtggaggctccttttttttccgaattttagttagttttaaattcctatatggactctatactctacttctaatatttcttattttttaattccgaatttcaactatttctaaactgtatttctatatggactctgttttttctttttctccaattaatgtgagaatttctaggccatgagagcgaacgtggaggctcctttttctattcctttaattatataatagattttagcatttacttccaataaactactccctccgtaaaaaaaactcaaattagaaggagatgcgatccttctagtacaacgaatttaaacatagggtcgcatctctttctagcttaagcttttttaggacggggaaataaattgcttcaaagaactcgtaccatttcattacacactcttatttctaccgtacttactttaaataatgtagcaaattttatcagagtggaacaatcggcggtgcatggttcgcgtttagcggcccgcaccatacatgcccctgggtaagaacataaaaatgtgaaaagaaatccttcatcgtaaccgggggcagatctagcataaggacgaggagggctcgagcattaactactggtaatagaaccatgggagccttcacttcttttttttttgtcataaatacatgcaaagaggagattatagctttgtctagtttgttcagaccagtgacgaatctaagaaaaaatagtagggatgtctgaacaaactgaataaagctacaacatctcttcccatctacctacattaaagaaaaaaataggagtttcatgaaaactcctataatcctcacatatgtagtgaagactcaagaccccgtcgccctcatgctagatctaccccggtttcagaccctccgatattttttcatgatccgtcgcttggtcgcaacgaacgggtggtcgtacaaatcagttcggtacgagtcgactggcgaggctgactgatctcacttgtgttctgacccgtagatcggcccgtgcatgcgagctctcgccgctgccacagttaaactgacgccaaatcgccaatgtttgctccttgattccagggcggtcagcgtgacgggacgcgcgatcgacaaatcttcgaccggaatcgcgccatcccaatgtcgatcccaatcatagcggcatatgcacacagggacgacgacgactcgaccgtcgacgcaacctgacacgagtgacaacgatgccggccggcgggccggcggcagttgcaggctcgacgaccgtcaagcagggcttagatcgatattgatatatcgtggtctcgtcgacgatctcatccatccggccggttcgtgacagatagggctgccgttgtgactggctgcaggctggtgaggacacgtactatgctactaccccgtcttttttttaaaaaaaaaaccaatcctatgtatttactccccccgtcccataatataagagattttgagtttttcattgaaacgtttgactactcgtcttatttaaatttttttttccaaatataaaaaacgaaaagttgttcttaaagtaccgtagataataaagtaagtcaaaaaaaatactaattttaaaattttttgaataagacgagtggtcaaacgttgcaaagaaaaactcaaaatcccttatattatgggacggaggaagtagatttgtagctagaaattcgttgttttatggagtagtcgtacgtcctctctttgctctgctagaacttctctttcgatcgaataacgtcgtggcacgtaacactgcacgttctggtctacaggacgttcaacgtacttatgtatcgtagactgtcgtacttatgtatcgtagattgttacgtccaccgattcgccactgctttaatgattttccatgtactactgctcgtctgctcctagattaattagattgtgttgtggccatggattaatggagtggcagtgctattgttatccaccccaatagtcggagcggaagaaccatcatcagatcgaccgaaagagacgtcgcacgcattatcatgtccaaacgcttcgattttgagatggatactgtttctttttctcttcctttggccgaaaaacagtagcgcatacctggctcaacccctgcttcagaatctatagtatgtacgcagggatggggctacccttgtagcgttgtctcgctccgatgggcatatgtatgaggtatatatcgatcgactattcaattcgaggggcttaattactttacgtgggcaggtggagcaccatcgagttctaaaactgtgagctcagccatgttagggtacatattaagggtgatgttacgaaaaacaccactaatactcctacatttttggcgtgcacacggttgaccgatcgagctaggattgccctgaagcgtacgcagtgttggagctttttgttgtttgttaactgttcctatggtgcgtgtcggtgtcgagcctagtagtgagtttccaaccgttgacgtaatatgtatctgagtttttctcctaaactattttgagtcatatgtctcggaaatggatataatatagggaaaaaaataaattacccccctaacggtacgaattaccccttcaatttaaaacggatattcttcactctcaactttttataccagattaattaccctccaaacagactgcagagcgattttgatgctacgtggcgtacacgtgacagttcagtcaacataaaaattgatgaaatggatggttactcaaaataaaaaaaaaactaatgaaacagacgtgtagggaattaatgtagaaactcatacgtataaaaagatagagtgaaacgttaggatatagaagaaattggatgaaatttcaaggatgcacgagaaatttccttgaaagagcggcaaacgcattcttggtgaggtgggcgctaagaaaattttttggccatattaaatgagtgatattttgttgaatgagactgataattgtgttattaattatgcttcactataattatgtgacaggctactctagtctcttctagtgattattttgccattaaagccagagaaaagtaatgcgagacaatgagagacctggagctagggctcagggcggtaagagtattaagcttccatctagctggcaaattgtaacagcttggaatttgattttaaaaagcacatcatgcgataaaatatgccaataaaaaaacagtcaaccaataacgaccatacacggagtatggagatgggaaaacgtcttgtatagtcagtaatgacttaaggcttcttttggaactctcagaaatttaattattctgatttgttttgaaataggggcgatgccccgcaaaaaaaaaaagggcgatgaaatttaatagctcaattgtttgctcttcagtttataagtcgcaagcaaaatttaaaatttaaacttaattttagagttgattttgatgttttttcattgtagtttattttccaatattgtcttttaagttacaaagaacacatgtatgaaagtttaaacaatttagttgttaataagcgttacgacatataattagctgtaaatgaaatgatggaacttctcgaaaagtatgtgccaaatagtatcttaattagatttgtgcggtgctatagttttcctcgaccctggtcatcctacgaccatgcgccctaaccctagaaattaatatttgcctccaacaatgctgtgaaatggatgaagttataatttatatgaggtcttaaaaaattgagcgaattattagccaggattttcttccagccacgtgcgagactgaaaaaagagttaatttggtggcttggatacctggtcacctggaagtaaacccacccaccaacccacagtacgattttctactcttattaaagtagggggtaatccaacttttttttccaatagactcagaattaatataaagaaattaaaccgtgacatgttaatggtctcaccaacagttgagttgttgctagcctttgtatcctcctgttttgctctctcatggcgaacagtacgtagtaacatgctcagatcagtggtcaacggttggccggggaactagctaggcctgatcataggacggcaaatggtgcgaatcggatttccccatgcgccgggcacatgcacacatattgacatcaagagattgcaaagtactattcgcgaatctcgcagcaggttgcccgtagctgactacgtacagtacaccccctgccagctgatgacgcctagctagtcgtagtcggccgggtcaccaactcaccatggactggcggcaactcttgtacaggatcgcgtttcacctgccatttcggtgatgaacttcacgggagttctcacgtgcttaaagaaaaggtgtagtaacagtgcacgcattttgtgtgaacagctcagtgcgtgcaggtgtagggtaggagtcgtcgggagatcggtacgatatcaaggaactaggacagcattgtacagtccccgtacccttttttcttccgggaagtacccaactcacgtcaacattgtggttggcttggctcagtcctagcatgggaggagggaaaaaaaagaaatcaatcggtttctagtgtcaacactcaacacgagtacacaactcgcatctacgaaaaattaagtcccaattataagctacccattccgtttcataatataaatcatttaacttttttaatcaaatttatttaaatttaatagagtttatttttcaataaaaaaataaatgtattatcaaaatatattgaattttaaatttaataaaactattttgtataactattttctataaatttagttaaacctaaatagttttgaaaaaagccaagcaagttataatatgaaataggatcatgcatgcatcctccgatccgatgggctcgctacaggtagcccaagtacgttgcgggtgcatggtgggcaagggggaaacagtagtttatgttgccgctatgcgtcggtcgcgtagtatggctcatcaccaaatgcacgtcgccctcgccgcgcgcacgtgtggtggcgagtcccgccccgcgaccgcgtagtaggactaggagatggatagactttactagtagcattccggtgggccgtcggtccgacgcgcgcgcgcgcgcgagggcgtgcggtgcgagcgccgagagaaagattcccccaccccgcgaacaccgcgcgcgcgcgcgacgacgtcctcatctccttccgttccaacgagcggatcgaacagccacacacaggggaaaaaaaaagcccggccccgccacgccgaagccgacgcgcgcggcggaaagcgacgcgggggcggcctccggaggggatcgatcctgtgtgcgcgtgcgtgcggatgacatgagattctgcgtatccttcgcggggcgccggggggtcgatcgtccatcggccgtattagctggctgcatgcccgggcgcagcggtggctttcaaggcgctactggtcctgacctgcacacatacacacacttatcattggcattggggccctcgcatcgaagctgagagtagagtgggtgtgcgtgtgcccatctcgatcgatcggtgtccaaagccttagctatatcgacaattaagactgcacagctagctgcaccccactgttccaaaggctcgcgatccatcgatgtgtacgtgtgccgatcgatcgattggattatttgggtgcatgcacacaagcccgtctgcacagtgccactgtgtttggagcagtgcgcgtgcgtttgcatgcgtggccgatcgctcctctcacacgctcctcgccgcgtcgacccggcggacgtacgtgtggctttttcgttcattctgctggggacgctgccagttcgactgttggataatagaaccgccgctcggtttcagatgctagtggctctgggctactggtactgatttttgttccttggcactgttcactgttacatcggcaggcgagatagatcagccggtggccttggactatttgccggcacggcttcgacgactactcccgtattttattaatttgctacccaattttctatcggtactccgttttgcaagtgcaaatgtgtgtgcaactcatttatatatgacggctgcggtagtagtactgtgtagatacatatacacgtggtatgcacatacacaaattttggactacaagcacaggacgacccatgtatgactactgcagcatatgattatgcttggactgtgtacatgcacgcatggatatcgagaaagtttgcacagtgccatgcgcagggatggccaaggaaagagtttgaccgaaaaggaggcatgcattgcatgggctacacacctttgcatcatttctgacgaccaccaaaccccatcctgctcctctgaatcgatcaagtggtacttcgtccttgcagcaataaactatatgtgatacttttagcatatagaacaatcaggaagctagacaagaacagagatcttgcttccaaattaaacatcgtgtaatcgagcaaaagctacttaaagaaagagtaatacctaaaaagtaattcaataatcactgttcaagtaattaagaactttgtagcctgaacaggttttctgggattctgtctgatcaaagctatttaaaaagagatatatatgctcgaaaagaattcagtgatcactgtgcaagtgatttatagctctgtataggctgaccagcttttctggagctttgtctgatatattggagtatatatatagtaacaagtaacgggatataggctctgctagatgcgtacctaattgtgcgattgaaccgtgatttgacctgattttactagaagacatgtcggcaatcctgcgccaactatcaacaggttaaaaaggaggaagagaaaatagaatagcaagtgtcggggaaagatgttgtgatgtcgctcgaggacatgatgaatgtgcatgaacaaagatgatgctgatcagaaaagaaaaaaagaagggctccatagattaggctatacttttttacccaaaaatgctaatgcaagtgcacaaggatgtgtcgattgctcaacagacaaataggttcttttgatcaaagggcaactcgatgagcttaccatccgattagtttatagttaatgtgcacaacaagtgaccaggttagaagaaaagcagcttagccgagtttactttagtgcaagctgaagtgtgcagatcgagttgcgtctgcggctagcgacctcaggcctcaaaaggccatgccatcagtcagtgcgggcacttgtcatgaccccctctggtcctaattctgcaacttagcatctccattgggcactcactcgtgcggcacaatatgctccagcttttggctaattcggctcctgcttttggctaattttcgcggcataggagaaggtagctttcaactcgtgaggaagagaacacgcgaatgcaggggctcttcggacagcgaaaggcacaattggtcactggttgggtggtggtcaatgacacactgatattgtttgttgtttgttgtttgttgtgcgaggaaattacgagcccgggaggatatggtaacctaggaggaggcgcccgtgcaacgccctgaagcgtacgtggctctgcgtggtgcaggcctttctgataaaagatgaaagggtcctgccgcttttcggcccaccttggggatggaagcgtgggtggtgggtaggcacatcgcccaactagacgacgcccaagtccaaactatatttgcactacaaccagttgcttactatatagatctttatagcctattttcagctcacttatatagcggttaatatttcactataaatatatggtccacaagtctgtctaacggattttcttagttcctgtgactaaaccagctataaacttacccgcttcttatctttctcctctcctctctcatcaactcagcatttagtcttcttatagccctctattatacttctattatacttgctctaccagtaatctactagcggccgaggtggtttcattcatcaaacgatgaaaagcgtggcagaatgggggcgtgcaaagcaatggagtacacatatacttgctgctgcttgggtgccagattggcatggttacttacttaccggaagactagcgcacacgaaaagcagcaggtcaaatacggaagcactgggcactggctcgagagaaaattttgcaaaagcatgtgctgaaaattttgagtgctcgcttcgggcttgagacagatattttgctcctgtccatttctgacggagctgcggctggatggatggacaggctccccgtgcttccccccctcggtggatggcaaacctacctatccacttgtggtaagatcttacggccattggcttgccctcgacatggtccataataaggtttagtataactcgccaccgaagataatgattccgggaaaacgacggcggtttcccaactcgggcgacgtggcgacgcgcgcggcgcaaaccaatcgcgccgcgggcgagaccgagacgagatcacgatatcgccggaggggttgcgcttgcgccgctgggtagaggttggtgggagagcggcatcggcgagatggcaaccgctgctcccgccgcggataaacgcatccggcaaccggcatcgaacgttccgatcatggcacagagctttgctccgacaagagctaagctcggagctagtaacacagtgtcagtggccctgtgccgaaccatggacaatgatgatggccttatcccctctggtaaccagacagtgcgcttggactgaactgtttctggcctgatagctaatgtaagttatcctggtgcagtggtgcctctgccttttttacaaggcactcaagctctcgaagaacgatgccagcaatcagtactgcagaagcagtgcatctgggaagtatattaaggatttaagaacatagcaggaagtgcaaaaaagtggctgctgggccgacaacagatgcataaatgggctcacattagttgaacttgaaccacaggttgcaacacacttgggaagcaggatcttcagacgaaaagaaaacagaaccgaagcatacggtgtccgtattcatactactccctccgtcccataatataagagattttgagtttttacttgcactgtttgaccactcatcttattcaaaaaatttgtgcaaatataaaaaataaaaagttgtgcttaaagtactttagataataaagtaagtcaaaaaaaaataataattctaattttttttttgaataagacgattggtcaaacagtgcaagcaaaaagtcaaaatcctttatattatgggacggagggagtacatgatatgctaagaacagggaaagcagatcacttgacacagaacaaaacataattccaagtgaccgacaattgaccagttatttcacatatgcattagtgagcataatcacaacaaacaggcttagatatccaaagattcactatcagaaattttctaacggtagcattacctttcaaaggcaaagctcgaaaaagatgggcaaaaactgagacaagggtgttggtgcatatgtatgtgcatgcaccaaaacagaataggtaatacattcagacatttgggtgtaagttgaactgtctgtaaattaagtaaagcaggcaatttcctatttgcagttgcgcggttttactacaatgttacaagatatcaaaaatatattcacatggacaaaggtaacaacaatctcctttctcttttcctcttcagccttctatgcctagatattttgagacctactggaaggagaattccgaaaactacaaagatggctgaaagtctgaaccatctcaagtaaagggcaacatagcaggacaccatgacaaaacaaaacaagatagcatagaagagagcaaccttgagatcccgcctgcaacataaaggatcatggatttaagagcaataacaaaggcctcagaagtcaaaacagaagcagaagcaggatagcaacaaccaacagattatatattgtgctaccggcctaccgaaatgaaaatcacctaggaattccagttgcgaatacctacctaaagctcattttcacaagctatagtatttcctctatcagtttcattatagacaagcaagatactttctatatagtagtttagactttaaaaaatcaacaaggatttccagattgcaaatactaagagctcatttgcattaaccatgctacattcagtttgctagttcttaactctgagaaagggtatgaacaatttcaggactatcgcattcaattggaaaaatgagcacattgtgttcactataaactcgatgtttcctttattcactccagcacaagctaagtatgtcacaaaattgcctaatataatactccctccgtcccataatataagtctccaaaatcccttatattacggggcggaagtagtacaattcaggatagtgaattctatgatagaatgaaaatcctctgttgcaatgaaaatcgaaggcattcattatcaatttgtcttttagtttcaatagttacaattactttggatgcagactgtagggaatcaaacaaaataggtttgtaggggtccaacacaaagcatagtttatgttagcactacaactaaatattttgaagacagttacaagccttaattcagtaccacaagtgtcatcagtcatgtataaaatgacagcaatgctgcatggaaaatataagatgattcactggccaataggttttgcttagacaacattaagtaaatacatataatcagaaaacagagtacacaacaaagtagattgcctagtttctaaaaatcagtaaccggttttcattcagtcaccttcctcgtattggtcacctacctagtagtgttaatatggcttagctggactgtagtctcactggcaacccgacagttatgagcatcagttccctttatgtagcctaataaacagcctagtagacccgtttacagaacactgtagactacacagtaaagtgttcgtgaaaacagtttaaagcaacattcgcttgctcctataagtctggcatccactatattttatatacacatttatgcagaagcatgtataaagcattacagctaaattcaaatattcactgcaacattttcatgactgcctcttcgtatgagaaagggaagctgcccatcttgcaagataaataaaagcaagtttctggcataatagataatagatgtaacaaatagtgggtaaaaaagactctgttcaaaattataaacataaacatactatctctactatgaacttttcatcataagtcctaaaccctaacacaaagcaccattttttaaaggttcttcaaggtcgcaggtttatcttatggtatattgtttgtaaggccacaactcaagtgatggacttgatgttgaactttggaaaatcgtgagtcgttctttttgtagtactaaagaaatatgatggtttagccaatgaaaactaaaccaaaaaatagaacaaacaaaaaaacagaaaaaaataaatggccaatcttttctttaatagaaatgttactactaagtaccaactggaccagcctgtctattcgcatcagttgtagtgacctatttattcctgcttagctccttcaactataatttattttcggacaggccctaaacagacaatgagattcactttattaatccatcaattagccattggctgtcatataagccttccaactggcacgccatgccatgcagacaatccaagtctcttgaagcatgaaatggcaagccatgaattggtgtgatcaacaaacttaaaacatgggttacatacatggacatgaggacatcccatatcatcttagccacctctccattacactgcagtgcatataatggataaagtgctaaacttatgcagtgcttgccacttgctaggcatattcctgagtctagggataactggataagttgtaaaaattaaacttgagcaaactgaggttggcctggccaaggtaggtgggcttggcaagttggcagggcttgaccaggtttagggataggacaggttcttaagtgactaagtgtgaggcctgttagcaaccaaacactattgctttgggtaattttgtcaaacctggaccaacaccaggttgcttaaatgaaacagtctcgatgcactgcaggcatgagttttgctcaggtataggaaactacaactagctgacagtattcagttcccctttcttttccttagttccttcacaaattgttgtattcagctactgacaaaagtgaagacaccatagcttgcatcattattcatgaatgcagttgtttgttctagtactccgttgactatgatcatgggaatagatgaaaagttgcataattaagttgttttatccaaatatactaataaaacacaacagctatgctattgtcttgactattg

SEQ ID NO: 94843 - DNA, 1966 bp, Oryza sativa
ttgaattttttttattttaagtcatttttttgtcccaaaatgtaattttaaaattaaaatttaaaaatctataaacatgcaacaatattttgggaccctaaacagttttaattcaaaaaattttcaactacaaagttgtaggttgcgtcgagggctacaattttgatataaagtttgtcttcattagagttcacatgaaaaagttatgaattattttttatataaagtttttagaccgtcatgtttagggaccggggtgacacaattgaataagttggaggacctaaacgagtgatctgcaagtttagagaccgggatgacacagtcgaacaagtttgaggacctgaacggtcgatttgcgagtttagggaccaggatgacacaatagtataagtttagggaccggtgatggactttactcttttaaattttattttttctaatttctttctgcatcgtattaatgtagatactgaatactttaaatgataaatattgtcaataaccggcctatcgagcatcgtttccgaagtgatgctatcgattccgaccgtttccgatcgttttcacccctaacgccaaccataccgacatggccaaatagcattgtcacactatttagacgagcgtggtaatggtgttttaccacactaacccgcctggcatgatcaataaaattaaagattttttaggttataactgttgtatcaaaatatgaggattcctacaatgactcacatgattccaatcacttcaataattctaaatccaaccacatgcttgcaaaggaaatctaggcaactaaaaattcaaacattgacaactgtagtgactaaaagaaaatcatttgatttaaccatggtacgtgctaaatgaccttacaattcttattttatctaacaaagggaataagtagtagtaccagctaataattaatactccctccgtccctaaatgtttgacgctgttgactttatttaaatatgtttgaccgttcgttttattcaaaaacttttacaaaatatgtaaaactatatgtataaataaaagtatgtttaacaataaatcaaatgataggaaaagaattaataattacttaaatcttttgaataagacgaacggtcaaacatgtttaaaaagtcaacaatgtcaaacatttagggatggagggagtatattacttcctctgtagcagagtactattcttcgtctaaatagtatatccctttagtttaaatttgaactagagaagtacactcattttaggacgaagagagtaccaaattaagcacatccgctatctagttttttaaatttattttggaaccgatggggtacgtgggagtaacgaacaccacagcgaaagcgacggtaaacatacatgatgcgaaaccgctaattcgcatcacgtattatatatatagagagagagagagagagaaaaaacgagggaacaaaacctaccgcgcgtacgttaacgccgatcggccgatcgatgtctgggtcgttttcaactgtatagtagagtgagtggtctctggcgtggcggcacgtgcggccatcgcctaatttcatcacaaaaaggaaagaagaaagaaaggcgaccgatggagacgtggacggggggtcgcgcgcgaacgtacgtgtggattcatcgaacctgactgacccgacccgatcgacccgagcttctggacgcttttgttatctaggccgacggcgacgtatacaggcctcgtgtagtttgcgaaaaaataaattttaggttatacttcctccttcgtattttaatatatgaaaaagtacgaattacctttcgaactattacggtcatctgaattaccctcttgaaccacaaaaccggatatttttcaccccgaactatgtaaaccggacgaattacccccctcgatccaaaccgcggtggttttggtctacgtggcggtccagtcagcaatttatttat

SEQ ID NO: 94844 - DNA, 1103 bp, Oryza sativa
tatagacactatttattttcttaggattaggaggcaccagggacttatgattctcccagaagaggaattaatgaaccagatttagcgaaaagggtgatggagtagtgtttagaagtacagtggtgtgatgtgagtcgatgcagatcgaagaaagacgtcgataacttgcaattagctgtgctagttattatttatctacaaatgagccatgcattgaggtatagctgattagctatatagtcagtggcggaggacggaaaaaattttaggtgtggcctacgaattaccatggaagttagcacagaacgaaaaatctcaatgcacgttattatatgatgcaatattatcttaacaagtctacattaagcatggtaaacaagaactaattacaagttgatgattcatcatctatttgcaaacaagtatagatagaagagtaggtactcaaaaaaatacctcaacttcctaagattcacgctttcaacaatacatcacaaataggaagtacagtactgagtatcgacagatatattaccaaagattgattaatgttcacatatgttgaacctgttgatggagtgatggatgcatggctagttggcttgccgcttgcttgctgtcgccgcttggtgctgcacgcttgcactgctgttgtgccattcgtcccaccctgcctttgtctctgctcttcctgcgctgcgcgcctgcccatttgggccctggcggctggtcgcgccgccgccttgccggagcggatgccgcagccgcagctctggaagcctggtggccacgccctcctcacctcaccctgccttcccgcgcgcggcgcgcaccgcagcagccgccgtccgccgatggggattggcggaggttggaggagatggtcagatgactcagatgggggaaatttgggtctcgtttacactaaacaagcctaatgggcttactagctatcagcgtgaggaccagcactggcatgcgcggacgcgtccacgccgcgtctcggccgtcgctcgtctttctcacgatgcggcgtcggcactctctctgacccggctattgcagtgcgcggaggagtacgcgcggggggggggggggggggg

SEQ ID NO: 94845 - DNA, 667 bp, Oryza sativa
ggaaagatgatgccatatcaataggataccatgaaaagttccattgcttgatgcttcttacggcttatgcttattgatctgcaggaggaaaggaacaccatatggccacataaccctcaaaccggatggagttactgtgtgatgattccttcttggatcgctcagacacctgaagctagtgcgactgctgacaacttcttgaaatccatagttgtgagtactgcttatattatcatcacgttatttttgtcagtcaatttggattgacgtacagattggaaatgttgtgtctctggtattaccgctatgctacaacataaatgtgcttggagtggattacaagtgagaaaaccttgttagaccaataaaaaggacaaaagaagttcagcacttatcaacgaagaactgagcttctttcaaaactatctcatattgggtagtggatgccaactttctaatgtattacctttttattgttctttcattttgagtaaatcgtgtcactttccaatattccaccatacttatcaaactagtttattaggctgctggactcacaaaactgtacttttctttagatcactaaagggtcacttttggttgttagcacactgtcctgactcttaatgacaacatggcgtgttgacgcacccccctgtatggggtg

SEQ ID NO: 94846 - DNA, 951 bp, Oryza sativa
ttaacccaaatttccagactattttgcgtattaaatccctgtccaggaccagccagggtacacaaaacgacaagtaatatacagttccaaacgtaaaataagcgtaaaatacttacagaagaggcacttagtcctcacaccgaaacaaaagcagcagcagcggaaaaaaaaacgatcctagcggggcttcagctccactccacaggccaaactcaactggggtctgagccttggtcctctaactccatcttcagctcagaagcactacacttctgaaaagggggaataatagcaaggctgagtacaaccaccgtactcagcaagccacaccaacgatgcagacgtgcaaggggatacaaggatggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattaggtcgatttattaagtgtgagactaatcacggtgaatctggtcgaccgcccataaccgtgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcagacaacgggcagcccccctttcgtgccgcggtgaatccggaagccgatcaaccggacaccccggccgacccaactccatcacgcccaccctcgcctgggtacgtcgactagagaaaagctacactacaagcccagccgttgcccacgctggcttgtggtaagtacgatagggtaccgagctcg

SEQ ID NO: 94847 - DNA, 659 bp, Oryza sativa
taccgaaacggagagtataatgcagggtaaaaccaaagagaggtaaaggagtttatttgcataaagctagcatttataaccagaaattgaaagcagtaaaacagttgtaataattatccatcagttaacccacttgctgctcagcactacaccacgttgagacaagcccaaaccaccacatgaactaatcagttccattaagctaagctaagggtgagactaatcacggtgaatatagttgaccgcccataaccacgggcacggctattcaaataattttactctgatcagaggtgtacaactgtaacaccccgattttcgttcgggactaaaaatcaattaataatgcattttctagaaattaaataaaagttaaagcaatttcatcaagtgatcagaggtgatacaaagtaaaactatggcaacaaaaaaaaggcccaattcactaaaaaaaattgtgtattctactagcacaaagtcaccgttctcacataaaaaggattatgcgcgtgtgcgttttataggactcgaacatgagagacctctcttcgtacacagtatcccttaccatctcacgatcgtcggaaatttattcagcttggtttgctatcttatgtggtgttttgaatctgctaaaagatgaagttgaagattaagtg

SEQ ID NO: 94848 - DNA, 745 bp, Oryza sativa
ggcgaattcgagctcggtacccacgagaccactttggactcaagtgtcgctccccgcatgggcaaccaggtggcgaaaaacctagccgccgctcacccccgactcaggcggcgggaagaacactccggcagcgctctcgacggtgcgggcatatagcggcgagttgccagggcagcggacaatgccgacgcgacgagctggccatggaggagtggcaatgacggttgcgcatcatgggaggccgcggtagcgcggatccggccagcgcggctgagctgagacgtcgaccaagcagatctagcagctgagcagccagatcgggcatggtggcggggtggtcctgtgagaggcggcgaagtgcgggaaaggcagcgccgggtgcagggagacagcggcgtcgggcgcaaggagacaacggtgtggagcgagggccgagacgatggttagatttggcgcctggcaactccgtggttggctctggctggcaccgagcatctaacatggtggggcaagggcatagtggccaatgtggcgcggtcggcatcggtggtaggtcgcgcacggaaggaggttggcgggaggctgacctagcgcgggttggcatggtaggagcggtaggaagtaggcatgatgatggcggtgggagcggcgtggtgcgagtaagaggagccgtggctggctggtgtggcacaagcggggtctgctgcggtcggcgctccggttggagtctcggtggaggcatggg

SEQ ID NO: 94849 - DNA, 993 bp, Oryza sativa
aatagttctaaggataatatgatatcgtctagacatgtgaaaagacgattgaagtctgtcaggaaattaagaaactccggagttataacgttggattacatccaaacagcgagaaacctggcagatcccttcacgaagggactatcacgaaatgtgataaacaatgcatcgaaggagatgggtttgagacccatgtgagttatactatggtggtaacccagtctatgtgatcggagatcccgtgaattagatcctgggaagaacaaaccattagtaaactagaggagagtatcaatatatataccctctccaagtgaagatacatgtactctcgtgagctgcaaggcaggttggctatgccttaatgagttctgttggctttaattagcgaagatgttgtcctgcagagcattcttgaaagaactcacctttgtgagcttgactgttggtcgtagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtccccatcgaaccgctggtatataaacagtacattggaaaaggcaaatctcagtgagattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgtcctcctagccacttgaagcatgtgtggtggagagaagaggggaaacacacgcgcgcgctcgctcgcctcgcctggcctggcagggcaggg

SEQ ID NO: 94850 - DNA, 652 bp, Oryza sativa
tatatctagattagataattttagtctgcttgatatttattttacgttctttttttccttcttgtgttctttgattaattaggtgataaggaggaacatctagtcaaggaatatcgtgatctgaaactcgagattgaacaaattaaatctgatatacagtctctgcgacatgagaaggaagggagaggctaccataaggttttttctttttctgctttcatgtcgctttataaaactcttttttttccctcataccaatagctttttcattgtaattgttacacaggaaacattaggtggcacctcaaatcagcaaaaacaagagaataacgagaaaacaaagtatgttgatcagaccttttttgggggcaatttttataagttcctgttaatttattatttgagttacggatatgatatggatttataattggaataatgaatttgtctgaattttcatgttcaaccaggcaaccagcgatagatggtattatgaagtcattacgagcaaaagcaacaaagttgcagcaggtcaagataaggtagtctctgattgatgcgcattagcaatttaaccaaaataaatcaagtatataatacagaatgaagttaaaacattctttttacctttttttttcttcgcagctttcct

SEQ ID NO: 94851 - DNA, 1607 bp, Oryza sativa
tattaaaaaacggaggcaatataatacaatgagaaaagagtcaaatgctttattattgagcaaaaatgatggtattatttttatcatcttttagcggaatctatctaaccatagttaatcagcctgtgttagtagaagtctgtatcgtcatgcatcaacatatcatgagattattagttatagctaagtacagcagtgtaatcatacttagcatatcacgagactatcgggtaatggacaattatctttaattgtgctagagaaaaaaaaaagtgctcccttcgtcccataaaaaactaacctaggactggatgtgatacatcctagtaaaacaaatctaggcatgcatatgttcagatttgttgtactagaatgtgtcacaccagttctacattcgtttttttgacaaagggagtaaattacaatccatactatgtattcttaaaaattcttaaaagttttcatataatggtatcctttaaccattttcatttacacaatagctaactttacattttaatttggaccaccatattctatccatcttcaagtccggtgactcagtaatcacttcgcacattaactctctctctctttctctctctctccattttctttttccatacgacagttggataaccgatagatctatcaagaaagagcccgatatagcgccttcgctcttcgtcgggtcagctcctgccttccaaagtccctgcaagcccaatatctccgacctcaatggcaacgataacaatagtgcgcatcacgataggggaggagaaaaagacttgtcggttactagaggttaaggctgcgcatgtaaaggcaaaggagaggaacgatggtggttcatggagaaagagcagtgatggcggtgcgtagagtggcagttagcggttgctggtggtacgaggaatttgttatcgacacaatcgtttaattttttcctaactattgatgatacatgggtcaccagttatataaagaaataacactagctagttttaaaatactaccttgtcccaaataagtgcagccgtgaaaatccgtgttaaacttttgaccgtccgtctcaaatttttaaataagataaaatgttaaacgttggatgtgaactttacaaaactatactaaaataggatggaaggagaggtaagtaaaaatattgagataagggcagagtagtcgagtacctctcgttgtctcctccgctccttgcctccttgcgccgccgccaagacgagtcgcggctgaacaggggagggccgggcggcgatctccatcgcagcggaggggaggggatcctggtgcgtcctctttctgattcctctctctctctctctctcccaccccaccgggactggaatttgcttgcgcttctcttctagatcttctcctcctccttaatttgatagccttaaacctctcttaaataattcaaggaataacagtttgtttgttcacccaaaagtttgggggttcaactgaacccccatgtcccaagttggatccgcccctgatttttgggaagcctttgcaattggaacacagaagggggttctgtcccaaaaccaacttctggccagtttgatcaagcaatacca

SEQ ID NO: 94852 - DNA, 883 bp, Oryza sativa
caaagtatctattacttgatcttcacttaaatcggtgggtccaatattataaacctgttgacagaaaacacgaggcctggtagatctgcttaactcctgcaggtccaaagctcgccttcgggtgtgttagcgtgctagttgatttgatcctgcaatcaacaagaaatagaaacaaagagaccgcggttaaatctataaatgatagccgatcggctaggtgccgatgacatatcatttatctttgagccgatgtcatatgtgaatcgatcggcggttgtaaatagacaataaagaactaaatctattcgatcggctgtagatattaacaatgtatagttcttatatcgatatatatttaaatcaagtgactgggatagatctgtcgccatgccgagacagtataaatcacttagatcgaaatatatattaataacaacattatatatgtttatagcatagccgatcagatagatctagcatgtatcggctaatactccgatactactctatatcaagatatcaaaacaagtataatatatcaaataaaagcctaatatacttaaatgcaataagatcttgacgtaaagggcggatttaacatgtcaatgaagcatatagaacaaatatggttaaatcagataagatcggctgaaactccgatactactctaatcggcaaccagaaggcaggctagagattgaaattctaagcacgacttaatagatcaaactcaactgatgcagcattaagtatgaaaagaagaacaatatctagacaatcaagccgctggatgtttcataaagtggtagatatcttatataatctaggtcaacatcgctatttaacctaatcggctgccttctgtcgacagatggtagccgag

SEQ ID NO: 94853 - DNA, 1012 bp, Oryza sativa
ctctatatcaagatatcaaaccaagtataatatatcaaataaaagcctaatatacttaaatgcaataagatcttgacgtaaagggcggatttaacatgtcaatgaagcatatagaacaaatatggttaaatcagataagatcggctgaaactccgatactactctaatcggcaaccagaaggcaggctagagattgaaattctaagcacgacttaatagatcaaactcaactgatgcagcattaagtatgaaaagaagaacaatatctagacaatcaagccgctggatgtttcataaagtggtagatatcttatataatctaggtcaacatcgctatttaacctaatcggctgccttctgtcgacagatgttagccgattgtaggttagatgacgatattgtcgaagatatatgataacttgacgaattacatagacaagattagagtgtcgtaaagatgaaagcactaatcccgagaacacaatccatcataacaagttttacctcttgttgaagatcgaaaccggtgcagctcaacccgaaagcaagaactcgtcgaaataaaactaaagcaaaaaggtggcgatgcgccgagattgtattgaacgtgtgtagattccaaattacatagggctcgggtctatttatactcgagaattacaagatatgtccataccggacacgactattatctctaacaaactctaagataccataagtctttgcggcagacttttgcccaagcatatctctaaggaaattacataaaatatcctaattaatagatacaattgccttctcaggactctatccatgtgcggcaatcatcttaaagcacctcaattcaacccgatgtcatacaccaagttgtattgtcggaatcggctgcatcggcttacctagtccgactcagacccagccaatcctaatcgtagccgatctggactccagccgattcctgctctgttctcgaattcgatctcaacacaagacttcacttcgatctaatctt

SEQ ID NO: 94854 - DNA, 1147 bp, Oryza sativa
caagtttgatataaagtttgtcttcattagagttcacatgaaaaagctatgaattatttttagatataaagtttttagaccgtcctatttgacccagatgatattcaaatccaagtttagagaccggggtgacataactgaacaagttgaaagacctaaacgagtgatctgcaagtttagggaccgggatgacacagtcgaacaagtttgaggaactgaacagtcgatttacgagtttagggaccggaatgatacaacggtataagtttagagaccggtgatggactttactcttaattcttcatcttttttttcttttgtaattttgtttgttttcttcttggatgataaatgagaaatgtccaggggtcttccggctagctccacaaggtggtgggctagatgacctgggttcaaagcctcacccctcctaattatttgatattaggtccttctctaatattctagttttttttttcttggatgataaatggtggcttgctcgtgtcggtgtcaggttcccttggttggctttggtttagagggagggactgtgaacagaaagaaacgtcgtctcgtcgggatagagcctaagggtgtgtttagttcacgcgaaaattagaagtttgattgaaattggaacgatgtgatggaaaagttaaaagtttagttatgtttagttctttccaaagttggaagtttgggttaaaattggtacgatgtgactgaaaagttgtgtgtgtatgacacgttgatgtgataaaaaaagttgaaaatttggatctaaacacagcctttatgtgtgtaggaattttgatgtgatagaaaagttagaagtttaaagaaaaagtttggatttaaacaatggccaaggagaaatgctactagctgtatacctgtatgtacgtagcagagcttccagattcggttgctcccgccgcacttgattagtgttagtatttcccttgtatacaagggagcaaagcacgcaagcaagagctaatccagcaccggccatcaacacgtacacggtacattcgccgtgtgcattgtcaaatggtatactcccctcttaaaaaaaaattagaactaaatatgatatatcataataaaacaaatctaaatagggatatgccacattttgggg

SEQ ID NO: 94855 - DNA, 916 bp, Oryza sativa
aatagccgcgccctcggttatgggcaagccgagcaatgtaccccaagttagtgttttaattcttaaaacctgcttaacaactaaaatgtggaatggttggcctgggttggcttaggacgagctgggacccagggtcgggttgccagttcggtctgaatcatcataggccttgggttaaggcaggttcgtgtgggttcacggccttgattaataacattgtatagttctaggatcgcgtttacaaaatagctttgagcaactaaacgtctttaaatgctgtttactgcaacgctaacccttattataaattcccttgtactcccttgcatttattctgcatttgtgggtgtgtcttgttgagtacggtggttgtactcagtcttgctcaatttttcccaagtccagaagaggagctccttggagatgaaggctttggtgtctagctcgtgcctgccgtcaagcgcctgtggtcgtcgccctagtcttccgttgtttcccgtttgtctttgtgtgctgggccttcgctgcccgtgtaataaatatatttacgcttccgcttgttaaactctgatttgtatcaactgttggtgtaccttgcctcctgggacaaggattaatgcacgcacgtaaggaacgcccgttgggttatttccggtcgtgacaagttggtatcagagccacctttgaccctaggacgagccgtagatcccaagccttagcaatattttcaaaaataaaaatctttgattatttgtgaaaattgtctagtctctctctgtcttgctgcttcatttatcgccaaaaatctgacctttgaaatgttgttttttttgttttgtttgtagatggccggcagcgtcacccgtcgtggtttggacatgactggtttcgtcttggagctgcggcgcatgtgcgt

SEQ ID NO: 94856 - DNA, 1885 bp, Oryza sativa
tatttcaaatataaaattacagtcctatataactaaaattacatatgtaaatttagttgatatgacatgtaagtgcactgtaattttgataaaaatattgtgtaagtaaatttgtattagttattttattttgtagtccgttggatgcaaatccaagagaagaaaaaaatctgggtgattttttctcaaaaatcacccgagtgatgaataggcggtcccaaaggaaaaaaggcgatattcttttcatctttcactgtagaggactgcttacgtgggcttgggccacgggccgacccgttggactggaggcagcaagcctggctaacccactttccagcgtttgaaacggtttgaattctgcttttctcttgtggcacaaatagacaaagtggaataactcactcacccaccacccttagattgtatcgtttcccaatcggacgatcagcaacgcttaaaaccaaagctagagacactggggagcctatataatattccctcatcctatctaaaatactacctatctcgccattgcttacctctagccacaccactcgtctgcccggccgagccatggatcttccgcagcagcagcagcatcccgagatcaatctcggtatgcatgtctctcctccgggtagagctagatgcacctgctttgctcgcgctgtggttacatgtgccacgtttctcgtgttcttgatcgcttctctgatctttctctcgtgtttttttttctctctttttttttcatttctcttcgcgcgcggaaactgtttcttgttactcttttgatccggtcgcgtttttctctttcactttttatttcttttcacctcatggcagtggcgtgttcatcgcctcatcatgcatcttctatatctttcttgttggtttcctcggaaactgttccttgtaactctgttgatccggtcgcgtttttctctttcactttttgtttctcttcacctcatcccagtggcgtgttcatcgcctcgtcgtcttctatatctttcttgttggtttcctctgtattttcgctcgtgggactaatctaggtttcattctttaacaagtttctcctgttactaactaattcttattttcttttcatgatttagacgagaaccggggtgcaagggtgatgctgatggttcgttttattggatcaatcgatctatcatcttttgtcttgttgattttcgttttgcccttatttcttcgttccctgataatggttgtttcttgtttcttttttccattttaggaaaagaccctcctgaatccgatcttcctcgtggcgcttatgatgtactcgcttctcatcgggaacagccttagcggccggacggctaccccacatggatatggggctccacccccatctccagctgggctcgccacgttcatgggggtcagcttcatgtgcctctcattcgtgacggtgggcatggttcaccttgtgcttgttcttcatcttacgatggtgaggggagtcggcggttttccaaggctgacgattctctttcgttggttcatgcctgcttgcctcctggcgtccacctttgtatactttgtccagtccatgcacacaacgcggtaccaaccttttgttctcgttcctagctatttacttcctgtttatctcatactcatcaatttttgttgtatgtttcgaaaatcagttatggcatatggaggagcgagtggataaccttctgcatcgcgggggtcatctttgtcgtgatcaatctctcaatgatgctggtaataagttcggttacgtgtcttctgagattggtttttttctcgatcgtctgaatctcacatgttatatactatatgtttcttttctcagaggccattgaggcaggttggcttgact

SEQ ID NO: 94857 - DNA, 5025 bp, Oryza sativa
tcctcccccctccctcccagatctggccggaggagggaggagggaggccggcgccgccgactacggcgcggggcggcggcggctcccctcccccctccctcccagattataacatctcagcctagggcttaatagaattactaaaatactcatatcaacaagttgcaacttcttttccggaagccgattttcaaagaactccagggttaagcgtgcttggcctggaccaatttgggatgggtgaccgaccgggaaattattctcgggtgcgcacgagtgagcacaaagtgtgcagaaaagacatgtgttggtctgtgagggtagtctatgacctataaaagctatcagatggaagcgggcccggcttgggagaggcaggacgctacatggatctggccggaggagggggggaggctggcggagtccacgacggcgcggggccgcgggggcggcggcggtggcgacgacgacgacggcgatgcccggcgtggcttccctcccctcccctcttgcccggcgcggcgacgccggaggaggacggcggcggcgaccgccgcccgtgattttttttttgtttttttgaatgtattttcgcaagcgggttgttgccccgactgcgaaaatggatgattttcgctgtcgttgacctaccctccgcctgcaaaaatcactttttgccgcctggaaagatagtttttctagcagtgatattagtgatattaggttgatatggtaaaacaataccggcgtactcaccgtaggcagtttcgtagtattgtttcgccacgttatagttgatgtagctaaaaggtttatattagagatagtttatttttaaagttaaaatattaagaggtttaaaaaatttgcattcttgcttgccttaatttggactgacaaatgagctagagagatgatatatactatttaatttggctggctaattcgtttgtatttactttaacttcttaaaaaaagaattcgtttgggtttaattcttttatttaatctttagataagggtattttttttacccaatctctacatccaaccggatgtatgtggcctttttaaattgggaactagccactcaaacaatacaatgatctgaagctcgctcttatatagatttgaacacaggaccttagagtgctgctttaatatgtgtataaatacatatatgactactgttctttccaacaattaacagtcaaccccttaattatgtttgacgagtgtgattagcacgaatagctagctagatattggcagctaacaacagaacgttgatgtacatgtcactagacagttaatctccggtggcgttagtttctacacatgcagggttcccatgcacacacatctctcgattaattctccctccgtattttaatgtatgacgctattgactttttaacaaacgttcgactttccgtcttattcaaaaaatttattcaaaaaatttatgtaattatcatttattttattgtgatttgatttatcatgaaatgttctttaagcatgacataagcatttttgtatttgcataaaaattttaaataagacaaatggtcaaacgttggttaaaaaatcaatagcgtcatacattaaaatacggagggagtattatatagtagcatattgtttgcatagtacagtagggagcacgtttctaatttgttaagcacgatcaactcgatcgattagccttttcttttttgacagccgcaatttgtacagctcgatgtgcacgtttacgttacgtacgtgtagcacgtgctgaatttgttggtgccatagctttttctattcaccaacttctgcatccatatgcttgccttttagtcaatttggtgaaaaatattttaggattcgtgcaagcatcaacaaggaaacactgttaatccgtacgctccaacgacttaaaattaagttttaaaatgcaaatctatactttctatataattagtacccactaacaattattataaactaactaaacctcaacatgcaagcatgccacaccatcacacaccagcaattactccctccatattttaattaatgtatgacgctattgactttttgaccaatgtttaaccattcgttttattcaatctttttgtgaaaatatgaaaatatttatataattcttaaataacatttaatgatgaatcaagtcacaataaaataaatgataatttcataaattttttaaataggacgaatggtcaaacatcggatgaaaagtcaacggcgtaatacattaaaatatggaggtagtactattctagcctatttaaaatcccatgcaagcatgccacatcttccctcactagaaattactattctagcatattttaaatcccatgcaagcatgacacattatctacaatattatattatagagatcgataaatatgtgtcaaatcatattcctcacattattttctctacatttcaactttcatcatttcgacaatatttaatatatactcatccatgatttccgtagcaaagcgcggggtatcacctagtattaactataacttgtaccccagccactaatagctcataggatccctttttctcaattttttgagttgtttttgctcctcggagaaaatgtcacatggtggctattttgaaaaaaaatatcctcgtgtttgcatgtaatatccaatgtcctcgaaccgattgacgccccgttgtgttgtatctggaaaaaccccttgtcttttagagaaatacaacgtgaagaagaaaaaattctgcttccacggataacgatgtaaacataaaaaccacaatggatttttcgaaaaacaaccgcatctacccccacccaaaccctatccctcgctgtctctcacctacacccaccacgccccacccgcgctccacgctgatgccggcgtggggttgcctccaccgccgtccatctttccaccattgtcgttgtccattctcctcccgttgctgccttcattgtccgtcttaccccccgataccggccacaacccccctcccgctactgtgtgccctttctccaccattgctgctctccccttaaccctagcagccgctcgacggaggccttagcagagggtggagggagagaagggagggaaggagggctcgatgcatggtggaagggctcagtggtagtcaatcctctcccctctactatgtctcctcctccgatgcaccaacacattgccttgtccaccgccgtccattcctcgtaagttagtaggttgacgaagagaggcgtagatttttatttagattgattatgaattcgtggaaaaaacgatggatctcaacgaaaaaaaaatgatgaggatgatacatgctttatcacacagattattatgcatgttattatgaactcatggttcaatattaattaattaatttcacgtaagactactagagttgataacatatataatatgcatgtcgttatatatggtttaatatttcacgtaagactataataatgcgatgggttagagtcgtgacaaaacaaacgtacgtcatcgttttactaaagatgaggtttgatatcgacctccaccaatcatagagcaggttaacttctccgagatatatatatattattattgcataatgatttttctccattggaaaactatctagcaatataggagcttgctagggcaaggaaagaataaagatccatgcgctagctaggagttgtaagacactccaagattcgtgcacacgtttgtttttcattttcacccacagaatttcaataatcttaagatgttgatagatgtacctgtagggaaaattaatacttcctccgtttcatattattagactttctagcattgctcacattcatatatatatatatatatgtgtgtgtgtgtgtgtggggggggggggggggcggcgcctagattcattaacatctatattaatatgggcaaaggtagaaagtcttaacctgaaagatgtagcatttcccatgcacggagaactgaaggatagcccatttggttatgttatttttggtggatcctgccccacctgggtttaattagtcctaagcttttcaagcgtgctcatatttacatctagttattctttcagtgttaggatatatagttagacgcacgtggtgacgttattaatattaagatacgttggttcagtttttatgaatgtgcttatatataggagcatgatttcaaatcatggacaattcgattgtatgaacacattataaaataatttaattctcacaatcaaaactacagttgtgatctttggcaccttgttggggggctatacgaatgtaggggcatgcatgctaataagtattagtgtggtactccctccgtttcgaaatgtttgacaccgttgactttttagcacatgtttgaccgttcgtcttattaaaaaacttttgtgaaatatgtaaaattatatggctacataaaaatataattaacaatgaattaaatgatagaaaaataattaataattacttaaattttttgaataagacgaacggtcaaacatgtgcttaaaaagtcaacggcgtcaaacatttcgaaacggagggagtaattagttgctgattaattgtactgcatgcacactgcacacaggtcagctatatatatgcttcatgcatgcatgatgcaacttatatgcaagcaaacattttccgttcgcgaggataattaatgcaaccaataatacaaatagtttcacgtcttagcatgctgaaaggactaattaatacagtaattaacaagtacgaatttcttatcattaagtggacaacttgtatctcatagaaattagaggttaattatgtgtgtagccaactttttcaagcaatattatgatgcgtttaaatcgtataggtgattatcgtaagagattcccacgcgttattgaaaatcatttctccaaatccagaccatgcatgatcgatcatagcaaaacaaaaaacaaataattaaactgattaatatatatttg

SEQ ID NO: 94858 - DNA, 752 bp, Oryza sativa
  unsure (1)..(752): unsure at all n locations
aaatataatagttgtctcttcacatttactgcagcacacatatcaataattatttaattacttctctctcactccttcccagcttttctctttcctccaagccaatcagggaagattattcatgctaatttcttgttccgtcgatggtgctgtcgataggaaggctccaagccagcgctaggtgcattggcgcccgtgcatgatcgtcgacagattaatcgacgatgtttctctctcttggtactctctctccgccacgtaggtataaaatccaacgtaagcttactattaaccggtaatttcaagttattgtacttgcccttacactcacttcgtgttgggtagtttggtttgattgcaatcggagtgagtgcaacaattcacagcttgctgggtgtaatgtgtgtacggtgtgcaatcaggggggctgtgtggagtagaaccaaagtccaagttgtgttgagagagaactgaatggaacagacaaattaagagatgggggtgcaggatcttctcgccaaactgaacattggatggtccgattttatcacggaatttgtgcaaagctattgccaattacagtgcattattttgtgaagggactgatgaacaaaatgattgtatgttgtctacacgttgaaacatttaaagagtaaaaaaggagagttcggcatgaccgtggacatgattaatatccacaccgtgcnccctnctcnnngtgngtngcagntgactaacgttttcccaccacg

SEQ ID NO: 94859 - DNA, 2328 bp, Oryza sativa
acactagcagttgagttgtacctggtgttctaaataactacctacgttctttcctaatattcattattcctattttataagagtcgcacgtttcttacagatccccagaagatccggatgcaattttctgcccaatttgcagcaaactcctgtcgaattcagaatctcctatcttttcctgcagctctagaactttctatgattgcgacaaatttgtcggattagacaatgagccctacatacaagaagttcaattctgtaaaggaaaaagatagggatggcatattcatttcttcaagtcttgcaatgctgacttgagagtatttacaggactgcatttaatgcaaaaaggaggtaacttgcaagcatgttgacttcctaaccagcaagacacctttaaatttcaagcaatcggttgattaaatggagaaataggaagaaccatacatggctgcttgcctctgcctctataagcttctgaagcaaaccatccgtttcctgcacatagtgttaggcaatgctctaatttgtggaacaccttgaagcatagtgtacttaacaatctgattatctaattttatggtttcccaccataagtagtcatgattaaaagtttcgaacataatttgtagagttctgtaattgtgtgaaaaaaataagctataaccatgacgatgctctaagtttacctctgtaccccagccatcaacaacaaacacatcgagacaaaagccatctgatggtgagaacacatgagcttcacggatgttcaacccaatatcagacagtatcgcggatagctgtaaaacaatatcttacagttcaagcggcgacacaagaaggtgtggcattcgcatggaggtccctaaacagaaatcacaaagcacatggccttgccttactgaggagccttggccttgccatggaaaaaaaaataatttcatgaacaccgacgaattcgagtcccttctgcaaaattaagagaatggttatggacaaatcatgtaaaaaatgattaaagatgatcgctcaggcaaactaagagaatggttcacgaaaagaaagcatataatacatgagtgctaaactagtctggatatcagaaagaagtccatataaaaagaataggcaaagaagacgttactaatcatttcaaagaattatatgagaactgttgtgcaccgatgtagagagcaaaggctcatatccacaaaactcaacaattcaaacaaggctgattagagcaactagcctgattgcatataactgcagtaacaccaactatttttttttgcggggagcagtaacaccaactataaaggttgctcttaagtatcatgacggaagctttgtaccaaagaggaacacagtgttgttttatggacagaacaacctttcagtcaagttagcacccttctggaaacataatctatgtttatacaaatgaaatggaaatttcgcattcttgcagtttttagatcgaaccagatggttgaaacctgaaactgacgttccggattaattgattgttattatggtatagatatgtcattcgcacagcacaacagcttagtaacaaaaataccttgcagaactggcttcgaagtcatccacaccttttcctctctctagactcaggtcttccatcatcctttcatatggctcggattctgtgaattcatcatctctgtccaatattcacaggcacaatcgatgttaacacgaaagatatactgataagttggcttgatatttacagaagaagaagcatttttgtttggacaaagagataccattccgaacacgaaaagaaaggtacatacactccactgaaatcaactgtgtcctcaactagtaaagtatgtatgtatgtatatatatatatatatataaaagcattggaaagttggtgacctatacctcaaattgatagggagaaagcccccaccattaccgttttcagttggagttgatccagagtctacccctatgtagcgggcatggaagattgggcgcttttcagggtcggcgcagtcggcgagaatcctccggtgcagcagcacttgctctgccttgctgacatccagatcgatcaaatagctgcacaggcaagaagattgcactttgaaaggcgagaaaagcaaaacaactgagagacaggcgagaagcatcgtatgtgtactacctttcgggcaagcgaaggaagtggcggtcgagctcaacgcggaaggaggaagggttggagatggcctcctcgttgcgaatcgccaccaggcgctcgtagatgacgttcctaatgtcaggggacccgtgcacgctaccgccgcc

SEQ ID NO: 94860 - DNA, 1927 bp, Oryza sativa
aggcgtacgtgtacgtgtgaggatggtgagcagaggcagcagcaacttgaggaagacgaagaagtttgtgaaggcggcgtgtccggtgtccggtgtcgccgtctcataggtgatctacacggccatgcacgtgcgtccgactgtccaagctaagctttgtagtacgtacgtgccatgtctaactggtgttcgatcgttgtaggcggctcgggatcacgacggaggtggtggcgcgagcgaagacgtggtgcgcggcgtacgcgacgtacgatggcgtccaacacggcgcgttcgctgttccaggggcgggccggatcaagtcctggtgcaccccgtgcatcggcactgggcgcgtgtctctcgcgcgctgcgcgttacagctaccgccgcagcggcctacgcggcgctatttcccgcggcacgctgtccccgccgacctcacggcgctcctcgcacacgagctcacccgtggcatgcatgaacctcgccgttgaatgtagccccggcgccgtcgttcgccatgctcagcgtgtacgacgcgacgtacgccacgcgctcccttagcttccgcttcggcgcgcggcgcgcgcgctgccgctcctccgggcgtccctcgccgcagcgcgcgtgcccgaccgccacgcaccgtacgtggcaccctctccgtccccgacgtcttccgcgctagctcccgtgcagacgtgcagtggcagataaaaaaaaaacagagatgtctaaacaaactagataaaactacaatcctctctctcatccatctatagtaaaaaaaaatttagcaggggcttcatggactcttgtggtcttcacgctagtagtggagtcagggctcgacaccccaccgctccaatattggatatgcacttgctcctaggcacctcgagtagtgtcgtcgctgcaacctggggcgaggcactgccctcaagtagagatggcaacgggtgcatatccatcgggttcccctgccccatacccacacccacgatgtcaaaatattcccacttaaatacccacacccgtcgcgggtacaaaatcgtccccatacccacatccatacaggtaacgggtacccatacccatataattgatttgtagcatttatagttttgtattctaattagccatattagagttgtaaaccattaatattttccctagcaacaatgctattaatattagtgttcaaaggcgagtaaaaaaaattatacaaccacattacataatcaagaaatcaaataataatttcatataactagtctataacaatacttaagatgtgaaaggagttttatgctatgatttagtagtcgttgagacttatattgctaatagttttaggcttaatcaacgaatttttttacccatgggttggtgggtacgggtgggtaaagaacatacccatacccacgtactcaataggtaagagttttcgcccgttagtagacccatgggtataagagttaaaatacgattagcttctagtagaataaaaacctgtcgggtcttgggttatgggtccccattgccatctctaccctcaagtctgcccgcttctctccatgtcacggcgccaccatgtggaccgaccagccgaggctgttggggaggtcgcctgcacgctgcccaaccttacctaccgaattgcacccacctcttactaggacactcctctcatttcatctagctctctaccgttgcaatgtacgaatattttttctagtttatactaagttataaaaatgagggatagattgttaccgagggacgcaatctaaaactcgagccttatagaagggaccaaaagtaaacctttttcgtgttcaaaagtccaggcgcccaagcggcctgcctcgtagagggttttgggccgagaagctaatgttcgggctgagcagaatatttgataagg

SEQ ID NO: 94861 - DNA, 3133 bp, Oryza sativa
ctactttcttaataattgtgtttaatcctaaaatttcttatgttctgggacggagatagtagcatgtatgaacagtatgaagtactacaatgtaaatattttgcctgaaacatgctttgttttttttcatgccaaataattcagtgtgatatttggtaattcatacagtattccttccttttatacccactctagtttcaaatacttgtcactagttactacttactactagcttttttccctaaaaaagttactagctttttagctttgatcactcgccctttttgcaaaaatgaaacatatgtatacttaaaatatgttgcattagcgatgtgtgttccataaatacaaccagacaactttcactaataataacttaatctttaaaagttattaatggttaaaggtgaaacattatggttaacattgacaagtaaataaagatggaaggaatacatattttctaaagataggtacggtcctacaggctttgtccagcaaaaaaaaaaggacagttctgcagaacaaaaatattttggtggagtttttaaacattgcatccaacagaagccttatggtatattttttttctatgataagagaatttattctggttttttacttaaaagaagctgcaaccaattattatagaatttgcagaatgaatagctgcggattacaaaattatgaaacacaaagtagaaaactactaagaataccacccttaaaacaaagatctacatctatggttagtcagaggggagtagattctaatccctcgaggggatatcccttcgtatatctttttcttccaaattcgatgcaaatagttgtgaaaaattctgaaaaaaattgacaacgtagagtataatgatacctactagtccaccaaaattcatgttcaaattcgatctacacatcgagaaacaaaaaagacaaatttagatataaacagtacgttactattcatacgctgaatttgtcttttttatatctcgacgtgggagttgagtttggacttaagattttgtgaagttgtatatatgtgttgtatgaatgttgtcaaatttttccagaatttttcataaccgtttagatggtttttgagcaaacgagcgaacatcccctcgagggattagaatagtttcccttagtcagagtatgtttaacgttgtttgctccaatggttataagttgtacagtctctgaaaccagcagccgatctttgtcgatcgaatttcgatcccatcactgccgatgaactgacattgaaccaaaacggaagaagccttatggtatgggtggagaatgaaaataggaaagagacaggaaacatctttattcctaaactagtactccctccgtcccataatataagggattttagaggtatgtgatgtttcctcggactacgaatctagatcacatccctctaaaatcccttatattatgggatggagagagtaacaattaataggaaatgacacaacaggatagcagaaactgaaaacttcctttcattttctggggaaaaaaggggaaatttgacgtttggagctcatctgtagtggagatttaactgttccaaaagtttagaatagtggcagctatgttgatacagcactatgttatcttttctcagcagacgtgctggtaaaaaaaatttagtgcgaagggaccattgctagttggcccttacttttatattactgtaactgatccagaattaaatttctacctattttctttgaaagagcacgaaagcacatatcaataattttggtaatattattcatttatcataatctattttgctatacgctccgaccactgcacaatgacagtatttatttcgcagagaggccaacaggagctataaaatgatgttccgattgctgttaattacctggaaactgtactgtactgggcgagtgatgaaggtaggatggaagcgccaagctgctgtgaacaactgagggaaaattcaggtgtaatttcctctctagtctctagaattacaaggcaaggtatatatttttaacgtttttgtttatgaatagaagatgagctatgcttagattatggattgtatagtacccgcccattgaggctgggctgggtcctccagaatatatacccctgcatgtgtcactgacatcatttggtcgacatgatagaaatatttgggagcaaaccctagtaagtgcactcatagtagggtataactaatactctatttgtataaactataaagaaatgcaagtaccacccgctaactgaattagtaattgctataaggagttctcacgtttatttagccacgtgatcatcaaactgagccatccattggacagaagtgtctgtgagatatcaatggttagtatatgattgtcagtaaaggggttctatcaacgtaactatatacaggatgtgatgatctctagccacctgtaaatatgttttgcaaaatactgtactcctaattaaagggagttagctgttgtagcattcaagtcactggtggagaaaccatctttggtcggtcggccgaaatccacaatagtctcggttccactaaaaaccgggactaaagatcatctttagtcccggttgatggctacagcgggcatatttgatctttagtcccggttggtgttatcaaccgggactaaaaataatctttagtcccggttctaaacctatcaggccttgtcaggccccccgggatctttagtcctggttggtgttaccaaccgggactaaaaataggctctttagtcccggttggtgttaataaccgggactaaagatcccgaggatagcgcacgcaccagcccacgcttctctctctgaaccttgtgcatgcgcagcctctctctccacccttatctctttttattttccttccttatcttcatcctctccatccttctccttccatcctccccttctcttctctcaccccctctcctcctccccttgcagaggcagccggcggcggcgggatggaggccgggcgcaggctagcggcggcgggatggaggtcgggcatgggctggcggcgggcggccggtggcggcgggatgaaggccgggcgcgggctagggctggcggcgggatggcggccgagcgc

SEQ ID NO: 94862 - DNA, 1548 bp, Oryza sativa
  unsure (1)..(1548): unsure at all n locations
catgaaactttgctggtgtctagtttttggtgttgtgtttggcccaagtagggtgccttgctgcctaatttattatgacctctcttttgttgtgctcctcaacaggtagagtagccaatctctgctccatattttctcttgatgcattgccatttcacctaactaggcatatgcaaaattcacacaccctgattgtgtggactgcacatactttgggagctctggaaattcagtccgttgcattttatatctatgaataataaacaatctcaacacaagaatccacaaattttgacaatttgactctttgcaaaaactaattttacaaaaaaactgtgaccaaaacttatttaaaaatgactcttttgttcagcgcaaaatcgtatggtgctgaattaaacacctcagcgctaaatagcatggcgttgaatgcatgttggcacgccgactcagcctctcatccatggtggcacggccctcagcatcaattgatgtggcgctaaggtgtctaaattcagcgccatacgatttggtgctgaacaaaaggtcatttctgaaataagttttggccgcggtttatttgtaaaattagttttttacaaaggatcaaattgtcaaaatttgtgagaaatcagagggggtggggctaatacgcgaactttcgcgggccgcgatcacagatcagatcacaaattcactttatcgtttagtatcattaccttatgtctctaactctatgcttacgtgcttaattatctgcagaatttgcaagcaactgcatgcacgcatcttgcggctagagatcagaactggagtagcatgcaaccatgcataccgccattaattagcatgtactcacaaactctaaacacaaatttaaactttatacgtacaaacttttgatatggaaactttatatatatacttttcacatggaaactctatatataaaaactttcgatatacaaaatttatacacagatgaatttcaaaatgaaattaaaataaattcaaaaaataaaaactattaaatttcaatttgagccaaaactaggctaaatataaagtagtagactgggtacacattaagaattcccataaatcttcatagtcttatgcgtgcattgtgcagcaaacaacaacaaaaatcacatacttgattagtcctaaaaatcggtgattaaaaaaataaaaactaattacgtttagctatacaaggaaagccactgcatgcattcgaggctccagctgtacgtacgcgttagccttctcagtctttgcatatcaacctgtccgagctgatcgcgaattagagttaacgcgaacgttcgcgtattaggtatttagcgtcggtggcgtctctcctaaccttcgttgagaaatcaataatccacgcgccatttcattggtagcagatctctccttcctcctctgacctctctctccatcgcgcagatccagcaccgccatggccgccgcctcccctcccctcctncccaccaccggcctccccgccaacgccaccgccaccgnctcccccgcccccac

SEQ ID NO: 94863 - DNA, 667 bp, Oryza sativa
ggatctttgcacttgagcttgcatacgagtatatgacacttatgatgttaatgaatactcaacaaacatatacatatctttcatatgcaaccggttggtcaccaagtggaggatgccaactgatttgttgggactaatgttttcctttgagccgtgcaaaggaatagatctaattgcgatgaggctaatgaatgacaccatgggttaatggtcagcaagccaaggacatcgtcatgttggcaagaatgaagtcaagcttgtgatgagaataaagtcttgacaaaggatgacaaagaccttggcataaacatggttcaaccgaatggtcacaagtgttgatgttggctcaagcattaaccccaagttggatcgcacaaggcaaaggtataatggagctaagaatgttttcttagtctttttcccggtcttggtgtttggtgtagaccggatttactagataggtgccgtactatcaagaggggtctatgaagcgagcatgcggatgattttgtgccatattagttcatatgcatataggtgcattttgtgggcttgtctagccaagtgtggtgagttttatcaagtcccaaacaaagagagaagtgggcacatcctataggtttgggaagccacatgtggttatgtctggtggagtatcctttggagt

SEQ ID NO: 94864 - DNA, 6977 bp, Oryza sativa
  unsure (1)..(6977): unsure at all n locations
ctacaagtgccatgttaataatataacgtattccctccgtttcatcatattttaaattttaaagtcgtttgaccaaattatttaggtttgatcaaaattaaaaaaaaactagcaatatccataataccaaattagtttcattatatttaacattaaataaattttggttcaatgtttgtttaatattaaaaatattactatatttctctaaaaacttgatcaaacttaaagaatttttactaaaaaaaagttaaataacttgtaatatgaaatggggggagtactatattacgaaccgagcatagtttaactggttaagttaaatttcttatgatgaaacctatccacctaggttaatggtgcgaactgaacgtaccttaactggttggatttcttgtggtgaaacctatactcatatttttttagtggtatttgacataccgtaatgaggcgtctatgatgagttcgtcgatattaaggtaccaagacctagtatttggagatgctcataggaatatggtatatgtttatagagattagtgtacacatgtgtatatgattgtctgtgagatatgctatgttttaaaaaataatatactatctgttgagtcaatctatccgtggttaattggatctatgccattataattttgtcgaattgtaaatattactactatttacgaaattggctaactgttattagtattttgtaagaatttaaaccatgccattatattcgtctcggacgacatagttggaccagttttttacaaaccgtattttcaaatatactaaaatacctccagccggatgatgagcgggacccatctgttagacctacctttaacctcaagcattttatcatgtgtgtggtataggcaagtgatggcggggtcggtggcaggcaagttatggcggcccgatcgacattggagcttgccggccggtggctactacaaccggcgggagactaaatctagctattgcaaccggcctcttcgatcgagctcctgaccctccgccagcctaggccgagtttagttctaaagtttgaacccctggaaacatcacaacatcaaacttttttacacacacaaactttcaattttttcatcacacatcattttaattttaattgaacttttaattttaaggtgaaactaaacacacccctactcaaagcacgtgtggaattaagtttgttgtggccgacggctgggcaggagctcaacaaaatcgtgacccgccactagcctcctcaagctcctagcgggcggcccaatcattgtaaactgatcttgattcaggccaagtttagttctagaatttttcttcaaacttccaacttttccatcacatcaaagctttcctacacataaacttccaacttttctgtcacatcgttccgatttcaaccaaacttttaattttagcgtgaactaaacacaccgtgagctcttgcttcgtcaagctcctgtcccgctgctggccacaacgaacttccacgtgcgctggtcgccgcttcatgagctcccgtacaccggtgcacgtacgccttggcctcatcctgctcccaacaagcagttggccttgccgaactagaggaagggttgaggttaaagatgtgtcgacccagtcccactaatattatcctatatgagttagggataatattggtttacaaaaaatacgatatgcaaaaaaaattgatctaattgtgtccaaggcataaataataccacggtttaattttaagaaaaaagtaaatagcacttagccgattttataaataacagtgatgtttttataattggatagagttacaatggatggttcacgttaacccatgcatctatctatgtgagcagaccgatcacatgctctactcgtagacaagctgcagctgctgacttgctaccagtacaatttaccgtactactatgtagttactctctctataaaaaaaccaatctagattaagatactatctcttctactctccgtcacaaagtataataaatttgaatagataaagacatatccaaatttattcgtaccagaaaccattatattctgtcatgattttttatgggacgaagggagtagtatttagcactagtagctatgaattcgtagcttcgccgccgttctagctaggaattgaattgaagttggagtcagtatgttcactttgatgctatttttaaccatactattttttttagcaaagttaccataaaaaatatctacgtttagtttgttattaaatttgatcaatacataagaaatcctatcaaaattttggtaatattaccatcttgttaaaattttagtattatcaaaacttgataagatttattttagctccaatctaaaacatgcccgagatattgtgtcgggttggggttgggcaccaaatggaatccggccaccacatctcgcggttgcacgcatgcatggtgcgctgccaccgaatggcagatatgggatattttgggatgaaacgagacgagacgatcgagggttagggatatctcgtggtaacgtacgtgcatgtggtgaacagaaaaattcaggctgatgaaaccaggagataaatatgtgcactagcatgtagtactaccagcaggggtcacgggttccaaaagaaactgggatatgattggtgagtttggactcgtttgtctgaggaacacaagtctgcctttgttacttccatcgtctctagatataactatcttagtatttaacgtatctcatcgtagaagtataaatctagatcatggtactaaaatatatcttattcaatcttatgttgatatattgtgagacgaaaagagtagatatttcgatgatattgttttgatgcacacgaaattcaagcattttttaactgatcaggtgtaggagaagaagaatgcaagtaattcgaaatctgatcgatgaaataattgaatgagagtcatttcgcttaattttattctttgcttaaaattatagaatacttatatttataaacgaagaaagtaagtgataagaaaatatggagcgtatgtattacacaatctgatttttttatggaattgcacaagtatatggagtaggaaggataaatgctttcacttcgattcatcacgtcgaaagagagtgcaatgaaacagtactgcatcagttagaacgaggcattgtgtggtctgacatgagcatgttcccatctgcgttcaagatcttgttcactagtctcaaatatcataataactatattatttgtaactatgaataaggcacccttctttctcgcaaaaaaaaactcccattacatttccttataaaaaaaaagcttagttcggcccatggaaaaacctttttagttagtttcaaaagtaccttttgcagattatatgtgttttattgactctaacgatattcattaagttataaataccccatgtgctagtggaaattgttccacaaaatttgaaagctgtctactaaattctaaaatcaaaacttatttaatcctcccggacagctgaaattacatttgaatttttaacatttataatttactagaaaaaaatacccgtgcgttgtaatagataaatgctattttaattttattattgttatatagtttagctacggtaaaatccaccgtaggaatttgcatgaatattttttcaaaaaatcatgagctgcaattaagagtccgtatttcatcttaagttagcatgcgagtttttttaaaagatttcttatacaactccttttatacttccaaaaagaaacaagcttaaaatccaacttatggatctgtatttcaaaaaacgagcaaacttaacaaccgaatcaaatatgtatgacgtaccaaaacaacagaaaaacattttcaatttttataatactagagactaataaaaatctaaaaatgaatttctgttgcatattgaatctaaataaatgagaaaattcataaataaagttatttcaagcataaaaatatttactttcatataaggtagaattattttctgtaggccaattattcttatatagcttgaaaaataatttaggttgtacacaccgtgtagagtaagtgatactcataatattttaacaattttctgatgtctctataatttttgaaaattgaaaagttttttcagtctcgagtcacaatgtctccgctacccaaaaccactttgaatctggtcaaggatggaaagtgaatggtatggaataatgtttaaacattgttctgtggaataaagcttaacgatgaattctagatttttaatggaagttcataaatggataatttagcaaaagagggaaagaagggaagaaagtccaagccgagttactccctccgtctctaaacatctgacgccgttaacctttttaagcatatttgaccattcgccttattcaaaaattttaagtaattattaatttttttatcatttgattcattattaaatatatttttatgtatatatatagttttacatatttcacagaagtttttaataagacgaacggtcaaacatgtttaaaaaaattaacggcatcaaatatctagagaatattacattacgtcgcctgcaggaatcgattagcgaagacacggtccgagccggtctgcttcagagaagttgagatcgatcgtgttcccagctgctgtacacacctgctagtgctactggaagctctgttcttgtcgtctctatctagctagtcaaaaagtttgccaaaaaacttaacagatcgatcgatctatgcatctgcaaattgagtgcacatcgctgtagctagccgtgagatcgatcgatcgatcgatcatgaacatgccaagtctcaacgtacgacgactctcgaacgtacgcgtgctgaccgcgttgccacctagcagaaaggtgagcaccatgggcagaggtcgctctcacactactgatggagcagcagcctcgatcggcggcgtcgatggcggcggcgaaggccatccaactgcttgatcacacaagaaagggggtgagatcgccgtcgtcgtcctctcatccggccagctttagctgccttcgatcggtttggttggggagaggcggnnnnnnnnnnnnnnnnnnnnnctttatttcccggcgatggctactgcagattgcgcgcgccttttacggatgtgttacatatattattctgtttgaaaggcgatcaaaatgggggcgcgtgttagggtttggtgtgagtgctttgccttttctttttcttcgattacatggcatacacatacacacgtaatagcacacactcacacatccacaaatatacatggtttgaaatttcggcacccaccggcaaggtcaaaatctctccgaaattttcgagttttgccaaacatttgtaaatttggtcaaaacatgtaaaaattcaaaaaatttggccaaaaaattccgatttcggtgattttggttcttttggtccccatggacaaaaacacaagttccgaaattgcaaaccctgcaaatatattctccaacattatgcagggacataaaccaacaacacatcttttatctcattaaaaatatctgattgaaaatttacctatatatatatttaatattcgtgagcactggaatttgaaagccatatactcacacgactctactgccgtattaccgtatcactggtgtttccatagtgctttaccttttctgttcgccagatggatggatggattgtccagcacgtattggcatttggctagggtgaatagtcgttcgcgtgagcacactatctttctctttggtaacttttggacataagacatttgactattcgtattttaacattcttattattaaagttcccttatgtgcgacttatattttgtatacaattacatcctatatttttaacaaagacaaatagtcaaacaattaatattcagaagtcaagcattaatattttcaaaataaagagagcgatttattgcgtgttaatatcaaggtcttaaatcttcggctatagatgtttgagaagagttctagctatttgcttatatgtactccctccgttcctaaatatttgtcgccgttgactttttaaacatgtttgaccgttcgtcttatttaaaaacttttgtgaaatatgtaaaactatatgtatgcataaaagtatatttaacaataaatcaaatgatggggaaaaattaataattacttaaattttttgaataaggcaaacggttaaatatgtttaaaaaagtcaacggcgtcaaatatttaaggacagagggagtacaatttagccgttatagcttcatttagcccgctatagctgtttgagaagatcaactctaaatgtcttagcccgctatttaaaacattggttaatatacacttaacgaacatataaccagtggtaaatatgctggcatcataattaattatgtgtgtaaacgtgagtatcagaaatttaaattctcacgattgagacgagagcttactcatattctacgtactgtcacgccgatgatgcttccctatttctgtctattccttttactagccaaaaacttgtgtgttgcaacggattattcaaaatagaaaaagaatatcgcatacgtccttgttgaaaaaaaatattagcttctacttgatgcaaacaatactttttgtctgaaaaagcaaaaagaaaaatgccattgctagattttttgtacaaatcgatgattgtatatatgtgttaacgatatcccattttcatattattataaaatatgtacttgtcaataaattgtgttgtctatctcattttaaactgcaataaaaacctaaaaagtttgtaagttttttaaatcatgatggcaagaaaattaaaaaaactgtattgtagcaagagcagctaatgactccataccagcacatgataaagctgactgagcactcacaagttatatcgatactatgggccacatg

SEQ ID NO: 94865 - DNA, 1462 bp, Oryza sativa
agggttcacggccttgtttaataatattgtgtagctctaggatcgtctttataaaataactttgggcaactaagtgacttttaaatgctgtttactgcaaaacctaacccctatattattatctccttgtacccccttgcattaatcatgcatctgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgtttgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaaatggataaaacctaaggacatattttataaataaaactatttgtgaaagttccttttttctccttcccctaatgctatttgcaaaatgtttactccgttcttccttcttcggattttcaactagtactagatggtcaggtcagtgaagaagaggacatcgtcagttgtttgccgaagctccagaagactgcaggatctgctagtgaagtggaggaagcagtgaagccagctgtgaagcaggagtgaagatcttggagaacccgtcgcagaacctaagccaccctctagggtagagtcgttagtcgtgtgtttccttgtttgtgtgtgtagcgcgtggtttgcatcagtggggtgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtggcagtggtccaacacctgattaaccagaacaaattgcttatagagatactacagcagcatcggatgccaattttgaacccgagtcagatgcaacctcaagtgcagttggaggcagtccaagcactcacaccacaagtcagcgcaccgccaacatcccagaaggcccctcatgccatgccacatgttgacccaaaagaagcaagtatcatctgttttatgtgtgatgagcaagggcactacgcaaggaactgtcctcagcagaaaagaaaagcaccaatgcgaaccgaagatgaagtccgtaagatgatcattaccagcacagaatggcct

SEQ ID NO: 94866 - DNA, 1672 bp, Oryza sativa
ctatgcttgcaatgcatatttgttctagaataatataattgcacttgtacttggagtatattttgttggcagagattaatacataaatggagaagaaacgaggaaaactcactcctaagcaagcttaaggataagatgtgcccacaagtcaggtgtaaccgtcctggaaaccgccataaggacccacctgtcagtgaccctgccaaatctggaggcctactgggccggccctggttcggccgaaccagaaccctggtcacgccgactccggctagcctgacattaacaaatatttagctatcacattgagtgtctagtagatgttacataggccaccgtccatgtttagcaatatgagtaaactgcagatggtaagattagataagattatccaccatacttttcatttcactaatatataacaaaactgtacatatgtttacgataagccttatatttggatactattaatcattggattacttttgcttatttatttcagttgtgttgtctatataaccatcgtaaaacaaagaagaaacacaagccaaagcttcatacaaagcaatcacacaaatgggcaagcagatgccgaactgtagccgtggacttctgcttctgttgttggcccttctaggctgttttagcattcttggccacgtgtatggtaatctactatctaatattgaatctcaatggtgaatccaaggtttattttgatttcacaattattcaattcttctgtggtaatcacgatgtattaaagaaacatatctttcatagtaaaatttgtgtttccaattttcttctggacatccatcttcacatatccatgtattgcatacggtttttctttatctttcatgctttcctagtaaaatattttttatttttcaggtaataatctggattacaccaggagtgccaccatgaatgaaggacgcaacaatgtcaatataaatggtttggtacccgtaccatgcaacattttctgcccatcgaaggtctgttgtagaaatgtatgctaccctagcttgcaagcctgtgaggcaaattgcaagccaattgtttgatcagcttatcaagcctgtaattgtaaagaattgataataatattgtccgttgttcaccaatcaagagaatgatcaatctcctcatagatgaacatggtttgtccttttgtttaggggaaaagtataactgtcttattgatacataactggagatggccacaggagaatcacgagaataagcgcaagaaatagtatcgtatagtccatatggcatgtatgcatgtttgatcgtagtactcgtttacagaataaagtaggcactgtttttgcaagtgcggtccgctagattaaatttagttttgaggataaatcgaaaataccttttcatggcacccaaacgaagccaggaatcaatgggcaaccttttcaacttgggtctgcgtggcaggccaaattggaaccttttgtattgtatcatcattttttactgtgcgcatgtccttcgtttttttttaccatagtatgcacatccttcgttcttaagcacaataatattatcacaagcaatccttcccccctgaattatcacaggagtttatttatagttgtacccctttaaagaaatcatgatattgtaaccttaagaacgaaacagcctg

SEQ ID NO: 94867 - DNA, 4775 bp, Oryza sativa
taatgaggaaatacatgcggattagtaactcagtgtaatgtataacttggtagctactgccaatcagctccaagtgcacacgcatacaccaaccattacaactcaagcatgcaaattatgggttcaaaatgcataggcaattcagtctagagaatgacaagggcgcgttactttgccgaaacccgaccacgcctctgtgatcggagctcctccaggacggagtcgacgaggccatggacctggcgtccccggcatccgccgtacagggagaagtgccagccggcgcgagcggagtccgggcggacggcgcggccgaggggacggaggcggaagaaggcgagcgtcgccgccgccgccgtggagcagccacccgccgcccgcaccgccatgggcgacggcctcatcgaacccgccgccacgaagctgccgccggggaggagagggtttttggcgataagagcctcccgcgagtggaaggcgaggattcaacggtgcatcgagaggttagcaagagggacaaaaatcccacgaccgcaatatgagccgccggtttcgtgtgctggtcccattatggaataagttcaccagagggtacctcaacttaacagcaaaattattttgagatcccttaaccacaacaccagaaatatgtacccctaaattcactcaaactgtttaaaggaggtcccatggaagtatatatgggtggtttcactgacgtggcatcctaggctgtgttcgttacttctggatgggagcaaatccctcccacatagaaaacggggcggtacattaacacgtgattaattaagtattagcaaattatttttttcaaaaatggatcaatgtgattttttaagcaactttcgtatagaaactttttgcaaaaaacacaccgtttagtagtttgaaaagcgtgcgtacaaaatatgagggagagaggttgggaacctaggttgccgaacacactcctagtcatccaaaaatattaaaaaaaatacgggggcccacatgtcagccatcctctcctctgactttgatgcctcgtcttttaaacctcctatatattctgctttgggacctcttttgaactatttgagtgactctaggtgtacacatttctggttttgtggttaatggacctcaaaaaatctcgttgtcaagttgagagacctgcaatgaacttattccgttagcttctggaagattcgtgattgggcctcaacgggaaagactggctgattgggccatatgtgggccgtcactggtaacatttgaatttgctgcgggaattctagcttgtgtatcgagggtgtgactcgtttgttatacgatctactgcccagattttcctagaaattgaagtgctctacaaaatggctgtaaagttcaaacgaaaattcactaatcttgatgtaatgtgattgaaaaggtccgaattgagttttataccacagtacagagacaaatgcaaaccattggatcctcagggctccatcggtcctgaacctgaactgtggtcaatgctgtaaatttgttcattaattaagtttatgttttccaatgtcaggattaactttcatgtttcagctctcgagctccttgggttccttctaatggcacatgtccccaatagcctcatcggttattcggttaatataatcaagagctgattatatggcacacagctttattagtgattgaaaaataatttaaaaattttatatatatgtgtttttaacgacttaaaaataaatgttaaaagagatattatattaaaaataccataaaatcaattttaaattttaagttttaactgtagctgaatttatttatttggtaaacgatgaggcttcttttgggtggcagccagagcaccgaatcaatctgggatccatggccgttattagcaattaatttgcatccacgggatctggacaacacgtagaccttctagaagataaacatgtgctacgacagctacgtactgtcattgcaaggacgaagacgctttgtgtgtcccctaccgccctgtcagagaattgctatacagaacttgcaatgcgcgaaggctgtaatgcacaatctaaagtagtgaaagaactctaaagataatttcaaacgaagctgcttgattcataaatttgactataaagataattaccaagtgactcaatgaagtgtgcaattaacagtactgttgacgctctttcagcatagcagtataatagtattatctccgtcccaaaataattgtaactctaaattatttagcgtatattaaggtttgagaaagaaaaaagtattgtactctaaatgatgtataggatatagcgaaagaataattatgtagaatactaggaagaaaattaaatgagaagtgattgataggacaattagtactttattgtgacatttattttaggataaatttaaataatagtagaaatacagttaccatgaataagagtgtacaattgagactaattcagttaatcatttttttataaagaaagctttattaatcttagacaattatatcaaagtgatacaattactctaaaatcaattatgacttctgcatagctagaatgcacgctgcctacaataaaaaaataaataaattgcttcaaaattaaaaaggatgacatgacagcaaatattatatcgcagcaaactgcacccaaaagtactttaagctcacgtcgagataatttaggtgcctagtttattctcagtaaaaagttgtcttttttcttttcaaatttggtcctatttggctggggaatagtgtattaccacctccgtaaaaaaaatacaattctaacaatacacctagtattaagggaaaattaatgatgtcataattaaagaacagtgcgaatgcaactgatgtccttgtattatgtcatcaaggcaacatgtcatggtcaaacccaactcttctcccaaactgatcaagaaaattttcgttatctgctcgagctacgtgccccggacaactccgagaccgaagctgcaggaaagccaagtcaaaggcgacatctccaagccccatctaacctcgctcgtggtcaatatgctactttctgctatccccaggaaaaaaaaattgcaaagcaaagcacccttaaagcttggggcatacgagtacactgcaccgggacgctgtttggtgcgcctaattaaacaattcttacatggctgcttagcccacaagacagtcggcggtcagctgacggtcagtgattagcgattaattatatagaacgggtttgtgctttgttagtgcgatgtttcatggatgcatagaaaatagaaatgattgtttaaatcaaggcagtttcttcactcacagtctcacacctgcatgcaaggacctgcagcaaccatggtaccaaactaccaggaaggtgcttaggcttcttccaccacaagataacgaaacacatgcaacgaaattattgagactaacctgatcaggtttcactgtttgtttcaggacactggcaccaacgctttattagcaacatactttatcattactggatcgccaattagcgtttagcgatgacagcatgatctgaagcaggtagatcagaaacattaatttatgttttggataacgtgataattaaacagatccgaaagtacaaacaacgagtgcacttgtacgctgtcacagcatcagaacttcacaggaagtcaagaagaacagagcgctatatgaccagatttttctgacttctgacggcgaccgtagttgcatgcatgatcgaccagtccttgctggattatggacattgagcatgtcatttcgtacgtgctgtagtatacagtatactcgtgtggtctacagagtatatcagttcgattgagatcgatggatatatcagagagatcaagacttaaaaccgcagctagcaaagtctggtttcccggccagctagctgatcaaactaaatgacgacatcaactaaaattaagtgacgtttttctgatggctgatgcatggcgttatatataaaatatactcagtgggcacatgacagactaataattatataaattaaagaggaattttcaaaggcgtgcagtttttctcgtgttaaaattgctgacagtgaagtgttgacggtttgtatcggaccacgtattttacaacaaacttctacggtaacagctagagctagctgtccatgtagatatccaactagccaataagcgccgtgtgtcaattatctgaattataccctatttgtcgtggcatacatggagtgatctgaccaaaaaaaatgccgaaagctagggtgtgtttagttcacaccaaaattagaagtttgattgaaattagaacgatgtgatgaaaaagttgaaagtttgtgtgtgtagaaaagttttgatgtgatggaaaattagaagttcgaagaaaaagtttgaaactaaactcagccctagtagtattaattagctagctttgtctactactccttctgtctcaaaacaaaaaaatgtagagttatatgatacatattttaaaattacatacacatttatagttctagcatatgtcatattcagttaaaggtttttatattttaaagagtaaattacactttggttcatgttttattacctaagttgcacattaggctaggcattagcaaaacttttcactttagacaagattttatcaccaaattttgcaagttggaccagtggcccacgcgttaaccactgatgtcttcttcctcaatcctcaatcccctacgtgc

SEQ ID NO: 94868 - DNA, 3011 bp, Oryza sativa
ctaatgtgtgacgggggagattgttgggaatagtcccacattgaaagtttaaggggagtggcaccaacttaaaaggggaggggtccctcacctcatgagctagcttttggtataaattccatagaagtattaattactcgacatgccattgtcaggaatttttccagaattctaacagcagattattcgttgattctgaatcggacagacaaaatgtaaagaagttgtattccctgacaatggtaaagcaacacttctattcaagcaaccgaagagggtcatccgaatattattatgattgaagaaaaaagcaaatgttacaagaaagttttacatacaaaacaacactttttctctcgcaagtttgaactgaattgctgcagcaactctgcgtgtcgcgactcagcgtatgcattgcttgattccaaatgatccattcaatgccatgttcatgtcagcatagtgtacagatgctgttaggtcggccatagtactctacgcagtacacataatcatatacataggcttgtcttcttcctcctccgtaatatatacaatacgccgatgaattttgtttcttttgttttcaatgacagcgccatgcatgcagtcggtgtcttcagtgcctcggtatattattttactgacttatctgaattctgcagatatgctatcagcacggattttactacaatttgggtccaggggacgccagattcgccagccaaacgtcgccatcgaaatccaggagcatggtgcattgtactgctcgatgtccaattaagtcgttttcctcctcatctcccttgtcagcatgtattgtgatcttaattttctcctttgctctatctgttgcaagctttccgaatattgactgatctaggcggtgcgtttctgccgcttggatattgcaatatccaattttgcattagttcgtataaagattcagaaattagatattcatcttgcggtacgttttacaataatcgttagatttcattttcctatcttactacctccgtcccataacataaaagtttttttttttttgcccttatagttatataggcaaaatctcttatattatgggacagattacttaataatcgaaaatcataagacataggtaaacacatgttattgccgatcgattccacccatcgaatcccagatccatgagcgtctcccttcagaaaagctgcgtgttttccattcttcactgcaatagccgtttccttgcatcaaatacaaacatcatatgttctttatatcaatcatgagtttttttttattatttgttataggtaggatcaatggtaacataattagaaagaaatagaatctttgcagaataaaaatcagcccaagtaaacaagaccaaaagaaaacagtgcattctatcttaaacatcatttgtctatccgcagagcgtcttacaaaattactctgcccttctagcgtttgtgttcttataacctccaacactacatagtccttcaattaatccatctagaattgtcttacttcctccgtcctaaaatataaccattttttaggtaggtgcagatattaataaagtaggtagagatgattggagaaatattgcgattggtggagaagagaaagtaggtgtagataatggttgtgattggttgagataaaaggataggtagaaaaataacttcattttggaacaaattactgtgctaaaaatagctacattttgagacggaggtagtacacatctattttaactacgttaatcctcaaatttgactataagggattaggatttcctcaaatatttatttctactatttgtccattcttcttaaacatgaactgcatccaaatttaactatttctatttaaaaaatcaacttcatctgcaccaagcaacacctgcacataaacactagcaaaaccatataccaatcataagtttttttcccaacttgactacaattagaacaataacagtacatgcatcttacatacacaactaagttatcataatgcccaccaaacaacatttaacaaaatcattggcaattatgtaaagaaaaataaaagctctcccacttagcgaaaggaataaaaaacctctaagttaaaacaaacactcccatgcttagcgaaagaaaagaatttatccgccccctcacaaaaatcaaccccttttcaaaaacttgtgcaaacattaaatgtttcgtattgattatccttcagaaaattccttaagtgcacatgagttctgactcaatccattgtatgccattttttttctcatccctgtcatgcccagtgttttttttaatttttatcctctctatacaccttcacttagttgatcgtgcgttgacagttgcttatatgatactatctgaaaaacataaatctcaattccaaatgttttcgtctataataaaatttgaatgggatagaattatttgattccaaatttgaaaacaaaacgttaattttcaaccaagttttagaaaatcattaaatccatacaagagtttcactgagaaactaaaaaccaaaactattttttttagtttaaattttggtgaacaatttgtaaaaattcaaaaaaaattgatctgaatttgtttaaaatttaaaattttatttttaaaatttttggtcaagtaattctgtctctgttttttcacaaatgaatccttgttcatattgagagaattgtgtttttctcaacaatacgaacaggggcaatataagctattttgaaaaaaaaaatattgtggccaactcatggtcaactaacgaaatagttatggaagaggtcaaattgaaagctcaagtgaatgggggatgaggcgaaattcaggacatacaacggattgagccaaaactgatatgcacgtaaggaattttctctttcttggaccatttaatttgtataaatttccacccattaatagtgaaatcatcagggatgctaaagatcactagtgccatcttcttttttctctaaataaaaattc

SEQ ID NO: 94869 - DNA, 2289 bp, Oryza sativa
atatatatatatatataatatgtgcatatgagttttatacattttatacacataaattttgtacctataacttcatgcttgtaaatgacaacgaattgcatatggcccatgtatatgaatgggctacagttcctttcgggccatgtgcatgggtttttttttcccaaaaacatataagcccatttaaaagaatgcacatgagagaaatatcattaccctcgacctgctaaatgggaatgggataggctaagactgaaatagaaatgaccgtcgataaaaaggatttcgtgtgatggtgtgagatgctatgcaccgtggtgatttgtaacatatataccacagagatttggaatggcatggctttatgcacaacaccataagcataagtgatatctaagtagttaaaagaaaatccttatatgagaatgttgggcatgttcactttaccatcactttcaacccaagtaaattttgatagagtaaaaaactaaacactaccttagtaccttaccaatatcatcttagcaaaatttgatggttcccaaactttctaatcataaaaaccctaccaaaattcggtaacctcaaaatttaccaaattgaaattggcaataaagtgaaatgcccgtaaatttaacgactgaaaataaataaacatatcagtcaggagacttgacaaccggtgagcattagtgtaagaagtttattttaaaccccgtaaccatgggtgaaacataacgtggcctctggccacccgggctattgcctaaggccttcgattggaggcccattaggattaagatttttcagtgtatgtaactaccatgcaaggctcagtataaatttgccgtcaaacaataccattttattaagttattaattgcgcagtgttatgaatttgctactcaaatctgccaaacatcttctccaccgctcaaacgtacgtgaatcagaacacatacatatatgtaggcatccttgcgtgatatagctaaatggatcatgcagactgatgactcttctgggaggacaaggcttctatggcagtacccagcggccacgccgactccacgtagcaatccccatacttgacctgtttcacaagcgtcatctccctagttggcttcaaacctgcgaaaccataattccaatttctatgtcaggtgttgttgctgctacttgctagtaacttcagtgtggacgaatttaattcggttgttctttagtacgccaattttgtaaagagtatattaatttttcaaagtgaactaatattgaaatggaaacaagttacttaaagatttgccgcaagttctaataaataattatttatatgatgttttacatgttcaataatgaggcattaggaggcactatacaataatatatatagtttatattgtttgtttatcgagtcctaatatgtcactcctactacacagatgatttattggatgagaaaattataaacagttgattctacttacgattgtaaaacatctctttaattgtttttaactcagattaatatatggtgtgggtgcatagtgcatacattcgtttgtgtaataaaattagattagctctaaatacaactatttttatggttcccgaaaagataccacactgtccgcaaattaaaatattaatttaatctgagttaaaaagatttaaagagatgctttacaatcgtaagtagaatcaactgtttataatttttctatccaataaatcatttctatttatactaccatcctataatctctcaataaaaactgtaaaattatataatatccaactgcttagatagaaataagtttttttacaatataagtattgttccactgattccaacgcacagaacatacattttcacctaatcacggtccttaaggagaatttaaacacttaagatgattgaaaggaaatcttttttccctaacattaatatttgcaaaaaacacttatattctactaccttcgtcccaaaatagccttatttagttcgaggggtaaaaagtgttggcttgccacatcgaatatacagacacacatttaaagtattaaacgtagtctaataacaaaacaaattacgaattccgcctgtaaactgcgagacgaatttatttagcctaattaatccgtcattagcaaatatttactgtagcaccacattgtcaaatcatggcgcaattagtcttaaaagattcgtctcgcaatttacacgcagtctgcgtaattaattttttttctatatttaatactgcatgcatgtgtccaaacattcgt

SEQ ID NO: 94870 - DNA, 3056 bp, Oryza sativa
attcctgcagcccaccaaaatctaaactttgcgctgaactaaacacaacctatttctgtatttcccctaaaatatcatactgaagatgatcaagcaagcaaccccaatcaccatttgcttctgagttctgaccaccgctcgccgagtcactggtccacctactctccgtatcaaacaccggaccaccgccgcggcgtggtgttcggttaccggtttgcaccggcctccccacgcgagaagccacacgagtccacgagtcgcacccccggcaacacgagaaacggctggatgaaccagcgaaaatccagcccggccacacacgggagagctctagtagcgcgctgagcagccagcgccgccgccagagcgcacatgccgatgctttcccggggccatgcctcgatgccgcgacggatgtgacgctgccatccctcgttgcgtagacgtgcgcgagctgcgagccggtgggttcgttcgcggtggaaaggccacaacccgacgagacggctgccgtgtcgatgacgcgcgcgcgcgtacaaaacgccccagcggtttgcagacgcccgtgccgatctcaccccatccatcggctgggccgcgcggcgcagcccgcgggcgggcggagacaggagggacagctagtcgcgggcgcgcatgtgacggcctacctgaaagcgaccgtgcctggctccgagcgctttcgtgggaggaggcaaagggggcgcagcgcgacacgcatcgaccggctcgggacagctcagtcacacgtctcggcgtacgaactggttgggcgctagagcccgcatggaaaggatgatgagatgatctggaccgtgaggccacgatccgacgggtggatactggcggggagggaaaacagaacggtccagcggtccgtgcacggtggacgggggtccacgatgtgattgagtccctaccgtgtctgttaaacccaagttggctgtactggatactacgcgtcctgcttatccgaaataatttcgacgattgggactcgtcccttcaacagcggtggcaccggcacgtcacgccagcatcatcatcgcgtcacgacctcccccctctctcattttggttttcttttttccggatctttaaattatgtggcgttgggcccaaccgatctagtacatgttacctgcaaaaaataattcgtggtacaggtacccatgattcaactctgcatttgtttacctgcgtcgtacgtccattttgtgctatccaatgttgatcacattattcgcttcacaaggtaggagtaggagtactgtaagtaacttgagtgcgagttaaaatggtcaacctgtacactcactcgccgagttcagctactactccagtaattctcaagtaaaaccattgcccttcatcccgaagcaaccagcacgccttttccgaacccgatcgaccatccgatcagcatccaacggttgagccgcgcctgagccgtcaccatggagtaccagagcagtttcctccacgcaaatctgggatcgccgagcagagctgcgcaaacgcaaacacaacataaaacccttccacaaaatgttgacctgaaaagcagcgcctccttcacatgcacgttgtccgtagcgcgtacatctcacgtacttggctgcatgtattccggccgcaagcgaacaagaacagccgcagaggagcaaagctctgcatttcaacagcgtagtatagtagtactgtagtagtagtatttgcttgtggtcaggagccttccttgaagcaacctccaaggtggcagcattgcaacggacgaattaagatccaactaatctgcccatggctcgtactttaggttactaatcaagcatcattttataaactaattagcctttcctaaataactgtggctggcatgtgggcccggggtggccaaccctggccagcaaccgcacgcgaaatacagcgcaagatctagctttgtccatgtgaagaaagctatgtacgatggtacatttgatatcaattggttcaaggcattgtttagtatggtttgtgttattaattattgcttatttgtttatgcagtggtttgcacccaaagaaatggctgctacgagagctagctagcggccaatccatcgctctctccccatgttacttccccctccaaacatggcgattggatatgcatcgcacactgcccctgatataagaaagagcagtagataatagctatctagataccccctgagaaggcaaagactgcggggctttgacaagttagttagttaatcatgagcagaagaaacttgcaatccaccgttagtagaaagaattcgtttcacatacaccggtttagctatacgtacgtacctacctaccttgtgaataatgcaggcaatgtcactagagatagctagtgttgatcgatcgatcattcacgccccatatcttagtggttgctgcgatcttggtatcgtacaggtacagccacttgacgtacgaatattgcgtctagcacgttattgcctgcgttcatttggctcgattgaattggaacaacgtcccgtgtttgcgcgatcgatcgcgtttttcttgcggcctgcattattaatttccagggggaattcgaacgattccacgctgctcctgcgatttcaatcatggaggttggttcaccctccgtccgcgtacgttgatacgctacttgcgcccgatcatggcgcgtcctcgatctgtttataaaaacgaataaattcgccatcagatgatcgtcgggtgaacggaagtgtagttgaacgcttgatgtgcattgccgtcctaattctggtgggggcagggggggggggggagttcgatctgattatgtctgttaactgacggttaggacttaggactatgatctagtcagttagtttgagatgtttttgatgtatacagtttaaattaaaaattcgtatcaacgacgttcgctcgactgttctatcactacaactatgtgtcatggggagacttgtttcatcatctaaacacgcaaggattcggctcgagagccctgaaaaggacagtaatat

SEQ ID NO: 94871 - DNA, 1728 bp, Oryza sativa
cttacatgtgctgcaaaacctctgaattcaacggtgatgactatgagataagttatagtgagttcatcgtcagatcatggaaatcatgttttaatctgtaaggctgatttttcttttgtcatatatttgctctagtgactctactgtatatatggtgattgaataggctagggtaggctaggcagtgattttccatgcatggtcaatgtagtggttggcaaaaacaattgaattgatggtcaatgtagtggttggcaaaaacaattgaattgatggaattgattttgggataagtaattatataatcaggtgttaattaaacttgttcgataatccatgacatatcatgtaggggctacatgttcaattcaatggcttgtttggatgtgtttggacttaggagtgagttgggatcctgattcatcgcagtccaatcatttggtacattgtccagcacggtaaggacatcttgaaaaactgttgctgctgaaataaagtgttctcttgacttctggtcacctgtagcttttctacagtttgatcaatcactcaatcctttgtactataacacattaacacttaattttacttttgtgatctcgcagtcgctgtaatcttttcctggcataaacatccctattgctactgaaaagagaatttactgtggattaaagttacagcatatagttccataaaatctgtcagctccaccgtttgctcttcactttattagccgcaaccaaaatctaaattctaaaactttcattttgtagttaattttaatgcttttgttatagtttatttttcagtgtcatattttaaaacgctaagaacacatatataataaaaaaaattactcatcagttaattctttttttctcgctaatgagcattatggtttacgattgtggattattttccttgctgtaaatcgaacaattgtcgtcccctcccctataatctgctttgagagcttggtgctctagcctgtcgtttttcctttgtccgctgattgttataattggtactctttaggcctgttcactttgataccattttcaaccatatcattttttttggcaaagttatcaaaaaaatatccatgtttagtttgttgtcaaatttgacaaatacataagaaatcccgcaaaaatttgacatttaccaaaatttggtaaagtttattttggctacaatctaaacaggccctttattccttctaatatatcatgcggaacttctgctgttaattgttttaaaaaaataaattgaataggtggtaacaaatcagtaggtgatgcttttaattacttttacacgaggatactccctccgtactcgtaaaggaaatcgttttggacagcgacacggtcctcaaaacataactttgacttcttgtttctataaaaatatttattgaaaagtgatatatgtatacttttatgaaagtatttttcaagacaaatctattcatataatttttacatttttaaactcaataacttgagaattattcatgatttatattcttgaagtttgacttaaaaattgtcctaaactatacgaagggagtatgatgtgatgtggtggctgctagccgcctcgatctccaacatcatcagcaaattgggccaaagggacatcgcagccgtcagctacatcgaaagctgctatatatacggacaagaacggctgctagcttaagtatccaatccatccatcaatgtg

SEQ ID NO: 94872 - DNA, 1536 bp, Oryza sativa
tcatattattgcaaacattggtatacaagaggtacatgcagagtgtttgggaattaagaaaggggcaactgatcaactcgattgagctacggaaaattcacgcaatcacctatggtatgtgtacatgaagaaaatgcaaaatgcccttgtcgtttctacgaaagctagattgcttggggctcttttgaaacacagaaagtttgtaggattttcacataaataattgagctcagtttctaaataatttgttctaattcctctgtttcaaaggatgcatgccttcacacgaatttactacggggatgtcgtgagtttcctacatttgcacatggagcttaatcgtagatcaatatgaaatgcgggaactatagtcctatcagccgtttaaatcagagaggccactgctaagaaaacaaaaatttcacgaacttctcacataattaagcttaatagaacttccctccaaacacgcctacatcaatatatttcatgcaagccattttttataatccctcagtttcaaaataaatcaacttttgttcatagattgtcaattgatttattttgggatagacatgagtaactgaactcctagtggaaattaaacagaaataacagaatgtacaaccaactacttactctatcccaaataaaccaatctcatacagaatgtgatatattctgtacttactccatcccaaaataatgcagttttgcattattcatgtccaacgtttgaccgttcgtcttatttaaattttttttgtgattagtatttttattgttattagatgataaaacataaatagtactttatgggtgactattttattagttttttcataaatttttcaaataagacgaacggtcaaacgttggacacagatcctcacaactacaattattttgggatggaggtagtataataaatttgaaaagaaagttattttgaaacggaaggagtacaggctaacctagctagttgaccaccactaacttattagtatcacatttactacacggttatgcaaagtcatcgatatatatggtgtgaagtgaagagagctaaggcaatgtatagtacacacagtacaggcacactcgatggttctttgcatatctcccggttggtgaccacacgtacacaactacaccatcctagcttttggccccatctctctacctgtaaacatgagtacacacatgcattcggctcatttatgatttggacctaaagcaagatgatcacagaacgctaagaccctgtttagatgggactaaaacttttaagtccctatcacatcggatgtttagacactaataataaatattaaacgtagaatattaataaaacccatccataatcttggactaattcgcgagacgaatctattgagtctaattaatccatgattagtctatatgatgctacagtaaacattatctaattaagattaattagacttaaaaaatttaacttgtaaattagctttcatttatgtaattagttttgtaagtagtttatatttaatactc

SEQ ID NO: 94873 - DNA, 5018 bp, Oryza sativa
cgggggtggtgtgggtgcttgggtgggtgacgtcagcaggcacggcgcccggcgcaggaggacggcgacttcggtgagtaccacctatactactggctacgagcactagtagcagcagctctcgccctcgcggcgtcccatcgagccatcaaattattgcaatcgcttccctgttcctccccatctcgtccttgtgatccgtgcggtacgtggtgtcgcagcttttgtttaccggacgcggctgggctgaaggcctgaagtaggagtaggagtgtttttttttcccctgagaaaacccagtggggagttgacgggcggagggacggacggggggtggagccgtggaggtgatgtgaaatgtgatcgctgatgcgatgcttcggagacctggtggtggctggtgaatggtggtgatacgtgtaccatgcaggtgtaccgcgcggttggccgggaacgtgtttcggactttcaggtttgagccgttctcttttggaccacaggggttacgaacttcgggtgtttcagtggagagctaaagcctaaaaggcctgtctatctaatttttgagctaagtttgatcaccggtgttacctaaaagaggtactctattcgaccacttgtgtctagcggttagctcattatcatggttagtgcgctatctcatcttttctattctactggcccaacaatcatgcactcatctattactcctacctcatctagatgtagagatagagaaccaaacagaaaaaaaaatggttgacataacttcatagcttcaatgtaagagagtacccaccctccgttccaggcatagctgctcatgttgtttaaactaccatggtggcgcgtgcagattacgtggctaacataattatattttctctcgtataatagcatatatattctctcaattaattattaaaatatattagaaataacgatataattttaaattttatactaacattaccaacctaccgatgtgtaataatcatattacattgtatatacgtaatagttattaattatttttaatatctaattttagttatttctaaattatatttctatatgtactctaaactcgtcttccaatatccttattttttaaaatccggatatttgttatatgtaaattgtatttctatatagactctaggctattctttcaatattatttatttttaattttgattttttattatttataactgtatttatatgtggactctaaactcatctatcaatattctttatttttttatttcgaatttcagttacttctaaattgtattcctatatggactcgtcgtcccttttttaaattttgaattttagttatttgtaaattatatttctatacggactctaaactctacttttaatttattatttttatttcgaattttagttaattctaaattcctactcctatatggactttatactcttctaatattccttttttaattccgagtatttcttaattgtatttttgtatggactctatactcttctttcgatatgtttttttaattccgaatattagttacttctaaaatgtatttctatatggactctaacctaattttaattttctatttttaattctgaatttccattaattctaaattgtatatcggcatgggctctagtcacatcttccaatatttattactatgttttaattccgaatttcgactaattctaaattgtatttctatatggactctgtttttctttttcttcgattaatatgagaatttctagggcgtgagagtgaatatggaggcgcatttttctattactttattaagttaataggttttatccctaaatgtggaaactagtagcaaggatgctaactactccctccgtcctagaataaataaagttcattttcatccatcccgtaaaaaccaatgtagaacaaaaaaaaaagactataataccttcactttatgaaatccctatgcaattattttttatctactcccaatgtacctatacatactttcacaaactctgatgcaatgattgctaaaaaagaatttatttgagataaataggatgtgctaaaaatgaacccattataagatgaagagaatattttaactgtgaattttgaaaagcgaacaacttctttccaagtctaactgtgttagcaaaataattaatcccttcattctaaaatacaaggaattctagggttcagatttcgtattaatatgagcatgtatacaccagttttcatgatttccatcactcaataattctatagccaattagatgcttgataagtaaattcaaaattcaaaaaaatgacaactagagtgacttaaaaaagaaatctgttgaacttaccttagtacttactaaacaacctaaaaatcattatactccctcctttaacaaaagttacacatgttatttttgtcaccaagaccaaggataaattaacttatcttgcatgtaacaaagaacaagaaatgtatgcacgcatacaaccaatgagtatgaagatggcttctcgggttctgatcaaacatttaatttatctctccacttaagtctgcaatgcatagagattacaaacagaacaacttatttggaaactcaaatataaaatagatctaactcttgtggaaggagtgagtactatatgacatcactacgagagaagtttattaatgaacattgcatacgcctttagttcttttatatttatttttgcctctaccaatgagttaactgttttgtaaaactagataaacctcgtgcgttgctatgggagttctgtataataatagtgtaaataacatttaatatagctagacaatatcactttatatactttataaaattttcatttgtgatcggccatgaaaaaagttataaataattatgatgatgacgtggttataacagtttaaatcatatatataggatgatcaatcaaaagcaaaactacgatgatacatcttaataacataagagaaatgaaaagataatatagattaattatccaaagacaaatttaagtaatatatgattccgtaggtgaaggaaaagagggaaataatttagaccatagattaatcatctaatagctaaaaacaattaaggtggtatggcttaattagataatagagagataactttaactgtatttattgataatgaattttaggattcgtatatatgaaaatactatggaattctttcgttccaaatggacgactttaacttttatcggtgatacgtgactaaacgtgatgaaaaaacacaacacgtacaccggaaaacaaaacgtagtagattaacttgtgtcatcctgcttgcttagcatcgatcctttgcttcccttttctctttagattgagttgctttcctttgtttcttcttttactccaacataaaacagacgttagatatcgttcgatcctttacagagccggccgctttgtttggcacatgtggcaagcttctttattccggaaatggtcgtgaaataggtttttgggtgccattctttaatcatcaacacgtacttcgtatctttgtccgcctcttttctggctcacatgtgcaagcgagaacacaaacaaatatggcttatacagttcaagcttttccgagacgaaataccactacacagtacacgtcttggacggcatacaatgcgtgtgctagacaccgatccaacaacatccagagctactgcaccacaaagtccacgacgaatcctctttcggcaccgatctcccatatgctgtgctccaaagttgcccagaacaagttctctcctgaagcagtggctttgggaagtactatacgcgccatgcagatctttttgttaccatgcgaaatctgcgagacatttgcaagatccacaacgccgctggggcccccggggttctacgcccttgtgtcgtgtgttctaactaatgcagcatactaagctgcttgcctgcagttttgctgttaaatttgacccgctcttttcttattcacttacctatgttatttcatatttttgttagcacatttttaaactgctaaatgatttatttcgtatgtaaaatttttatatcggagttattttaaaatatcagctagatatttttttaagtttataataattaaaactcaaataattatgtgctaataatttttatgctttccgtgtcctaactttatttggatcttcagtaaaacaaacatcatctttgatcgcatttttatgaacactctactactagcagatatgacaaatgtctctgagtataacccatgtgacacacacggtcacggtgatatgtgaatcgaataataacaaggtgattagtactccgtagtcagcaacgcagtggttgctagtacgcgataagaggaagctcacgaggagagataaggatcacgaattttactaatacacaaacgcacggacatgaggaaaatgcatcgaaatgattgggagaatcttgtcctggtccgatgagtggattaaagaaccagctttccgtcctgtcgtggaatctcatggtgattgagttctcatcctacgctcggcgagaccacagcctaaaaagaggcctattggacgctgtacattttgacagcaaagctcgggaaaccggcgaaagtgtgaagctggaaacgctagaaatgaaagccctaaatactagtagtactgcaccatggagttgagtactttggctaaagatgagtgtttgtcatgatcccatcgatggctttggaagaatccaaaggcaaagccgtccgacgcggggcaagaatcagcaacgaacgagtagcgtccagggggatgaaaacggccacatgctacgggtggtttcgcccattacgaggctcgttcgttcgtgctcgcgccatggcgcggtgtcgcgttgtcggatgatcagcgagccggggctgccgttgtgatcggctggatttctctgcgattgcaactgaccgagccatccgtccattgtcttttgtctccattccat

SEQ ID NO: 94874 - DNA, 5772 bp, Oryza sativa
attcctgcagcccccctcgcgtccgcgcgcgcgcgctcgcgcatggccgaccgcccggtcgccgccgcgtcggccctgccgcgcctgcgccgcccggccccgctgccctgcctgagccgctccacgcgaaacatgtgagttacagttactgctgcctctatcgttgtggttggttgaattgtgctcttaccaggtctgtgttagagcaagttcaatagtatagtcaactactagttccaatttatttatagttaatctaatagctcatttatacaatagttacatactacactattaatatctggtcccacctatcatacacacactgcgctttggagtttgtgctacaactggctacaaatctgtagcccgctgctcttaattacatgaatattgcgtctgtagtaaattaaaggtcataaataatgtccgtgtggattaaattcgtgatcgcgcgcacgtacggtcgtgtgcgtgcagatcgatcgatctgggtgtgatacagtgtacacctacagcgcgtaagttaacgtcctacgtccatggccgtgtggctgccggccggccggccatcgatagcagcatgcatgcacagcacgtcgcaagacaacgtgtgcgcgcgcgctataagctacaggaccacaaggatcgacgaattaatgctagcttcggctgtacggaaccccctgtttcgatcgatctacctagccgcccgcaatggttatatatagattctctagaagatatccatgtcagcatatttttctatttgaaaaagattaaatgaagagaaagagagtaaagctatctactaacttggagatagtctatagagaaaaacgaggcaatagatgagagagctatagatacccatgtagacatactattgaggtggtttactattaatctagtatattgctgagatgtacatgttttatagagagcaccttactttaccattgcgggtgctcttagtgcaatcccaaccctccacctagaatgatatttatggcattaaatacattgtcacgtaggacttttaacttatgtggcactatattaattaagaaagagagtgaagaaaggaagaaactggatctcatgcaagacacagcttcaacacaagaacctatgcactagacactatcaagttttgcattgggagagaataatgtcttcataatagatgaagaataaatatgattggtagagaagagaggtgacgtatttattaatgtcccactttaagaaaccatgggttgtagagtgtagtttctattgtgatgtcttattgacatggcaccatagacactgcttatggacactatgggttgggactgcccttaggccctgtttagtccgccaaaaactttcgcaaaaacatcacatcgaatctttggacatatgtatggagtattaaatatagataaaaagagaaactaattgcacagtttacatgtaaatcgcgagatgaatcttttgagtataattagttcataattagccataagtgttacattaacccacatgtgctaatgacggcttaattaggctcaacagattcgtctcgcggtttccaggcgagttataaaattagtttttttattcgtgtccgaaaacccttccgatattcggtcaaacgtccgatgtgacacccaaatatttttatttcaccaactaaacaggccctcatgccccgtttagatcccaaatttttttcccaaaaacgtcacatcgaatctttggacacatacatggagcattaaatatagataaaaacaaaaactaattacacagtttgtatggaaatcgcaagacgaatcttttgagcctaattagttcatgattagccataagtgctacagtaacccacatgtactaatgacggattatctagactcaaaagatttgtctcgcggttccaggcaaattatgaaattaggttttttattcgtgtccaaaaacctcttccgatatccggtcaaacgtccgatgtgccatctaaaaatttcttttcacgaactaaacaagccttacaacgatgcacatgaacatatatagctagatctatgtgtatactctacgtacgtagtacaattcaattctctgatctatatttattacgacctgtttgtgcatgtatctttgtgctatttgttacgacggcaattgacaggtcatgtatgtgtacgtgcccgcgtgcatctatgaacgatctctctctgctatagctcgtactatatgctctacatagttggcagtttggcaccaaaaactaaacaacgtcgtccgacggtacgtagcacaataaaataacgcacgtaacgcgagtacttgtacgacatatagatgtgtgatgcatggtgtgcatgtccgataacaatgaggactgaacgcatatatatagcttggacatgctctcgatcgatcgtctcgagaaagtgggtacatcccttctttctatataaagttaagactaaaagctcaaacctcatgctttcacgtcatcatcaaattatgaaccgttggatgaatgcaatagatcgtttctcagacgttggatggaatgtagcatagagcccaacccattagtcaccgggtgagtctcttcgcctcctcagtgtcaaatgtagctcacataaacacattggcccatctccacacacatctacatgtatctagcccgtcaatccgtataaaagagctttgtggctgaacgccccttcagttgacatgtgctacctaatttatctataaattttgaatatgactgctaaaaagaatttctccaagaaagctattagtttcttcttgagattgtaccttctatttaacaaattgatgtaaaccaaatcccgtggcaaacgcgcggggcatcctctagtactgtcaagagtttcagagcctcaacatcgatcaataaatggaattgaaagggacaattaaaacaggcaagaaacggaagaatgaattgcatgccttaattttcttgtccatcgcatatgcatggtaatctcatgcatctattgcgactatgcgcaaaaatgtactgcatatgctctttcttttatacaattaaccaacacgaaagtgtccattttacgtacgcagctcggcaggcattgcatacatccgatccaaacgtacatgcactgatgcacgccggccgcatgctttcctaggctgatcgatgtgctctactatgcagcacgcacatggatggtgagctaccaaagctagctaaagttatttctagctctgtccctaagtcaccctgttcccgcactacacatgataccagcagtactcaacactgtttacttgggtcatggttaaaaaaactaatccatgcatcgaaccggtccatgcgcgcattgcgtacgtgcgtgggctagctgttgcagctattgcgctgctggacatttttaggcagcgaattcaagtgctagtactactagaagtacgcgtacactagttacccactatccggcaagtactagcccgatcaaatttaagtcgaacaagacgaatgttctggcctgcatgcagcagtgcagtagtaggcagtagccaactggcaaaatgtgcgtacgctggcttcttcaattcggttcatccgcccgtccgccgcccaatcgccgatgcgtgtacgtgcgacgaggcggacgcgcgcgcgcacgcacgcacgcccgcccgaccggcgccgtcgcgcgtggctgggcgcgcggtgcattgcgtttgcgtcggtgtgtcgcgcgcgtgcatgcggtgctcgggatcggttgcgtcttgcgtggttgcctcgcaatgtcatcgagagcttcgatgcaagcgtggtttcttttctgaattccatgcacgcgatggtcgcactgctgcgcttgttgccacggctgttcgcctcagttgtaaaaagggagaaaaaaagggactatccgaaaaaccactacaagttttttaaggaagaactttcaactctaactacagtataattgtaatataattccactatagctaattataactataatactatctccgttttatattataagactttttacctttgtctacatttatatagatattaatgaatttagatataatatttatgtctagatatattaacatccctgtgaatgtgtgcaatgctagaaagtcttataatatgaaacaaatgaagtataagttatatataagtattaaaataatactacctccgttttttaatagatgatgctgttgactttttctcacatgtttgaccattcgtcttattcaaaaattttatataaatgtataagatataaatgacacttaaagtactatgagtgataaaacaactcataacaaaataaattacaattacgtaaagtttttaaataagacgaatggttaaacatgtgagaaaaggtcaatgtcatcatttattaaaaaacggagggagtatatataaggaacgcgttagggagggagctcaggaggatatgcgaatagataacaaaagtcaatagcttcaagcagttgttgggatggagtcatggagattaattttctcggaccacttccagttgctcatagctaggttcgttcgttgactttgtgaaatttttaccttcttcctgtgcactctgagaggcagggtttaactttccaatttcaaagtaaaaactgctcctcggttttgccaaaatccgatcgaaaatcggtaaaaaccgatgactttcaattaacaccatacgaaaactgactaataccaatccttttcacaaaagtcgaccggttttcgcgaaattccagcggtattgcgaatcctgctagtgagaggcaatggagccgccattgcagacgaagatggagcaggcaagcaagatacgagggaaaacaaaaagattattctctccatacttttcgagcaccaaattccaccctacttactcccaattctgcacacatcaaccatgttactctccatgctttggcataatatgctcccggccggtcatctttccatgttgcatcgacgtcatactcactcgaacgatgtcgacactggctcttggagaaaggaacgacatatcacatatgtctatgatattctatcccttcatcaaaccaacaggtatacaagattatcactagctagcactgcaccatggctagagcccaatttcgctctcagctagcttggattgtctgatggcgacggaagatatttttttgccatgctcaagagatctagtcggccgatgatcaaaacgatgaaagccaccaaggcacaaaactcgatcatcatggctgtcaaaatatgcctgacgcactcgctggcatatgcatctcatccaggattagatagttgtttcagatatgattgcacaatatcctttaaatccagtcgatatgttatagcgattctgaatgacctctaccgtacttgttgtgcatgcactgaaagaactgaaactaaaatatgcaagcatgaaaaaatcgcaatcatgaaaggatcaagcatcaagtcacacaaatctgaaactgaaactaatttcgaagcgagagagattgagggagagaaaagagaagctggagaagccataataccacttgcaggtgggtctcaaaagggtttttatttttatttttgtatatagggccacatagatgccatgtcagcattaattgaccccattaactcgccacgtgagataaaaccgttattcaaactgctcaggaactggttttgatggttagaggatgctctgtagggatgcaaat

SEQ ID NO: 94875 - DNA, 1167 bp, Oryza sativa
acacatctccatcctagcgccgccctctatgcccgccgtgctcctcatctccatcgttgcctcctccgtgacgacatatgctgccgccaccactgtcacggaagaatccggcgagggaagacccgaaccgcggaggccgccgccgacatctccccgcccgcgaccaccatcagcgagagtggctccccgccgaggccgccgccgacatctccccttccgcggccaccgttagcgagagcggctccccgtcgaggccgccgccgatatctccccgcccacggccgacaaggaggaggagagtggctcccggcccttggcgccgccgttcttgtcgccagcttgctccggtcatcggcgtcgtccgctccggctcagccgcttgtccttcttcgctgacaaaaagagagagagagcggataaccggatagattatggatatgaagctgacatgtgggtcccactgttttaattatttttcagggatcaaattaccacgtaagcgccacgtcaataccacgtatgacgaagacctagtcaaagaagccacgtcgacgccacctcatttaaacggtttcgtaagttgggggaccagttgtacccggttttgcgaccaagggacgaaaatcggactgggcgacaaatagagggacccaatgtgaacttatcccttgtcataacgagccagctcactagctaaacgaggtcaagtcaaaaggcagtccaacaaaaatatttagaggctcagcccaactaggcaccaggtataaatgcaaacaaattaaccttagatccctatccccccgttatctcgatcccagtgttgcactctcgctcccccccatctcgcatcgagcctccgacgctcccaacgccgtctcgacctcccccatcacgcctcgtgccgccgccagcagggtcatcgccggccgttggctgccctccgcactggatttttcacattttggtccttttaaaaaacttatttcgcaaatagacccctaaaaaaacttatcccagaaatggtcctttttgggccgccagagtggctggtgccgtcgtccaacgggacggcgccagcctctctggcgccgtcctcttgccaccgtggtacacgcgaaccgacgtggcaggaggagggcgccaaaatggttggcaccgccctaggga

SEQ ID NO: 94876 - DNA, 1157 bp, Oryza sativa
atgtcatgtttttcttggcaggtcaaacaccactgttcctgtcttcaattcatgggagagctgctgctacaagatatcttctcgatcatggttccaatcctgcgattgataaaatagtgttacctcttcatggtgctgcagtgaaaggtctctctgtctctttctcacacaccgcaaacacagagtccaacatatatttttgaacaatatatttgatacatatgcaagtgaattctttcttcacttagattcacctttattttcttctaatatttctgtcaatatttgaactattgtttgtacttaaaacttaatggataaacacagggccagtagccagatgaaaccagataaaattttcccttgtgtgcaaggttgtttcgggagaggcactccttgtgatacatatttactggtcactatattatagtcatgactctggatttttgttatttcgtgaaaaacttcgcaacaagttctcacaactattcaactaaatggcaaattgcacgtagagactaagtccttgcatcagtattttgtcactagtaagtttgttttgtagtttgttactctctccgtcccaaaataagttaatttagtacgggatatgacatatcctagtactatgaatctggacaggcacacatcccgtactaggttaacttattttgggatggagggagtacttaaaattgttgacgaatatagaattctgacaatgacacagtcttgaatgatgcttctctcttgggtgtttgcatggctctgattctcatttgattgatgatttggatgaaaaagaaacaactacatgtttctggacaacaactttagttcctatacttcgttattgttgtcctgattataagcatatttgctgttaatatgttgaattttgttcaagctaagctttttagataataaaattatgaaaacttaaaatccaatttttactgttatccaacagactccttttgaaaacataactgttccgaatcactattaataattgtttctaggctgttcctgattgagctgaaccttgttccaagtccattttcaacatatatctaccaatgaagacctctatacctatgataaacattgttttctagtttgttcttgttagtaatgtataaattattcttttgcag

SEQ ID NO: 94877 - DNA, 2074 bp, Oryza sativa
tgactctggatttctgtcattttgtggaaacaattgctacaagttctcacaactaatggcaaattgcacatagagactaactccttgcatcagtcttttgtcattagtaagtttttttttcatagtttgttactaaaaattgttgacaaatatagaattctgacaaaggcatgaagtcttgaacaatgcttctctcttgggtgattgcttggctctgattcacattttattgatgatttggatgaaaaagaaacaactaaaagtttctggacaacaacttttgttcctacacttcattattattgtcctttattataagcatatttgctgttaatatgttgaattttgctcaagccaagctttagatattaaatttatgaaaacttaaatccaaattttattgttttccaacagactgctgttgaaggaaactctgttcctgtccaggaatcactgttaacactgtttctagggtgttcctgattgagctgaaccttttgttcttattaattatttagaaattcttcttttgcaggacactgcgaaatagtagagttgtttctttcaagaggagttgatgtggatttagattctatcactgggaccccattgctgacagctgcgatgaatggccaatatagcacgatgaagattttattggagcatcacgctgatgtaagacatcaattttttttgttgctccctcatctgtgcaaaagaaatgcctgacttgttaagcttttaaggatagtatcactgatttcagaccatgacacattagaattaataattgaaataattttcctccagcacctatgccccatcttttttttaattgtcaaacacacatctttattactcaattggctcagtggaatcatgagccaccaggcaatttacttactccgggaggggatcagtccaaacaacagactgacccgggtcccatcttaccgcaatttgagctagttcataagcagaagtattacaagaccgaggagcataggtgaaatctactttggcaaattcgctgaataagctgttggtctggagcaatgcacacaactaatgttggattataattggttctctcaatgcgcaacatcctcactttctcaggagtgctataaatgcaatttatttcctgtataagcacaccatgtactgatattaattttctttttttcccttttatttaaacaatttcaagatcttgattattccactttcgcagcctaacagggttgtcaatcataatggtaccccattgattatgtccatagtttctggatcattggaatgcgtgaagctattaatcaaagtcagttacctttttcttgatgttgatattcatgtttgtaaattgtagtaggctagtagcaccttgtttattttccttttcgtttcttggtggatgacaactgagatcaaacaacaatttcatttacacaggttggtgctgatgtgaattttagagatcccaatggtgttacttgtgtgatggtcgcagcaaatcatggctctcctgtcatcatgaagtgcttactagatgctggtgctaattcaaatattccagatgaagtgagtaatattctttcctctatagcctgtgactggatgttgttgcattaggctgtagtgatcttgagagattaggataatctgctcacttattctttttatcaagtgcgcaccaatggataagtctgcatcagaagaagacaaagacatatggctttagtgaagcatacttcatagtatgtgacacatgatggaaccattgcttccatgctgctttataggaatgcaattgttgagtgctcacattccactccaaagggtggatataagttttgattttcactactgtctgagcctgtttggcgatgcttaatacagggaatgatgagaaaatactaaggtttacggtttaccaatgtctgagtggagaaatatttaggtcccctataactgatcgaacaaactaatgtcctattctggatagccctttggctgggtaccctttgaaccttcatcctatcctgttgtgacaaatatcagtatgatataaaaa

SEQ ID NO: 94878 - DNA, 2193 bp, Oryza sativa
gggccttttttttgtctgccgccgtgtgatggataaatgatttaagttatttatatatattattatacggctggtcagtgttggagaaatttattacttctttccaaaacaaattaaccaaatataaaatgtttaaattcataatattatgatgtatcgcatctcatatttaattggtttattgtaagatagagggaatactattaggtacgcttgatcatgtggtgtgtgccttgcattcatatgaatactactctcttcgtcccttaatataagagattttgacattttagttacactgtttgactacgtcttatttaaaaaatttgtgcaaatataaaaagcgaaaagttgtgcttaaagtactttggataataaaataagtcacaaataaattaaataataattccaaaatttttttgaataggacaaatggtcaaacagtgtaagcaaaatatcaaaatcccttatattaagggacggagagaatagtattcatatcaaatggaccaaatacaggcagctgatagatatagggatatgctacacaaagacaagctcaatgtttgtgtggtgtgatgtaatcttaggagtgagcccataaatagtgggataatgttaaagcaattcgcacaatgctattgctatggctaggatttaagtaaccataagatagggccacatgagatagaaaaaaaaatacttcagctcttgtttatgaggtgaatgagagagataaaaatattttaattttgtttgtgatagaccttaagtataatgtgcaccataaactaatgctacttaccacaatatatgtgacttattttataagtgtaattattattttaagattatatttttcataaattattattgttgtgctaacgccatatcgatcaaaaaaagtgagcagaggggaatatgcatgatatatagcatatcacgggtatgattttgactgctagctgctgctgtatggtactacctccgtcccatataaattataattctagatggttgcatatattaaggattgagaaaaaaaactataatcgatgctccttattaaatgttctatatatagataaaagtggaggggtagttgagggtaaaatagagataaatttgaatgagaagtgattaatgagaccattaatactatattgtgataattattttgggacaaatttaaatcctagaaatataactattataggacagatagtaactagcactctttttaaaactaattaatatgggtgttaaatgctgcgtgcatcttggaatgcgttatatataggagtatactactagtagcttgtgtgcctataaatataatcgtatgtcatatttaaccatattaattgtgatatatattatcacgattgcatgcatggtcaatataattcttttatttattaattaatgtaagagtttctggcatttagagtaaacgcgatgttacctttattttactatgtttataatatatatagtccagtatatatatgtgatacattggttgacaaacttagtattacttaaaaaaagatgacatcaatagcagtttatttcacgtacggtagatcaatgcggcgtacgttgctagacaaaactagtgcgtaaaaagtttcgagcacacgcagtcataataatgcagtaatgcagatgaccaaggtgaatggggtagtgcatgcatatatacacttggtcaactctgtcgtatacagtagtagacatgtaaagtactaaactttattcgggctcgtcatcgatatatcgtcatactaacatatgaactacgaatctgaatagcctgtacagattcataggtctagtgtatcacatccttacctaggtgtaagggtgcaagcgggcaggcttgcaaacccgcttatataccttttacctaggtgcacttattttgaggtgaaccatccattttataataatataattattgtatttttttattataaacccaaaaggttacaattgcattggccgaaatgtcctaatccattataatttaatatgattatttaatagttgataaggatgaattaatttcaaaaagcgaatattcaaggtttggatgagcttcacacttcaaaatttgggcagaccagtccaaacataattttttttttactgacaaggggactacatcctcccatctataagaaaagacgc

SEQ ID NO: 94879 - DNA, 838 bp, Oryza sativa
ctgcgccccaatgggctcatctaggcatgttcgtcttaataggtacatttatttcactaaaaaaatcttcagagttgatttgatggaaaaatatatatttcccccagctttggcgtattcagaatcaagtaaacaactaaaattttgtaccactaagaccaacgattccaaatcttccgttagtaatcatatgcaatcattttttattgttgataccaacaaaaaaatatttgcctacatggctgattctgctagcctgggcatccaaactggtttctgcttcttagccaacttgatccaaaaaagcatttgcctcaagaaacaaattatatccaaaacatttctaccatcaagtttcatctaaaacagaggaataattagactttgtaccaaagcaccggctagtacattactactatcatctgctagttctagatttggattcaacacaagaaaaaaataacctctaaggtggctatctgacctgaccaattcacacggaagacgacaactaattatctatcctaacaaaaaggaaaatccagcaaaacagaaaataaccccaagatttgcagaatgcaagcaaaaaaacctctctattctcacccaaaaaaaaagaaacatccgcaagcaaaagaaacggccacatctggttgctgctctccatgacacaaagctctccaaaaatctcgaatttttctcgctctgaaccaaacagaaaaaaaatgcagacgttttccccaactaattcaccaaccactaactcacaacaaaacagaattaactttcctctaaatctacgagccacgacttcagctcaagcactcaccaaacaaaa

SEQ ID NO: 94880 - DNA, 931 bp, Oryza sativa
ttgttgaacttaatttaggttttctatatattcattcttaacttttggatagtaagaaattaattctaaaagtattaattaccctaaaaaattactccatccattcttaaataaagcatttctttatactccctcattccatttatatatgacattggttagtaaaaatttaaactaaccaaagtttcatataaatggaagaagggagtatgttctttaacaaagattaaggataaggaaaaaaatatttcatctcaatcacttcatttgccaaatattgaatggctatgataattccatcgtaagcatatgattgtcgcttaaaatgcttagtttcctgtggattgtaatcggtgtcatagaaacacggaggggttatgtgctattttctttatctatactccttaattagtggtggtggtaaatggtgaatctaccattatttgtactaccaactcgatacatttttggggataaagaataatgtggggtctagtataagggcttacacgtcaatcaaccttatcaccaactctttatttttttctttaagaaggaaaaaggattgtgggggctagtgggcccagagagatcacatttaagtaacaaatatatatatatatataaactaaaagataatatttatacaaattaatggtactgacgggttaatgatatttttttaataaaatcctgttacatatggttgtaattgtacaggtaatattatatatatatatatatatatatatatatatatatatatatatatatatatatatatatatatatatatatataaatggttgcatatgtaataccttcaaagaatcatgtctactatctttacattaaatgtaattctttatattttaactttatgctaaccgtacatattggcgtctctacatatataaccatccatgcatgc

SEQ ID NO: 94881 - DNA, 1498 bp, Oryza sativa
tctcccaaacaccctctatataggactagctctctctagaaaactagagtaaactagtacttcctccgtttcatattataaaatttttagtattatctatattcgtatagatactaatgtgtatatggcaatgaaaaagtctaataactaaaacggaggtagtaccatgtttgctgcgcatccatctgacttcgatagtgtccctgtggctagagaaaatccttttctgcacctacaaggggcgcattggagatacgtatcctatacgccggggttcatcaggtcttcgtctcctggggaaaaaaatatttactacggtatggatttttttttttacaaccaaagggattagaatagtacgcgtcaagattgactgagttggattttgaactttcctgggaatcgaggtggatattttgaacgggatcgaacgggagagcatattgttgttccgtccacagatactgtacgtatatactggtatcgccaggcacgtcatagaaatttctgcaagcgtatatatttggatgtggatattactgaaagcgccaaaatccagagtttgaaatttactcggaccaacttatttcctctatataccgtaggttcaagtgtaatattgaggggccttagtgtgaccatgtatgctcagtttataatcgacatctctctatatctttaaaaaagctattctaaatgaggatttaacactagctataacaacgaagctgtaatatcctacgtgatgttaaatccctacctagctcggttatttttttagagagaggatagtgttagcatgccaggcctggtcgatagtgatagcattggtttttaagatttgtctgaattgaagcttaaattttgtcgtttgtggatgttcgggagttcatgctgtggtattttgtgccgcacaacctattaatttcgctgcagcaaccgataaaccgcattgttggtttgtagtaacgccactgttggagccgaagctcctctagcagggtgaagtggcagcccctttgaggtattcagccagggagcgaatgaatagaaatgaggctattggcgtcacgcaaatgaacaagggttgcaaaagatgatggtttagacaatgttttttttggaacagatcaacttgcattgattcggcttttgggagagaaagccgaaaggattacaggaacaaagtcttacacaaaacgaaaagaaacacaacacattacattactgctgggtatatccagctttccagatacagcacactgcaggaacaacacccaaatagaacccttttggactggggacaaactagatacaagcaaaacaacttagatagatgatggtagatgttgtggttttagttgaaccagtttccctagcccagcttcatgccaccctcccaagattactcttttttccttttttaacagcacgctccacttttgagagaaagacagagctttgtaggccacctgcaagggtgatttcaccaagatat

SEQ ID NO: 94882 - DNA, 2062 bp, Oryza sativa
ccgaccgtccaaagatgatttctccaccagtggaagcttttcgcgctagctgtcacttagtttgctaagaagaacctgtaaatttttgttattcaccaaagctagctcttcttttaagggcgatagctgtgttcttttccggtgagtttttataaaaaaaatatatgatgcgtttttataaaaagtttctatgtagaagttgtttaaaaaattcaaataaatccatttttagttttataatattagtacttaattaattatgtgctaatgagttttcacgttttgtgtgcgctaaaatctctctgtcaactgagagatcgatcagagccttataatatgaatcagatggactacgcagctaatttgttgaattaagaaagtactttcatacagtatcagttaaagtttagttttttgaacttaccaaaaattaagtacaccttataaaagtgaacaggagaagccgtgcattcatatttatatctttcttgcctcctgttctatgcacgatctgcctttctacttcatccattgcaggaaaccaactatcacgccatgcaagcaaggattgatttgcttccaaaatcctccatctgtctatctatctgccaaatgagacaatacacatgctctgtatgaggcattggtcctgttctgcaacatgtacacgtcgtccaggagcacttcatgttacataagttcatttgggaacgagtggcattggaaaacaaacacactgcacatttagactctctcgtactgttgtcaaaccaatgctgaagccacaacccaacaactttgggttgttggctgaagccctaggctcatcgtcagtggcggatgcaggatttcgaagttgggtattcaaaaatttacacggtgaatttgttttttaaaaaatatggttaatatcatcaatgcaaatactatttcttaattagaaaagttataaactatagaaaaatattgaatgaaaacatttatcttgttgggttaacatgattttgaaatataatggatgtatgcttaaaaaatattgtgagcttatggaagaaaaatccaaaaacaggattgaataatcgggaaaaaacgagaaggaagctaggaatcgaacctagcacctgttgattacacttgatgatatggggtatagctattttgtaaaaaaatgggtattcttctgaatacccatgaacgttgtggcgtccgcccctgctcatcgttagcctataatacgttagttgtttgataactttattattaaatttagagttttgcaatacccaatgttaaatgtatagtttaatgattaatttatttctaaatatgtagtttttgtaatatacaactttaaatttatatagttttatggttgtttgataaatgtaggtttactaaatttactcatggtttaattttctttctctgacctaaggttattgtttgagttatgtacctccctttcttacttctgaattgactctctataaaaaagaaacttatgagagccacctacctattatgatacttctattattttattcacattccactcctatttataccgatcaccatgcaaggcttgcttcctctgtccatttatccgaggccatttatctggcaaatgaaataacccctgctatctcttcattctattcagtttcctagcatgcacactacacagatcatgtgcgaggattttacatcgagaatgggtggcactgggaaaaaaacagtattgtatattcattcgtatgctgctgcatccagtaatggagccaccatacgggcaaaccctatgtaatggcccagggccatgtggccatcggcagcagggcaaggcagcattccattttcgtcgagatcaatggatcggccacacagagtcgcgcagtggtacactttggccggtcgaatgccctcgccattttctcttgtggatgactttttgtgttcgatcctgctacaaaactatctaggggtaatggcatgcatctcttgggaggctcagaaactttcgcattgtcacatagattttgctacaaaagaattctgttgcatt

SEQ ID NO: 94883 - DNA, 1021 bp, Oryza sativa
aataatcttatcctaaaactcaaatagtgataaatgctaaatctaggtgacgtatattataggacgctagctagtcaataattatatactaagtctaattcccaatataataatcttatattaaaactcaaataatcttagactaaaactcaaatagtcatgtgtgctaagtgtaactgtcgtatattagaaccctacacaatcttatatgctaagtctaattacaaatctaataatcttatactaaaactcaaatagtgataaatgctaagtctaggtgacgtatattataggacgctagctagtcaataattatatactaagtctaattacaaatataataatcttatattaaaactcaaataatcttagactaaaactcaaatagtcatgtgtgctaagtgtaactgtcgtatattagaaccctacacaatcttatatgctaagtctaattacaaatctaataatcttatactaaaactcaaatagtgataaatgctaagtctaggtgacgtatattataggaccctagccagtcaataattatatactaagtctaattacaaatataataatcttatattaaaactcaaataatcttagactaaaactcaaatagtcatgtgtgctaagtgtaactgtcgtatattagaaccctacacaatcttatatgctaagtctaattacaaatctaataatcttatactaaaactcaaatagtgataaatgctaagtctaggtgacgtatattataggaccctagccagtcaataattatatactaagtctaattacaaatataataatcttatattaaaactcaaataatcttagactaaaactcaaatagtcatgtgtgctaagtgtaactgtcgtatattagaaccctacacaatcttatatgctaagtctaattacaaatctaataatcttatactaaaactcaaatagtgataaatgctaagtataggtgacgtatattataggaccctagctagtcaataattatatacggggtcca

SEQ ID NO: 94884 - DNA, 1542 bp, Oryza sativa
caagatgtctcatcttgacttccgcaaaactgctggttcttggatcatatatgagcagtagtcctgtcgatcctaaccatatgagtatcctcccatcatctaataccagcaatggcttacatcgtactcaagaacagggatgaacgattcagtctgaatgctatattctttaacccaggcacgggtctcataatcggttagaaaccataggtccatggttgaacaaaaccgctggtgatgaactaaatagcctttcaactcagccagacaaagttgatgccaaattgagaaatactcctgtggatcaaaatcaccgtcgaatacaaagctgctgctaattggcccctggatgtcttccctccattcctcagtctcaaggtcaaaagaaaagatgaagtctggatgaatgccagctcccagtccactaataatcatagcatcatatagagcatccatcaagaagtacaccaccccattaacgacgacaccgctgttcgccttttgcatctcaacaaagaactgacggctctgttttcccctccaatgtgcatggccttggcctgtgccacccttgactgtaaagacctcacagagctgagggagctcaaggtctgtaaatccgggacggttgaacatccggagcaccttgtactctcccgtggaggcgtgttggtgtaaatatgtattgtaccaaggacctatctgtaaagtgttatgctaatagaatagatgaggaaggggtgagctgagaaggctaaccctagaaaaattccccaaattgaacaatatggtatcagagcgggtcgccggcgactggggaggttgaaccctagctggcgaggtcgcagcggcgcggcgcagcggcgcgggccgaggcgaggttggcgcggcgcgacgacgcacgcgcgaggccagcgtggccgcacgcggcagagacggttggtggccgcggcaggaagcggcgctgtgccggcgcaggacggcagcgctgctaaggcgggacgtggagtgaggaagcgacggtgtcgacggcagggagcaccaacggcgacaacgcgtgcggagggctagctggtgacggcgtgtggcagaggagcaggttgttgctgctgctggtgaggtgttggtgctgctgctacttgagaaggtgaagtgggcgcttggcttgctgttgctgctgtatttgctgctgctgtgctgatttggggaagaaactgagtacttgctgctgtgctgaaaactgagaagtagtgctattgctgctgttctgttttggtgagaaactgaggagtagtgttgttgctcctattagttgatttggctaatatttgatctgccatgggggattgaagtctggtccttgttgtacctctgttaatgtggtaaagaagaagctaagggaagaaaaaaaatgtcttctggggagggaaaggaggttgtggatacttccttgcttgttactaaaggtgatatgaaaggtttgctagaggatttgctgaagatgggcatgataggtcctaggaatgcggctggagtgtctgc

SEQ ID NO: 94885 - DNA, 2098 bp, Oryza sativa
caagatcaaggagaaattaaatcgtcttggatgttacaaaatcaaggagtgaatacaagcatgcaaccaatgagcatttagatgacttcttagttctaattaaacatttaatttatctctttatttaagttttgaatgtataaagactacgaataaaaacaacttatttagaaaaacttaaatgtgaaataggtgtaacttttgtggatggagtgagtacaatcgataaggatctaaggttcaattcagctacttcgtacccactaaaatcaactaattattaaattttcaccagtgtaaacaaatacaacaaccagctgtatcaggcacgttttatttttttctacgaattgaattataccgttccagaattcatgacaaattgacaagtatactagtataagtcacagaacagtccttcacgtacacgtatactcgtcatcgtcttctttcttccttcgctgctaattaatctctctcatgttttctcactttccatctccggagaggagagattatttatttatatttatttatttatcacggtcaaagcatcggggttgtggggcccacacgccctcgtgtcggccgctgcagcggggcccacgcggcagtggcatgagggccaacgcgacgtgcagactggcagtgggccctcgcatgctacgcgcccctcgcaaatatcgcttcgtctctcctgtaaaatttcgtcccgttgcggatttgttttttcttttttttttgcatctagacccctgtaatttgttgttatctctaataactagcctactctagtttaaatactactggctcgttttggttggaagtcttttcttttggtgttgtggtagtagagttctacgagacttgttaaatcgatatcagttatagctcaaatttttccataatttttgcttcgtctcagagacatttattcgtacgaaagaattaaacgtttccgaaaatattttgttaggactagatgtttatagagaggaagcttcacgatacgtaaaccacgaatctccaccataagcttatagggctttagtccccatttgctaaatatattagtaactattaaggaaggtattaaaaaaggaatcaaataaagacttgatgattcgaaagtgttggtgtgttttgattggaataaagcgaacaatgttcaaaggcaaattgttccatccgaatttcatgcaagattaatattcatgacatcccatccctatatagtatttttctctttccttgtgcttttagttcattatcgagctagaatcatattgttctccgttaacctcacatgtacatctcaactccaaatatgttgctcaatcttgcattaatctcatcttctattgagtttatgtagctggctatatgtgagctcataccagtattaccactacagtcactctaaagttgaattccactgtccttccaagtcgatgagttaaaagagtcaaagtatcgcgtaacacaaataatgtgaattgtagcttggccactgacatttcactttgaaccatacttttcctaatctgttttactttagactagctaactttacatttattgtagtttagaccatcttacctttcttctatagctatgtctagtttctatttggaaaacatatggcatgcgcatagatcggggagttcgcccgatgtgccgaaaccaacttgcatgaggttattgatttgctgaataaacaattttatggtgatcaaaactactactagcccaaagtaaaaaaaaaaatcaaacaatgatccgaagtaaaacatcggtaataaaaaggtatcctaaactacaattcacttataaaaatattaccccaaatcattacaatcactaaaaccaagcacttgaagatgaatacgaagtaaaaccatggaaaaccagaaaaaaaagacattagcacataactaattaagtttcaactattacaaactcaaaaaacatatatacttatatactttatattttaaagtaacttccgcatacagaactttcgcacgaaaacacatcgttcaacactgtttgtaagacgcacgttaacggaaaccgaagtagaatcagtttctggtat

SEQ ID NO: 94886 - DNA, 5119 bp, Oryza sativa
ataagccggagcaaatcggcctaatatccccaaaattcgagaaaccctaattaatcaataaattgatctgtgaaggggtttctaaactaaattgtttttgaatgctcgatgtaggcgttgaacaccggcggccacggcagctcatacgggaacgcgacgccggcgtgcgcgttccgctggtgctcccgttccaccgccatggtccggagccacgcttcctccgacggcgacagacagcatgaggtaccccctttccgcccccgacgattacgccagcgatgccgcagccgaagtacacatctccttgcggcccggcagcccgcgggtggccacggacaaattcagggtgttcttgactgagcagtgagcacccagtcgccgttgctgggtagccaggaaaatactctcaggtggtcgtcgttgctcacgccgatgatacggagctcgccgccgccatcgtcgtcaccggcgacgaccctgaacttgcacttgcgggaccactccctcatgtggtctgggaatacgacgatggagaacctcgccgtgagctcgtcaagggctaggcggctaggaaggcaccgaggctgccgcggcgtctcatctccgacgtggggacggcgaccatctggtagcgccgcgtaagtggctcgcagacgatgaggccatcagggcagcagcggctgtcggagtctcggcgatcgtccaggaggcggtgtccgggacgaagtcgagtgagaggcggcagccgtagacgagaaccggcctggagacgtggacgaacgccgcatgggagaccgcgccgccaacggcgtggtattggccgacgaggtcgggcccgtggtggacacggaagcggcggaggaagacactgcaccgtcggcggcatcaacgacgacgacgcggcgctagcgcttgcagacggacgcggcgcggatgaggcaggcggcggatcggagtggaggcgcagcaggacgagctcgaggactttgtcggagatgtcgtcgaccacccacgtagccacgtaggcctcgccgtcgccggcagcaacaagacggtcttcttcctccgcgccgccgtgctccggttcttgcaagttgcgacggctcattctcggatccattaaccttgatcttcttctcgcgtttgtttatggcttgttatagagtataccatatcgtgcatcatggtagtattttatactcactccgtttcaggttataagactttctagcattacccacgttcatatgaactaggaaggtagtccgcgcattcgcgtgggcatatattttaagatgtgtttgagatatttacagttataaggatggaatattaactgtagaacacctctcatgcttcaaaaaacaaatctccgtataatttttctgtcagcatagcgtataatttttccaacctagctttataccatacactatttggttaatcccaataagtaattatcaatagtctttatcatataaaataagaaggaaaaattagtttgttttaaaaaaatatatctaacaaattaagtgtaaattgaaaataaggtgtttttgtctttaaattgaatgttagtggacatttttctaacaaatcttaaaaaacttttatcgctaacaaatgttttttattgtaccatcaagttagacctccttttgtttgttgtatattgatgcaatttgttgcatacttacatatgaatcaataaacatagaggagatatacatatcctagtcctcgcttccctacgatacgtgtgatctatggtgctattttttttaaaaaaaatagctaatcaacatgaatcttaaaattgaaatctaatagtaagaaatataacttttaaaccaactatatactgctaccttagttgctaccttagtgtaacttatatatgcaataatttttggaggaattcataattccatggcgtaccatagagaaaaatccattaacatctatgcacttaaaaaaagatgcaatggttaaatataatttcgcatgcatttttatttttgaagtgtggtgtattatgaatgcgcgcttgaatatctatccatggtatattaaaagtgcattaaatactatctaaggttgattacatggtaatataatatagtttagagcacttacacaaaagattatttgtgttgctcagcttatttgagcatactaatttcaataaaattatgaaggtactgtatttttatcccgtggtttatacgatttatatatgagttagcttttttttttttatttagctatgcatgtttgcaaaacaatgtatgctagtgcaacatgttttaattgtaattcagttgacatgtaaaagactaatggcgtgtgttccttcgaattttttattcaatggcttgcactatttatatgtaaactatgctcaaatcttatattcttatatagtataatataggcacatgaagcttacattactggaatgactccaacaatcagataagaaaacaggcgtataacttataattataattattgattgtttctttttgtttgatagcttaaagaaatagtgagaggagaggaatgaagagaatagggtcgaaccatagagggaaaggaaaggttgggtagtgctttgcacaggttggtgggagagggatggaggagactctctttttctaaatgatttagctaatgatcaaatgcttttttttctcagatttctataatttttaaggtgtgcatatcacaggttatgaatttctatgaaggtagattcagttttaactggaaaccgatgataagatgttttgtgttttcctttcttctaagtttcttctaatttttttaaatgtgacatatgttgacttaatagtgaccccgtattttctctaatttttattatatagaataatttttgatgacataatatatattgtcaattttttgttgtttggttgttggtctatgttcaaattatgtatttcaaattttatataccaaaatatgagtaataaatattctcattttcttatttcgttatagataaaactaaataaaagaacattacaaagaaattaaaaatcaggtgttatttggttgcagaagagatgtttattcaaattatgtatttaaatttttatatagtaacatatggttaatatagatcttaatttatttatgtatctaattataaaaataacagttcaaataaattaaacattagatataactacgatgatttagctatctaactgttgattattgttcttttgaattcttagtcaaaaatacatcgtttaataatttatataatcatcaaataattaatcatccctgtctataataatatatggcccaaagtctatagccgtgcctgacccgtttagcctcaagctaagaaattaagttaaaaactaccatgtattataagaaaaatggaaagaggcaaggagaggagaggcggtcaagggagggagtaaacatgtacgtgtgcatatgtacggtactgcggatgggagaatattttgtcaaccaatttaagttatctataattattaattgatctaatatactgaaataatgaatcaccaagcgttttataaaatatccatgtggcagattaagagtgtttataggatatttaatgaatttttttagcatataatagaaataaagggatagagggagagctagctagacttaatagatcaaagtctatttgaaataatttcaattttcgttatttggggattaaaaaagcaaacgaacggaggacagcaaacgtatgacgttgtatgtcgtacgtgcgtattccccacggagacaggatggagggatgtttttttaaacagtgatctaaccatctaatataatgggtccaccgatttaaatgaaaatcaatggtcagatttatctattttattatggtgccacgtggcggtatgagagcgtttatagggtgctatgtggtgatgcgagagcatttataggaagtttaatggacttttagtagatgatagatagatagatatacgctaatgatctagacatatatgtatatatatatatatatgtatatatatatgtatatatatatatatatgtatatatatatatgtgtgtgtgtgcaatgttagaaagtcttataacctaaaatagaggaagtaaaaaatttagtgcttattactttagcctataaacaatcacctttactcgaattacaaattaatctactgacgtgcactagaagccattgaaaattattcctctatttttcgtctttccttttcttcttctcccttcggctttgcttcgcttcttcatgctaggttgcgccggtgactaagatagcgtcacgaaccctgatttgaggctttaggctttatggtttggcgagcggttagatcattagagcgtccccttcctctctgcagttcttctatttatagtactagtggggttcgggagcttatctcgaatttagattcgaaattagttttaaccaaccacaaaaacggcatggttccaatttaccccaaaaaactttgttcttatctctttagatcggacttgtgggctcaatccgaaaaatcaaccaacagatataacatttatatgatggataaaatccttataaatatgagatttaaatcataatgcttggagtaatgtgccatatgtcaaaaattacatgttattttgtgtaatttgaaccataatatatgtggttttgtgaaatttattcttttttaatctttttaataactactagcaaaatgcccgtgcgttgcaccgggtattagcggggtgactgaagtttgatattaatgatttaccaaaacaccatagtataattattagcatcaattatatgtacagtgataaaaaaaagccatgtttgtttttttactattaatctcaatctctactacatcattcgtgtatgagtcagtttttctaagttcgttcgttttttaaaatacaacaaggacttctaattgcatctcataattttctaaaaacgtccaataaacgaccaatgaaaccacacacaatcctaaaaaagtaaaacaaagcaacattcaattcaaactatatatgccattaattagatctcaatttcaaagagattatggaa

SEQ ID NO: 94887 - DNA, 867 bp, Oryza sativa
gcatttcttggatcgtcgtcgtcggcaccgccatcacggtcagcaacctgtggatttggacacctctggaaggagctcttcagagaacggaagcagagcatgacgaagaaaagcacgtaggtgtatcaagcaaccatgctgtagcataatctatcgaaattgcactgatgatcagatgattcagatgacgatgatggatattttggatggcatttgtggagaattctctatatgacataattctttcattcaggtcagaaatctcaagtctaattaattagtacttagtagggaatagtccaatgggcattctgtcgcatgcattgggattttacttgttgatcattcagctaagaacactaatcactccttgatggcgagttctttggagtgatggttccctttagcatttagataaaaaaaaaatactgtactgctacatatacctcacttgatgattaccaatagatggttctttggagtgatggttcccttcagtattaatgttgtctgccacaatttgttcatgatttgatgttttcactttttagtccctgtcacatcggatgtttaaacgctaatttagagtattaaacatagactaataaaaaaactaatttcataaatgagagctaattcactagacgaattttttaagccattaagccataattaatccataattatgaaaagtttactgtagcatcacattgtcaaatcatggcgtaattaggctcaaaagattcgtctcgcgaattagtccaaagttatggaatgggttttgtaattagtctatgtttaatactctaaattaatgtccaaacatccgatgtgataagtccctgtttcccaaacagccgcttaagc

SEQ ID NO: 94888 - DNA, 2395 bp, Oryza sativa
  unsure (1)..(2395): unsure at all n locations
tgatatcctactaaagttatattattacaaatttggatgtgaggatgattaatatgtggatttaatggtagaaaccaacaccagaccttaggtggtggtacaagtgtcatttgagctaggttgttgttgacgtaaatctgacgtctagtaaataccaaacaaatctggttgcaaaatattataatgttatatttgttttctagatttatttcgagagatattttttatataggaggaagtgcattgattgatgtagatataggtgtgatactcatgtcataactggtggtagctaaatataatgtttatgaaaatgcaattcactagatctgtttatgggcatcccgccttgaccggcctaggttgggcctctattttcatcctaaaaacctattccaaagcctgaacaaaccaaaaaagtaaattaaatattaatactcatacttttttttattttagagtaacaataataataactactccattcaaatatggaaactgataagtattttaggttataggctgggccaaactcgggcttgtagttttctctcagctttttcatgacccagcataacctgctttgacatgtctacccttggcagactatgggcaaagatgacacattgcccaaatctgtggaagggatagagaacttcaagtggggattccattagttttcaaaaaaaaaaaagtggggattacattcatttcatatgtagatcacaatttgagatatttactatgctcaaatgatggtatggaatcatttcaatttttcacaaatgtgtgatatggattttggtaaatcttcctaacaggatcagaaccgactacaaagcgaacacttgatttaacaccaaaagttgggcgcccaccccaacccccctccccaggagccacaagtgcaaagggatgtgatttgacatcctacaaaacttaaatcaagagagatttagatgcgaggatatggtccattaatacatggattcaagggtggaaaacatcatcgcttaggtggtggtacaagtgtcactcgacgtatatggtggttggcataaatctggtgtctagtaaatgttgggacaaatttggatgcaaaagattatatgtcgaattattttctagatttatttcaaaagatatttttacaggaggaagtgtatttattgatgtagatgtagatgagctcgtgacataacgggtggtagctaaatattatatttacgaaaataccattgactagacctatttattggcaacccacattgataggctagcttgggtctctatttttatcaaaaacctattccatagcttaaacaagcccaaaaataaaaattaaatattaatatttatacttttttgtttaaataataataatatctattcagatatgaaaactagctcagttttgtagtttttcctcgcacttttcatggcccaagataacccgcattattcgacatgcctatccttggcatactgtggttgaagatggcatgctgcccaaatgtgcgaaagggatcaatatcttcaactggggatcacatttatttcatatgtagatcataatttgagatatttacgatgttcaaattgtggtggtacgaaaacttttctattattcacaagtacagatgtggatccggttagaggagatgatctgnggtgaacattccattaaaccccttaaatttgtgaaaccccacacaaagggggggggggcgattaatacccaaaagaaagaagacatcgctacgctaatatggtggtacaagcgctattggacatgccaaaattccaatgatatatatggactccatgaagattcagaatggcaagcagagttacaaaccctgtctttatctagggatcagggctcaatataggggaaaataaccgttataagttcactagtctttctgcccttccccctacaactcactttcgtaaaaggacccctacaagttcaatttctcttttacttcccctttcactagtttttaacgatttatcaccgttggttcaattcctcgactcctcatgcctcctgggcttcagcacggcaagacgaagttaccccatgtcgttttagcaagaacatctacctccttgtcaactacggatcacctaagttgtaaacgttcttaatagttgtgctgtgttttgtgttgaggtttgccatcaccacccctgcgctcgtggaaggaaagagaatcctagtaaacttaaatcaaagagggatttagatgggagaatatgatctgttgatatgtggattcaagggtggaatccagcgtcacttaggtagtggtacaagtgtcacttgagttgtgtgttggttggtgtaaatatggcgtttagtaaatgccgggacaaatttagttgtaaa

SEQ ID NO: 94889 - DNA, 689 bp, Oryza sativa
taaccatgacatcctccaatgttcatttcttaacttttttttatctgcaactgaaaattcttaaagggagcttgacccaaagaaatccttactactattttaagattttaccttaaggcacacgtcgaaccttcttcctttttggattgttgatcttattttagtgttactaaggatcatcatgatcaggctctcagatcaattctcatgttgcttctcttgattcgttgttttctggcacttgttttgttaggatctattgcactgcatggtaatcgaaactacgtattgtagtaaactatgtaaagataaaacaagcatattaaatatgtaacaatatcttctcaataggtaagactttagttcgtgcacaaatctgtcaactatgagatcatgccgtccatgagccacgacaaccaacttggtactgtattcaatgctatctctatttttgtttacatgagtttgaccaatttctgggattaaaaaaatactcgccacgataaccatgacatcctccaatgttcatttcttaattttttttatctgcaactgaaaattcttaaagggagcttgacccaaagaaatccttactactattttaagattttaccttaaggcacatgtcgaaccttcttcctttttggattgttgatcctattttagtgttactagggatcatcatgatc

SEQ ID NO: 94890 - DNA, 731 bp, Oryza sativa
tcactacatccacaaaatccataaacctaattcaaatacaagggtgtatcaggagtacaggttgcttactcattcatctcgcttagaagacgaggttgtttattagtgcataatccattaagtttttagctaaaatgacttgaaaaatagatcttatatatatatatatatatatatatatattaaaaaacatactatttaaaagttcagaaaacgtacacgtgaaaataagggagaagttgagaaatacgagtgccaaacacaaccctcataaatattaggcatacacatgcatttcaattaggaatccagtgagcttagcgattaactccctccagttatgagtatctgtgttcaactttaatcgtccgtcgtatttaaattttttttaaaaaattaaaaatttaagtcacgcataaaatactattcatgttttatcatctaataacaataaaaatactaatcataaaattttttaaataagacagataattaaagctgaacacagaaatttataaattgggccagagaaagtaccattttactgtaggtctttgtcgaatataatggtgcgtgtgtagtggagtggtgtttccatgtaatccggggaaaaaattccctaacccctgtcaggccaaatctttccaaccaaaactattcatctggctgaacccactcttctctgtcttcctccactcatcttatgtatacttcgaggatgagcagagcac

SEQ ID NO: 94891 - DNA, 1435 bp, Oryza sativa
atgtatacatatatatatatgtatatatatgtgtatatatgtatatatatgtgtatatatatatatatgtatgtatatatatatatatatatatatatatatatatatatatatatatatatatatatatatatatatatatatatatgtatgtatgtatatatatatatatgtatgtatgtatgtatgtatatatatgtatgtatgtatgtatatatatatatatatgtatatatatatatatatatatatatatgtatgtatatatttcttataattgtgaaataaagcaggattaagaatttaagatctattctatttgtgcatattgattataagagaataattatcaacagttaatgataaccattagatgaaacatagctatatgatgcaaggagcagcacttgatggaatttactcaactagcaacgaaaaaataggaaataagttagagattgttattactcaaaaacgacagttaagttatttctatctctaaagcgccctttatgagatcaattttggatgctttgtaacttaagaagtacaaagcaccataaaagccctcattaaaaacatgtgtagcacatttatgtatttgctatcaaatccggtagtctatatacgaaacatttacaacgcggcatatattaggtttcatcaactaattaactacgacaaagttgtaatatccccatatccaacttacgaatcgttccctcctaattatggactacaaacaaagaaatcaccagcctttggataatacatagtaactgaactattgattgttcggtgaaaactttaagttgatttaattttgaagctgttaaccactacatattaagccgagctatttctaatctaacagtttcatattggcatggagtagcctatttgcctcttgcatatgtgttgttaccattctcatcccttgggagagatattgttcatccactttgaacactcaatcctgaatcctaaagtccaagaaatctacgagaaactaaagacaagcaagactagatattatccgtcagtcccatttgccatgcacttcactcttgaacattatgttcgcattctaagaataaagatgattcaagtaggtagcaactaggattgtgtttggcacaacattgtatgcatcaccaatatgaatacaacattgtaattgccaagaaccgaatatttttttatcaagcaacgccactggtttttttatattccatttttcctggcacaaccacatggggcccaacaatgtgcacacacactggtcaatgccatttgtatgatcaatatgtatttgtcagtggacgctagcaaaagctagtagttcttggtgcacacaaaatacaagtggaaactagaaaagaaaaactcgagtcccccttgacttggcttttaagaaagagggtgagggctcaaa

SEQ ID NO: 94892 - DNA, 1805 bp, Oryza sativa
tgtacacatttgttgcggttcgtaaaactacttgttccttatattcatggtaaaaatgaaaaaaaaataaagggtcagcaaaatacaatagaacgcttcaagatgtttcgatgtaaagcattcatgatatgatgacaaagaaaaaggggaagcacttgtcattagtgatgacataggtgcatgactccatccactagtatttaaatcctgctatttgcgaatattaagtacatgcatatgcatatggcacaacaacaaaaacctcacgtagaggctcatttgtagagaatttttaaaatgcctgtaagttttaaagctctatagtctagagacactttttaaagacactctcaaaatcgcctaaaatatttttactttagggacactttagagacatttttaacatactttgttaaatttatcttgtagagccatcttttcggcactttaaaatttgccttatatgtaaaggcattttttccaaatattaatatatatcaagtaactagatataagtaacacaaatcacatacttatatgtaattatatgaggttgagatggttagtgcattgaggaaaaaaatggtaaactcaacaggtcatgagtttaaggattgataagggataattttttttctttttttttcatattgatttgctatagttgccacaacatattaatgcctctacaaagtacctctatttgtataaagacatcttataaaatgcctcttagttcatagatacaattcaccaaaaggcacttatgagacactcttcaaaatgtctctataacactgtaaaggcattttttaaatgtctctatagtattaggaaaatgtctctacaagatatatttgttgaagtatgggtttttaacatgattttaaaatattatgcatatgcaggtagactttcaacaggattgtagtgatataagagatgtgccgctaatttctatctcttagagtgtttgtcaggggggcgcataaagggatgggttcactgaggttaccgtaaacatcataacggaaacataaattcggtcacaagttcaaactgatgttatgcaaggctaatatttgttctttataaataatatatagtattcttttatgcacaccatatattttaaaccatgagacccatgatataaccatgcatcctccaatgttcatttcttaacttttttttatctgcaactgaaaattcttaaagggagcttgacccaaagaaatccttattactattttaagattttaccttaaagcacatgtcgaaccttcttcctttttggattgttgatcttattttagtgttactagggatcatcatgatcaagctctcagatcaattcttatgttgctcctcttgtttcgttgtgttttctggcacttgttttgttaggatctattgcactgcatggtaatcgcaactacgtattgtagtaaactatgtaaagataaaacaagcatattaaatatgtaacaatatcttctcaataggtaagactttatttcgtgcacaaatccgtcaactatgagatcatgccgtccatgagccacaacaaccaacttggtactgtattcaatgctatctccatttttgtttacatgagtttgaccaatttccgggattaaagaaatactcgccacgataaccatgacatcctccaatgttcatttcttaacttttttttatctgcaactgaaaattcttaaagggagcttgacccaaagaaatccttactactattttaagattttaccttaaggcacacgtcgaaccttcttcctttttggatt

SEQ ID NO: 94893 - DNA, 1007 bp, Oryza sativa
tgcccatgatcacgaattcatgactcgagaattgtacacacctcttactcaaaatccttggcctaatcttaattttggcataattttgcttttcttttttcacatagtgccctaatctattgtggagctatgatcgacgtcgatatgaacggtagacaacatcgtagtcgcgccgaccctcgagggaaagaacaccggcgagttgccaagcatcacacagcgaagatggttcctcgtaggtgtccggtaatacgatacgagggcaccacaacggcgaatgcgtatgtttcgacggggtacggagaagaaatctccgaacccctaagatgcgcctgggccatgaaccaattgggccgtttagtcaaaactggaccaatcaccggcccaccctagttgttcctctccataaaccagaagttgccgccgcccgccgccgacggcgatcgacgcgacacacgggtggagaggaatatacgagtacggtggcggccggcggcttcaggagttgttgatggaaaatgggagtattattttcgagagtataagtctgtagtttggttggaatacttgaaaattcgagagtgtttgggagaattaagggtccaattcccaccaatctcttacctagggaggtctgttaattcgtgagatttgaagggaattcaatgtgaaaccaaacaaaggatggagactatgccaaacatgccctacgagttttttttttctctctctcaatcatccagtttaatttgcccttaatcaaagcagggttttatgagctaatcacaccttaatcgacattgagcaattgtacaacggtgccacaaaaaaattcagtgacagaagaaccaaaccttaggttggttggtcggtcagtcagtcagtcactgcagcggcttgaagacctgagagtgcggcgagacgacggcctcctgcaccatcctcctggggtcgccggggtcgcgcacccacttcacctcgctcatgttgggcgtctcgacgaacag

SEQ ID NO: 94894 - DNA, 650 bp, Oryza sativa
ccatctaaacagtcattcttgaagttttttttgaactttttaaattcatatggtttgaagtgttaggaccttccaatcttgtatttttcatttacgtattttgaaaatcatatattccaaacgagcccttagaatgctaataactttcacctatgcgaccacacgtatatgcattacaatttttactcgattatatggatttgttttttttccttcaactctgtcccctttagaacaaaggaatttgagaaaaaatttgatagattggatcctatgtaaccatttggaacaaaggaataattgctcaaattcctttaaattcttttagattgtgtcaagtcataggaattatgaaggattatcaacatgaggtgccacctcttgggaaaaaaaatttctgtgtctgtcagtctcgtttgattcctatgtttttttttctactcaatccaaatgatcatttctactgtttctttgtgtttttttctatctgtaggatttaagataacaagacacttgaatttaaaggagccattaagctgatgcgttccaaaggagccattaagctgatgttaaaaggatatttttcatgcattcgtattattttgtgtgtacatgtttttatataattggtcaaaaacacttggaaaaaa

SEQ ID NO: 94895 - DNA, 1546 bp, Oryza sativa
atccctttgataacaaaaaaagacacgaggcaccaagaacacgcgagtaatcgagcatactgtacctctggtgaccccacgacgaggcgccatcacgcggggtggagctccgtggaactgcccgccggggcagcgacagcagcaggaggaggaggaactcggcagcagcagcatcatcatcggcaggaggaggaggaggagatgacacggcacaacgaggcgaaaaagccaccgcagattcccccagcttccgcttgctattggcgggcaaaacggcgagcgataggaaacgcacctttttcgcggccgcccgccgacagtggatgccggaggggggaggggggtctagggcgaccacggcggcgcagggccggagaggggcggcgcgccggcgagggcgagggcgaggggagtgcgtgtgtggggctccgaggtgtggccttcgtgtcgcgcgcacgtgaggggaaaagaaaagaagaaagggtgtactttttccgaatctcaaagcacttttggacggacgggcgggtggggtggcgcgagcggcgatgtggatggaacattcgacggtgtcggttgctggagatcctcccctcccggtgtttgtcctgctactgcggagtaataatataataataatataagacttcctatgtttcataaaaaaataatatagtactgaatgtgtacatatatgcatatatctgtccagatttgttgtattagaatgtgtcacatctaatcctagatttgtttcttttggaatggagggagtacgatggagcatagcagacttcatcgagccggcagcaatggtcatccgtcgtccgtgaaatcggtggcttggcgccctccttgggcaaaccaggatttttaaaatataggaatatgaacaacacgatcatgtttagcacggcttcagatcccagatctacgatggatttgaactttctggatttgaactttctatgttaaactgtagtgatttaagaatgtactgtaaattttatctaaaacatgaacaaaatgattcatccaaatatttatcaacataatcgtgaactcacattcatggatttgtagaactaggaaaactcagttccaagaaatcttggatccaaagatataccaaataggacctatatatgattgaatatgttagtttagttcttcgtgtgtactcgtaagggttaacaggatcgggtgtgtgttaataatgatgagtgtgcacatgtatacaggcatccgcatctgagtatgtatcgtgtttcgtaaaagaaagtgccctagtactccaaatcttttagattgagaaaatacagaaaaaaaaactacatgaatagcaattcgtatggagcacaaaaaaaatacaagaaatcaagaaaagaagagatagacacggtagattttttttcaaaaggttggacctcatgttaaaattcatattcattagatataaaattcatattaaacggcatggggacataaacgccctgtgtaaatcgtgaggatggacgtgatcaaaccataaagggctgcaggaatt

SEQ ID NO: 94896 - DNA, 1287 bp, Oryza sativa
gaagaaatataccaagagctctaacctcttgaaaaatttcctttgagtctatctctctcatccaatttctgtatttttcctgcgctccaataaaacgattatttccgtgtttttcctgtgttttacaatcctctgttttacacttcaattcctattagaattctgtgtttttcctattccttcattttttcaaccctgcgattcaaatgggccctgaagctagcaacttccaagctccaaccgatagacaactctgtccatggtttcgctctcacgggcgactcttgctgcaccctgcatgcagaacttgtagaatcgcgctataggtttctccaatctccaatatacgaactcgcaaaatcatttcaaccttgtcgacttgtcttacgttgttcttgtgtacgtagagcaaagtacagagaagtacattgctcttcaagtcttcgtccagatggggggtgagagatagagagagcgcatcactttttagccttttgttgcgcggacaaggctaatgtttggaacgctgtctgtctttttcctggccatgccgggctcgtgagattcctggggaactgcccaatgtttcagacgaagaccgtggtgcacagcactggtgccgctggaagtaaaactgtactacgctcgggactctgaaagtctgaactctgaaacctgaccgtgaccggctagagacgaacgcgagtatacgcgacaagtatgcagactttgattcacgattcacgtgcccgggctcagcgggtgtccgcaaccatgcaaacggcggcgtttccggtgcggcaaagctttggcttcttggcgcgcggaacggcggcgtctcacgcgcgcggcacgcccgtgtgagtgggatgggccggtgggcgagcggtagaggggaggggagcacgcggcgggttgggtttcgctggcagcagcgcctcgccttcttgggctctcagcctctcaaccaaaatgggctcctgcgctagctgcagcctaccgcagcacagtgcgctcggttgggtggtgcctgccgccgacgacccccgcggttgcggcgtgcgccgtgcgcggatgcgcccatgccacgagctgtgaactcttaattttagctcaaagaattgggtctagattctatagtgaaattgtgaagcaaaacccagctccatctctcattttaaattatgctgaaactgtttgactgagcttcggctttaagagaggtgaaactaaagctgtgctaaacatgttcttaataaacatataaaaaaacaggtccctttcgca

SEQ ID NO: 94897 - DNA, 1474 bp, Oryza sativa
tttgtaaaaaaaaattgaataagacgagtggtcaaacgttgcaaacaaaaactcaaaatcccttatattgtgggacggagggagtacttctttcaattcgattttagatttctgtattttaaaacgaagggaatagcttaagtagaaaagcgacttgttaaccgttttgagttgggtttgttatcatcagcgggctcaaaaccgtacagctcgtctgctccccatactattggttcatatgctaatcctaatctactcctaccacagtgtagggcccggctctaggtggaaagctgcagcgtgcaagcaaaggagagcggagagcgagcacgtgcgttttacgcacccccagtctatccatgggaaaatccaggctggcacggcagccggacaccggacaggaggaagtatctcaaaatatctcggccgtctttaatccacgccacacagccgccattattcggtcgacgcggaccatcgttccacccaccgcgagacgatccccgccgtccaatctggtgggccgaggagagcgcacggtcccgatccaacgcaattattcgggccccacacgcgcgcagtccatatgcgcgctcgcatgctgctgcggccttgggccacccctcctgcccgggtgcgtgatcgtgggccccaccatcggtggcaggtgggccacggcgctcggtgcttcggatcttctgcgccgagacactgtactttgtctcatcacgagtacaccgtataataatacggtacgtagtactccgtactagtgtcgtcgagttttccctatctttttaattttattacacatttaatccgtcgagttaattttgtgacactgtcgtagaaatatactgtacccgtagtactcctacgcatgacggcgacgcatgctactactactcccaagtcgtgtaggagtactccagtatttatgggtggggccagtgtgatgtgacagcgtatctttgggcacacgattggctgggccccaccatgtcactttctctcccgtccactacagcgaatagtaggagtactgttcgttaaagctgatgggtgcaggagccaaagctcgaacaagtagagtagggactagtagtactactactgctagggtacaggagtagctggaacaagtcagctgcggtgcatataaatgcaagtccaatgtgagccctctcgttgtgttgctcgtggctcatcgcggccggccttgatcgccaccaccgccgttgcgttcattcgtctactacgactccggcggccggccggtggtgccttcttaggcaggcgatggcggccgtcgcgccgcgcgcgcggctggtggcggatgctccgacgacggggggtccggccggtgtggttcttgctcgatcggcgacggcgagtcgtctcgtgcttttttttccgtgtccctcgtatttggagtttgtgatctggctgaagatggaagttgctgcttccatcc

SEQ ID NO: 94898 - DNA, 2353 bp, Oryza sativa
aggaaatttagcaagagcttcaatctcttgctaactttcctttgagtctatctctctcatccaattcctgtgtttttcctatggttcaatcaaacggttattcctgtgtttttcctgcgttttgcaatcctctgttttacacttacattcctatcaaaatcctacgtttttcctactcctacgttttctcaatcctacgattcaaaggggccctaaagctcttactaaatttcctccaaaatctctataggattgtacattccataggaatttcaaaggattggataggattcaatcctttgtttcaaagggtttcataggaaatttttctataggattgaaatcctctaaaattcctatattttttctccaaatcaaagaggcccttagttgagaaaaaaatttgggtttgattgtcgcatcgaatatacggacacacatttgaagtattaaacatatagtttaataacaaaacaaattacagattccgccaggaaactgtgagatgaatttattaagcctaattagtccgtcattaacaaatgtttactgtagcaccacattgtcaaatcatggcgcaattaggcttaagagattcgtctcgcaatttacacgcaaactgtgtaattgttttttttttcacatttaatacttcatatatgtgtccaaacatttgatgtgatgggtgaaaagttgttgttttgggaactaaacaacccctgaatttctttaggctccatgaattcgactttgtgccgcgcacggtgtgcgcatgcaagctagcgagcattttcatgatctgctcctgcctcctgctttgcagatatcattgtacagaccaccttccaagtgtaaagatcaagcaattcaggttagttgggaaaagttcagagaaaaaggggaaaatgccccttctctttccctttcttttgtggaaaggtagagaatatcagaatatatcaaaatgccttgttgcaccaatagagttaattaattatacctctcatcaagtgaccacacacaatggagcaagttatcttaaacaaaaaaaaaagataaaaatcttggagcatcttgagcatggatgcaagaacagtaggcaaagaaaagatcagaaggagagcaccaaagggaaaggaaaggagaggaagaaaggtggtgaaagcaaaggtaagctaaggccaccaaaagaccaaaagcattcatgcatgaaggcaagaaaggttaggagaagaggagaggatcaaattataagagtgagaaaagaatacccacacaccgaagcaactttgcagctaacttaggctctcttcgatttgattaaagaacactgcacacaccaagatgcacccaccccacataaccatggatggcattctgaatttcttcttccacttctagatcaaatcagcttctgccttgattactttattaaccgaccaaccatcatgctagtatgagttaccgttggtaaaaagtgctctgtaatttggtgtgctaatataggctagctccattgactggtgatttgatggaatatatgattagcactgacaccccactattacgttatacatccctgcaaaatagtcgctggcaagcggatctagtatctgaatttgcacatgctctgtaatctgtatagtggtcaaactttttttttgggggggctgaaagaaatgcaaatacttgtacaacactgaagttttttcagctctaatggaaggtgtttccagtgtaattgttcactaactgcctgaactggcttagagcaacagaacttctgtatgacactatgacagctagtagtagcaccaaaaaagaaaagaacagaacatttttttgtcttcatattcaatggcatggacacttctactggcatacaagaacgcaaataagagtaaccgcaatggtaatgtaaggtgttctctataaaacatatacatctcagcaatagactagattaatagtaaaccaccttaatagtatgtctacatgggtatgtatagttctctcatgcattgttttgtttttctctatagactatctctaagttagtagatagctttgctctctctcttcatttaatatcttccaaatagaaaaatatgctgacatggatcttttatagagaatctcttatagagagcttatagataacaattatgggtgctcgaagcaatgaggtccaaacgatgcaataggaaagaccagttcattgaatggactcgccaaccatcgaaaagctctgcaaattttgccatttactcatcagtcatcgcactctcccgttgatacaaaggcgatgcacacacagcgtaggcagacaccgagaccacttcttcgtcttccc

SEQ ID NO: 94899 - DNA, 1651 bp, Oryza sativa
acttagtccggctgttgctggatcgtccaggcttgcaaggccctggcccatctatataattctaagagttcctttttttttcgaggaaaataggagatgttttctgatttccaacaggaaatggatgatttatttgaaatttcagcgtttgaaacaatgttttaactatgtattgagttgatgactgcttttgctcttcttgggtgtggaatataggatttcgcactaatctgtgacattttccccgcgtctggaatacgcaattcggtatcactttactgtattcttagtttctttgtgtttatcagtgatcactggtccataatactccctccgttttacaatataaatcattctagcattttccacattcatattgatgttaatgaatctagacacatatatctatctagattcattaacatcaatatgaatataggaaatgttaaaatgatttacactgtgaaacagaggaagtacttcctccgtttcacaatgtaagtcattctagcatttcccacattcaatataacatcaatatgaatgtgggaaatgctagaatgatttacactgtgaaacggaggaagtagctcgcaacgaaattggagaaataatgtgaggattattcgaagtaccatcacgaaaatgagccatttcctggttcagttcgtatatttttttcacacgatgaatgattcactcgtgctcaaaccactccaatactaggattacaaccaatccacacacacaccaacaaacaaaacaaagctatgcaacatgccgacgaccatggacaaatcttatatccgataccgcaccaccgggttcttgtactgaagacccccattatacaccctccacgcaaggtcctcgagttaaaacgagtgaaattttcacccattcccattatcgccggctccatccacctcgtcgtcgccgccctcttctccggcatccgtgaccgggaccaatggcgagatgacactgtccaaggggagagtgatcagcacggtgactgacaagcggtcagcctcggcgccgtgccctgctccgggtgcagaagaaacggggcgagccatccctctcactttcttcagctttccattgctccacacctagcacgcgtgccataaaaaacaagaggcattaaggcaaattcaagcaagttgttactgctttgatgctgctcaaagagtaaaggaaacaacagacatgacatgatggtcactttgtggtttctcttcaaaagccgagatctttgactcttttttaaggtcctttggtggattccaaaccgagctgtgaggcagtgatgcaccggttgatgcagacatggggcctaaatgggtccaaattgagtggtgacgcacagcctatactttagaatttgatgccttcgcaaaataaaaatggatgctttttagtacatgtctatgcttcttagagacagactctgccactcacgaacaatcaacacatcttttttctgtggtgaacgaccagcaaattcgtagctgtaaaacctgtaattaattttacacgtttgccatttgtttttttaatgcaaattacaaactgaatcaataatatgagtgtctacatgtcaatcatttatgtgttatctgtgcaaaaattaatgctctaatgtcct

SEQ ID NO: 94900 - DNA, 2938 bp, Oryza sativa
ttctgccaaaaacatatcttctacttgcatgtgtcttaagcacttgcttatgaaaaatggttttgataggtattttgttagaggcaagccatacacctgtatgtgaaaaaaatttgcatagtagtgcgagagacaaattataatatatgcgtatatataagactagttatttaaataacagttgactgtataagttttccatgtcacattatttagataatttatagacaaacttgtataatatttcattaatttgttaattatacaattaattatattatttgatttcgtagagaactcgtaccgttacataataggaatagttaattctatcgataatataagtacatggacaactcatatctcctctctctaagcagcactccaaatctcgcatggcatctctccaaggttgatgtcatgccaatattatgtttttaacaccggcaaaagctttgccgttctacattaatagagaggattattttttttaacgttaaaagtatttaaatggcatgggggaagatctcgtgcccgcgaaaaagatctttgttagatctcccggtgtgggtatctctcgaagctttgctgctctcactttccttgccgcctcttctttagttttagctattatggtggcagtggttgacgccatgtgtcgaaaaatctgtgtgttgtgctcacgcaaaagttcctatacaatgagaatgagaagggatttgagtgacatcttcggcgtccgtggcatagagagaatttgttgccaccactcctctatacggtgtcacaggtttcctattgttgttaggtgaaactgcatctattgacatatcgtcatccatatcctctgtaaatatttgtatttcgctagtaggtttattgttgtccccggtgctatccgactgagagtgggcacatttacgggtttggcatcctcttcttttaagcatatccaccgtccaaacttggtatagtcttgttttacaagccaaatggagaacttgcatttaggatagcgcaacacttacagatcatctagttgaaggtagtttaggctgcacctaggaattaaagattgtatatatgttgacttggtcatgtattctctatttaattaatgtgaatttctagacgatatatcttttgtgaatccagtagctgcatgggtttgccgaattatgtggtagagccagacgaactggtgtaaaaggtatgttgtggttatcttgtggtgaatattcccgaaccatctatcctttcattgttggaaagctttcaatataaattcccttcgagcatgtcttttcatccaaagatatgcatgaaacaaaatcctttagaactacaaagctctaagaaatagccatgaaaagatggaaaagaacaactcccactagttggagcagacacacacacaaagttgagagagcggaaacgggaaaatgactaaagttaggcacgcaacaaatccaacaatttccggaagacgagaaaaaacccaaaagagcatccactttacttgttttgttcctaagctagttgctagttcgagcagtcatcgatcagcattgtgttcttaattttgactagatcactaccactccactgaacacactactcatgcaccgctcctatcacgtatatatgctatctgctgactgatgtgcgcagtgcgcttgcctgcatatatatccagatgatcgtgcagatcagtaagtggaaactaggccttttgggttcaccaaaaggtaagacggataacgatacatgcatggtttttaattatgtatcgaaacaaatatatttaacgataaattaaccgttacatgagatggtgcccggctctaatatatgtttaaaataagcgcatatatccgatcctaaatttaaacgagtatgacaaattttataaatttttaggtatgaacattatcttgtttacctagtttaaactgaattgaatattttagatattgattttagatatgtaccatcaaacataataattagctagttaggcacgtaataatgattatgaaataaagttgaacttaagttgttttgttattaggtatagatatgaatcaaatttttacaactaggtatatatatactcataagttgaaaaaaattagaagtttttgagtcaaatcgtatatttgcctcatatatgtgtcctatatatatactacctccgtcacaaaatgtaagcatttttagtacattttaagatgaaggtagtatctttgttacctgcatgctatatatttgttccagtgtaaatgtgttcttcagttgctgaaggaaatacatctccatcgttctctgatccaggggtttgactagctagctcaaatgcggaataatagtggactctacaacttacacttgaacttgcacaccgcacaactcctactagaagggagggagattatgaggatatatattgattgggaggatggatagtaaatataatatgaattgatctattggatcagttatatatatatatatatatatatatatatatatatatatatatatatatatatatatagacacacacacacacaatgaggatggtaaattagtgacaatatatgaatgtgttctattgtcaaaacgaaagggatcgatgagttatatctctaggttaattagtttacaacgaagagttgaagctggaataaacaagtcaaaattatatctgtataacatcatagtaatgccgaccatgtacgcatccacatggccatacagcaacatcagaaacagaatttaattaattatttgactaaacccagaatcatttgctgctgcatcgaatcgttcctctcgtcatcgccgacgcaaacatgcgctagctgatcagagcgaatggcaccacgtccatgccgcctgtttgttagctacactgcaacatacactaatacgctaa

SEQ ID NO: 94901 - DNA, 1488 bp, Oryza sativa
ccgtattcgtgtatgagcatattcgattcttattcgtattcgagataatccgtatttgtttccatattcgagctatccgtattcgttttcgtatccggtaaaaaatatgaaaacgaatatggtataagcattatccgtccgtatccgctccgttttcatccctatatgatggtacgttaaactacttcttttgttctaaattctgttctaaaatatatgaatttctgatattcaaattcgttgaaggcaagctatgagaaccttcgacctattctgctaaagcagcagcgacaacaacaaataagcctgatgaaaggcacaaggtaaaagccaggctacacgaagccagaggctaaaccgctgaggctgtgtttattttacaccaaaattaaaagtttggttgaaattgtaacgatgtgacggaaaagttagaagtttgtttgtgtaggaaagttttgatgtgatgaaaaagttaaagtttgaagaattattttgaaactaaacacggcgtgagtaaagcaccaggtggcaataccttgacagcaaagcgaagcaagccagggcagctcactgaagaagagaagcgaggaggcagcgaagcatgttcggcttgacatgccaaaacaaggggaggcctagtaaacggccccatgcgactctaataagacccatagaccgatcagatggaccaaagagaacagttaccctttgtagatgtcactatcagagaaacaatcatgtaaatttactagtgcactaaattataagattataaatccggattataaatatataaaccgactccaattggtgtgtctaatagagggtcggatttttaaattactatacaattattgctttccattccattccacaaagtttaaaaatacaactgaaatgattaaaaggggatcttttgatctaaccttattagttgttaaataacttagaagtttttatattttaaaacagagcgagtaattattaactgactgaggacaaaacaaaagggaaaacgatggcatgcaggaagattcggattgtttgttctagcagtagctaattaatggccgcttttgttctctctttccacaacatgagatatacatgaggctattctcgacccaatagctagaatggtgtccatagcattaaataagatgccacttaaaataaaaaatgatgtggcaagtgaataaataaggaaagagaaaaaatgtcttgcatgagacatagtttctacacaacatctaagatatcatgtgagataatgagcattaaatttaattatgaaataatagtgtttgcattggaaaaatggtgtctagtactagttttttttatgatgtgaagtttatggaaaatatatctagtgttttgggttgggaaggcctgatcgactttcacagtgcacttgaaaagaacgcatgcatgtttaatctaaggagcatttgctaattgatcagtaatagtactagtattagcatg

SEQ ID NO: 94902 - DNA, 4976 bp, Oryza sativa
  unsure (1)..(4976): unsure at all n locations
catcgtttcaatttctttaaacttctaattttagtgtggaactaaacacagcctaagatttttattttcttttctaggctgtgtcgatgcataagccgatgtaatttcattctaattaatgaaattcttcccattaattgtctgaaaagaatacatgtcaccgatgagaaccgaactgttaggtttttgtatcaacagtcaacagatatatgatattcacagttaagttaagttggtcggagggaaaagaatataattaaagtaaatcatcttcacagttttgttgtaactaacccagggcaagcaaaccccatcatcttgattcttgaccatggtcctgtttggatcctctgggctattaaatagccctccgaaattttgctatttaggttattaaatgtagattactgacaaaaccgatttcataacccctaggccagctattttgcgagacgaatctaatgatgtatattaatttataattagtggctgattactgtagcatcactgtagaaaatcatagattaatatacctcgttagattcgtctcgtaaaataacctaggggttatggaatgagttttgtcagtaatctacgtttaatatttctaaataacaaaatttcggagggctatttaatagtcctccggatccaaacagacccatatgcatgttactttgagtacttcccgttcagggagattcttgtggtctacggagcagcttgcatggacgtgacgtgtccggtcacaacgctattgatattaatcattagattttttttccctttggttcatactgaagtttaaaagtttggttaaaattggaatgatgtgattgaaaagtcgtgtgtatgaaaagtttgatgtgatgtaaaattgaaagtttggaaaaaaaaactttggaactaaacagggctatacttgagtagaataattcatattcagtaatacgaatatactcctattcgagcaacctttttgttgctcgtggcgaggcaacaggcatgggttataaatacctttcttgtttcaactctgcaaaccaccaaccaaagctgttgtcaatagctacacgagtttcaggacatgtgcagcaataaccttttattgacaaactgacaaggcaagatgcatagaggatcacagttcagacctcagttggagatgaagtgactagtgaggcatgaggaagaagatggagaaaaaaagacagtcgaaggagtatttttttccttttctttatataaaactgaggactgaatgaataaacaaactactccacctgcaaatgcacaaagagaaggttgtgagattgtcctcagtttaatttacaccttctttattcctagtttatagataagcgctactccctccgtcctaaaaacagacagacactgaatttccgtgtcaacgtttgtctatccgtcttatatgaagaaaatctaagttaataatcaaccggtttgggcactgtgggatctggaacacagtgaggaaaaattggcatgcgtgatgacggcatgccaaactttttgctcaagattctctctcgattgggaagtgaggaagaagactgctggatggaagcatgccatgcatggaccatggtgatgtgagcacgcactttataaaaatttggttgtctagcatagcatacagtaggtcctggatgatgagagatgtaggaggagtggccaaccaagtgcacggaattcgaggaggaggatgagcacgtaccccagaggtcaaaaaaaggggtcaaagagcatcgccaatccaacgaacaaaaggccaccaaagaccatattcttcggcctctgccctattttgtctcccctctcctcgccttttctccccttctttttccaagtgcaacaacaaacatgtcatatgctactcctgagaggagtactccgtaaaaaaaaaactcaatttaatatatttttataaaaaaatattgtattagattatttggtaggagaaagtactttctccttccaaaaataatcaatttaaaagaagatgtgacctcttatagaacaatacgctatattatatatattttagaagaggtcacatatcttcctacattgatttttctaagatactcgactactcatctactcctttcgtttctaaatatttgacgctgttaacttttttaaatatgtttaactgctcgtcttattcaaaaattattaattctttttctaaaatttgattaattgttaaatatatttatatgtatacatatagttttacatattttataaaagtttttaaataagacgaacgattaaatatgtgcttaaaagtttaggggttcaataaacggagcgagcagatgagatgagatgcctttgccaaggtctcgagtagggagaggacgacgacattcatgcgttgctggtactacaatgtcatgcatgctttcctttcacgtgatgggtcaaacccgtagagagaatcttgaatagtgttactgtagtgttcgtcaaactactaccttgtcaggctatcaagatatacaaacaatgctactagtactggataaatagataatactataatattgcacggaataactgtgtgtatatatactagtatctgctggcatttgggatcgatcggctacaggcatactactagtaaaaaagactggccgcggcaacaaattatggccatatagtgttacctgcaccgagaaagttgaccatatactagtactgcttctatttggagagatgggttgttcagttgtgtacaaaagacacattaaaaattgaccttacgtagtcattttcaacgtactcctgtttggagtactgggacacattttttacagcctcaataccatacgtgtaagggggtgtttagattcaatggtgtaaagttttggcgtatcatatcgggtgttatatagagtgtcgtatggggtgttcggacagtaacaaaaaaatagttgcagaatccgtcaataaactgcgagacgaatttattaatccatcattagcaaatgtttactgtaacactacattgtcaaatcatggagcaattaggcttaaaatattcgtttcgcaaattagtcgcaatctgttaaattagttactccttccgtcccacaaaaaatccattcctaatatcctaaggtggaattaatggagatggagaatgactaaaataccctagattattaaaaaaatagtaatggtgatagtagataaagggtatggaagagataaaatttctcgttttacgtgctgagggtagataggatagtagaagttggtttttttggacaaaattcaaactctagaagttaatttttttatggagaaagtatttttttttatatttaatactttatgtaggtattaaatgttcgatgtgatggagtaaaatgtttttaggatgggtctaaatactacgagtattctcgtagtagtagtagtagtaggagaaggagtatgtgtgtgtggtctttgcagcaacgacgcacaatgcatgcaggaaaggatctgcacattctgccgctggatggccgattctgccgctgcgctgcctgcctgctcgcatgtgtcgcgtcaaataaccgcgagaaaagcaaagcagccagtactcctccggtgtggtgtcctgcaactcggccggaagaatcttgcgtcacagatcgcccggaacagccacgccgatcctccctcccacacagtggcggagccagagatatgtcgtcaagtccggacgactactannnnnnnnnnnnnnnnnnnnnnnnnntatttttttctaacatcgaaaactatttacagtgaagatgttagcagcggagtccgaacgatcgcccgacgctggtggagaatccatttatacttccggttggtaactccctttaatcctaatttttcaaccgggactataaatccgggactaaagatatttatctttagtcccggttgaaataaccgggactaaagatagatatttagtccgggactaaatatacgagagggtaccggcagtcccattaggtctcttttttttcattgtttctagctagagtttaatccctatattttctcccaaatcaagtgggatacatatccccaaatcaagtgggatacatatccctaaatcaaacctcaaataaaagtaacaccccaaaacattcacatcacaaatcttaagttacttatacgcacaaatcgaatatatcacaaatcttaaaaaaattacacacaaaccaaatacatcacggattatacatctcagatcatgcaacaaatcacaaaattatacatcttagtgaatcacaaattgtaaaaaaaaagatgccggcagcggctgccgcctgccgccgctagccactaggcccgtgcgcggcccagccggccgcctgctgcgtgggaagggaggagggggaggagagggccggggatgggaggggaaggagaggaggcggagggggaggaggagggagatcgatctgagagggaggaagggaggaggagagggagatcgatttgagcggatgggaagggaggatggggaggagagggccggggatgggaggaggcggagggggaggaggagagggagatcgatctgagaggataagtgcgaggcggttgtggaggagaggatagggaagaaggattatatattaagcgttgaattttagtgccggttggtaataccaaccgggactaaaaatcttctagatcccggttgataacaccaaccgggagtaaagttaggatctttagtgagtaaagatcggggggcctgacaggtttagaaccgagactaaatatcatcttcaccaaccgggactaaagattaaatatgcccactgtagccaccaaccgggactaaagatcatttttagtcccggtttttagtggaaccggactattgtggatttcggccgaccgaccaaagatggtttctccactagtgcgatatgcacgggagctag

SEQ ID NO: 94903 - DNA, 2697 bp, Oryza sativa
tcatattgtgaaaattgtgcagtaacgttagtgcccgtgtacattaacaatatatgtgttttgcagtaaccgatcgttttactgcaattccatgatgatgttactaagaaattgtaacggaattgatttgcttctttcatggaggtagaaataatctaccttgttttttgtttgaatagcttactaaacaatatatgatagcatattagaatgaaaatgatactatacaaattgtccaatcttggtcaaaccctcaagcggatgctacatttatctagttagaattgtgtagtaatatagtgctaaatagcagtaataacttgtgttttgtgtattaaccgagcatgttactttaattccgtgatgatggttactacgaaattgtaccatgtatcttacacgtgctaaaattaatttactatatgtttttgtttgaacaatgtattgaatggtacggatgagggaggagagtgcagataaggcgggtgaggagagatgcgtgacatggcagagaaaggatgtgttttcacatgataggataaagcctcacgtgctaactgtatacttgttactgcacaaaagtataagtgttactgcatgataggtgtatgttaccacttccaactagctatgttactgcacgataattgtagttttactatgtcatttttacgagatgaagatcgaataggtgggccattggtaaagtctgtaggtggctttgagcgaggtctgattgatgtatgagtgttttgaacaattttatacatttggtaaaaccatgttactgcatgtatatgcccttgttactgtaaattatacattctgttactgcatgtggagggctaaagttcaaaatattctttgaaaagcaatatcttataagatatatattatttttgaaaaccgtttccaccatgatgctatagtgttactgcatatggagggtttccacactatgttactatgaaacttataatcgttacagtaacgacatgatgtgattacagtaacacaaaacagttagtagtaacacttttgatatagtattactgcttgtggagagttaagtttttaaaacatatctttgaagggtaatatctctcacatcatatactacttttaaaaaccgtttgcaccatgatgttcgaaaaaaagtgcttatcaaaagtagatccatcatgactatattatgactaaattttaattttgttactgcaagtaaaacacggtgttactgcacgatgaacaagacattactacgtcgttccgagacgagagctaagaagagagggggtggtgggaaaagtcaccggtgggtttgaccgacgtggggaacctttgaccagcctttaactgaggtgggaggtgggttttggacccttggggggagaggaggtgggttggagggaggggggtatagaacaactattttataccttgggtgtagaatagttttttctatatatatatatatatatatatatatatatatatatatatatatatatatatatatatatagttagcgatttaaaaatcaatacttgaaaaataaacattgataaaaaacttcaaatcaacttcaaaattaaaatttaaaatttaaaatttgactatggctgatttctatataaaaccacaccatatgtgcaatatagtgcatcggaagctaatcctttaacttatctgcacatataaggtctgtttggagagcttaagattctgataaacaactgattagtagccagctttcttaaaaatttggaaaagctggatttttctacttctggcttctaattcattctggattctatactataactcgtgagaatcatcaatcaataactcccctaaccatcccctttttctccgtttttttaatttttttctggctacctcggtgattaacacgtcgccgttttgcgattacggctcctcgagagcgcgtttgcgaccgggaaaacgcggtttaccggtaatttcactgttaatctcacgtttgaggatgcccgcgtggcggtttcctccaccgctggtgtccggtttgcgatctggttattttgcaaaaaaatccttgtctatgtataaaattttaaactaaccctcgtactacctgacagcctgttgtacttttcacaaaaaaccccttaaccttcagagaaatacaatgcaaagaagagaaaaatctgattttaggggtagctctgtaaaaataacaaatacaagggttttattgaaagataaccacgcctacggcctaccccccacaccccgagccctaacccaatcgtttcccgttccccacttcctccccactgcgccccgcgccgccgccggcctggggctgccgcccggccgccgtcgtcgccgtggtgcggcctccccctgtcgccgccttcgtcctccgcctccccacccccctccctcgccacgccgtggcgtgagccctctctccgtcgccgccgtcattgaccgccttcctccgtcctcgccacgtccccctaagcaccaccaccacggcccttccctcaaatccgcctccgtcgccgacccatccgcgccgccgctcgccctcccgcacctcctcctccccagtgatgtctcctgcctccatccccacctcgtgcaaatcgggggaggtggacttcggcgtggaggaggtcagcggcgtggaggagttagcgaacctcgagt

SEQ ID NO: 94904 - DNA, 2402 bp, Oryza sativa
tatatgaaatgttcatacatggactagctctcaaattacatcaatcatattaagctatataaacccatatatttagtggagcatcatgtcccacccaattaatcctcgaataaaccatgataatatatatgcaattaaaaaaagaaaaataccttaattttactttacacttacttttcgttgacatgtattctaaagaaaataagtctacctttttcaaatgatgaagaagattataaataattgcttatagatattacttaaatatgatataatataaaactaatatgttagaaaattataaaagaaattaatgtagacgaaaacaatttatggagaaatcgtggtagatgttcaccggttaatattttgctcttataaatgtctcaaacttagcgtacgaagtatgcccgcgcattcgcgcgggcgataaacggcgtctaagtttctactattcaaatgtaacataatggtgaagtggtgaccttaaatagatctacttttttttatcactgctaagataaactcatggtacatatttccaatttattttccaggggtggaagcatctgaggttccagcaaggaaataactccaatataaactatattccttcctgtggctagttgttgaaggaaagcatattgatatattgttactgtgttaagaagattgtggtcgattgcttggttataaataaaagaagaaagggattgtctgtatatacttttaggttgtaaagcaaatcagtgttgatcttgcaaaaaaactagcctgcatttggcattgtgtgtggttttgaacattccagctatactatatatgtagtaaacatcagtgatgtaagacttctgtactcgcgtgctagtgattataaagttgtggttactagaatctcacatgctcaatcgaccaattggtttcagaattttgaatttgtgatgttacatttgcactataaatgcttcaatatcccttccaaccgagatgtaaatacaatgcagatatggggtttgccaagtgctcacagatcgagttctcacctcttgaggtagctaattatcaaccagggtatattaaaaattctgctttacactgctagctactctggaagtggattgagcatttaagctattataaggatgtaagggcctgtttactttccccaaaagaaaatttttgggtgtcacatcggatgtttgatcggatgtcggaaggagtattcggacacgaatgaaaaaattaatttcataagtcgcctggaaactgcgaaacgaatcttttaagactattaatccgtcattaacatatgtgggttactatagcacttattaggctcaaaagatttgtctcgtgatttccccctgcaattagtttttttaaaaaattatatttaatgctccatacatgtgtccaaagattcgatgtgatgttttttgaaaaaaaaattggggaactaaataaggcctatgtagcatcttgctagcttcttcacactggttggaatgcaaaaatacacaagtcattttcaacaatataaaaaaacaaataaactaaaaatgtcagaagtatgtactccctccgtttaaaattataattcgttttgactttagttcaagtcaaactattttaaaattaactaagtttgtagacaaatatagttatatttataataggaaattagtttcattaaattaataattgaatatattttcataatgtatccgtcttgggtcgaaaatgttaatactttttttacaaacgtgattaaactcgaagcagtttgactttaaccgtataatataaaacagagagggtacaatttagacagttctacaaccaaaaggaaccatccgacctgtttagttgattttaagcctaaggatagccacagaataatttacatgcttaatttcttttaaagttctttttctagtaaatattgatagtttgatactactaatccatctacatcctcgagatttttgacccagcaaaacccaataggaataaactaatatgtgaattatttcatcagaagcgtttggtaatcattccaatagtaaatcgtactataggatcaaaattgaattaaatctggccctaattacgatttcagttttcatttttgactaggaagaaaacccgcgcagatacacggtatcttaattatttactgttcatagaaataatattaagagaattaagtaatatcttaccaaatgcatataagaaattgtagattttgcctcataataacaaatatctatgtcgtgaaatagaccgtggactttaatataaatgataagaatgttttttttatacttgaacaaaaatctcttttgtccaagttatgtaaagttgcctattcaccattacttattatgattgccgctagatgc

SEQ ID NO: 94905 - DNA, 5645 bp, Oryza sativa
agtcattcaggcatgttaaaagaaactgaagtctgtcagaaagcagaaaaactcagagtgatagcattggactatgtctagacggctaaaaatctagcagatcagtttaccaaggggctaccacgtaatgtgatagactgtgcatcgagggagatgggcttgagacccacttagagttgcacaatggtggaaacctgtccattgtgatcggagatcccgtgaatttagatggcgaaacaaactattgtgcaactgagagaagagaccctaaaatgagtttatcttcatgatgcacttctcttctaatctgtatagtaggatggtatacaccttaatgtgatccgagtggcttttcataaagaagagatgttggcctacagaacatcttagaaggaacacacctatatgagtccgactgctagtcacagtctatgagatctgggtgatctctagatactcatgaaaaggccaggagtatgacttatacgctccaaacagaggggatgcaaatggcagcctagtaccagttaagggtttgagtgaaacctgaatcgcacaagactgacaattcaaggcatagtccattattcagttgtgatctagtgtagctcttttcctaggtggaagttcaacttaacagtctccaccgaaacgctggtataacaaacaggatcagaatcgagagcatttcctgtgagccatgaaatttggtggggattgttagattaatggtctaggcccaattaaatcctaataaattccattggcccacattaagtgctatgggtaataataccaccttggaaatctaagtgaagaggtctcaacttaaatacagagctagtggagagtctctgttgaccggttgagatggtgctcggacaaccaggcggggcgaggcgaggcgaggtaaacagctgctgctgcgctctctcgttttgtaacggacggtaataaacacggagaattgattttgtatcaatgaacgcttcggttacggaattaaacgtcgtgaattgattccgtcggttacggaattaaacgtcgtgaattgattccgtcggttacggaattaaacaccgtgaattgattccgtattaacgagcgcatcgattacgaaattaaacaccgtggttgatgactccgaacgttactctcgcgctcgcatatatatactccgcaccgaccagaaggattgacgaagttctttctgactcttgcacttcgagttcctccttctatgttcctgagctgcagaattcttccccggttctgttcacctgcgtgcacaggtgtacgggacgagcaggtgcctctggaactccgttcgcttgagaacttgcacgggtagagcggcgatcaagtttttgggtagcgcttcaagtgtggctgctcctgttctttgttcttcgacgacaacgttgcatcttcctctacttctgcttcaccatggctctactggagagaacagaggagacaacatcaacggaggcaatacgaatgcctcaacatcttctgcaccattctctgggtataagattctaactttatttgattttcttcttgttattacatgttcacaatgttatccatgggacttcaatcctatgtgaatgtcaacgatgtctatacttattttaccttaagcatgctcatatttatgtttagccttatcactagattgcttctcattgtgtatgtcatgtttattgtcttaatattttggattaaaatataccgaattatgaccaaatttccaacaggtcaaatactactgccctttttctgttgagaaatttgcttacatttgaatgtgttcaatggaattatttagtttggaaatactatcgaattattgcaatttgacaattgcttgaatttgacctgaaacagatggccaactgatgtagaccgggcctagtttaagcccgagcaggcaccaaagatttaagctgaattaatattctcgcttgctcaatcactgaattcaaaccgtaaaaattcttataaatgaccagacattaggaagtactggtaaggaagtcaggtgcatcaccattttacagctacaaaagttactcacaaaagcaggcattttagagtctcaagaaatagttcagctccttctccagacccgttctaatctacatttcgccttggctacttcctatgtctaataacacgttttttcatgcaaaatatttctatataaaaatgtttttaaaataacataaatctacttaaaaaattcaataattactccctctggttggacaaggttaaggttaagcttttataactttgaccatcaataactttaaaaatatttagtttaaagaaactagaaaaacatatatagatttgtctttcaaaacaatataataaaagtaaacatacatttatttattgtatatattattatagaaaaataaggtcaaaggtatatcttgtagaacgtgacattgctcaaagcatcaattaaaatgaaaccggagggagtaatacttaattaattctatattaatcattttcttgttttgcgtccggctaataatccgtttcaaaacccactttggaattaacgaagcctgaaattcaggcctggactgtcatcatgctcatcttttttttctctacatccttttatatgttcgatgcgaaagcatattgagtttacgcaaaccattcttgcaggacgatctcggataatggacagttcgtacgtagtagtagtacgttgggataaaatttggcaatcgaacaatcactttccagcactcgcgtctcactcaccctcacctccacattcattaatgctcgataggtgatggtactactactagaagatcccacccttgcaactgcaagatatccactgatgaccaattcatccaccactaattactcatctctacaggctcatgtcgtcgtctagcttcagttctcaagctagctagctagatactacttctacttcctatatatgtactcatatctgaatatctgatacagtagcaggcaggcgattcgtggtcgttgaagcggcgaggcatcgatcgatcgtcgccgtcgtggtcgcccaggtccagcaggctgtgctcgatcgcaattaatccatccatccaggacgtacgacggcgtcgctttcgccggtggcttgcaaaggcagcctctccggctttgatgggacccaaacgccgactcgctgtcgctgatcgttaccacctcgatcggtcgccgccgcgctctggaccaagctagctacccagccaacccttccttttgccgcgtactcgctcgcatgaatcgacctgatcttttttattttcgcaaacgcgcaaaatgatcatcagtatattagaagaaagtaaagttttaattacacaattgccgtggaacaaggacaaaaaaatggtctccaaaaccaccaaaaaccgacgatagaaaaaaattgaaaaccctgaagcgatatgatcatctgatatctccattagaagttcacgagtaattgggggagaatttaacgaaacttgatcaaagatgaatactaacaacaacctgctagcttcagtactgtgtatgcatatattgatatatgggaaacctgatcatgaacgaacggctggtgatttacacgcaacttgaccatttcttggttggtttggacatctcactagctagctgaactgttagatcgttcccaagaaaaaagcagatggatcgatcgatcattttgaccaaggaatatgcatgcagggcctatcaatacaagaacgtttgtacgacgttttgcaagctagtcagccagccaaattaagccttttggattcacctgcacacacgtacatgtcagacagtccgagtcggtgttaactcagtcatggagatttcgatgggtttggatgaagctgactttccttttgattcaaaggtagccatcgatcgacaccagcaagtaatagcagcttgcattggtcgacgccaattaatgaccggtgcaacggcgaccatcgcggcttaattaactagctgttgagaccaagtgtcgttgagtctaagagtggattttaaactgtagatagaacgtttacacgttatttgcatgttactttgagggaatgttcactttgatgtcaaaaaaaaaccttaccaaattttggtattgccaaaattttgataggatttattatataggtgcaaactaaatgtagccacttttttgacaattttatcaaaatttgataagattaaaaatgatatcaaagtgaacatgccctagaaattaacttacctcattggcgattttgatgtaggtatacaagtcagcgagcttgatggatgcaattaagcagatggaaccggcggccgggcgtgtctcgcaagttcagttatctgcccttctgctggggcccttgaatatgctggacaacacagggttaattacgatgcgatgttcttaattagtagtttgcagctggactcatagtctcatatgcggacgtattcactggggccttaattaatgagaacttttactggtacaatatactaccagtatatactggcagtatataaaagggcatattaaaaatttgatagaaaataaaataacactttagtaattttctgttcagattgaatctaattgggagtacccggtcctggatcttatcgtgcgctaggggaggagcatactgaccgccatttgatgacgaagcacgtaatgatagcatgatttgatgatagaataacgaagaaaagacaaaattacccttcaaactttatactgcaatctaattaactaaaaaaatcaaatcaatttacaccgttagatcatatatacttgcagtatatactagcagtacattgtaccataaaagttctataattaattaattccgcttgcagtactgcactgtttccttgagcgctcaattttttgaccttcagagttcagacaacgagtctgcaaagtagcacgatctctcgctcataccaaagtaattaagcattgatctgatgacccagagagaacatatagaagcaattgagtaggagtgtgcgtgtgtgtgtgtttatgtatgaacaatgagctggagtgaggtagaacctcataaggaacataccaacaaagttcatgcatattgaaattggttgtatacacggactaatcatagcttcaattgttaggtccaaacaaatgcacttcctgcaattaattttgtctcagattttcagatatatatatatatatatatatatatatatgacactcatatggggcaccatggtgcccgggcaccatggtatctaatgcacaaaatttttcaaattgtgagtatatacctagttataataatttgattcatacctatacttatcaacaaaacaactcaaatttaactttatttcacaatccatgattacatacctaactaattatatgtatggatgctatatacctataatcaaaatctaacaaaaacaagttcaaattcagttcaaacttgctttaaactagttagtaaagtagttaatgttaatacctaagtaattgaaaaagttttatactcatttgaattgggtatatactcaatttcaacaatagtgcccggacaccatggagcaccaaacaaatttactat

SEQ ID NO: 94906 - DNA, 746 bp, Oryza sativa
tgcacaacgtttcatgcactacaccaagctgagctgagctgagctgagcttggtggtgaccccccgtgaggagacacttctatgcacatgcttacaaacatgaacaatgcaaactgctgagctagcatccaatccatgcatatgataaccaacaaaaaagggaagagacaagttgtactagctatggccagagtatagtactccatccatccaaaatataaatatttttagcatattttcaagtcaaatatttttaattttgactattaattaatagcaaaataatagaaatatcaaccacgtaaaattgatattattaaatttatcattaaataatttatcataatatgcaactcattttatttaaaacatcttacttttatatagatgttgttggtcaaagtagcatctcgaagatcgtgtcagaataaaaaatgattatatcttgggacggggaagcagtagcagtagtagtacgacttgcaacatgaccatgaatgtgctatgcatggctagttgttccaattgaactttgttttgcaggggcatccgtgcatgcatgaacatagtactaataattaaacataccttgcaactgatcagcgagtgcagagcttgtagcgacgacgttgctcggcgtcgcagcagcagtggtggtgaatggaaggatcatggccgccgtactagcatctgcagccgagacagcatcatgcacaggagaggcaagatgatgatgatgatgatga

SEQ ID NO: 94907 - DNA, 2258 bp, Oryza sativa
gcatgagtgcgcgcgtgacagcgccaccacctgccgcctgctggatctcggcttaaaattgggactttagctagctttgttctcctgttggtgaggggcagcgatcacgtaaaacgggacagagggccatgtgaccacaaagtataaatgtctccgtatcggctagctatcagcctatcatcggtcgagccttcaggctgcagctcagctttggttggtttgcttggatcaggtgcgtcgtgtgtggtgtgccgggcggcacggcatgcatggggcggcggaccggccggcgtgcaaaagctgccgcagagaattcatttggaaaaggcgtgcgcttggtacaggtagaacacgtgcacacgcgctccaaggcgagttagagcacgttggctctcggtgcaaacgtgccacatgcatggtccgattcaagtctttgaatagaccctacccgcctagtatgtaccagctgtccgtagccaagttttctttagctttggttaaacttgtgttccacttttgattttttaccaaattaacatgacaactactgttgcttgaattctcgattcatttcgtgaattacgtgcccgcgcgcgtgccgacctgcgttagctgtcggaaaagatagtcaaagaagaattaccactaactctatggtgtttggcaggataaacatctagccacttgttgcaatcaaattgataagccaaaactgtacaacgaactatattattatattgttacgacttacgagatacacgtcatataatattgaattcgtgagtcaccttattctggtagttcttagaaatgcaatggacggcaaaaaaaaaaaaaaaactatagatactagcacagtggtccgcaaactatatcgaccaacctgcccatttataatttgaacctacaatctaacagtaaaaagctatttttattcaataatgtaagacaatccagggctccaaaaaaaattaatgacattttttaagttatatatatatatatatatatatatatatatatatatatatatatatatatatatattattttttacccgttgcaacgcacgtgtatttttctagtgtatatgatacatgaactctatggtgcctggtctataagatttaaatttagtataccaatttaaatgggtacgaaaaagttcaaaacttttttgggtatgaacattaactgaatttgaccttatatatgcgtctttggcttttttttttcctaaataattaattagggtatgtgatatgagatagtgaaatattttaaaattggagttattttgttgcaagttatggttatcaataagtaaattgttacacctaagtatgcacccataagttgaaagctttcaaaaaaatgagctaaattcctgtatctcaaacgagctgaggcctcaattcaatttatcataccgagaaacattctagattagcaagaacatctggcatttatattattatggttgtatatagatagcaaatttgaattcagaaaatagagcaacacggacataattatggtgttgtacaacatagcgttttctttcgcacaacaaggtcgtggagccaagcctcccgtagtgatgaacaaaaccgaactagagctggacaacgacataccatggattcaacaggaactttttcaacttttataatagtaaaaaaaagatatagagatagtactaccgaataattattcctgaaggcacaggcgaacatgcacatatatatattatgacacgactgaaggattatactgttgccaaatgtagttatatgcatatcattatccaaattggactttagttagttgtactatcatagatagattctcaaacaaaaaaggatactatattttctatctagattcctattcgaacaaggcctacaaacaggaggcatatatctataggctgaggtttgacgctttgttactccacgaggcatatctataggtctagccaagcataactgtaactctaccaaggaagaggaataagagtacatgagcaagctgctttgatctgaaccatccattgcaaccgaaagaattcacgtccagtctcgataatgttcgaatcgtcccatgagtggacattaattaatttatatgcctgtcctataattaaggtgcagatttgagaaatgaaaaacatgcataatgttttgtagaatatatccagtatattctcttggtgtttgagatgctcagcagctaggatcatgattttgcatgcacag

SEQ ID NO: 94908 - DNA, 8236 bp, Oryza sativa
gggtagatgggccgagagggattcggcccatcgaccccgggggaggcaaaatagacttttgcggaggaatttgatttggagggatttggattcgggattgaactcgacgatagatcggggatttgagatcttgagatggcacggacactagacaacaagcaagaaacaatttcgcaattagggtttttatgagataattttcccgctaggcgccacgacggaacgggcgctacagttagtcaggccttatctcttattttggataaattgacttaacaagtgttttatgagccaattcgggatcagctcgttaatttagcactctactcggcttggtatcatggtatgaataagagttcaagccgcgcccaaagtgaaccaagccaactcatgctcttttacctttttcctatccctacccatgtcctacagtctacagatagactctttttgccaccgtattcttattggtaagtgacttaccgctagttgtttccaagatatcgtgtggctgtatttgacatgagagaaaagagaagattgagaaaatatgcaaaataaggtgactcattagcgtatgattaaatgggtatatattaactattttaaatttaaaaaataggttaatatgatttttaagcaactttcctatataattttcttttttgcaaaacacaccatttagtacttcgggaagcatgtgtgcggagaataagagaaatcttttctcaatcaccagctaccgaacacagagtgctgtctcattccttcttacgctataatatcctcttgaactatttaatgtacgttgatcagacatcgtcttatgtgcaagctagttattctcgcaagttattctcttagacttttttttgttccttttattaattttctatttttgagactccactcaatcctaatttcttatcctgtggactcatcattttctttttatgagttctccgaatctgatttcatcatatattagctttttttccaccatttttttctcctctttcaattttgatgactgcaaggaatgtaaacgagagcttgtcgggggcgtgtgatctcagcatcgacatcagcatggtagagacccctcgcgggcaataaccggtcggccgacggtttgaccatggtcgagaaaactgaggagaaccgtatgaaaccgtcacggcacacgacacggtcgcgcggaccattgaacggtaggagacgagacccgtagcaagtgggtgtgcaaccgtgctgtgcctatccaacgcgaccccatgccgattcgtctctccaagttcctctctccgaaagcgaccgcgatctgttgaggaggaggaggatcacgggattttcaccggcctcacgggagatttgccgtgttgaacgtacggcagctgtggaatatcaatcggtcgaagagaagatacgcggtagtacgaaacgtgcctacaatgggcgggcagctaaaaaagggaaggcacacatatacgccctgcttggccggagccaagaaaaaggaaagaaaaaacgctggtgctcgtgtagtcgctgaaaaaagagaagaactacacgtgcgtgccgtggctggacgcgccggccagccgtccggctagatatcgtatgagtgtacctaatcgccatccctcgcggggcgcgcgcattgctccggcctcctatcgtgcgcctttgtcttttgctcgcgcgtggctttagttttgccgtgcatgagtgcgcgcgtgacagcgccaccacctgccgcctgctggatctcggcttaaaattgggactttagctagctttgttctcctgttggtgaggggcagcgatcacgtaaaacgggacagagggccatgtgaccacaaagtataaatgtctccgtatcggctagctatcagcctatcatcggtcgagccttcaggctgcagctcagctttggttggtttgcttggatcaggtgcgtcgtgtgtggtgtgccgggcggcacggcatgcatggggcggcggaccggccggcgtgcaaaagctgccgcagagaattcatttggaaaaggcgtgcgcttggtacaggtagaacacgtgcacacgcgctccaaggcgagttagagcacgttggctctcggtgcaaacgtgccacatgcatggtccgattcaagtctttgaatagaccctacccgcctagtatgtaccagctgtccgtagccaagttttctttagctttggttaaacttgtgttccacttttgattttttaccaaattaacatgacaactactgttgcttgaattctcgattcatttcgtgaattacgtgcccgcgcgcgtgccgacctgcgttagctgtcggaaaagatagtcaaagaagaattaccactaactctatggtgtttggcaggataaacatctagccacttgttgcaatcaaattgataagccaaaactgtacaacgaactatattattatattgttacgacttacgagatacacgtcatataatattgaattcgtgagtcaccttattctggtagttcttagaaatgcaatggacggcaaaaaaaaaaaaaaaactatagatactagcacagtggtccgcaaactatatcgaccaacctgcccatttataatttgaacctacaatctaacagtaaaaagctatttttattcaataatgtaagacaatccagggctccaaaaaaaattaatgacattttttaagttatatatatatatatatatatatatattattttttacccgttgcaacgcacgtgtatttttctagtgtatatgatacatgaactctatggtgcctggtctataagatttaaatttagtataccaatttaaatgggtacgaaaaagttcaaaacttttttgggtatgaacattaactgaatttgaccttatatatgcgtctttggcttttttttttcctaaataattaattagggtatgtgatatgagatagtgaaatattttaaaattggagttattttgttgcaagttatggttatcaataagtaaattgttacacctaagtatgcacccataagttgaaagctttcaaaaaaatgagctaaattcctgtatctcaaacgagctgaggcctcaattcaatttatcataccgagaaacattctagattagcaagaacaatctggcatttatattattatggttgtatatagatagcaaatttgaattcagaaaatagagcaacacggacataattatggtgttgtacaacatagcgttttctttcgcacaacaaggtcgtggagccaagcctcccgtagtgatgaacaaaaccgaactagagctggacaacgacataccatggattcaacaggaactttttcaacttttataatagtaaaaaaaagatatagagatagtactaccgaataattattcctgaaggcacaggcgaacatgcacatatatatattatgacacgactgaaggattatactgttgccaaatgtagttatatgcatatcattatccaaattggactttagttagttgtactatcatagatagattctcaaacaaaaaaggatactatattttctatctagattcctattcgaacaaggcctacaaacaggaggcatatatctataggctgaggtttgacgctttgttactccacgaggcatatctataggtctagccaagcataactgtaactctaccaaggaagaggaataagagtacatgagcaagctgctttgatctgaaccatccattgcaaccgaaagaattcacgtccagtctcgataatgttcgaatcgtcccatgagtggacattaattaatttatatgcctgtcctataattaaggtgcagatttgagaaatgaaaaacatgcataatgttttgtagaatatatccagtatattctcttggtgtttgagatgctcagcagctaggatcatgattttgcatgcacagaacaatactgttatagcttagatctcaagccacataatttcattgttaatgtttattaccgttgcatatactagatattatcatcgatcttttcaaaagagaagtgatcatttatcatgatggcagctaattgagcgggtaggagcaaaagtcaagccttatcatgtaacataaatgcacgtgctaaattgtagttcaatttgttaaaccaaacttgggttgtcttcaggaggtgaggttgggaactcaccttctgcgcacgtaaaacagagcgacacattttttatgattaattaagtatttattaatattttttaaaaaatagattaatattattttttttaaaacaactttcacacataaaatttttgcagaaaacacaccgtttaatcgtttaaaaagcgtgcgtgcggaaaataagggaggtgagtttggaaagttgggaaaagaactcagccttagggaacgggcggaaacaagaagaaacaattgtcaatgcgtgatttaaaccagaagaaacaattgacaatgagtgattagtcttggatgcttctctatctgacgagaggtactaaaattgtggactgtcttgaaggagtatagtgacatgttttctactttctttttaaggatattaaggacatttacagtgcacgtggtctcattgagtagcttgatatcacatggctgtcatatatgttgagaccatatatctaaaataaaatccctcacaatacatggtgttctcgtgaaatagtttcaacttttcatgttagcctctaatattttcttattttagtccttgtattttataatctgtataaaagtttaaaattatatattaaacaccttaaaatctaaaattaatataaaataactactgtctctcctccccattcattcactcggtccactctcctctaccatgggttttcctctctttgccagctttcctcttttttcttagtcagtgatacgcttgtcgcctatctcctcgctccccactctaatgctatgcgcagagctctatggccatcatctctctcctttcttcattctctagtgttgtctctcccctcttcacactatgaggttaagtatatcagggcaacgtagtttgacaacgagcatatcagggtagcgcaagcctggcaagctgcctactcatctgtagatcaaagcatcatcggtgtggttcgatgagctcagtgatcggtaatgatagtctcctcctagtaagttcctctagatctacatatcttccctccagccaaccatgctatcaactacacgaaagggcccacacgcgttacgtggccatgtcctctcctaacacgttagcgagtctcggctacccacccctccggtgtggcctcgcattgatgtacatggaaatcgtggcttctgcaaggcatgacaagcctcattagggcacaacacgaatgtggagtggcagttccgatgtagcaagctagagccactcgtcacgtcggcgtactgtgaatgctttagtggatataaaagatgatgtttcttgcttgtttatgtaacatttttaaatgtacgaagtagagatagagttatcaaaatttaacattaccctgcatcgtatttcactgccaaaaattgctgtgaaaatagttactggaaggagaggtgcccaatttctgatgctgcgagtcgacggacagcctatacttctcttccaagttgttcttttctttacaaaaatttattcagtcatttgctaaaaaaaagctatatctaattattatggttgattaatgaacggctataagttacaaaaccacagggtatttagctatttgtcattattagagttgacgtttaactatttgtaattcatgtgttggatcaggtgtggtaaatagttaattgtcacatataaggatggtaaatttagagatggttgtctttcttagagctaaactagaatctctgagatgagcggctgattattgttttgattaaactagtatggtggcccgcgcagattgcacggctagtatcattatatcttctctcatataatagcatatatgttttctcaacgtattattcaaatatattaaaatgacaacataattttaaattttgtactaactttacgaaactactaatgtgtaatattcatattgtattttatatacgtgttagttattaattatttttaatatcaaactttagtaatttataaattatattcctatatggactctagactcgtctttcaatatatttttttaattccgaattttcgttacctgtaaattatatttctatatagactctaggctctttttttaatattatttatttttaattctgaatttttattatttctaattgtatttctatgtagactctaaacttatctttcaatattctttaatttttaatttcgaatttcagttacttctaaattgtattcctatattgactttagactcttcttcccatgtttttttttaaaaaatgaattttagttatttgtaaattgtatttttatacaaactctaaattctacttttaattttattatgtttattccaaattttagttagttttaaattcctatacggactctatactctacttctaatattccttgtttttaattccgaatttctattatttcttaattgtattactatatggacactatactctacttctaatattccttatttttaattttgattttctattatttcttaattttatttctatatggactctatactctacttgtaatattccttatttttaattctgaatttctattatttcttaattgtatttctatatggactctatactctacttctaatatttgttatttttaattccgaatttttattatttcttaattgtatttctatatggactctagtatcctcttccaatattacttattttttaatttcgaatttcaactatttctaaattgtatttctatatgtactctgtttttctttttctccgattaatatgagaatttctaggccgtgagagcgaacgtggaggctcatttttctattcctttcataagttaatagatagattccacacaaaaataccatattcagccattgacagatattgagccatattctatgaatgttatcaaactttcttccaagttgttggattgacagtgagagcatctaatcgacagatattgattggaaccatattctacggatgttatcaaactttctgtaacacacagggagctataactcttacgcaacgtaccttgatcatggcttcgtccccaaattgcgcacatgtacttgcatttattctttggacatgttatgtgccataatgtggaacaatattctattgcatgaatatgatccgcgtcattatcacaagaattgcgcacatgcctttgacacctcagcgaaattgtcacgatctttggacaagcatatagcagagcagcagtctagcagacaaaataattgagcattagtttaatttgtcttgtcataaaaaactggagctattgtcgcatatacccgtctttgtctacgtgtggttcgcctttcatcggcactatatgatgatatgaatagggggtgttattagtggactaattgtttattgatatttcattaaattggtgggccagttcctacttaattaatcgattgtgctgttcagatgctgtagcctgtagccctgtagccaatatccagtccagtggccgtatatgtatccaggccaggacccaactagcctccaacgtaggatggaaatgattttgcagagatgagagggggcgagatggaggagtgcggggttaagcaacaaaaagctgtttcggataatatattaaatgaaaaaacttgaattatagctaagactattgtggccgtacaaattacctctctcaataaaaaaaccaaatatcctttaccctcaactttttatatcggacaaattaccacctgacaaactccggagcggttttaatcgtacgtgacgacacgtgctgtctaaccaacaacaaaaaaaaaaggtaggactcacatgtcgtgaccgagagaagtgatggaactgacaataggccctcactattttttttattttcttatgatgactgggctgctacgtatgcgccacgtatgaccaaaaccgctccggagtcggacatgggagtaattcatctggtataaaaagttgagggtgaaaaacgtctggttttttaattgacgagggtagttcgtattgccacaataggtggggggaggta

SEQ ID NO: 94909 - DNA, 1621 bp, Oryza sativa
aagtatatttaacaataaatcaaatgataggaaaagaatcaataaaacgaatgatcaaacatatttagaaaaatcaatagcgtcaaatatttagagacggatggagtagcatatagaggtgcaatcgcctttgactacttggcgctaccgcaagagctgggcgcgtggagctacaacgcgaagaaacgatagaagcagcaccatcaacgataaattcaacgattacttaaaaaatataaaaaataaaattacagccctatataactaaaattacatatgtaaattaagttgatatgatatgtaagtggattgtaattttgataaaaaagatgtgtaagtaaatatgtatttgttattttttaaatataaaattacagtcctatataactaaaattacatttgcaaattcagtcgatatgacatataagtgtactgtaattttgataaaaatgttgtgtaaataaatatgtatttgtttttttgtccgttggatgtaaatctaaagttggaaaaaatttggatgatttttttttctagaaatcacccaataaatggatagtcagatccataaataaacatcaaaattatccctaatcatataagtagcaaagtactgatatagccttataaatcaacggcttagactattctactaatagtagagaacaccgaagcaacgactggctggccgagttgatcttctgtaatccagctagcaacgtacgaatccgagttggcgagttatcgtgtataagaatgtgcgagggtatgcggtagaatcctccgtccatacaccgatcgatacaccctcttacgtatagcagactagcagtaaacccaatcaaactgctgtacttgctagttgctactccacaatgacccgttacaagccattggtgttgccgttgatgctgatcctcttacacacccagctcattattgtcccttcttcatcagcagctacgtacgccaaccacaccggagccctgccgccggcggttgttccatgcttgccggaccaggcatcggcgctgctccggttgaaacgttctttctccatcaccaaaaactccagttccacctttgggtcatggaaggccggcacagactgttgccattgggagggcatccactgcaggaatggggatgggcgtgtgacgtctctggacctgggagggcgtagattggagagcggcggtcttgatcctgcgatcttccatctaacctccctcaacctcgcttgcaacagcttcaatggatcctaactcccgcagacagggtttgagcggctcaccatgctcacctatctcaacctctccagctccgatttcgtgggccaggtacctaccgctagcatcagtcgcctaacaaatctagtatctctcgacctatctactcgatttgaagtagaagaattcacacaaggtcattctgtgttgtcctttgattcagttgaatctagcgtgctcaaagagccaaactttgaaactttaatcgcaaatcataaaaaattgagggagctctacctcggcgctgtggacttgtccgacaacgggatgacatggtgcgatgctctatcctcgtccactcctaaccttcgggttcttagcttaccaaactg

SEQ ID NO: 94910 - DNA, 2187 bp, Oryza sativa
tttttgggttcataaactcgttaacaacagggcagcatatctttggggtatagacaatctaaattgaaggagcaaattaaattaatactccactcggttacaaacaaggtaattagtatcgagatacaaatataatcgttttgatatcgggatattaacataggatcagaatactatcggattttagaaagtacatgtttgtatataaaatatgtaatacgttgtataaactaaagcatgtagtattgatttttgtaaatttgattggtttttatgtaaatatgagcatattatttacattatttcaaatccaccttattttaaataatatttggtatgattgtaggatcgtagaattgggatactatctaagatttcataggataatgtagaaataaatagtaagatcaagatattatgaaaattagaatatactggaatcggtatcatttcagcttagcagtatcttagtattgtaagatacaaggataagaatcgagatactaacaaccttgattacaaatatttgacttttataacaagatctaactaaagttttaaaattctaactatcaatatttttcaaatgctaaaacaaatttgtcatgttatgatggtgctttgtaggtaaatttatgtaggagtatatcaattttctaaattaagtatttgataaattattgattattataattttaaaagattgatcgaaccttacgatatatatgaaatatttatgattagaatagtattattatgggacaatttcgtttttcattattattgcgtgctttttccaccttttctttttcaaaatgtgaggtccaaggagataaattttgttgaattcacaaacttccttgccaattcaacaaaacgagcagtttgtggaacattggtagaaatcagctttagatcggacggtaaaagaggaacaccaatcctcgcgatccagatcggacggtggagcgaagcgcccatattcatcactcgaccgttgcttcatctcacagcgcaaagaaggcgagtggggcgcaaaagagggaaaagaaaaacaaaatcagaaaaaggcaagcgccgccgcggccgcggcgcgaaccaccaccagatggcgccgccgccgccggggcggccggcgtggtcgatcaccgtgcgcctgaggcaccgcggctggctggatctccgcgccgccgcggagaacgtcgtcctccccgggtggggccgcggcggcgagcgcctctccctcctcgtccgcctccgccgcggcctccgcctcgccgtcacctcccggtgcggccgcgcaccgccggagaagaacccgcgcgcctgcaggatcttccgcttcctcaggagcaagctggcgcgcttcccctccatctggcgccgcaagaagccgccgccgccggcgcgcgccaccgccgcctctcaggtgatccaataatctctcctgggtttggatcaagtagcgtttctaacttactttagtaccccattcttgatttgatttcttgtttttgatttgggtctttgcgtgtgtgttagctatggcggaaccgagcaacaatggcgtggccggctcatggcggaaggagatggccggcgaggacgacggcgacggcggcgctgtacctcgtcgccgcgctcgccgtcgtgatggcttccaccgcggcggttcgagccatggtacattaccgaatcgtgcacttccgctgcattttctctcagaattggtgtgaattgtgcatatgctgtatcttgcagaatgggtatgggagaggatactacgaaccggttggtcacagcaagtcatggagattcttggttgcgaagaagattgccaggttgttggagttggagcctcgcctctacgcgtggctcatgaagatcagcttgaaccggctcctcaactggtagaaattcgctggatccattcacctagtggctggatcacattgaattgtggaaagaaattctcagctaggaagtaggaagggttgatgtttacatgcaaactaatttaacttaggttcatatgattatataataagcatacattcagggaccaaacaaagtggtattgtcatctgagtttctgttttgcagtgcggacaatgagagtcaggtagtcagccgtgtgttttgcctcttcggtacaccgtacacacaaccaaaaaatgaagaaaagag

SEQ ID NO: 94911 - DNA, 2309 bp, Oryza sativa
acataagcaaggcaacatcaatcaatagcataatctcacctgggaaacaggggttctttcagaaccggaggtgaggatcctgcaccaaagatctcagcttctgttcatgacgaagaccaaatctgaccattcaaaacaccatacagaggcaggaagaagaagaacaggtcaagaacatgtagctggattggtgcttctcggtcaaagcttgaagcaaacgcgtaggagagtaacagagagattcggaaacatgcaaggcacgagacgacggtggcagcagagatgactacagcccacctactcctactactatgtgtattactactcgaaggatccaagatctactcctgcttttaaagaagaaaacttgaagcagagagagagagagagtatgaacctttttgttaacacatggggaagaaagtacggtgtattgttaccaatctctccaaaaaaaaaggaaaacgagagataaaagcaaaaggatggaaacaaaatagacaagaaataaatagtggcacatggtgtcaccagccatgtgtgatgtgttgtagtacttctcaagatttcctttcttttattttcttaaaaggaaaaaatggacagcatggttgctggagatgggttgtgtatgaaccatgcattgaattcttataccatggaaattaattaatgcttgcataagtaggaggaggagaataaattacaaaactaaggggtaaaaaaagaacataattttctagtaaagaatagaaaattaacacgagattgatgagaaaaaatgagtggaggtgttgcttattgataccttctgaaaacttttccatcatcagagttacggacaagatgttaacatacaaacaaaagaagcaagacctgcaaattccaaaatattctgtcagaaggataacacaaaaaaccaatagccatatgtgctcttatatagactgtagcatccatgggaagaaccatacgcaaagctctaccgttggatctctagtctggatggctgatgcgtgcagctccgaagcaagatgaaactgtaggaagagagagtaagcaagtgttaaataggcatcaatgagggagagttaattacccaactaaataggcaaaaaactgaagcatgaattctgaatgaaacgtgcaactgagttcagttcagttcaggcaaacagtggctgtaaaagggcttcaccatgtgatgtttctgaatccctgatccctatagtattaaagaaatgaccatctgatacgaccgaaggattcatatgatttaatactcagatctttgcacacatctccttgtattttagtagctatgctgtctgcttgtatacacacaaggagtacagtatgaagtgcatcagcggccgtggcaatatttgccatgtttctccactagtaaggatctttttgcaagattcaagaattttatgaactaatccaggagcgaattgtggaaaaaaggtagggtcagctcgaggcatgggcaggtcagagacattgacaacggacaggccattgctgcaacctcccattatttctgccgtaatctctgaaagtctgaaactgaaagtgttcttgggttgctgctagtcatgcatacttccctatgcagacaccttctcaggcttcgggctcaataaaagtgaaattgcaagttggagagttgggtttggggcgttggaatttaggagtaaagatttgctggttgtttcttacagcaatagagaaacatatgtgagaacatggtgtgaatttcagaatttgatcgtggaattgtattgatcatatttgaacaaatgataaaacacaaatcaaaattttaagtttggtcactaaagtaaatgtagaaatccagcttagttacataaaacctgaagcctgaatcatccatcgtttcatgtcaacaacgctttaattgtcagcattaactagtaagctaatcgatacatgagcgactagagttgcacgcggtggctatggaggtaggagacgtacacaaagggtggccgagaatcggcggcgctccggcgagcggcggcggcggcgaggcgaggacagacgtgggaagccgacgagtgtgtccttcaccacctgacccccacacgtgggggtaaaacgccgccggcggcccgaggagagccgcattcatggcgggtcgtcccctcccaggacggagaaggcggcggcactccggcggacggcggcgcagaggcgatgcccttgtgacggaaagagagacttacaggtgggacccactaggccggtgaccccacatgtcatcgaggtgtaattttgcataa

SEQ ID NO: 94912 - DNA, 678 bp, Oryza sativa
ttcttggaattggtagttatgggtctgttcttcagtgcaaaattggtgagaagactgttgctgtaaagattcccaataacagagacagccgcaaacctctgccaagcatgcgagagtttaatcaagaggcaagtataaagatatattctgcaatatatcttttatatttctactaatctaagttcatttatagtagctccatgcaaaataaaaggttcatttcatagtaattgctgacaaaagtttaacatgggggattacagttgtctctttgatccctcaatccattgaattcagatcagtgcaattgctattgtgagtttttgactgcgcaatagcaattgcagacaatcttagccattcattttgctacccaactgctgaaaatgaccacaaaagtaatttctccacagtttccggctacagtattttactctgattcaaatgttagctgcaacctcacctatttttcctgccttactttctccctgattgcatgcctactaattgaaatacagttcagaaattccatgggtataaatgcaagaaagtttatgcctacctgaattgttcatatattaattttcccgcaagttagagctaccgtacaatattcttctcattttctcggatagaagagctctgaaaatgcaggttgccatcctcaaaaagatccgg

SEQ ID NO: 94913 - DNA, 3201 bp, Oryza sativa
catctctaatgaactttagctagtctccgattggttaggtttcagggtcaggatggcagaagagggtggcaggtgttcctaggatgaccgaggcagtagtgacccaccggtgggttagcggacatgacaatgcaaggagaagatggtggttctgcctcagtcacgggcaagaatgacggtaggaaaagccttatcatttgagtgattaggaaacaataaaaggtgacatcagatccgataataggagccatcgaaggaggacagtagcgttggcgtgagggtaactatagatgaaggagtataagggggcaaagtggttcatcaagcctcatagagtagttaggaggcaatgggaggtgacgacgcggggtcatcggagtcaagaaagaaggaggcgactagcatcgccgaggttgtgaggaggaatgggtggcatggtacggcgggtcttactggcaccggatactacaccattgaggaggatggtaggaagaaaaatctattatattattaaaggaatagaaaaggcagagtccatatagaaatacaatttaaaaatagctgaaattcggaattaaaaaataaggaatattagaagagaagactagagtccatatagaaatacaatttaaaaatagttaaaattcggaattaaaaaataagaaatattagaagaggagactagagtccatatagaaatacaattaggaaataactgaaattcggaatttaaaataaggaatattagaagtagagtatagaatccatatagaaatacaattaggaaataatataaattcggaattaaaaataaggaatattagaagtagagtatagagtccatatagaaatacaattaagaaaaaaatagaaattcaggattaaaaataaggaatattagacgttcgctctcatagcctggaaattctcacattaatcggagaaaaagaaaaagcagagtctatatagaaatacaatttaaaaatagctgaaattcggaattaaaaaataagtaatattagaagagaagaatagagtccatatagaaatacaatttagaaaaaaatagaaattcgggattaaaaaatgaggaatatttgaagtagagtatagagtccatataggaatttaaaactaactaaaattcagaataaacataataaaattaaaagtagagttttgagtccgtataaaaatacaatttacaaataactaaaattcaaaattaagaaaaaacatgggaaaaagagtttaaagtcaatataggaatacaagtaactgaaattcgaaattaaaaattaaagaatattgaaagatgagtttagagtccacatagaaatacaattagaaataataaaaattcagaaataaaaataaataatattagaagaagtgcctagagtctatatagaaatacaatttacagaaaattcagaattaaaaaaagaaatatgaaaagatgagtctagagtctatacaggaatatatataacttacaaataactaaaatttgatattaaaaataattaataactaacacgtatataaaatacaatatgaatattatacatttgtagtttcgtaaagttattgcaaaatttaaaattatgatgtcattttaatatatttgaataatataataagaaaacatatatgctattatatgagagaaaatataatgatgctagccgcgcaatctgcacgggccaccatgctagttcagtaataaagagagaggagataattcaggtgtatagcaaattactttagaaaatcttaaggtcccaacttttagcttacaacctcgaactattaattgaattattcgtgacatgcttctaaaactgcaattccttcggaaactttcttagtcagccttgcttagattttttttttcaaataatttgctcgcttaatagtatatattatttattttattcatacaagtagatctataagttttaattcttaaaaagaacatgctagactgacctttagacaatccattttttccctactcatcgctatgataaacatggagtaattcgagtcatttgacatgctgtaatgattgggttcactgtatacatatttgtcgacaaaaactagacatttaagcaagatttctttgtgactttcagttatcttcagttgtgggagtaggttttaaagtagcagtagtggtaacagctaaaaagcgatggagggagctagcaatggagcatttcttccctggaaaaagcaaggccaccaaattaagctaagagcaaccaagggtaaacggtaggtactcctgtttctcaatgaattaatctaatactgcatgtgatacatcatcgtagtaatgaattcatgttcataattactatgatatgctatatttagtataaaatttaacttattgtgagacaaagattaatagtattataatgtgtcaatgtgagacggagaaagtagtcatttcgttacaaagaaaatgacaaacacctcaacatactggccgtcaaactaagcttttctttaggactaaacatcctaaataatgcccagatggatcgtcaaagacaaaattatgctgctaagagaaaactcagagttacacatgacgggattagttgggtggttgggataatcctgacaaaaaaacctgcgacaacgctgccgcacgggcgtcctttcatccaggcctctggtcatgtcaccctgcgaaattccagctgccagctcaagaaatggcgcatgaaatcagtaaaatgatctttgaatatttaatcctgggagaaagagctaagctaagctaaatccaagccaaggaatgtggtcctcacgttgtcaaatctccataagatgctgctaatgaagcatcgggtatgctatcatcgtgtcacattgtccaatcttaaatgaagccaggcacacatggatcagtctgcaatattcaaatcatggaacaggacgcttgtcatgcagctggggaagcaggcttggatatcaagggcaataattaaaatacagttcaaggatcaagaacctggtcctggcaaaacaagttctgagacccttaaacatgggacaattgtctctgtaaacaatcaacaggacggcagtaacgacattcggacatactaattctctccgccctaggctcaggttccactcgtgtgctgctgccttggttcggttttgctgcgagcaacaggt

SEQ ID NO: 94914 - DNA, 1265 bp, Oryza sativa
agtccaaatttagtatttcgaaatgtacatgttgaattcttatgcttttttcctacaatggcgctaaatttgagatgattatctttgatttatcatatcttaatttgtgcattgaatttaattctatacaataatattgcttaatttatttttcttcccttgaaagtttcataattttgtgatatggaatacatttggccaaactacaactgataatttaattttatttctattccattattttagtttatgaatcatttcaatttctcttgtggtttgttcttttttattttttaactgggaatcaaactttatttaattggcgtaattgtgttatgtctctactttcatattcatatgtgatttttatccctattttcagggtttatgattttgcccattctttttttaaaaaaaaacaaagctttagcttgcacctggtatatatgttaggtcacgttgacggtgataagtctgtggcattcaccattgaatattattgtatgtttacctctacttttggtcatcactcacatgggtctgccccttatacccttaaatctaggcttcttggttcaattgaattaagagatcagcgaactatgttcaaaatagcatcaacaatggccaaagttatctactctttcagaagcaaacaagatggcaatcataaataattcccaatgtggtgctaataaattaaccaaatcttatctagctgttgctactagacatgcatatatatatgtatgtatatgtatgtatatatatgtatgtatatatatatatatatacatatgtatatatatatatacatatgtacatatatatatatatatatatatgtacatatatatatatatacatatatatatatatatatatatgtatgtatatatatatgtatgtatatgtatgtatatatatatatgtatgatatatatagtaaatttgtttggtgctccaaggtgcccgggcaccattgttgaaattgagcatatacccaattcaaatgagtatgaaactttttcaattacttaggtattaatattaactaactaactagttcaaaacaaatttgaactgaatttgaacttgtttttgttagattttgattctaggtatatagcatccatacatataattagttaggtatgtaatcatggattatgaaataaagttaaatttgagttgttttgttgataggtataggtatgaatcaaattattataactaggtatatactcacaatttgaaaattttga

SEQ ID NO: 94915 - DNA, 2048 bp, Oryza sativa
aactcgttgtattatcttattggagttgtataaataaggccgttctcctaacactgtttcaggttcttaaaaatatggtgccactttttcagtcactttgctctcaagtatacttctatctaacctatctcctctttcacagagataaaaattactgttaaatataattttatttgtgtattagaaaaaatataatgcaaatatttaaaattacattcaaatattaaaacataaaatgtaattacaatatatgttttgaaatttacaatctaattacagtatttaagtgtaagtaatctatagtgtgagaacgatttaactgttttataaaataatatagcgtcataaatatagctactccctatagttttgtgtgtgtgtatgggaggaggtattttgcatttacataaaggctatatttatagttttacaaaatctgtaggttttcatctatagtttcccaaaaggaataagtctattttgactactatatgtaagctatatatatatacatacatatgtatatataacactatatgtaagctagttgcacatgactcgtattatgcatggtcgaaggtcgatcgatgtttaaattagtttcgctaaaaaaaaagtgaagtcaaaatatgaccactctctctatacacagtttgacgttatcaacaactgtgtacaattgcaattttttattatagtttttacatttccatgcacccttaaaaggtaccaagaggcagtaccagtgtacttatctatgaattgagagctgaggtgacaatcttttgaaagaccatgaagccatttgatactgtcatcaaactagctatattgattttaagcatattggactctgattttgtctcgtagaagatggttttaagatgctatcttacatgaatgctacatacatatatatatatatatgtatatgtatatatatgtgtatgtatatgtatatatatgtgtatgtatatgtatgtatatatgtgtgtatatatatgtatacatatatatatatatacatatacatatatatatatatatacatatacatatacatatatatacacatataaacacacacacatatatatatatacacacacacacacacacacacacacacatatatatatatatatatatatatatatatatatatatatatatatgaaaattataagctactaccgggagtagctactcccttccgtaatggatcaggtcaatgaaggggatccattaaccaaccagcccatgtaacagtttattgaattaaataaataactaagtacttagattatggcttgattatcggcagcacacaaacgaacgtaccaaccttctgctctgttttaatctaggtttttttttctttcgcatgcatgtgcattcaaaaaccgagcagaaggtcttgacgagtttctgtcaagattcgtttctgctttttgttatattctgcctatttttgttaacgtttcagattgtgttctgctcttcctgataaaactggtattgtgatcacatgacatagttagcaactgacgagcagagagtgatctgttttactgggaaaagcagaaagtgttctattctagagggagtgatgtagcagaaggtgatgccatatatctacatacacgagaaatttatgccatttactaatcgcttgccagccattgcacgcattgatgcgcactgtatgtgaaccagaaaaggagcaggacaagctttgttaggagcagaaaatcaatacgaaagagagcggaacttcggttagtttgttagcagaaaattagttctaaaaagagcagaacatcaacaaccgaccgcttatatgtagaacaccagggaagagctgatgttctgctacctttcaaacagaaattctgctcaatgttctgctccttttaaaatgggtcttcagaaatgatcttctgctccttttccagatctattcttctactaattagacgagcagaagatcttctgaaaattcatacgagccatctaacttgtttagcgcttaccaccgtaaatgtagt

SEQ ID NO: 94916 - DNA, 2309 bp, Oryza sativa
gatggggctatgcggatttaatttagctttcccactgttaagttgcttgcagttccggttctgaacagctttgtgtctactctttccgacagaccacagattgatagcaccaccattactatgctgagactgtgagcatgcacagctctgaagccttttgtatgacaaggatcaggagttcaggatgcaagtccaccatatggattgaatttggtggccgtgtaatttctgtgtcctgcaaaggacgttgctggtttctttacggctgctatgttgctaccttttcagagaaggtattgcaatctatattcgcaaggctttatcagttcataggtatgttcttatcctatcgcccgacaaatattgttctttcatctttcatattattgatgaaacatcttttaattgagccacaatgagattgatgtaaactatcagcatacaattaaatgtagtgcatggagtttcagaccaacatattctaacaaggaatactttaatagaaggttcaagttagacctcatagctctctctcatttgtgctattctaaaatgaaaggaaacgatgtggtttatgtttctttcttgttagacttcataggtctttctcattttgtgctatgatggaattacaaaattgtagatgcaaagttgattaattgggttattcatacttaaatctttttttctttttttttgccattggtaaatggcatgcatcatgcccaccaattaattattagttgagctattgatttttactgtaagtacagaaaaggatggccaatttacatacatttctctcatttttctcaaataataattaagaattgttcggtgttgtgcaaatagactcaaaataataattggaattgtgttcatttgtgccaggcggtgctattgcgtctcttatttctctaccatgagtgaatagaggatatggctactgttgattggaaatagaagatgaagctttgaagatctgttctctatgaacagctaaaattctgtaaacagtgcttgtggtgcatcattctaaaaagaaaggaaacgaatggtgagtatgagcagaattattattcctgcacataactttgaactccatgccacttccatctacatgactatcagtttttgtaacttgcaagaatcaaactggagaaggaaaaacagaagaaagatggaacaactgcaaatctgtgcactactacgactatatatggatttgttgtgttttttttgtgatgtatgttgtaattgatattgtgaaatatttatcgactgtttgtataagaaatcaataatacatgtgcatgtattagttgtgttttagcgtttcagatctcagcgggatgagttgttaacagccatcttgtttattctgaaattgaaaggaaaagaaatttcaaatatgaagtagtagagccaaaaaaaaagtatgcccatcattttcttcttaatcagtttatgctatcattaattaattatataataaggaaaaatatgtggaaactaagaataaataaatatcatcgtagcgttagcatgtgcatgttactagttagcctataggtgtctgacctattggttatttactgttttgtctccacacaaattttggtacacaaaattgcttaaaagaaattttcattgttatcagcatcaaaatttgactttgagaacccctctatagaagtctggaggggaatgaactagttccaactactaaagtgctcatatattcaataaaaggatcatttatttttaacgtgatcgtgcctaaatgaggatgaatagtttgtttcattgaaagatcatttaacccttttttttcctattccatttgaagaaagaagctaagcatacgacactgccgtctccatcccatcgccggctttattggtcaggcgcggtccatgcaagggactcagagggaagattcctcgtgtatatgtatcattggtcttgccttgatggccggttatcttagagcgggtacaatagtaggctataaaccagctgcaaacatattttaagaagataaataaggagagaggagagcagcgggctacagatttgtagccagctatagcatggactctaagacgcggtgtgtgtatgccaggtgggaccagatattaatagtatagtatgtaactattgtattaatgagctattagattggctatagataaattggagctagtagttggctatactattaaacttgctcttacatgtttgtttttgttttgatggaggttgtcctagaagcttactactccctctgtcccataatataagggatt

SEQ ID NO: 94917 - DNA, 3589 bp, Oryza sativa
taaaagttatagatcttgatgagttatacaactttgttgttgatgactttttcagttgaaatcatttagtatttgaaaatgttgtttgaagttgtcatattttcaaattcaaattcaaattgttcaaacaaagtcatatagaaaaatgaccaaaataaaagttatagatcttgataagttataaaactttgtttttgataattttttcatttgaaattatgtactacccgaaaaaattatttgaatttcttatattttaaaatttaatatttatatagttcaatcaaactcggatggagaaatgacgaaaacaaaattggtaggtctcaatgagttctacaactatgtttttgataactttttcatatgagttcatttagtatcataaaatttaattcgaagttcattttttctaataagtctgatttgccttctctttgggttgggctacctcatgggccttatgtgtaagtcggatatgcaataaaaaatacaggataatatccgacagatatcctattccgacgaatatcacctatatcatatttatttttatatctgaaaaaagtatccgaatttaaaaatttctagatatatcagaccgaaactatctgaataaaaaaaagtcaattcgaacggaaattatccgaatcactttgcagcacagcatttcccaacgcctccaagtcccaggcacaagtgtttggagagaagacacgatgcgtgattaaacagtaactggcgcatctccctagtttcttctggtaataagagccaacacatacgtggaatggaatggtagttttttatagacatcctctcggtgcgtcgtataagaacggtaaagttttttctttcaaactatgcatatctctagccagagaactgactactagtaccttcataatatatgtgttcatgtgcgcaaattggcagactacctacctcaaaactattactatcttaacttatgtcgattcaaatctcagaatcttcaataattaagttatagaaatatcaggatttaatgtacagaaagatttgtccacatcaccaagaatattttttttactcatagttaaatctagaattaagattacctttgaatcgcaagaatagaaatacacgggattctaatagtattatatgtgcaaaacagattattgcaaaatataggaaaaaagtgtaaaacaaaagaattgcaaaatacaagaaaaacatagaaataaccgtttgattggactgcagaaaaacgtaggaatcagatgagagagatagactaaaagggaaacttccacgaggttggagttcttactaaattgtctaaaatctctataggattgtctattccatatgaagttcaaaggataatataagattcaatcatttgtttcaaaggttttcataggaaatttttcctattggattgaaatcctccgaaattcttatgttttttcttcaaatcaaaagggcctaaatgctttactcagggcgatatggataaatctcatacgtttattttttattcaattatagtttttggttttcactacatatggtgcatgtataacaaaacttactaatacatgggaaggaatggctcggagaagactcttgtctagtactactatgttccacaaatcttaacctgatcgatcaacaggcttcaaactttctttttccacacttcgatttgtttgagcgcctctgtttttcccctgtttgttcggagctctgttccgccactgtttttcacgtcattcatattgtgtgatttgtgtgaactgccacatttatcttcgtgtgatttagctcttgtttattttccaacttttccttcaaactaggaaggtaacccgcgcggcacctttacttagtggtgtttgaaattttgttatcatgtttatgtataatggagctggttcatatgaaactataatttatattacatgtgtttagattttttttttaaaaaatatcatattaattaaaaccgtaatatttttttatactaaagatgtttttgtagattttaggatatattagtttaagaaattttttattaaaaatgtggtaatatgatttctttatctaatttattaaattaagacatacccacgtactcttgtttgcttctcctacctccatccataaatcgaaagatttaaattttatcgtagattataagggattataaatactactcgtaccatccaaccatctctcatttaatttttatccaatattactttaaccaccttataattctccaactacccctatttaatgagacttatttaatgagggcaaaataccccttgttgggcttcttagtatttttttcattcctccttatttcctataaaattatatgatccattttaggcagaagatagtaattaaaaagagcttaattcgtagaaggatttatttgtacctttctggattgatttagctttacctatttgtatagttaaatagacctcatatacacgatgagagatataattaagttggtagaaagacgtcacatgtttagtggtacatagtaatgtgtccaccaattgtatttttaaaaaaaggtggttattttgtcagcggtaatttttaggattttcttttattcagcagttaacttaattgccatatggagaaaaagaggtgacaacctatgggctcgtctcgtccgtgaggaggaaagtggatacatgctcgttcgtgagaagggaagtggatacgtgcattgtacatatgaaatctgacggtcttatcgatcaataatctttttaagatatagatctaatagtttaaaataaggtacataggtttgggtaatacgattttttttctcagaatctcttatatttactttagtttattagagcatcatatggtggcttaggaacgtttatagaaagccatgtggtatcttgacagagtttataggacatttaatggaattttagtatataataatagataattcatgtcatgttaattaatatatcaatcaataattaaataatttgtatgtgtagtgccaacataattttttattggttcgccactgaacaattaagttggtacaaagtaatgagtccaccaattttattttaaaaaataaggtggttattttttcagtggtattttttaagattttcttttttgcagtgattaacttaattgccgtatggggcgaaaaaaaaagaggcgacagcttgtgaggagggaagtaaatacgtgcgttgtatatagagactttggcagtcttattgattggtaggttttttttaattaagatatagatctaatagtttaaaatatggtacattggtttgggtaagacgatatttttctcaaaatctcttatatttactttaatttataagagcatcacgtgatggcttaggaatatttatagaaagccacgtggcagcttgagagcgttagtaggacgtttaatggacttttactaataataatagataattcatgtcttgttaattaatatatcaatatataattaaataatttgtaggtgtagtgtccaaatattttttttatgggctcgccactcaaatggaaggaa

SEQ ID NO: 94918 - DNA, 2059 bp, Oryza sativa
tcgtcttattaaaacatttaagtaataattaattcttttcctatcatttgatgtaggcatataattttacatatttcataaaagtttttaaataagacgaacggtcaaacatgtgctaaaaagtcaacggtgtcaaacatttcgaaacggagggagtataatggtaaacttacagtcaactaacgaaatgggtacaattatcggggataaaaataaaacctcacagtaatataaagaggatgatgtaatattcagaggcaagaaggaatggagaaaaaacttatgggtacgtaaggaattttctcatttctctccgcatcaactcctgatttgtttcaaacatgtaatatattatttcatctgttcaaaattatagtgcatacctttaactgttttgaggcacagttcgcaccgttatattgccccaaaaattttcatatgaaagttttttaggactctaaacaagagtatatatgatctggttgaaagttttctttttcaaataagttatttagttgatcgctgtagtagaaagtttttagtcacaagtcaaacttgttggtcaaaattacacactaaagaaaaaaaaataaatataaagtaacaaaccaaatctttttctatacaaaccaaagcacatgcagttgggacataaaaaaattaagacatggcatggctttggtggaaagtggaaaggacaagggtgctaaagcacatgaacatcgtgtgcgcgcatgttcggcaagggtctttttttttttaattttgttgtatactcattttgctaagctcttttttagagtgaagtaaaagaacggtcctcatgtgaatgtatcatgtagatctttgtatcatgtagatatgcagtggttgtggtgctgaaatttttttctccaacgaagcagactccaaacagtagcccgaatgggagtattttccgaatagtttaaaaggttagattacttgtgtgatatatctactaccgtatagagtattgccgatgtgaggagtccgaacctctataaaaatacccctatacaccgctctttaatttactccatactcgtataaaccatggtagtagtactaagctaagccctacatccagaaataatgtagtcgggtttagtccatacgttgtgtgttgtgctgcctttctccctggtttgctgattagtgaggtgggttctcataataaacatatttttttaccaaaaaaaccctcggaagtcggaatccttactaacacatgatgttgacccatccgaagactagggtagccggagacgatcccaacacggggatcgccgcgtacgtcgtgccgagccgaatggcgatggagctgagtaatctagtcaaaatactctctatatccatctcagcttctatagaaaccaatattcattaaaattggagtttagagttgagagttagagtttggagccgtaccaaataggaccctgctctcctcgtcctcgtgcttcgtctgcagggcagtagggaatttgggtcggctcggctctggcccagattgggcagaaaggaaaagaaagataaagaaaggggagtgaaaaagtctattttagctgtctactctattgacccaatttgattctctcagccataaaatcggttatatcacctctaccaagtattaaaatcgtgcaaaacaactccctcaactgttttaatggtggttctagctgacgatggcttctacagggcggaccggtcatcgtaaaaattttaaaatagatacgggcccaaatgtaagtgactacctctcatcccctctctctctctctcccgtgccgtgcagccacactcgccaaaaacctaccactcgccgaatattcgcactagatgtggccttttgtcgtgtccttccgcctgttcatccacccaccactccctcccactactagtccttgggacaccaggcagtttcggtttctagtgtgcagtggctcaagtgcctcatccatggcacatccgcatagtcacagaatccctcctcacacgggtcttcaaggaggagaagggggtggccgagtgaggg

SEQ ID NO: 94919 - DNA, 1809 bp, Oryza sativa
aagtgctggatgcatgaaaactataaatatgactatctcatttgaaaaaaaataaaaaaataaaatatccttatgatttttggatggaactattataaaaaaacttaaaaatagattaatataattttttaaaataatttttctatagtttttttttgaaaagaacaccgtttagcagctcagtaagcgtggatatgaaaaaactaggaatcagaaggaaaagtgcacataaaaagcagcctaattttagaggataaacttttggattaaaatgatacgtttttcaaactgctaaacggtatatttcgtacgaaaactttctatgtaaaagttgttctaaaatatcagattaatccatttttcaagtttgtaataattaaaactcaattaatcacacgttattatcacctcgttttgcgtaaaacaattaatatttatcttcaaatcttgaggagattcaaacaccacctaaatattcgctgattttttgatgcgaaaaggaaatttatcacctttctacacgtcgtctagtactgctgaattatcaggctgtgtctgtgatgtctgaatatctgaatccgacaagacataacactgttgattccaactgatctgatgagacgagaatcagtgcagtattgcactgttgggaagaggccaaggaagggagggaagggaaagctactttgctgcttgcttttttcccctcgaaaaaaaaaatcccctcgaaaaaactttgctgcttgcttttgagttggttgctagctgcatcttagtttccaggttgtgaattagtacttcctttatcccaaaaataattaaatcctaaaaataaatttaaactcttttatcagaagaaaaacacaaatattagagaaatatctaatatcaaataaataaaataggtgaggttttaaactcaagccgactagcccaccaccttatgaagctagctaaaaacctcttcgtgtttctaactagcttaacagatcgagtactgtgaagcaatacagaagagctctctaaagagattttgacttcgcttacagttctccagtgtagtagcattggatcagggtgagatagatcagttctactccatccactttaaaatataaacattcgtaacatctaaaatttataccaacatatatatactttacaaatagatcctttgaagtaaaacaatgctgaagtagtactagaaaatgtccagatttagatgatgggagtacttaatataaatagaagtatttaaaacgtatttactccctctgtcgcaaaataagttttgcactattcatctctaacgtttgaccgttcgtcttatttgaaaattttttatgattattatttttattgttattagatgataaaatatgaataatactttatgtgtgactaatttttttaaaaacaaatttataaatttttcaaataagatggatggtcaaacattggacacggattttcacagttgcatttattttgggacggagttagtatattttagaacggcactcataatggctggctcgacttatgtgacataacagtgatgttatattgtcctagtttctgtgaaaatccattaaatttcatacgctcgcctcgtatggaacgcatgaatatcatgacaactggagtagtacagacaacagttgctccattcacacagtgcacgacgacagaggacgacgtaaacgattgcaaagtcgcaaccaacgagcacatggctgctggctggtaagaaaaagctcaattaaatatcagtgtactgtatatatgtacaaatgtactctccatgaa

SEQ ID NO: 94920 - DNA, 2005 bp, Oryza sativa
caagtttcttccatggccactcggtgaagataccgggtttggtgaccaattcaggctagctgagctcgtacagtacttgctagcgctgctgctactactgttttcagggttagtgatttactgagctctgttcttgctcaatttacagactccttttgtgtgtttgatacgtacatagggtgacaggtttaattagttgacagaatgacagatatcattaattatgcatcatgattcacggtgaatgacggcaaaaattcattaggttggcaacaggtgtcgtctatttagattagagaaccttgccttgcactgctacccaaacccaacagtattgtgttattatcccatggtgttgagttatgtcttgtcaacctatacccatggaagaactttgctttcccgtctcaagtgtatggatgatctaattaccatgtagagttacttaaaagggatttaacctatacaattttcctaccgaggatgaactcatgcaagattagtcacaactgtctctcctttttaattgttaaaagttgtcaatgcacaggttcattgaaggtttgaagcattgtaaagtaaaacccatcacctttttcttagaagtggatttttatccctcgaggggacatcccctcgttttgtgcatgtcgttcaaaaagttatcaaaaaaaatttaaaaaaaatatcaagatagatcaatatatgatatatcttttcgtaaacatgtgagctaaaatttgacttatactattcgaaacaaaaataacaaatttgaccatgaattacacgttctattcatagtcaaatttattatttttgtttctacctgtataagttgaatttgaatttgcatgcttgtgaagtgacatatcacatattgatctattctactatttattttaaaatttttttgatgactttttaagtgacatgaaaaatgaggggatatccccttaaaggataatttgagttttccctttttctttgttaatatagggttttcacagtctgttactcctactagagtattagctacctactgcttgacagttaaatgccttgtcagtcagattgttggcaagccgatcaagccttgaacataaagcattatgtcgatttcatctttaaacagttctctcaatcgattgaacctccaggtgtcaacacacattactatgttctgcctcccaaagcaggtggcggatttcgggcagaagttcaatgtcatagttgatgtcaggctgtcccaatcttaggtgtccagataatgtacaatgagttcattctctgtttgggacacataatttaatttcatggaatatacttccaacttctaacttctaagaatcaaaaaagttttcctcgttccagatagggccttaaatagctctcttgcattgttgatcatgtgcacttcacctgcacgagttttttttttttctgggtcggcgaaagctggccaaagtttatttttagaattgtgagtaagaattaagaaagtgttcaattatctgcgtgccctctaattgtaatagtatattgaaaacaatactttatgtttatacatgtgtgggggtagcatttttaaaataataagagcataagaagagaaactggggcaaatgaccagaagtcctataggctacaacaacttacatttggaaaaaagtaagacactacaaattatgttccgaaacaaaataggagcaggtaattccaacaataatatcgttactccttaaaggatgagttggatgtgttggatgatggtgtgttttacacccacccccatcaagatattttttagctagatgtgtatatacgtgtgtattattatctttagtaaaaagtacattcttatcatgaatgtacatgtacattttttattcatcttatatttatatatgcaagtgtaataataatttctgaactgaggaaaattttttagatctcaactctatatcttatagggtggacttgttggctagttagccataaatat

SEQ ID NO: 94921 - DNA, 1085 bp, Oryza sativa
attgatcaattttgcatgtgtgtgttgttttgtactaggttcgcacaaactagacaagttattgtaccaaaacgagcaatttacaagttgttatacctatttgcacctaccaagcaaattcatgtaccgcgagcgcaatttactctaatttttatcatgtcgatcaccaaccacatgatccatccgagattagaatagatgcagactgcagagaaccaacaaaatgttcagcgtgtgcactcctcgatcaccaaccccactgctctctgaattgacacatgacaccacagtaccacacatgcaaatgcaagcgccttctgttgcgttgcagctgcctcagctgcctctgcctccgggcaccgaagcaattaacctgcaaacaaaaacatggtttaggtgaggccaacacatccatcttgctggatctgtctctgctcctgcttggttttcttttcacagggagtccatcaggattcaggaacacaacatcctctcctgttgcgagaccggtgaacacatcctgcattcctgctgttgcgtgctcgtgcaacagattagatgctgtcggcgacagccgaagttccatgggcttactttgatttgctagttgctactctactgaactccaatgaagtaaagttttttttttatgaggcagtaaattaaacactcaatcaaaaatactactccccccgtttcacaatgtaaatcattctatcattttctatattcatattgatgttaatgaatctagtcatatatatatctatctagatttattaacatcaatatgaatgtgaaaaatactataatgacttacattgtgaaatgcaggaagtacagagccaaaattttaggacacacatctattgtttcgacttaggccgtatttagtttcaaagtttttcatcaaactttcaacttttccatcacatcaaaactttcctacacacacaaacttccaactttttcatcacatcgttctaatttcaaccaaacttctaattttggcgtgaactaaacaaagccttacataatgcaattttagcatcaaatcaaacctgtccattttatagtgcttgatg

SEQ ID NO: 94922 - DNA, 647 bp, Oryza sativa
aactcgggtcttttccttgattcgattcgtttcgtccattttcgttgcttaatcgtggcgaataagcagtggtcacatgcggcacagctagcttaacaaaggtgcttagacaccgggttttaggcaggatttcacactgatttttttggcttttctgctggtgctgttgctagctgctcctccaagcgcgttgtaactgaagaagcccatggtttttcttatggttctgaaattccccttcacaaaattcgtcaaatggttctttaaaatgacgaagcaaacaaaaataatttaagggtaaaaaaaatgtgtgtgttatattagcagtttaaaaacaaatgctagaaaatatactacgatgaaaaaaaataccctaaaatcaacttcaaaattgagttttacaaaattaaaattttggatgtgcagggtaagctaataagcaagcgttgatagacgtatctagtacaaatgatagttatagtgtactatgaacagtttctgaaaagtttaatttactctgtcataaaagtacataatctattttctctacagagaacttcagaatagtatgactatgaacagtttctgaaaagtttactccgatacagagagtgaaaagtcaattttctctacataggattttagag

SEQ ID NO: 94923 - DNA, 743 bp, Oryza sativa
gctacgcaccgacagtttcagtaactaggatgttgtttatatcagaaaaaatgcaggggccccatatttagatcagggaaaaaagattattggatttttctggagaagctagctcaaaagtcaaaataaactgatggctcttataaaaagtggaacaaaagaaaatacataatagatggttggagatgagtttgcatgatgcacgactgcatcaccgactaaatagaaaactagtaatatatatactagcacataagcattacattggagggagaaccactctttttctataataatcagctacaaattgtgctgcaactactctcaaccttttagtttctgttagctagcacaaaacatttaaaaatatctagtacattattcttctttatgttatatctttataagtcaatcataggttattttactacatggtataggcatttctacgtttaacagtataaattaaatgttctgaacttaggtgagcctaactatagtgatcgtgtttataagaaaaactgtgcgtgaaatggcatgtagcctagtggttgcagtgacatgagtagcacccaaggtcctgagttcaaatcttcataggagtgaatttcagattgagttatttgagggctaagtttcctattcgataggttaagttcatgattaaaatggctgcatatatccggttagatatagagcccggctaaaaaaatatccttctcgaaaaactgtgccagctttca

SEQ ID NO: 94924 - DNA, 2910 bp, Oryza sativa
acacttctacagttctactcgatcacttctgtaggttaaaaatatacttgttctgttttgttagattaattttttgacagttactctgttacaaaagtagtacaatacttttgaatatgagtataataaatttaatcattttataaaagttatatcctaatagagcaattttgttagtcaaagagacaattagactgacatgctcccttgttagtgattacagtactacttgcttgattcatttcgttccttccagcggcccgatcgatctagctagaacaatcgatcgggcaatcaatctcgttcgtcagctagctaagctagccatgttgccatcagggtgtacggcgtcttcgtcgtccttgttccagtacgatcgaccagcgcaaaaatgaaaaagaaatcataaagggaatgttgattgatcgagtaattgggcgatttaagtccggactacatacgcaaccaaatcacacgctaatgaaaacgtacgattccttcttaattttgttcgcccattggaacgattttgctgcctggtaggactttactatcatattatcatacaaaatatatagggtccactcccgataccctcttattttaggtaggccccctttaatttaaagaaaaatctagaaattttagaggttttttttcctatatagccatttgaatcaaataaatgaacactatatgatcatagaaaataactcatttcatataagttttggaggaaatttaacatgaggtacaaacccatagaaatattcttttgagtctattatctctcctcaaattatcttgtttttttatggtccaataaaaatattattactatgttttttctttattttacaattctctattttatatttacatttttgtaaaattcccgtgttttccttaccccccctccattttcccaattgaaagggtcccttattctctcttaatttcttgtcctgttcttttatctctctatctttctttttcccaaatgctgtatagtctccttgtttcattacaagtaataaatatcttatacttcattaaccttacatgtaactcagacaagacaagtagctctagttgatcatgtatatgaattatattccgtataaaatcctccatcatcaggtaccataacgtcgacgcatcatttttctcaaaaagaaatgtgaaatgcaggacatcaaaaagcagtaggccccaatgtttctctgtagcagtcagtctagtgtcccccatctgaaaggaactgatctaataaaaaaggtgcatatatatacatgtgtgtgtttgtgggttaggcagctttacccatttggaacctttctttctatcccaagaacaattaatctagcatttatatttttcgttccatttttctctatttttcatcatcagggtatctcatattctgatattcaggtatacgtgggtgtactgtagctgtagccgacaacagaatagaagagagcacaaaggatacttacaagcggcctgatagctacagcgttgcattgcgccatatcggccgtgaacttagctgataatgatatagatctcagatgatactctttcagaaaaaaagcaaacattcagctgtccatccttgggttcagagttcagaccagcagggctgcatgcatgcattttgccacttgctgaatgcgtgagaatatcatctagctacaccaaatgtactactcctagctccttaatgcatccttaattaactgtatactccaaatgaatgtcttatcatctatctgattgagaaatcagaatttcagatcaccaagagcttaattactgtatgtccttcctgaccttatctgagcgatcgagctgactgacgaccaaccggcagcttatacagaaacagtgagagcctgaaaactgtagtaatacagttctagtagctaaaaggacttgacttttcttaattaaccagtatatgtatatgttttcggatgtatacaaattctcctcatgcctgccagatcgatcgatgcacagtttgaagatagataggggatgtataggacaagagagaacacatgcattgaagtgacaaaattaaaaggagggacgcagcaatcatcagatgatactacaagcaaaggaacactccacatgtaaaaaggctgcatgccacatcaccccctctgcctgctcttggctcttgctgcatccgcatgcctccaaaatcaaccggtttattaataacattcaccaagcatgaacagaaatttactaatggatcgaaccagtgcttgatttttatgaaaatggatttaaatccggccactacatttgaaccggaatgtacgtggccaaaggatttgtgctcagggttttaaatttcgaaacttggttttctgccagaggtgagcgaaagaaccgaaattcagatttttttcgtacgaaattatttgaaattttgactgattttgaatgaatttgaataaagtttgactgaattcacaaaaaattgcaaaaaaccgaaagtttcgggcgagatgtgagcatttcggtgggggcgaaatttcgaaccgaaatttcaaaccctgtttgtgcttcacgttctttacaatcaagttaataatattgtaataagtaacagctaaagtagaggatgggattttcattgcattatcaaaaaaatgtatatatatattcgacgaatatttccaccggtttcacctcacaacataagctatagctatctatcttcatcagcagcagaggcagaggtgagctgagcacaacacatctccccttgagtagttgagtactgcacttgagtgatttaaagcttaactagtatactgactgcactaagcttaaacctcactcgactactaccacaaaagtgaaatattcttggctagtctagtctac

SEQ ID NO: 94925 - DNA, 762 bp, Oryza sativa
ggtgcggtagtcgagcatcaccgaccacccgttgccgtcgtcggcgcgccgcacggtggcctcccggtagaaccgcttccccaccaccgaccccgtcatgaacgacatcggcatcgccaccgacgtctcgtcccgcgtcgttaccgccgccgccgccgccggcttcttcaggtagatatcatctccccctcccccgcccgcttattccctccctcccggagaggaggacgcttccgccgccgtccccagcagccgccacctcccccccgccgccgccgcggatcgctgcaggaggaggcggcggcctgcgagtgtcgccgccatgactggtctcgctccgctgtttgggcctaagctgctgttctagtagaggcaaataagtctgtttcgtctccctcatctcttgctcctgtaaatcgtctccctcaactgcaaaaccggatatagcgccgctcccggaaggctttttttgtcttcggaaagtagtgaaaatcaactccttcgatcgttttggaagtggtttctactgacatgacagtttgaccacggtttaacttgctaagtcagtagatgggatccacgtgtcagcgactttcatgtcacctcatcttcttcatcatctctctctctttcgggctcattcggtttaaaggatttttataggattattgtaggaattcaaacattaggatttttttcctatatgcctcattccttccattcctataaaatcctatcaaatacctaaggattatagcctta

SEQ ID NO: 94926 - DNA, 3663 bp, Oryza sativa
agcagtttgcaacgcagcgctagctttgaatcgcgcagctgagtgcgtaacgctgaggaaagaaatgaaagcgaaggggattgtggtgggtgatggcatttgtctccaagcaagcccgcaggctcccactgcgcggggcaaggcaagcaggcagcggcaggcaaggcactcggcaagcaagccccttcccttccccgggctttgctctgccagccggtttgtgcagaaaagttagcgcgcacacatgaagaaagcactgtctttaccctgcatgcaactgacaaaatgtggcagaagcattactactgtcccatcgtaccagagaaaaaaaaatgattagcccgttcacaatgcacttgtttgagatatgagaaaaaattgaaatgagagtaccggacatcaaacgagataagccattaacataatattaatcattttaaattttaaaataaattcatataatttttaaagtaaattttaatagattttttccgttcatgaagcgtgtgcgtttcttcccctccggcttctctcgaacacttcaaatggcattcaatcccaacctgttggctataagatttctctccacatctgcacctcgtgtgcccctaggaagcccctcgcactaccgcataagagcaagtttaggccatatttagttcgcaccaaactttccacaaactctcaacttttcatcacattacatcacatctaaaactttcctactcacataaactctcaactttccccaaacttctccccaatttcagaaactaaacacggcctaaggcttacatactacactattaataactggtctcacatgtcatacacacacttcgttttggagttcgtgctacagctggctacaaatctatagcccgctgcttctctctctcctcatttatcttattaaaatatgtttgcagctaggttataacctgctattgtacctgctctaaatacgacttccccaaccgcccctcaagccatgtgacgtgttccctcctcccatacacgagtgtatggccgggtttagttcccaactttttcttcaaattttcaactttttcatcacatcaaaactttcatacacacataaatttccaacttttttctttaaacttctaaatttagcgtggaactaaacacaccctttatctctctccgccgagtcgtttcgttcctcacgcatagcccatccatccctcgcaggtgatgacttagggcacccacaatgtggatgaaaagtgggtagtaagaccccttactacctactttaccattgtgaatatggatagtagagcagataataactataccaggcaatagcactactacctggtaacaagcataaaaaaatattaaactctcttctctcactcactctctctcttttctatcccatcattgctttacatgtaggtcatatcttactacccacatattgtatattgtgtgaggtagaaacaactatgagtatgtttagatttatttggaatgacaaatggaaaaagtgttggtggcaaaagttttgacgttgcaaaaatactagttggtgtttagatgcatactaaacttttgctattctagcacttttcggtggagagagagagagataaatagtggtcccaaagcacgttttggcacaatttgctactatggactagcaaatggcaaatgataaattgtcaacttttactagtagtgttagatccaaaatggcaaaaagtgctctaaaatggtaaaattttggaggatctaaaccgggcctataacctagttttgtgagtcccatcttactacccacttgataaatatttattgattatgcccttgggggagggtggaaagaagtacggctaccaggaacataccagtagggaggaggacacatcaacaatgttgcagcctcaccaggagagggtattagggctttttccttgttcttataaataggtcgtttttgtcaaattcgatctcaccaaaggcctatttgtaagaaagaataattgcattttaacattataaaaagaccctcgacgtacatatttttgacgccgatcccttttgtgttagcaacttaccaccatgtatcagcatcgagagatgatctatttttatttttttatatacgcattttcaaaataaaattttaaaacaactaaattataaaatagtcatgcaggatatttcggttggttccgttgccacaattcatccatcttactagtttatactcctcacttatatatatatatatatatatgtatatatgtatatatatatatatgtatatatgtatatatgtatatatatatatatgtatatatgtatatatatatatatgtatatatgtatatatatatatatatatatgtatatatgtatatatatatatgtatatatgtatatatatatatatatgtatatatatatatatatatatatatgggaaaatagttctatactcctagggagtacgtactccctctcccatccaccgttcatttgatcgatcagatatgtactccctccctcatcataacgggtttggctcggtggatccgattagtttttctaattaaaagaccggactgcttattccgtaatttggggtttgctcccaacaggccaaacagattatcccgaaaattggggttttggggggcggcgcggcgacggaactgcgcgacgacggaccagcgattcagctttcggggttttgggggtcagcgcggcgacggaccagcgattcagcggcgactgtgtggctggcggcggtacagagatagcagtttgttccttcctccagtgatgactcctccccttcctccagcgatggatcctctctcaacaacatgtgttcctgaagcagaagtaatcgatctagagtcggctgaatgcaggagcggggcaacaatggcaaaatcgatgggccatagcagtggatttcatccaaagcagcaggttagtattcgtttatttttgtacggcaagatcaagacacgttgcctaaaattttcttctttgccgcagggtcacaggaaaattagtttgtcaccacagtccaaggtatgccacctgaaattgaatacatgtatgcctgtagagagggattaggtgtagttcggttcatgtactctctcagtttcagatgctaatttttccccttttagtgcatatgatggttttttgggtggatgaagttaatgctgttttagcccccacccccataaagaaaaatgtagatggtagtacgtactgaattttcaacggtatatactcattttttctttggaggggaactttttggaatctgctagacggtattaagtattgatttttggtgtggcagggttcttactgaactctctgttaggcaatagtatatactgaatttttatgtggggagctttattctctactttattggacgatagcatatactgcattttccacatctatactgaatctttccacagtgattcatagactgaactttgatacgcaccagtatttactgaatttttcatagatatactgaatttttctatgggaggctttgtactgagctttgttatacgacagcatatagtatgtactgaattttgtatgtggtacatactgaacttttctagaagatagcatatactgcatttt

SEQ ID NO: 94927 - DNA, 1964 bp, Oryza sativa
ttatttactttgctactattttcaaccttaccaagttttggcattgccaaattttagtaaggttgccaaaattttggcaaggttaccaaattttggcaagatttcatatgtaaaaactaaatttggcaacaaattaaatataaccacttttttggtaactttgcaaaaaaaaaagtaaggttgaaaatggtagtaaagtgaacaagcccgaaaagctcaagccaacatgatattcaaactaagccttactcttagaggtcttaagccaaagagaagtgaaaaaaaactaaaaaatgctaattctaatattatgttctaaaatcgacatgtaatccctccatttcacgatgtaagccatcctaacagttccaacatttatatggttattaatgaatctagacgtatagaataacttacgttgtgaaacggaggaagtagttcatagctaaaaagaggtcgtttctcaaataaaaaatgcctagaatcgctaatgcgtgcgcgcgtcctcccacctttttttctttttttaccaattttttcgttttttttcacactttttttctgattattttttttaatcttttaacatgttttgagtttgaaagttttaaaattttgagttgaaaattttcaaatctgaacttgaaagtttttgaatcttcttgaaagttttcaaatctcaatttgaaaatttttcaatttttttcaaatcttgatttgaaagttttcgaatctcgatttgaaagtattcgaatcttgagttgaaagttttcaaatctcaaattgaaagttttcaaaatttttaaatctggacttgaaagtttgtccagattgagatttgaaaacttttaactcagatttgaaaactttcaactcgagatttgaaaactttcaagtacagatttgaaattttttaagttaagatttgaaaagatatgaaaactttcgactcagatttaaaaaactttcaactcgagatttgaaaacttgatttgaaagttttcgaatcttgagttgaaagttttcaaatattgagttgaaagttttcaaaattttcaaatctcaaattgaaagtttgtccagattgagatttgaaaactttcaactcagatttgaaaaccttcaagtacagatttgaaattttttaagttaagatttgaaaagatatgaaaactttcgactcagatttaaaaaactttcaactcgagatttgaaaactttcgactccgattcgaaaattttcgactcgagattcaaaaactttcaactcagattcgaaaattttcaactcgagatttgaatactttcaaatcagaattaaaaattttcaatttaagattttaaaacttttagctcaaaacatttttgaaaaaaaataagtgtgctaaagattaaaaaaaagtaatcgaaaaaaaatcgcaaaagaaaaagaaacaacaactcgtgagaaaaggaaaaaatggctgatgggttgatgggccgaaagcagttagcaagttggcgcgcgtgccaactagcaaccccagaaatgccacgataaaacacgcttgtaggcaggacaattggaaatttccagtttcacgatttcgaagtaggctcgtcgagacgtcgacggcgtggccgtaggccaacacacggggtgtccatgagaccatgatccgctgcctacgtacggacgccggccccacccagatgaactgccctcccctccaccgggccccaccttctccccccgtcggcccggccggcccgtcgcacgcagcaaaatatctccgcccaggcgcctcgccagtttgtttcttgtgtactgtagtaattaacaacccgttccaccaccaccaccaaagacccggtgcacacacggaagcacgaagcgaagcgtggggtccatggtgtgtgtcagtcacactgtgcagggcacgtgggggcagccgctcaagtgagctgtccttttatctcatgtg

SEQ ID NO: 94928 - DNA, 3143 bp, Oryza sativa
ggccctccgcgacccgctgccctcgcgccggcttggcagtagcgaggagaaggagacgagaagaagaggagaggaatagagataagaatgagaagaggagataaggttgaagagatgagttaaaaatgagaggaggagataaggttgaggaggagagaggagttaaaggagaggaggaggtacctcgatccgatcgtgcacacctctccgatctccgcgtcgatctttactcccggttggttttaccaaccgggactataaatagatctttagtcccggttagtgttaccaaccgggagtaaaacatatggcgatcttttttcccggttgatgttatcaaccgggactataaatagatctttagtctcggttggtaacaacaaccggtcctaaagattgaaaagtatcctgtagcttttaaaccgggactaaagatatttttagtcccggtttttaatacaatcgggggctattgtaaaatctggttgaccgactaaagatggtttctccaccagtgtaattagcgcatcttttgatgaatatacacattttgtttctcaatgacacagtgtcacaacgagtagcagccggtgccctgtgacgccgatctatgtacatgaaggtcatgctggatccgatatcgctaattagcgatcgatcacctggggtgattgttcttttttcatcactttattttttttcaccatatagtttttcttttcggataagtttacatatctaaagtttatttataggtcaaaagtttatatatatatacctgatttaaatttaaatttagattttgatgtttttatatagaatatttatataaaaaagtttatacatacatatgaagtttactgtatatatttataagtgtaaagtctaaagacatggatatatttttaagggacatggatatatttttaagggtattattttgttttttaaatttatttttttatttatggtgcagtaggaagggaaaaagaggaagaaacgtacgtgttagggggagagacgggggtgcccgatcgctgtgggcgatcaccagcccattagcccttccccggctggatcgatcgatcgacgaaaatattgactgacgcacgtgcgaaattaagaagcacgacccaatgcaaatgtcgtcgtcatccatcgtcgtgcatgtcacgtagccatctagccgacatgcatagtactaatatactttgattaattagcaaatggattaatttctctttcactaatccatgggcaacagtatacagtacgatgatcgaagatcaaactaccacgaattaatgtagtgtcttttgttcgcaaaaaattaaatacacgcgcacgatcacgtacgtcatcacgtacgtgtgctagctagctgtgacttgatggatcgatcgggattgggccggggagttggtcaagattcgccatccatgcaggcatgcgcgtcgatccatcgtgccgtcgtcggcgtgcgtacgtgcatggtggccgccgctcgtttccattccgcgtcgcatgcatgcgacctactcctccgtcaaaaaaaaaaaataatcatatccataaatctacatacacacgtgtcatattcatagtaagtagttagaatttatctttttccatagcagagtagtagttagcactgtgctactctctctcttcctccccctctctctctccagctcaacatatatcatgcatatttccgccgtgtcactgtcctggccggccggggccctcaccgccggcggctcagctccctgcgcgtactactgcccttgatctccagggctgtcccaagctaagatctgggaccctgtgctaaatataaattaaataagacctcatacgtagtgttgataagtactgtttactgggacaaatctatagtataaaggccagagtgtcagacaacaccgatgactttcgataaaacttatagcgaaattgtttgtccatatactataacaccatgatctaagtataattagcacactatgacactaatagacacgttataacactaacgcatcaatttttttggatccgccaacttagtaatggtgatcttatatgtgtagagctatgccaaataagattaccacctaattaagtagtggcaagctggctagttaagtagaaaaagaatcgccgcatcaattcagtttttctaactagtgtaaaagtgaaatccttattacctgaaacgcatgtttacattatcgtcatgaagtaaagttccttaatgtacctatcattatcatctaacacttgctagagccaagaagaataaatctccttctagcctaattcaatgaaaccaaaagagaaaaagaataggttgaaaagatcctaaacattatcgctcatctcgcacgtgcccatggacggtcctgttgatctcctagggattcaccaatcaaccactatacctatgtttttttcctcctcaccccctctctcccctcccaacttcaattacactcgctgccatccctcactctccgtctccagctagctctcccacttggcaatcgctgtctctccccttccctcttcagcggtggcggcgacaatgagctcagttatccctctctagcactttctctccactcttcaaagatggcggcaacaagcttcccaaatccattcttccctagtggtggcgaaggcatggatctaggcaagccagcaacaaggaggcggagtgtcaggggctcggagttggagatgagatctaagcgagtgaggtgtcaaccttagtggtagcgaggatggtgcgatgaactgcatagatcgaggtggcgggtagtgtagattgagcattgtggttgtcgttgctctaggcatccttcagcatagatcggagctgccctctgacaacgagctcgccggagtaggccgctttgtcctccaccattgcttagattgacaccatcgtttctccttctttctcctctgtcgtgccaccttcttccaggagggaccacacgcgagggtaagtggaggcagggacgtggccgcgtgacctcccaacatggatgcgtgcaagctatttcctcacttgtagatggacatcagtgatttcgccaagaaacaagtgtcctcatgagggggtagtccaatcggccgga

SEQ ID NO: 94929 - DNA, 682 bp, Oryza sativa
cgatacaatcgcagagacactgcataaatgcatatcaattctaggcaacaatcaagtcagatggggaacacaaactcataaatgagccgataaggaatggcaagcgcggtgattgaccatgtaatgtaaatctaggaaaaaaaccttgtggattgcttgcagaagagaccatatagcacagttacaagctctagagaaaatgacacatgctagcagaattaacttatcgaactgctatcgcggcttagctttaaagtaaagcagcctctttactttgtagataagggatcggatagatgcattattggtaatgtaataaaaacgaaatatgcaggtttcaggaaaagggataattaggaaaccccgacatatgcagagttcaaacctttgaacaatctctaatcttaggagatcatcggatcacttccaattacaaactgctctggcctgaagtttagtttcttactgcaacccgtaattcaaaaatgctaagcaagttagtgtatgaaacagtttggcagtgagcttcttgaagccaaaaagatgcaacaaccaaacggttggggaaaagaaagtccacattattcagcaaaacctcatacacattacagtgaacaccgcagttacaactacagcgaatcagggccgcagggcgcggcgcgactctacatgagatcagaaa

SEQ ID NO: 94930 - DNA, 1383 bp, Oryza sativa
caaggtaggctcaaatttgcccgagagctttagccaattcagtggcacgacatcaagattgaagagatacaacaccttaatactccctccgtttcacaatgtaagtcattctagcatttcccacattcatattgatgttaataaatctagacatatatatccatctagattcattaacatccatataaatataggaaatgttagaatgacttacattgtgaaacggaggaagtatcttcttatggaaggtcataattttacgaaacatttaatgatggccccaaaaagattatacattaaatgtccttcttcgacatttcatttcaaaaggagtactaatgattttggagggagaaaggacaaaggtcagataatgttggacattatgatagatttaatctaatagtctctatcatgtaaaagtatgtatatatataaatatatctataaattgaaatattctatagaaattttatcaaggagtataaaagcatgggagcacattcatgttattttagaatccatactattcacatagattaattttgatcataattataagccttataggttagagcatagggtttggacatatgaaaataatatagccaagtttctgtaaacatagtccaaacatatatgctcatatacatacacgcgtactcacccatatgaatgcacatgtgcacacttatttctaatagcacatttaagagattagatcattggaccagtatatgtcgagattatcataacctacaacgaaaaaaaaatgaagagttggctggcatatgttgagaacctcgcgagttaatagttaatcgacatatcatgagttaacctcacgctttcttagattggaccaacacgtacatattgagggtaacaaagtcttgttaaagaataattatctgtaaatttaagcacccgtactcttggaatcacttaaaccccgatgtgcaatttcaactataaggaaaccaactagcttagtccgcaacatggtcaggtgtttgttataaaagctttcgtaacattatatatttattgattgatgtaataacttttaatttatgtgaaagaattaggtggtgaaagttgcatttcattaattttgaaaggtctaacattgttttggaccgaagagagtacaacaaacctattccatctgttctaactataagcatctctacaatttacttaccacagttcaagtatttcaaaacaattgaatatacagaaattcattcattttcagttaatcaggcgtttgaaaggggaatgttagtaatttaaaattcaaaattaggctaccaaggtgacaaagagaatggagtaaattgcacccacggtacaagaacttggtgtagatgcgtgcgattt

SEQ ID NO: 94931 - DNA, 1773 bp, Oryza sativa
tgcaatgcaatgcaagagtgagagtgagagtgagctaggctttagctaagctaaggtatatgaatgagctcgagctaagcttagcttgtgtgtagtgctcaaatgggagggattcaagggtggtatttaaatgggtcttggacagagaggtcactgtggatgagatggcagagaggggtggcatgcatgcactgcacttgtgttagctagacctatagctgcatcatatcaaggttagtttgtaagtattcatcttgttttccaatgtgaggtttggatttgtgtgccctaatttaaccttaggaccagtagaggggaatgttgtgtgctactaatgtttgtgtgtgagtgtgttgcttcaaaattaagaatggttggaatgttctccccttagttttcatacacttcatttatgatgacaatgcatgctagctctctaccacacatgtatgcaaagttatcatcctataggtataatatgggggtatggcatacaacatatacagtccaacaccaggcagcatctgaaagtgccacattaatcaagctagtgaccaagaagcccctgccaaagcaactctttaaattttgctggtcctacatatattctaattgtggtttaattaagctagttctaataatttctgccttaagcttgcatggagtcatgattcactcctgagttagacagtattacaaactaatcagataatgaaaagatgcctgccactgggttaggaaaaggatcagggaaagaagagaacatatgtaacctagtcatccacctttttaacaattgtaatttgtgtgctccaataaattttaaaaaatgaaatctttgctccaagatactacttctatagctatatattatgatacatgtcaaaatgctactacacacaataatgcccattttttacaggccatatggctttgctttccttcgtatccatgtgcttgcttgcgcaatacatgcatgcatgcaagttaaaaagatcaaacaaaaaaaaaccttaaagctatacttatatttgcctcattgcataagcacttaagaagctttcaaatggagtggttagcttgccctcaaaactagatgaacaacagtgtgaaatgtgtagaagggcactctttctcatggcattccctgtgtaatttttttggtatatttcttttggttccattcatgcaaccttgagtgacactcacatgaggtgagggtccagtgggtctccccttctttgactccttttctctagtgaagctttgctttgttcatttgcatgagctagctagacagattaattaaaataaaatgcttgtaacgatcattatccctcacaattcccattgaattcttgccgataatttaatcacaatggacattctatagattagtgcgcatgtgcgtgccggtgttaggttcaaatgagaacaaatcgaaaggagtgatattaaatcagcaaaacaagagaactatccctttcatgtctctctagagccattttaataaacctaatagatgcctttttggagtcaaaaagaaagagagagagctagagctatagccaaaccggagagagacgaattgaagacgtcgtcgaggtggtaatgcatccaatgtatatagcaacatcaactcgaccgactgttaagtgtgtgccatgtgaggtttaagcaaaacaacaactgaggtggatactacttttcaccggccacctgtctaatttctcctccacattaattaattagctgctgtgtaatagcatcttg

SEQ ID NO: 94932 - DNA, 2943 bp, Oryza sativa
tgggccggggcaacaacgcgattggcacgcggaatctgcaggggattggtacatgaagagatgagagagcccttgtcgcacgacgagacatgcattcgcgtgtgacgtactctcgcagtctcgctcgctcgcctcatccgtggaagccaaccaccgagcagggccgtgcttccggacgaacggaacggaacggaacggaacatgcatcatcatcccggtggtggtccgcggggcggcctgcccgttttcgcccatgacgataaggcaccaccacgtcgctgtctcttccatttatacttactccctccgaataaaaaacaatttttaactgtgtatatagacatagccgcttcatcagctaaaaaaaacctaacttctggctatatatttggatactattataacttatgtcttatgtccagatacatagtcagaagttggcttctttttttttttttacagagagagcactttacttaagggtgattggttggttatttcacattgccaagccacatcatagtcatgccacatttttcttaggtattcgtttgttttgatgttataatgatatgccatagtttcttagccttgggacccacatgtcattctcttaaatttgaaacagagtgggtgtgttcggaatagcatgtttccggcatgcacagcaaacacggaaaacgaagcggtccattagcgcgtgattaattaagtattagctaatattattttcaaaaatagatcaatatgattttttaagcaactttcgtatatattttttttgcaaaaaaacgcactgtttagcagtttaaaaagcgtgcgtgcgaaatacaatggagaggggctgggaacatagggttctaaacacagcctgtcactcttgtagccaactttttcttagtcatacgtgtgtcataaattgtctatggtaaggatagaatcaaccaaacacccccttagcttgctagctaagctttttttttttaggaaaaaaaatcgctggcttaggtcgtccgagacgatgaccgtactgacccactccatctgtttttgacttttgactgcctaattaggctattggagacgtgttccgtctgacagctccatcgattgttaaaattaaattgtaaaattttattttgaggttgattttagtttttcaattgtagattaccttttaatatttgtcttaatcactaaggatacaattgtagtttaccttttaatatttgtcttaatcactaaggatacatatataaatgttaaacatcaaatatttttaggtgctaataagcactgctcagtaaaaaaaatcaaaccctagatttcaatctagatataaggtttaaattttttttggaacgaaggggatacacggataagaccatgagtagttggctgaacagctgctgatggtggcggtggtgctctatcagtgtttatctgctcaagggagggagttgccaattgcagctctatatatagagagagagtggcgatcatggatcacttgtttggatgtgaacgattcaggaattgtcatttgtggatgtgaacgactctgggaaagcctttttgattgtgacgcatgaattcgttgagtgtagtggaaattaggccgtgtccgtgtgtggttcatgcctgatgttgattgatgtttttctctcaaacttttggaatttgctctttttatcttgcacggatgaagtatttgagaaacttttagaagcacaggacatgggaatctggtagttcgttgccaccttaaatgattcaggagcttgtcttttgagcgtggtcgaacatggtatatcaaacaagtgcgccacaagagtacatatatgcaaattaaaatttatacgttctaaaatactttttacttcaagtaacatgcaataacgttgccacaaccacaaggttatttttatgaacatctagatcaaaagccaatctttttacaaataataaaatcatgtaacatctaaacattatgatggagatatctgacagagcctttatgtttgcaagttagacaatcttattgtaaatcagttacgagtactatatactaaattttttctatttttatttagacaaaagacttaacttgcataatcgatatcgatgttgctgtaaactgtaagcaacagttgtgcattagtccacatatttttagccgaaagcctttgtttatgtaatcaattctagtgttactagtagaaactataaagagccgtttatattttaaagtactgtaccagtacttatatattactttcttcgtttgatactataaagttgctttggttttttttattaccaaatttctttaggtttgccaaatttatagaaaaaatagtaacatcaataaaattaaattagtttcattaaatataacattaaatatatatttaataatatgtttgttttgtaaagaaaactgttgttatatctttctacaaacttgatcgaatttaaacaaatttaactagtaaaaggacgacttataatatgaaacgcagagagtagtataatattcatcgtagataattacataaacctttaagcacaacatagataatcgcctcataagaaattattcttttacaaatttatcacaacaaaatataattgtccaaacacaattaagattgtagcttgaattggccgtgacacataaccacctccaaaaccaaacacgctcttctttccgaaggagaagagaagagaaagggagaagaagggaacattccaatcaattattcggctgcgaaaaggcaagccgcaaggcagctcaacgcccgtaggcagggagaaagggaaagaaaaccagcaaccgaacgaacgaacgacgccaccgcccaccacctccaccaccaaagccccccccccccccccccccccccaaaaaaaaaagggtaccgagctcgaattcgccctata

SEQ ID NO: 94933 - DNA, 907 bp, Oryza sativa
gcttatctctgatatcgatatccggcagcttgtcttggcgtgtgttggctcgatctgttgtatgtcgtgtcttgattttttttgttcctccccccctcctcctagggggtctatttatagtcataggtgtccccttatctaagtagaactagagagactaatatggatacaatccgagtagtccttatagtttccatatagaactctattcgttcttgcttatccgaatctccttctatatacgagatataattccgtataagacttggtacttggtgggccctatcgagcttagtcaactactattatgtatgtggtatacataaccatgacagtaacacccgacttcaatgcaaatgaacgagttcatgttctcaaccgaagacctttgaaaaaccgttgtcgtgctcacttgaccgttcttggtggcatgaggaactagccattggcatggtggatacaggacctcctaagggctcgacatgtcgtgtcgagaacatgaagaacggcgacgcccatggctcagcagccgtcctcgccattctcatcttgttagcgagctcaatgtagataagaggaggaaagaaggcccaattagcatcgccaggcgccatgcctgtaacgccccgattttcgttcgggattaaaaatcaattaataatgcatttctagaaattatattaaaagttaaagcaatttattcgaatgaattgatgggagaattaaaattttcccttaaaaatcattggccgggaatattttggaatattttttgtgctctaaaatactctccggaatttttcgtgaattttcggagctcgagaaataatttaatagcacaaattttatttaatcaattcaaataaaaagaaaacaaataaaattttcccctctttgtctttgggcc

SEQ ID NO: 94934 - DNA, 3360 bp, Oryza sativa
aagttgcatagagcatttaacaaacaagattgatgaattagatttcataaatacatatgagttttacgtttgggtctgcaatttctgcagagataaggtaattgatctgtcgtcagaagtagttaattcaccatgctatctgtacaggttgagactgaacattgtgcttgtagctaggtggagtactactcaaatgtttctaattaagaaacaccccctttaggatatgaaactcctgtttttatagagaaataaaaaaaatagctctaaaaacgccgcctcaacattagcttttcttgtagcgaaaacatctaaattcacagtgcaactgttgagttcaagatttcgtctacttccatctaaacatgtgaagcataatgccccattattcatgcatctgaactactacgtcagtggccaatgcaaatgccatcacctaaaaagaatcatgatcaggagtagggccagaagttgttgtcaagccatggcatgtttggtgaactagcacggccaagagatgctacaacaccggcaaatggtggcgtcatgggcatggggttcacttaagcataatgcatacactcatggacaatttagggaaggaattgaagaataatcagtccatcaatcaatcagcatccttttcttagatcatgcttggtaaatgtgaagttctcttgtttgtttgtttatggtaggtgttgttttgagtaagctgggtaggagtacttgtttttggtgactctcactcattgacctgagctggtggtgattagttaaaaaaaaatggaaatgggaggaagtactacatcagtacatgcatatacattgcaaaccaccacaaggaatcaggcatcagcatcagcatcagtcatcacttggatttgtctgcgtttgtgtgtgtgtgcatcttttgtgcatgcatatatgggtgctagtataactttatataggaggcatttacacacagccacagcagcagtgtactgctctgaagatctgcaatatatgttgcttggtgttgccgaaaaggagaaagtccttcacatctatcactgtctaactctccaccagaagcaatttgcattttttgcattcctcacctcacctcacagtaacatagttcttgacttgtattcaaattgaaggcttgtttgttaatctcatcagaattcagaaaccatccaattcatctttcagaagaaagtatatatatatatatatatatatatatatatatatatatatatcgttttgcctgatctctgagcatgcttagtttctttgttacaaaatgctgaaccgagctgaactgaaaatttcagaaatgtgtgatgtgcaggtggagataacatgcagagggagacagctcctcccgatcctgacattgcagcatgtccgtgacatcagtaactgcttggatattttttattcatctattatactgcttgaacagtagaagaaactaggatgatatggcagttactgatgttttatcttgtgcatatgcagtgctgctaagctcacttagaagatcttggtcacgcggcatccggtgaaattttggttgctgtgattgtatttggaatgtggctggatttggctgttaactgtgttgtaaattttgtgttgtattggatgtttgtcgggttgtgttgatgctaattgggctgtaacatttatgctatatgggtttttattgtgtttgattgttgggcctatatgggcctagcccacttgttatttgatactaatataaatgaatataatatggcgggctgaaaaatgatgtggtataatgtttgggtctatatgggcttttgtactggacttggcccatttattatttaagcaaatggatataatataattgggttaaaaatatgctatatcatagatgggtcaggctaaaatctagtcgggcttgccattgggctaagctcataaacaaggtactcaatacatgaattttaatgggccactagatattttatgacttttttagactagataatgacgaatatgagcatcataaagttactttatgacgacagaaggatcgtcactagattaatgatgaaaaaataaggtttcgtcatagaacgcctttagtgacgcatgataggtgacgggaattttcgtcacgcgagtgtcacagattacgaaacgtgacgaaaattttaatgtttgtgacgtaaatgaagcgctatctatcataagatctcttatagtggcttcttgcctgcacctgcgcactcttgcgcctggcgccacaatccatgccacgaaccgcaaccgcacactattgggtgacttgtgctatattgatattggcgataactggctactacgactacgacaactttatctcggctacatcgactacggcacaaaaggctatcatcgtgttgggtacttttgccggttttttctccagtccaagtgtccgcactgctcacgcttggactgcgggggatgttaaagtatatggtagttagagtcatattagaatatgattgatttgggtggactcattccatatatgtaatcctttcttatcctccccatgtacacctatatataccgccccctgagactcaatacaatagttttatgttacgcagtatacctctcctcctataatatccaacatgacaatccaaagcaaattaatattaggagacttgcaatacctttcgacgtgatcactgcaaaatcagtgtgttctaaagatcaaaattcatacagcaggtgatgatcgagcatattgacaaatgacgaatacaagaacgagagtgtatccacgcaaaaaccacgagccgcttctccgtcgatcgagatagtacgctatgtcaccacgagccgcttctccgtcgatcgagatagcacgctatgtctccagggacgctgcctccgtgtcgagctcagccgcgcgcctctccagcgcagaggcccagtcacgcgagcggatcgtgtcaagcaactcgctggcctggagaatcggctcggagaagcgcttgatcgagaggtaatcgaggcaggccgaatcgagagcgcggaaatcatcgtggtcgatgtggctgaggtgaagccataccttctccatctccttgccatgacggatcctggcacgagctacctcctgtgcggaggctatctcgtcgtcgtccagcgacaccaagtcccacaactcggaggggatccgcttgccatcgaccatgacctcgtcctgcttcccctcaacctcctccccctccccctgctcctgggccatcgcggcgtcctggacgatctccccctcctccaggtccatcccggcgtcctcgacgatcctatccgtcgcatcggaggaggccccct

SEQ ID NO: 94935 - DNA, 714 bp, Oryza sativa
attattagtttattactacagtattttattttatggcatcgaatatttcgggtaggcaatattgagaacaagtgatattgatggaaatatatttgcctaaataaaagcttcatgaagtttaggcaactgtgacaaatccgaacttcttctaatttctaaaacgaataaaaatcaccaattaccttagaatagtttccaattccaattaccaaccgcagatatatatatatatatatatatatattaaaaaatccctttcatgtgaaaaatccctcaacgtcaaccgcgtgggacccaccagtcactttatgggaccccacacctaattggcgggaacacataacaaaaaagaaaagggaagaagaacaaacttgctaataacattttcccgcgattccaaaagttaggtacgaaatccacccggggggaatcgatccgacggcccagacacactcgggcccacacccccctcccgcgtgtgggaacccattcctttcttgtcgtcgcggtggccgttaccgttacgtgctccgtcttccctctccgtctcgcggaaccactttttgcagtttcccccctccacaagccggattattattcttttattattcctttccctcctctcgagtccgccggcttctctctctccgtcgcctgcctcttcgtcactttcaaagaccaaacaaaactcgagtagaggagagagatagagag

SEQ ID NO: 94936 - DNA, 2646 bp, Oryza sativa
tgatctcatatattatagtataattatagtataattaagcaataaaatattagttcccatctagtcactccaacgtgattagcatctaccctgtggtagctaatgaaaaaaatgaggtgtgagtggatgttcagaatcctatggaattcccgcattttcacagggttgctatagtattcctacaaaattcctacacgtgcttcctatgaaccgaatgcatgaacatggccaaatccaaaggatttgccaatcctacaaaatcctgtgtaatccctccgttccgaacaagccctaactaaattgctgcacaaagtagtatctaatgtatggaaatgttcatctgtatatgtttcatctttactgtttgagaatccgtttttgctagaatgcatgaaacagaatgatcaaatcttagcacatctcaggtattcatttatgaaatattttctcttttctgataaaataatgacaggaatttttctaatactaaatcaacacattcatttgcacatatctatttttaccataccaatttattcatggtttggtacatataacagttgattcctcaattctttgttcgttgtgtgtatgatgttgaaatagctcaatgattatttctacattcaaaatagaaaaacatcgacaactacattttaattgttagtaagtgattttgtatattaattaatattttttcgagaaatgcatatttttcatgttgcgtatgggctacgtatcgttacagttgtgaacatgtagtactaataacgtatattttacgcacgtttaaaattgtgaagagaatttgcctagcattttcagggaagtgttttcacactcttggccacttggcattggcttgcctcttggttgttgggtggtacaatacgagggcttttcatttgaccgctgcttgtacgtatatatagcagccaaatgagttctttcgaaattctaaacatgctcaaagacttgcaaaatctcccaccttgcaaaatcaacatcaatattgatgtcaacatgcattttcataggaggatatatatggatactaactactccctaattaagctcagaattataagggcttacgccatcacgcgaggtgctcatatgaaccaataataaaatgaatatcatctgtttaattataaggagctagtactgtaacaaaactgtgaaaatgattaaaatttaaaaaatatactactaagttggtgtcgaatataattatttgcaaccaacggtgttctttcgaagtaaaaccggaaaacgacgtacccaccacaacggtacaaaacctaacactactggcacactactagtcggagcctcggaggaggtgagccgtcaacagaagagccatcccggccctgtgccggcaacgaccgtcgaccgctaattctcacgtacgccccgacccgagagagcctctcgccgtccgtccggtacagcgaacctcaccaccagcgtagccgcctaccagctgcgtttcaccttcgccctcgcgagcgcggaaggcggaagcttcacgcgattcacgccgacccgagaccgagacctcgtcgcgcatccgtcgtccgtttctctcctcgcgtacctcgcgacgatcgaaaccaaacggacgacgcgggcacactggcacgtcacgtcgacacgtcctgtgccgcggggccctgtcctgtcctcccgggctcctcgcggccgtccgctcgctgcgtgacggcgtgtgcgggtcacctagctagctagcgccaagagaggaggagctataggagggggggttttagcggcggagagaggccgtggccccgcgtggcgcgcgatctgcacacctcggccgtccgtgagggaccccggtcacgtgggacgtgggcgtgggggcgcgtactgtgcgggaagatttttttttcggggtggggcgagagggatgcaccatactccctccgtaaaaaaaaaaaatcaaaccctaagttttcgtgtccaactttgactgtctgtcttatataaaatttttttataattcgtatttttattgttgttagatgataaaacatgattaatattttatgcgtgatttgtatttttaatttttttcataatttttttaaataagaaaaacagtacaacgttggacacgaaaatcaggttttttttttttggcggagagagtatgccaatagcccagtacgacgacggacggacgctgcagcacaaggcgctgtcgtttaggggtgcaatttggtcgctcgcgtcgtcgctttgtgggcgtccgcgcgctatttccattctgctgcttcccctgaatggcaactactgctaagctagtatagcaagtggtgaaattggtgaatggtgatcgatcgcctcgcggcttggagtggagaaggcgctctcgatcagatatccagatcgatcggaactagcaatgggtgatcgtgctgtatgaattaggaaaggctcgtccaagaaaaatggtactgtaatgttactactattcgacgaatatgggcaaagctcccgttttcagggaatcgagaagacagacacatatgctatgctatacaacttgcacgtacgattgatcgattccggatcgtactgacgtatttgtaacatactcgatctctcactctccgtgcc

SEQ ID NO: 94937 - DNA, 2088 bp, Oryza sativa
tcgcccggtgcggagggagccggatcgggcactccccccgcgccccctcccccacgtgcctacttaggcccacctatttatgctcctcttttttccacaaaagatgtttcacataatgtatttacaatgtttcactatttatagatctaatgttgtagtaaattaaaatactcttttgcaaaaaaaaaaacccacatattttagaaactctctattaagggaattttgtttattttttgttccacccaaaatgtttcacctagtgtactcataatatttcactatgtatagatctaatgttacactgaacgaaacattccattgcaacaaaaaacccacatattttggaaacccctattaagagaatttggtttattttttgttccaccgaaaaatgtttcaccgagtgtactcaaaaatgtttcactatgtatagatctaatgttgcagtgaactgaaacattctttcgctatttgctgaaacattgtttttatataaggtgaaacaacacccaatttaaacgagtgaaacattttcgatctacttagtgaaacaattctgatatatctggtggaacatcttgcaacatttaaaaataattcaataataagataaaagaaaatttcgtcgaaatatatccatgcgtggtcttgttttgaagatttaattgcaatgaatttaatagtgcaatcggatcatcatttggataagtagtttaagagataaatcagtttaaagtaattttgcatgtaaatcggacgctgacgtcagcgcccgattttaccctctcctgatcggacgcccgaccaggagtcatccaaaaaaatctatacgtgaaaaaaaattctcacttaaaatttaaaacttttaactcaaaatttgaaaatctaaattcaattttttaatattttcaactagaaatttaaacttttaacttagatttgaaacctttcgacttaagatttgaactttgaagtcaaaatttaaaaaatttcaacttaaactttgaaaattttcaactcgaaatttaaatttgtaagacaaattttaaaaactttcaagtcagatttgaaaactttcaactcgagattgaaaactttcaagtccatatttaaaaactttcaactcaaatttaaaaactttcaaattttaaaaaaaagaatgaaaaaaatatatggaaaatacgctgaggggagggaggcaaaagggaaaaaatcacgaaaaaaaaggaaaaatcgtgctgaaaatcgctaaaaaaatcacacaaaaaaaagagaaaaatcgggaagtcgcaaaaaaaaaaaagccacgtggccggtggaggggcgcgcgccaattagctcccccgaccagattgggccttaaatagacaccgttgtgtgcccatataggtttattgaatggaaagaacattattttttatcctgcatctgcttttattttctctacgaagagagtggctagggtatttcaaagaattttatgagttaagctaattcatttgaacttccatttaaattttggtgttcgaaagaaatcagtacgatgagctcacatccttgatgaaaaatgggactagaaatataatcaagttgagcatgtgtacattagttgtgcctatatgtgcttttgtatactactcctgttctcaagcaatagttatcttttctagtgaagtaaaatctcctaggaatataaagtatttttatctcaactttaaactctcttaaataacatattatctcttatattcgtggcctgataaagcatattattacttacaagttagtacaactaatatactactagagggtactattctttcttattgttttctttttggaagatcactagcaaagtagtgctactcttgctcgctagaacgttctgtatgacaacagtacataccccaatcatgtggctgtaactagcaccacgagtaaacttggccggatctacctaccgccagcctcttgaaaccaaagtgcatgccaaacagtctcccgtcccatactgccatacatacacacacacacacaagagtacacagctgaatatatatacgtgattccgtgtgactacttata

SEQ ID NO: 94938 - DNA, 641 bp, Oryza sativa
caaaaaaataattaaaatatggcatatcttttttatatttaccaatatttttcaaaaaagatgaatggtcaaacgttacacgaaaaaatcaaagcgaccactattttggaatggaagtagtacctgtagagaaaaattaaatattagttcttaagtgagtgtggaccgaaaaaattccttatttatcataaacacgttttccaaacttttaaatgatatgtttttttaaatatataaatgaacatgttctttcaaaaatcaaataaatcactttttcaagtttgtactgattaatactagactaatcatttgctaattgtttatattgttttacttgccatcataactcatgccaaattgcttttccaaacccaccattagccgctgtggcaagctcagttgctagcttgaggaggactatacaaagttgcacacacgccatggtactaacgagaactggaaaatatgttgactggaaaaattgtatcagttcatattagaaacaaattactgtcagaatgaggaaaaactcagtccatgccactaaaggcatcagatgcgaattggcgctcctttctcctttcaaggagtaggcataaacataggctctgcagtagtttcatctgaaattttaagatcag

SEQ ID NO: 94939 - DNA, 1777 bp, Oryza sativa
ttttgggacggaggtagtattttttaattccgaatttcagctatttctatatggactctgctttttctttttttccgattaatgtgagaatttctaggccatgagagcgaacgtggaggctcctttttctattcctttaataatataatagatagatagatagatgattttaaaaattggggaaagggaatagtgaagcaggaaagacttatatgaaggtgatgcaatagtatactccctccgtttcaaattagttgtatttctatgattcaaaactttattctaaaatagttgttacaatgaagtactacttatcccatcaatcacttctaattcaaatttgtttcttttctaccctcaaccatccttccacatccaaccatacatcatttaataaatggtattatatattttcacaaaccttaatccatactaaatatcggtggtagagatgatgtgaaaatagacaccaccactattaatattttaagtagtatagatatgcttgtgatgttctttgtgtgtgaactggagtactactatgggtttgtttggggagattaagattctgagaatcaacttgttggtagtcagcttctgagaatctaaaaaaactgggttttctaacttttagtttctagttctttttctgaattcaactactgcaatttcttagaatctgaatccctgtttgaaagaatttctgtctctggaaaaagatgcagcagctaaaaactgttccaaataagtctatgtaggatgggtttcctgtagaaccggttgtgtgctatccacggctaagttcttgtgatttccacaaagaagttttaattccaacttgtagtttacgaactacaagttgcttgcatatgtacagaattactcctccatctgatgagagagtaccttgttccatctaacgtacagatatttaaattggattaatatttcctaaagtcacttagaaaagcattatgtttgcatcgggaagccatacatggttggctcacctatatttattatactccgtttaactagcatagattgcgtggctagcatcgttatatttttttcttataatagcataaatattttcatattctatttattaaaataaattaaaatgataatataattttaaattcttgatcaaactaacaaatatgtgatattcttattgtattgtatatacatgatagttattaattattttataatttcagattttagttatttataaattgtattccaatctagacctagactcatctttcaatatttcttattattttaattttgaattttcattattcataaattctattcctataaggaccttggactcctcttccaatattcattttacttatttgtaaattgtatttctatatatactctaaactcttcttttaatattctttttttaattttgtatttcctttattggtaaattgtattcctgtatggactctagacctttttatcaatatttattttttttaattttatttatttataaaatgtatttgtatatggactctatacctttttttaatattccttatttgttaattctaaatttcagttatttataaattttattcatatatagacgctagactcctctcccaatgttgcttattttttaaatttttaattttttttctaaattgtatttctatatagactctaaactctacctttaattattttttaatttcaactgtcacttagttctatattcctatatggactatggactcttcttccaatattt

SEQ ID NO: 94940 - DNA, 1145 bp, Oryza sativa
ttcttctttccttcatgtatttcgttttcttttcattcttgtttttttcctttcttttgcacggatcacagagaaaaggagaataaagggaaaaaaataaaaaggaaaaaaataaatgggtatcatttatcagtcaaaataatgccacgtcatgtctgtgtggcatgccacatcaacgccacataggatcatgaaggggttgtggcaatttgggacctagatgacacactatgacaagttctgtgacttggatatgcattttgagagtttagggatccagatgacacacccatacaagtttaaggaccgctcatacactttacttaaaaaaaatatatatggcttttggcggaacgcaagcttccagatataagcttttcggcgtcggcgtcgatggcgagcggcgtagagactagagagacgccactgctgctatccatgatgagaaacgccgttcgccggcgacggcgtcaatacgcatggatcctacgatgtactcaagctgaaaattactacaaaataatctgttttttttttcttttgcgaacaccatacaatacaagcaccatactttcaacttgggatatttgaagtatcaagactcttgacaaacgctcgtcgattaagccgaccggtcattaatcgaacaaacacgacagccaaacaaaacatacagaacgagacactcagacactgatatgatcatacgtaaggtgataccttcaaagcctgggtgatacacacaaactctacaagaagtagtagtgcacacaatttccagggacacaaacacgagcaacaagctagagatcgacgccagcggacggtgatgcggtcggacaggggcttgtgcatgaacatttgacggacttaccacagcagcgccgccaccgatatcccgacggcggcgaggagcggcgggacggcggtgtatagcagcttcttgccggcggcacggcgggcggccgggttgtcggccacccagattgaagcgccgaccagggcgaccccgccaaggaaggccccggtgagcgtgaggcggtaaaaggtgtcggcgacaaagctaccccgcggcggctcgagcgctgcggccaaagcggcgggggccgcggagaccggggcgatgccgactgcccccaacgtgg

SEQ ID NO: 94941 - DNA, 789 bp, Oryza sativa
aatttaccatagacctctgaaaacaggaggccaatcaagacttaagggcactgaaagagaggatagcacttgattgcatccagcttcaactggcggatttctcatctgatggttgggtggaaggaaaggctgttcaaattgagctggccatctgtaaccaacatcaagatgcaacctatctgttgtagcagggcgctgttgcatttccggtgaaacaaaatgatgtggtgctacactaggccactcatatgatgttccacccagtgtgtttctgttgtacacataatattcacctccagttttcattaccccgccattgtcgcttatagcactgtgaaacatattagtaggaataacaggtggcaatattttttcagttgccactacagagttacgatcaacagtatcacttctggaaggcaaacaagaagatggttggagtgtagattcattctggccattctgcgatatgacctgctcattcatactaaagccatcagatgttttcacactctgagaacattctgtagtcaacaacgagctgactctgggagaatgcaaggtatcttccagttttgtgtttccaatgccttttacatctgttccattaagtgcaatggaagagtcacagcaattcactgctttgggaatgcaactcttggactgatggacatatgatgggagatgaggtgagacatgtgttgcttcaacaggtttatttggagcttctgtagcaatatgaggagcatctgtcttcaatgtgccagatccagggttctcagttttcat

SEQ ID NO: 94942 - DNA, 1032 bp, Oryza sativa
tgtgggcttttttttctccacccaagacgggctgctggctctggcccaacaaaacccacatgatgaagcaacaaatcgcgcgcatgtgagaatttttttcattttaaattttttatttttaatatttatagaaatattgtaccggtgaaaatatttacagaagtagaccctgccgccctccccgagagtggcagggtgacatgagagacagacaagatgaaaaaaaaactagaaaaatgtatttttggcagggcgaaaattgcatttgcctccttgcagagggcggcaagggacctcagtgcaaaatgcgcacaccttgccgccctccatttggttggcagggatggtataatatttctgtaaatattaaaaaaataaaaacttaaaaatgcgcatgggagttttttcgcgcattacatgagtagcagacaggatggggatgcgcagattgtacggttaggggggaaacggctgatgctatctactccaccacttaagatcactcagtgatatcttctttgaccaatgcttccaaaagaaaaccgtttgagaataacaaaacatttgtgcagtagaagattaaagttaactaagcctgatatctgtgaattttagctacctaatgcagtagaagactagatactgattgatgtaagcttttagtttttcaaatactttgagtatcaccaactccttcttgatcatgccattttgctagcctccaaacactgcatcttttcctgaaaatgttagcattgcatgattatgttctgaacattttagaggaaactagtaattttagaacttcactatgaatagatagtatttttacttttgttagcaataaagaatacttagtacattaccttccttttgttctccctctcctgcagtctcccctgtcatgttctccttagttttgtcctctactaggactaataattttctaatagctatatcagacaagggaagtcagagtgattgtttttgtaaaattgtgtgtttcttgaagtagggaaggtgagctatgta

SEQ ID NO: 94943 - DNA, 714 bp, Oryza sativa
cacctaattaggtgtagcccccaactatgtgattagttaccaaactaaacatatagttgaaagacaaaataataacacaatttgtgcattatatgacaaaagcatacgcgacacctaaataggcatgctagccgactgctttttagccacaataaaagaaatccgagtggtgtacactctaaaaggttcacgaatgaacacacttgacaggcatccgaatataaaaactctaaagattacccaccaagtattataaagattatggtaataaataagtcaaatagcctaggccatgactatttaccatggaaacaggcatataacacgccaaggaaatgactataataaaaacaagtcattcctagttaacccaaacagcttttgtagcctaaaaaagcttgcaaaaacagcataacgcctttctgtcgggcacctttttaatttgcattgcaataattccaaagaattatatgaccgcataaaaaggatttgatcagcattgggcaacactgttgtgcgcataatattgccaaagcaaaatatgcctaagtccctaaggaacacaatgggccacgctgttaaaaatattgggctgaggtactgttcaggcctaggcccattcgtacctccgatacccttaactggaaaatccgatatccaagcgacgcttcgtcttccccgccggaactctcgccattttccccactccttgct

SEQ ID NO: 94944 - DNA, 964 bp, Oryza sativa
attcctgcaagccgctgctcccataaggccgtaactcgcttctagttgcaatacccgcatatattttagattatatattatcttagtttgcatgtttatgtattaacccattaactttgactaaaatctgcgtctgaaatgttgctgcgaaatggctgtcgtttaaattagtccatgaagagctaccaccaagtgagattctctcgctttggcttacttagtaaaccaatttgagatagatttggagcatccgaggcagtaatatgtgaaatttgagatagatttggaggcggtgtgcattgttagctattacaaaccagttgtaaagactcttaaaactggagcatctaagacaggagtgtgtgaaaaaaaaattgattgaagagtttttctcatgctggactgtaaagactcttaaaactggaaaatctgagacaggaatgtgagattaaaaaaatttgattgaagagtttttctcacgctggacggtcaacaaaaatgtgtgaatacttttgattgaatagttttgactcatgctggacgatgaacattagttaattaagagttgttggttcgtatactgccaaaatctcttcatatagaactatatgtcaaaatctatcaaaacaagcatctatatgcttcgcaatatcatcaacataatggatgagcaagcaagcaatcaatctcaaaccaaatgaatgcctcaacaagcgatcaaacctcatctagtgtgtaaagcgcccaagggaactccagtttaggacaatgcaggcaagaagacctgaagattgactgcccgttgctaaaaaggaaaaagtaacataaaacactgacaagtgaagagccaggcagaacacattttgatcaatatccaaacggcagcttctcacataaataagataaccgatagctccaggttgagaaccaaaaaccgaaagaaataggttctttgagcggagtt

SEQ ID NO: 94945 - DNA, 4343 bp, Oryza sativa
tttttagctatcaaaccacactatgaataatactgaatagaccatatttttaagatatacctcgaatatccaatctaattgttgctatattaaataattaaaccaacaattccttatccataatgtcaatagggattgaattaaatcaattagagagaatctaataaatttgtaaaaaaaaattggaacgacaattgtatgttccattgccataaccatgtttagtattatgagtttctcatatattattgcatatataagacatactaaggcagcatgatgtagaagtacttagttggttaaaagagttatatatatgctactatcagctttaaatttaggactcacattgactaggtattgtttttaaaagaacactataaatgacatatataatagggaaacgaggcgtacaatatatatgtctcttatgtatttattgactcaaagaaaataacgaagatcattgataattgcttatagtaatgaattaaatattatatagttcaaatcttataaatatcttgtaaaaaattatctaagcaatatcgatgaagaaaatttataaagaaatagtactttaatttcaagcgtagcaggtgtcattcgattaatattctaccttacatgttactcaagcgtaatctactttacatgcccgcgcaaatgcgtgggctaccttcctagttaaattattaaatgtcgtgggctcctttaacctgttgttcgaatttcttttttatattccaatgtgcccttggatacaataaaccaatactagttcagtagaatgttgtccttcaattattgttttcaatgcaagttttagatacgaaaatgccagtcaagtttgtcgtaataaatgatttcataatcataaaattgtaaagattttcccctggtttatgcaacataattttgtgatggaagccgcagtaccgtatctttgttgattctgaaaggtaaacggcaactctctctttcttttggtgacaaaagattgtatgaatgaaatctctgatcagttaagcggatagtgtttcttcaaaaaaataaaagttaagcggatagtcttcgttgaaaaaaattttaaaaaaacatgaaacgaacgaactagtcaagcccatagcaatccgtagtgttaacttctccgaaagtcaattatgaaaaggctacgctcgtaggagccacgaagcctcctcctcttctcctggatttgcctttctttgggtccccgaatgtcgacgacctaaataattgaccaaaccatggcttcacctaaacacttttgaacaagcaagcgatcgatcgatttggaatggattgttcagccatccatctctcttggttttggtcctagtcgttgtactacagccgaaagtaacgagtagttctcttccctctcccttgcgtatgcacttacatatgtactctcttttactttctttttaggagaaaaaaaaagaagataaggcatttcgtcgttgaatctgtgcagtcatctcggattaaatttgacgaaatacatcgcaatactatgtttggatatacacaaattgttgagtaaatctataagccaaagtttttctttaaataaatcaaacaataacatccggtcatgttgatgccaacgtttgtactccgtacacaaattggcatcaacatttagtcattatgctcggtacatttttacacatttgtactgtacggagtacaaatgtgtaaaaatgtgtcaaacatgctaatgttttagtgtacggagtataatgacgtcatattgatgccaatttgttatttatttttttaaaaaaatatataaaacaacatttttcaacacaaactcttgtctttttccttccgctccctccgtcctagaaaaacaagtattggatgtaacacattctaatactacaaatttagatatacttctgtacagatttattgtactaagatatgtcacatccagttctagaattttttttttatggaaggagtatatagtagtagagtttttttccccttgcaggctgtgtgcgtggtattgttctccatggacaaagtatttcaatttttaaaacgacttggcagagtgtgttttatttcatagtgtccacatggcaacttctgtgatacactacaaagcagtacgttgactgttttcagtcgactttccgtcaccgatcgcagctgtatattcgctcgatcggaataaaagggaactggaatcgaggttagttaggaccgggggtgttggccgacgaatctgcactactgatctccaatctccactgacttttgtcttaaactaatcctcttcgttctcctctcacggtcagcatcaaggctagctaagctaaaagctacagccatgttctgaggttgcaacatggcgatcaagctagctagctagctgcatctaaggagattattacgaccgatattagctagctaggcaaggcaaggaggaaagcaatgccggccggtgggtgggagctcaagggtcaatgtcaggaaataattggtgctcgagatcgagaggacgaacaaaatcgactaaacggggaggtttaacaggtgatgaagcaagatctcagtaggtgaaattagctgtttaagctatagtagctagctagctaggaacagcgtgggcgtgccgcgtgcatatgcgtgctgatccgatgaccaaagaaccaataatccgcgatgtgtgtgtggtagccatgcatatgcattgacatgtaagaatggtcaatagtcatctctaatagtcatccatgtctaactgaaaaaagggcggagctaagaaactatgacgccgagctgatgtgtttttgactttgtctatcaggggttgttcactttgtttctaaaattaacaatctaaacattgtcaaaatcttcactatcaaatctctcattcacgaaaactttataaaagtaacaaactaaatacaacctacacatctcaaccttggtaaggttgatttaggcatcaaagcataaacaaccccttattacattcgtcctaagatataagcatttttgattaaaaaaaatagactaggacatttctaactacgaatgtagacaatcacttgtttatatttttttttctatgcccacacataactacgaatgtagacaatcacttgtttttattttttttctatgcccacacatattaacaggaatttagtgagattagtaataaatttctgatttttgcctctcgaagcatgtattagggaacacatttctagggtaggggcgggtgtcgtgttacgtgtgtatttgtgtgtgtgcatatgatgtctcctgtataatgaagtactctttttttatatttcggaacggtggaagtaagatttttctcagtatgttgatcagattttatttttcagattaacttacccgataattagtggcaagtgttacgttgtgatgtcaattagtaattaccaccttttttctatctcaatgagtccttttaggttgttgggttgatacttgtgttttttttaatcgaaattgaaaatgacttgtcagttgtaaccctcatagctgtgactacaccagcaattattccactcttttaaaagttggtagtttttctttattatgtatgttttataacccaatgtcatggcacatatacacacattacgtgtctggattgctggcttaatgcgtagtagatgttttctttgatttgtatatgacttttggttgcaacattcctgacaaaggactacactaacaagtaaaccacgcttttaggaaaaacaatttcatcttgtattttattcctttgtggactaatagacgacatgtctacattattgtcatttttctttgaaagtcaatatataatttgacaccttttccgcccaaagaataaatactactacaaaattttctcatttcggttgcgacctgaattaaattcccaatggatacaggccggaagcttcctgatctgcgataattaatcctcatcacgacatcgtagccagccgtctctgtacaaatattgatcagcaatgtcgtgagcaacttacgactaaaaaagcgaccattgcctgcatcattaggagcacgattgcgcaacatatctaaaacctgccatatcatattaacacttaacgtgagtcacgacggaattaacaagtccgtcttttggaggatctgtatcgtccaggattttattcccccgctctttcatatggcccctgcaatccaatctaaacacttatttgtgtacatcggcacatataatttgctagctccaaaagacaggcccattacttaatttgcacatcataattaaggcgcaattaagtata

SEQ ID NO: 94946 - DNA, 3808 bp, Oryza sativa
ggactaatagacgacatgtctacattattgtcatttttctttgaaagtcaatatataatttgacaccttttccgcccaaagaataaatactactacaaaattttctcatttcggttgcgacctgaattaaattcccaatggatacaggccggaagcttcctgatctgcgataattaatcctcatcacgacatcgtagccagccgtctctgtacaaatattgatcagcaatgtcgtgagcaacttacgactaaaaaagcgaccattgcctgcatcattaggagcacgattgcgcaacatatctaaaacctgccatatcatattaacacttaacgtgagtcacgacggaattaacaagtccgtcttttggaggatctgtatcgtccaggattttattcccccgctctttcatatggccactgcaatccaatctaaacacttatttgtgtacatcggcacatataatttgctagctccaaaagacaggcccattacttaatttgcacatcataattaaggcgcaattaagtatagacgatttgaataatcaaaagatgactgaaccgtactaccctgttcgccaaatcaccagtctcccttcagattactgaataaacgctgtgcatgcatcagtctaattactaacttagcttggctaagttaatttggactagagcattaaagcccggcgattcgattcgggtcagtcaatatattctatcctgttttccattcacgctgcagaatatattttttttcttgtgatcttccataagagaaaagaaaaaaaaggagatcagcattgcgagtttttgaactttgaacgaacgggaagcaatgcatatataataccagaattttggacctgttaactttaatgctattttcaactatatcattttttaataaaattgtcaaaaaaatgtctacgtttaatttgttgctaaatttagtcaatacataaaaatatcctactaaaattttgataaaatgacaatattattaaaattttagcattattaaaacttgttaaggtttattttgactatacctgaacagcctcagatggacgatggatcgatccagtcccggggccgcggggcatcatccaagctgccgcccggtttggaagtcacgggcttgctcccccatctgcaggtggcgttgggctgcaaaagaagtttggggggttttgttcggcgcgctcgcgtgcaggaggctgacccggcggcggtgtggaatcgtgcgtggattgggcgggcaggtcaatctcggcgaagtggtgcggtctcggcggtggaaatgtgctttttgacccggcctaccgcagcgagcgcgagcggtagcggtaggctcgcggtggcgcacgggcgcgcggcgccattttgcggtgaaaaggagggcagttttgcgggttgggttcagttggtcacatcaggtttggtctgggccggcgcgttacgctgttcgcgtggtagtagagttatactgcttgccgtcaatcggtttggtagacactggacgtcgacacctttggtcagaggagtggccgcacgcttgttttgagaaaatatttgattttccactgaccatgggaaaccgtatcaattcgtactttctcttctcgtttgtagtagcatttttttttcttgtgtgtatacacatgcggcagaatagagaaaaacagaaagagaaaatctggcgtagccagccaacagaagtcagaaggcaagcttggaattccacatcacgttcatccacggtgttctgaaaaataataggtgcatccacagtaataatccaaaggagcagggccatagtgagtagtattacaacaatcagttttaccctggccaggtgtgttctgagataatggtttgtttaaggagcaccaaactaaaagccacgacagtgatcgaaacacaacagtatagcaacattggcctgcgtcgatctagagccaacttgcccctaatcaaagagggggctaatctatctaagaatctattagaaacccaaagagacttgaagatcattatggacgcattatcctggattaaatctggtatccactgcccactagggctctccacttgccggtggggggctgcaagagggagcatttttctgctgctttttgctacaatgggaagtgggcaagtgacctgctctccctggaggtcaagagatcttgcttaggcttaagcctagtttcttctcccgacagctcaagctaatcaactaaactacgtgtgtctatgcggtccttaagaaaaagaaaagacgctgtgattaatcatgcagcaacttgaccactgaatcatgcgacgggaagagatcaccacgagctagcgccatcagctgggaacgagatgcatgtatgtgcagtactgcagtgcaaaaaccactgcgatagctgcttgttgtctgtactttactgtacaattcactattgtcggtcacgtttagcggcggccggtccggtgctagttttctcctatgtctgtgtgatggcactgttggtatatgggtggtggtatattattttcgtttttctggttacgatcttcaaacattgtaatcttataattttttcctactctatccgtgtgacattaaaaaaaaaaaaccactgtcatagctgcttgttgtctgtactttactgtacaattcacaattgtactggctagtggactggtagtacaggagagaaagaaaaggacaaaaaagagcggagtacgaagctctgctccagctagctagctcgacagatccattaatatggttttgacatgcatttgattggttccaagtggaagaaaagaaaagcctctctccagtgatccgggatggaagggaggagcgggtctctcaagaaggcaacttggattcatggcgagttggcgctgcgagtttaccgggtacgtgaagaaggtcgccgccgacgcattcgtcgtgcttaattagctaacatgctgcttgcagcattgctagctgttttggcaaactatttttcaaccggacttaatttgcgctttcccctttataggcactaaggctttcttcgagcacgagttcggaacttctcccgtcacacggaaaaaacgagataactcattagcgaatgattaattaagaaaaacttaaaaaataaaaaaaattaatatgatttaaaaattaaattttctatagaaaattattttaaaaaataaacagcttagtagtttagaaaatgtcgtacgcgaaaaataagagagaagatgggaattataagtgccaaacgtagcctcagacaaggagaattatggcattttaattacagggtacagagagcatatgcacatcatcatactcaacacgtacaactgtcgtctgtagaaggatatcatatcaccatctcatcatcaaaacaaaacaaaagaaaataatttaatatggcaaagagtgatggcccaccactaaagcccaagaatacacagcttctacgttgggaataagttcatctgaggtcccttaacttgtcaacgaatccgattttcgctcttcaaccgaaaaaccagatacaacagatccctcaactatcaaaaccggtgcagatgagatccctcggtggtttagatggcggttttggatgacgtggtgcctacgtggctaatttgactcggtcttcatctgatgtgaactgacgtggcaatttaattcagaaaaataataaaacccgtgggacccacatgtctggtgggacccacatatcatcctcagtcctcccttctccctgctatcctctccctcttcttccctgcaatgtgg

SEQ ID NO: 94947 - DNA, 2393 bp, Oryza sativa
aaagttagttgagattaaaaatgtcagttgagagttgagatcaccttgcaccgtgggcaagcgaatttctagacgtgtggctccatgccacatggcacactttttctccatgaggtcactcgtaggagtggcctccgttgtgaatgtcctaagaaccgtaatgtttattaagatcctttttgttactaactgtttacatgctatctagaatcgtcagtgatgggtgttactcatgacaaaaatgggataattttttgccatccctagcttgggttttgcttggaagactaacattttgtctatatatataagacattattttcaccatccagctataacagaatcccctcttgcctcaacccaaccaagatgtcattgcactgagaccatggaaatcctatatatatatctataaagtatatccccaccatttaatgttaattctcttttttctcatgaagtcacatcatcttaattgtttttagtctttgaatgattcatcaagggtgaaattacatatcttctcccaaagagccactcatacatctcagttatttataacgacccaggtaattattgatcaaggtgtacaatttataaaaatcacttataagaaatcatatagtatagtaagtaagagaaaacaaatatgactcatatctactatttgtcatataattctcctgcaacaacgtatgagattcccatctagtagatatgagtcatatttgtttataaacccacaagagtttgacacaaggccatggttcctgcttttgtaaagaagccatggaaatcaccatgatgctaccttcacgataagacttttttttgtggggcgtttgtatatatgcatgttagggggagggggtggccacaaaagctacactaggaaatgtgagacgatagaagagagaattggggaggaagattgaggagtcacaatgacttcctattttaaatggcaacttcagcaagacaaatagaaaataaaaattttgcaagggttttcacatagtttttttttagaactgttagctggggataattactaagggttctagctaatgaatatctacactaaatattgatggttacaaagtagaaaacctagacaccatctttagaactctgtcgtctttgataattgacatatatgatgttaggcttccttttcctttcaatatacttatgtttttattacacggaagagacacaccgcattcacacatctcggaatacatcaccccttaccacatgctaaaagatgaaaactaatggcagctctccaacctcattaaaatcctattaaaagagcagccccatgtgcataatatttattaccatcaaatttcaactgtggttttctttaaggatatatctgtatacataattgttttttagatacatagaaaaccttttctgattgtgcgactttgctagctgctaaatttgaagtgggttacgtcggcattagttatacatgtttttaaatattctcatacacaacatctaagataaaggctctaagaagtgggttctagtttttttttttaccatgcatgcatatataaccctgttaaatctagagatcaacagtttactttaaactataaattctttgttgacaacagttggaaaaccactacacatagctagatcgacttccctagaatacacagaatgttactgttagtactgaaacaagaagccaacaaccggcatttcgttcattttgacagctgggacattgaactacagtgaatgtagagaacaaattgccatttccaaagaatattatcgaaataaaaagagtatatacatatcgcgatgtctgctactagctagttagcaatgcaacaaatgcaagtagcaacaactgtaatttatggagaacaaactccatcctctgttaagaacaaattaaaatagattcttactgcctccctgagaggccatccaattcgctataatcaactgcatgctttatgaatgcatgcgcacctgaacctaattcagaagccgggaactgatcgaccctgttctttcagtaattaataattctcatttcatcaccaatatcagcaccgtttgccgacaagcgacgattaatcagccctatcgatttcactctctgaacttttagtttttgtcaaaaccgcggctagctgatctggttttaattgttccaagttcagtccaagaagcatccccagcaacaaagacagattcgattggtctgggaagacaaccagcctgctttgcaacctatccatgcatcgatccctaaccttctccatgcaccaaccaaaagtcaatatggatcgatcgagatcgagagcatcagataaatctcctttcgatcatttcaacattattctttcttcaatttt

SEQ ID NO: 94948 - DNA, 539 bp, Oryza sativa
  unsure (1)..(539): unsure at all n locations
ctaggctctcggccctcggttgtgccagcgggtatagctcactccaagcgtaattccggtttcaccaaataagggttaacccggaaaaacatttgagcaaaggccaccaaagcccgaaccgtaaaagccccgtgtggtttttttcataggcccacccctttccggctaaaaaatagccctaaatcaaagcgcgcacccgcacgactttaaaaccatggttccccttgaactctccggcgctatatacaacacgcgcatacaaaactgtccctttacctccgaaaggtcgctttactacccaccataaatctacccgctaagagcacctcacaagaatggtgccaacacccctattctctgccgggctatacgaacatgctttgatcatcggaactcctattacagcttaaccgtggcaactcgacnggagataatgctctcaatcttacagcgtcctcgccacataaaacactggtctccttcaccaccactccaacatattattcgcatacaacctattctgtgcgctgtaatccacc

SEQ ID NO: 94949 - DNA, 4340 bp, Oryza sativa
ttaattgtgattgatcttctcgtctgctagctggtaatgatatgtctgccaatcacccgaatcagaaatcgatgcatctgattcaattggctaggctcagatatatctccaaaacttattcaggactcgagttgaatgcacagctaagcagtagcttaacacttgcagcatgcagtgatgggaaaataagaaaaataaaatgagacttgtaataataagggataggtgatcgggcaagaagagcagaaggtgtgtatctgtgggtagtgaatgttcagagcagagaagacagcaggtcaatgtcccacccccccccccccccgccccaaccaaaaaaaaggttttttttttcagaactttatatcaaggacaaactgcatgaagtattgaggatacggatccgtatcatatacaccatccggtcataaatacttaatatttagaacaaaatttgacttgaaattttacagctagcactcaagagttactaagaggtacccgtagctcctagtaccaaacacaacgagaggtaaaatgtggcacctccagaccgtaaaatctctcacttacaaactttgactatcaattttgtattagaatatctaataagtttttataccatgataatactttttcaaggcaaaactaagcatatatactatttttttcctttttaaaatgagcattagaaaaactaatgatagttaaagtttcaaaagttctgactctatatatcatgaccattgtataagaccaaaatgacaaatctgagctaattatttattcattcatttattttttgcaaaacgtaagcacaaaagaaagctaattaaacactgcgttggtcactacctgatcaatctcatatcaacatacatttctgagaggattttactgtgcttgagaggtacccaggtacctcctaaatgaattaatatgcacctttgatttcgaaaggataatctagaaacaacaaataatattaataatggtagcttagtaattccttaaacctcaattccccatctgttggctagcagcatcctatactaatatgatcactaacccaatccatctgtgtctaacccggaaaaatatatggtgcaaagtacatatgtagtggaaacctgaaaactaccgttggatcgaaaaatagacgtctgatatttgtctatgtcatcacgagtaaaaattttgctatgagtaaaattttaaccgtgacattgacgaatctcggacatctatttttgatccaacggtaattttcaagcttccagtccactccagggtgcttatatagtcgcatcctttacaattagcacatcttcccatccggatccaccaaggcgaacattggcaagcctggcatgtgtggaacacgcctcactttgatcgggttcatcgttgtcatatttggtacagtagccgtaacacgtatccccacattctctctcttattctgccaggatacatcctgagtttccagaggaattatgcgccctagagcacgcaaaaacaacaggagctgaatcatgacatttaaatattcaaaaaagaaatccgccttattttgctcataatataattccagtgaaattccaaataaccccctacaactcactagtttttctatttccccctacaactcaatttcatacagaaaatcctcccaacaagttaatttatgtcctaactttaaccacagtcccattgtcaattatttcacctagttatttcaatttctagtgctgcatgggcctccagcgtcatgggacaatagtaactcatgccacctcgataggttggtaacttggtattatagaaattacagctggcgcacaagttgtgccatcgtgttctgccatcatcttagctcatatggggatttgggaaggcagatactgtaagggaggaaggaggttgtgagagaccaaccacaatcattagaaatagatgaaaataggttaggagaaattgtcttgtgtgggggtttaatgtacgaaattaagtagtagtaggcaaagaagaaacacaagtgatttgtagggggtatttttcacatttaattccatttcaattgaaatatgaatgtattacccagcccatgggggacaataaacaagtcaattgctgattggaatgcgcgggatcaggaaaatgatatctcagaacagtcagttgtctgcctgctcaaccgaggattactgatccgccagatgtgctgatggtagttggcatggaaaagacccatatgtcatggtttatcacattggtgtgtagctccctacccatgataatttattggcgcaaactaatttcagttgtatgaatttttttgtttcatacagcgatgattcattcacgaaataaaaggtcaccagtgatacaaccgaatctcatcagtattatttggctttgttgcaacattttactattatccacaaaacccggattatattcatgtattatttcgtagtacgcgctaattaacatgtcaagggttcatgaccataagatcttccaacataatatattctcatgactcatgagagggatttgatctagcaaggtggttctgatttgtactctttggttagtgtttatgataagcatttattatgaaaacatccaagcagatatttaagtaatctaattgtcaagtagtacataatatgcaccattccaaatttgcattttacagacttgcatacttcctctgttcttaattagtgtacagattgaaaccacactgggaaaaaaacagaggatggactcaagaaaagagtgaagctgattgcctgcttcctatgaaatgccaggttcagggtcataacgactggtgattaccattactcgagaaaacagttaagctgagcaggggtgcatgtataaattaattggcactataaatatgaaatactatgcgactgtggtgaaaatttggcgttgtcacctgatgatgacagaagtggtgagtccagatatagtgggttctgataatcaaacaaaccagttgcaaaatattacatgtttttgttctaatgaaattccggcagagctcctgccgtcgtttacctaaaaaaaaagttagttttcatgtattctgattatagaattaattgaagacccaaagcaaacaccatgttaattagtattatatcctgctctagctgttttggacaaggttaacataaaaaaattagaacttttgaccattaataacttacagaatattttgtttggagacagtaaaacacgatgtgtagataagtcttaaaattacttaattttctactgcagggtcaatcgcttaatgttcggctggttccaagaaaactaaacaaaatggcagattatttatcaaaaaaagtaaaagcaactgttgccaatgtacaggttttaaaaaatatgccagaatatcactcatatctatcatcattcatcgacttgtcctacagtggagatgttattatccaacccctttggggatgttaccttaaaccatgcatgtcctttgcttctaccttaataaagtagttatgttttcaaacaaatagataagtcttagaaatactttgagaaaataaaatatctacttattatatacatgtgtgtattataataaaaaatcatatttaaaaatatcttgtaggtgggtcattagtctttcatccctgtcatgttgattatctcttgtctcactgtctcagctatactccctccatcccaaaataactcaattcctgagtttctgtgtccaacgtttgactgtccgtcttatttaaaaaaattatgaaaaaatttaaaatgataagtcacgcataaagtattattcatgttttattatctaacaacaatgaaaatagtaatcataaaaaaatttcatatgagacagacggtgaaacgttggacacagaaacgcaggaattgagttattttaggacggagggaatacatatgaatccctcccgttcattattcacttcccttaaatttggcagaaaaaaagacacaaggattggacaacacaatagtcttgagatgacatttttttaattgtaatctttctgaacatccccataggaacattttttttaatcgtaatcttgctgaacatccccataggacaacataactgttcctgctttggagtgggtggcatcagcaattcagaatcttgacattgctgtaaaatcagagagtgtttgattattatttgagtaaagtccatcaccggtccctaaacttgtaccgctgtgtcatcccggtccctaaactcgcaaatcgaccgttcaggtcctcaaacttgttcgactgtgtcatcccggtccttaaacttg

SEQ ID NO: 94950 - DNA, 689 bp, Oryza sativa
gcggcgggtggtgtgtggcggtggacgagagcgaggagagcatgcacgcgctgtcgtggtgcctctccaacgtggtctccgccgccgccaagtcccccgcggccgcgccgccgccggccgtggtcctggtccacgcccggccggcgcggccgctctactacccggtgatcgacggcggcggctacgtgctgacccagaaggtgatggacagcatggaccgctacatggccaccgccgccgactccgtcgtcgccaaggcccgcgacatctgcaccgccttccccaatgtaacttagctttctctcaactccaaactttgacattctcgttttccgttagcacgttttttagacggttaaattatacgtttctaacaaaaaaaaacttctgtctagaagttatttttagaaaatctaattattcgtcttttaattttataataattaaccatgtgctaacgagttttctcaatgtctatgttaataatatccattcaattgccttaaaccaacgggccttacaagcggaggattttttttgactttaccattcaattgccttaaaccaacgggccttacaagcggaggatttttttttcctaaagtcaattacatggaagacgtacacacacgaatcacacttatggtggtacgattgactgatcatctcgtctcctctgatgtgcaggt

SEQ ID NO: 94951 - DNA, 772 bp, Oryza sativa
atgagaacaaccattctgacatgaccgatataggggcatacctgaacctgatgttcagtatttataatgtccttttgggaattatgtgatggttgcacctctttccagctctctcttggcttagaatccaagaaaaagataagtttatcagcaattcagcattacttactgacatatatatgaatcaccaccaactacccttgttcagtaagcattggtatgattcagttgggatagttgcctagtaggttgcatttcattcctttccttttctgactcccatttttcttgttcttggttggccatgaattctaactgcccaaatcttgcttagctgtaggctacaatgccaaaaggagaaaagatggcctaatctttttgtttagtgataggaaaaaaatgcatttatttcttcggaacaattagccgctgaaatataattgaacttctataatactcccttcgttccaaaatataaaagattttgggtggatgtgacatatcctagtactacgactttgaacatgctacattcattcaaaatcccttatattttgtgacggagggagtataataggttatacttgcattggttgcttactttttaattgacagcctacttgatatagctagttagtaccaatctatactgcatccctgtagcctgtacatgttgatttatgcagagatgaaagctcacagaggtacagattgagcaggatcactgatgattgatgaaacaaccaacctacctgatctgatacacccatct

SEQ ID NO: 94952 - DNA, 889 bp, Oryza sativa
tttcactcctcgccggcgcccaacgaccaccgctgttgttttccctaaatccggccaccgccgctgccccaaaccccagatccggagtttcacgccgccgcccaaggctgctcttccgaccgccactcgcttgcacgtgggggccacttctctgagccctgcgccggttgctgcccttcaccgccggagtcgcgactggtgaccaccgttgcctcgccgcgccgagcgttgctcggcgcgagtgagaagagagcaagagagagacagaagaaagaaggagagcatgatgatgtgttcactggtagggtccacgtggatcctacgctgactcagctaccacatcagataaaatcggggtcaaacccaccaaaagacctgtggtgaacggttttataagttaaggaatgtcatatatctgtttttgtggttggggaacaataccttcggtgtactttttccttttgagaatgatttatatttgtattatttttatgtggcacttaataaatatgtttatatccgtggataaatatgttctattttttttgaggaaaaagatgtggtaaatatgattaacaaggtcaactcctttcttttgcattgtactattgaagagttgtgtatcatattgcaatacaaaaatacaagatcaattcgacttttcgacctgaatggacgatcaagaaaaccggttctcaaccgtcgatattaaggtgaaggaaacaaacacgcatcaaatttattattcatcaaatcaaaagacgtacaaattacagattgttgttacatgaaatcagcactggtgcgtgggttgtagaaatcaatatcaatatgctacagtactattcactattcagaaaaaaaaaaagaaaacgcaacacatctttga

SEQ ID NO: 94953 - DNA, 554 bp, Oryza sativa
actgccagtggtaaaattatcttttagattggatgaacaagattaggtactttattttctcaattttatcttagttctgttagtgtgttagcttagttttctgtaaatgctgggtttataccatcttgacaccaatacttggtcatgacaaacaaattaagaaaaaagaaaaaagaaaaaaatagtctttttcttttgttgcaatcttcacttatttgaaccttcattcatatttgaggcgtccatggcactggtaagtcgaaactgtatcagactgcagattcatggtttttactatgctatctacaaatatactaaaattttacaaatgttgaacatattcccctcaacacatattgcacattcctgtgaccttccaatgtagaagcatttaagttcatttgttcagtgaacattaattacaagctgctggtgctgctcctggccactcatactgtgcaagtttgatgcgtttcttctccgttgatcctgcagaaacagaggaagagaaggtatcatgactgcggactattatgctcctataagccattgag

SEQ ID NO: 94954 - DNA, 667 bp, Oryza sativa
cgaggtaactaaacatatgcatgctttgtcaaatctcatctaacggcacagttttttttcgtctgaaaatcactctaatatgcatatatatatatatatatatatatatatatatatgaacttctgcaggtggacaaacctttagatgccaaggcaccgagtgatatttatggcgaaatgccgaagaccgacgatgtgacatggcaggtgcctgagttccagcatcaccatctcaagcatctgtagttcagtggcttcaatgaagaagaaatgcactggaggatagtggagcttgtcaaggagagagctgtgaacctgcagagcattgctctggatgacggatgccaagcctgcgatgttgtggcgaatgaatatgttctctccggtgggatcaaaaacaagaaaccggtgttgttatcagtgtcccagatcacaggatctcctcctattctcacccttgtatagagggtgtatccggtgccttgtgctcgcaggcgagtatagggttgacgccgactcttttaaatatgttcctaaatatttgacatcgttgactttttaaagcatgtttgatcgttcgtcttattaaaaaaattaaggaataataaattcttttcctattattagattcaatgcaaatatacttttatggaaataaaaaaataaa

SEQ ID NO: 94955 - DNA, 4338 bp, Oryza sativa
  unsure (1)..(4338): unsure at all n locations
cgagaacgaacacgtcaacgtacgttgccgcgagaacgtgaacgagaacgatcgaacgaacgagagcgagaacgagaacgatcgaacgaagacaagcaagaacgagggaacgaacgtgaatgagaacaagcgaacgaacgtgaacgagaacgagcgaacgaacgtgaacgagctagggaacgtgaacgagcgaacgaacgaggacgaacgttaacgtgaaatgcaatatatatatatatatatatatatatatatatatatatatatatatatatatatatatatatatatatatatatatatatatatatatatatatatatatatatatatatatatatatatatatatnncaaaatacccgtgcgttgcaacgagtgaaatctattttaatcatattattgttatatggtttagttaagatgaaattcactatgtgagttcgcttggatatatattttttagaaaatcatgagctacagttaggagtccgattgtctcaagttagtatctgattctttataaatagatttcttatatgattccttttgtattaccaaaaaagtgaatgatcttaaaaaccgactcaaatacggatatgtatttccaaaagcaaacgaacttaaaaaccgactcatacacggatgacctaccaaaataccgacaaaaacatcttcaatttttataaccgactcaaacacggatgacagaccgtggaaacatattcaatttttataatagggtgtatatatatatatatatatatatatatatatatatatatatatatatatatatatatatatatatatatatataatccatgcagcaacagggccatgcaaaaaaaaaaaaaaggtcagctcgatctttagtcccggttggtaacaccacccgggactaaagatggcttagccggccacgtggctgagccatctttagtcccggttggtgtttagtcccggttggtgttaccaaccgggactaaagatcgatctttactcccggttatttcacccgggactaaagatagcgatctttagtcccggattggtactcccggtttggaaaccgggactaaagggggttacgaaccgggactacaaagggtttctccaccagtgaattaaacctttcatttactattaatttaattttcaggttattaattactattttaaaaaaattcgggaatgtatagcctgttttttttaagcagccatgcaaggccgttatcatgcaaatggaaatcaaaatgtgtcataaagataaaagtgtttctttggctgttgtgcaatgacatgatcaacattgtgctccacaggacacggatttatcatgtgcatattttgcctgagtgagtgagtggtgataggggaaacaagaatgtatttgattgcacttttagtaagccctactggaggaagtttagaatttcctggaagacgtcattgtctttctaccaagatgaaagtttttgcaagattgtgcttttgaatgaaagatttcttgaagatagtaataatcttcatgctgacatatatggaagcagcggaatgcttaattttttttgagcacctagcacctaatgtcgacagatggttagctagtttcaagaatgagattctcttgtatcttggaggatgaatataatgatctaaaagagagttttagataggttataatcttcataaagctttgagtttttctttttttcccatgtaatttgtatttgtatttctagaccctttttgttatttataaaatttaaactactgggcaaagccatctgtatgccaaaatcaaatgatgcccaaataaaatatgcaaccttttaaattgagaatttagcccctcaaacaatccaatatgaaattcgctcatatgaagatttaaactcaggactttagagtgctatttaggtcactgcaactaacatgattgtagtcgtttattataagaattagtacattcgatgttggatggaaagaagtacattcggaagaggcatccgatcccgaacgattatcatcagcatattgcaaattttagatcaatgaacagggaaaagcattcgatttcaaaaacgcgcgcacacacaaacacaaaagaattcaccctaactctgtcttcattctctcgagcctctgtcatcatgttgccaattctcttttggtaaagcgaaaagagaataaagatagagagaataattactccatccatttcacaatgtaagtcattctagcatttctcaccttcatattgatgtaagattcattaacatcaatatgaatgtaggaaatgctagaatgacttacattgtgaaacggagaaagtaatttatatgtaagaaagttttgatcgaaggcgggacctcgagcccacgagtcgcccacgcgccagcggctcgggggcaaaccctagccgccgccgccacccaccctcctcccttctctctgcctcgccgccaccggagttcaccgccgaacaaccatgcggggagccaggatggcgggcggggccataccgcggcgacgcgtcgtcactggcacgagggaggcggggcgaagcgcggagcgcggtgagccgagcggagggcggcgcgctcgatggcgagggaggccggggatccggcaccgcggtggctagatccggtgctcccgcggccggatctagctgcacggcgcagggcgacggctctatcatgggcacggaaagctacggctgaaggccgccagcggcggcggcagcggcacgagggccgcgtgccggcgaggggaggactgtcgcccgcttggcagcatgctcgtgcctctctccggccggccttgtggtgtgcgcggggaggagctgtggggtggtggactgggctagctggtggctgagaagatgatgtggtggttcagcgacggttgttgtgtgaggtggtggtggcaatggatggaaatcgctggcgaaagccttgcttagcacttggctggcatgacgacggcgacgccctttggcgccgtttcctttcttggaggcgtagttatggcatttttcttcatcgctatcaatctccaggtgaaaactatgttccggtttccggacggacggtggcggcgtttcatgtcgtatccttcattggggcatcgtcttggagaaccttacccttgcttcgattactgttagcgaactcctgtgtcagctcgaagcactagatgcctaggttttggcgaggccttctccttcctggctccattcttgtattggtggcatccagcttcttcatttgtctctgtcaggtggagtcgaagctgtaacgtcgttggggtgcgacgttgcttggcaacgataacatttgcagtttctctctagggatgttggtgttgccagtgcaggttttggcgcctcaggggctttggctgatgtctaaagtatgagcttgctgttgttttgctcgttttggcggtgcctccaatgatgttatgatcgccgtggagtcggagctctgggtcgctgggcggcaaaggttggcaacgatgacacgtgccttgtgatgtcaaagttgtatgccgcttcttcagcttttcgacatcgatgttcgcctttggattctgccgtcgtagtttggttagagttgtgtggtgctcagtgtgttgtgttgtttgtaccggtcgtggttgaggggcttggcgagtctacttgccgagaggttattttttctttttctgtaacccgtctagttttttacttctgcttaattgaaatataatttgcagttccctgccggtttagtttaaaaaaaaattatatgtaacttgatcatttcctttttcaaaaaacacagcatcccaagtggctagtgccgttgacttgcaagcagcaagtcttgagttcgattaccaacttgcgcgtggaaaatttgtaagttttgaggaaataaatcttaaaataaattgtacatatatttagtatatgcttaaatgttgagttttgtgtgctttacggtagagccaaagctcaaacgatgagaaccttagccacgtactcctttcgttttttaatatatgatgtcgttaacttttagatatttatcttatccaaaaactttgtgccaacattttaaaaatataagtcatgcttgaataaccttaatcataaaacatcataaaaaataaataatgattataaagacgaatagtcaaacatattaaaaaaagttatttgtattatatattaaaaaatgaaggtaatactacttaaaaacttatcagtgttggacaaaaatagcaacacacatagaagagagaacagcaggacgtgctgcgtcaggtggcatcgcgtccaggtgag

SEQ ID NO: 94956 - DNA, 2318 bp, Oryza sativa
  unsure (1)..(2318): unsure at all n locations
ttaattgtttgagccatttcatctaacaataatgatgatgatgatactggtgatagtgttactgaacctgggtaatttacagattagttttgccttattttgttggtccattagccatatgaaatgcaacattatacattagacataactaaatgaaagactcgttacttttgttgaattgttgttaatttgtaatttgatgttcccttttctggcaatgatcttaggtaccaatatgacatgaacacaccaggttctccagggcaacttcgtattgcctcaacacgagatctgaatatgaacatatcagtttccaatacaaacatgttatcacaagcttatgctagctggaacaatattagccttggcaatgagttatacaggatggtatgccatttatttacgattctgactatatagtcagtgttcaattctgataacctaaaagacttaaacaatattaatctatatttaagcacctcctcattcctgtcatcatttgtctactgaggtactgttctttcattctatgatgaccaggaaacgtcttctactagtgaaaggtcgattcttgatgtgcacgaaagaagaagttattatgttatcccacaaaacaaacttggccaagacatatacattagaaccactgaatataggagttcagatgttacacttctgtcatctggggatgataggtctataaaagttccagcttcaagggatcttctggattctcatttaaaggggagatctgttaggttatatcgcttgatggttactgctattattgccaatgctgaggtactttcttctgcattcgattttgtgtggtttgtgttgaatgaacaagtgttcctttttgttgcatttgcatttgcttgtttcttgataacatgttagcggttgaaattcttttcatctacttggttctcattgaattacatttcgcgtttggcaccttaatagcactctgataattgttctgttatgtctatcaaatgcacaaatgttcatggcattctaaactagaaccaatcccgttatcacttgttggttattactggtccccagcatggtactgtgacctaatggacaaaacattacaattattctggctcattgtcagcaatttggttggtgcacttggttccaggcttcggcaaactttgctgtaacttgtaggtgattctattttgaatgtcgtctccgttgtccaaaaatgcgaaaacaggatgtccacgtgcaaacatacgagaagcttaaaagacccgagtagatacatttcaatctttggaaacactctgttcaaatatatagattccattccttcccataaccatcgaaaaggccatcgagtccatggactttgtgttacaggcatcgataatcagtattgcaggtctagagatgctgacctcttcataacatcatgcgtcctatgatactgtcataggaagattaaaggaaaagtgcccacattaccatgttatcaatgattactcatttttatactatcataaaaaacttgaaggttatttttttctgttcacaattcaaaacctatttgcagcacacgaattccatttggattcagcttcggtaaatatttcacttgctacgaggttgttgaacatcgtctgaaggagaaacacataagctttacatagctatctacttgtggccacgtttatgatgttgtatttccatatggaatgattattgtggctcacttaattttgttgttggtacacctttattctatatgcttaaaatacttaactcttgttgaagtcatctattcttgcacgaagaaaatatntgcctgtcataaacttggctttccttcccagattaaagttggtgaaagacagccactggtgaatatatggtagcactacggatctattcagaagattgtattgcatctggtgttcagcaacaaagtgctcgtacctgtgctgctgctggagaccaatcttcacaaaacataagaaaggtggaatggaatgaaatgttcttctttaaagttgaaagcgaggtgtgtaaattggaaatatactaaaataatatgctgcacttactttacatggtatttgttctcgtgatatggctactgcctgatctccattctgttatttaaaccttttcaggataattatgttctggaatttgttgttcttgatgctggtggaggttgtagttttgatgtgcaacacatttacttttctttattttcttgaaaacactggaggactgcgcttcctttcattaagaagaagaagaatacaaaacatttacttttcttttctttattttct

SEQ ID NO: 94957 - DNA, 799 bp, Oryza sativa
cagatctagtcaaggcttagccccttttatcttttgtttttccgctgcatttatgtaagacttttataatgtttgtaagacgtggatctgtatgtcaactttgtcgcttgtgtaccccagccagtcctggacggggattttaatgcacattctgcttggaattctattcgggaatttctgggcgtgacacgcatgggagaggtgtgtgcaaagctagggccacctatcggcacggaaaagaagcgtcgtaggggcgtgggatcggatggtgactttgcctgtccaagtagacatttaccaccttttagttgtagtgaccttttagttgcagtgacagagattttgactgttgcgcctcgtgagccatgtgggccacacccatcacccacccgcacgcactcgatcgattaaccacccaaacaacgccaatgcaagcagctcgttcccaagttgccacaacacaccatgcatcttcgagttcgactcgcgggcgcacttgtggagattatgggtaccccatacccacacggcacggttatccgactagttataggggataacttatatatatgaaatatgtaacagatcatgacttgggtattacgtttccttgtatattacggaacggcctaaagtcctggtttgataagattgtaaagtagatttaggaaaccgataccgtattggataaggtttctatcttgtaatcatgtcccccatcctatataaggtgggcaggaggccctctagggggcatgagacaattagatcgtcagatctatactacactcggcggatt

SEQ ID NO: 94958 - DNA, 2942 bp, Oryza sativa
aaatggctttggcccgctccaaatgtagagactttatttctatatatggtaaaagaaatattcttttgtagagacccctgggaaaacaacggttttcactctcatgagctataaagaacaacgggtgcgaggtgataagaaaccagaagcagattgtgttgttttgaaacttcattttctgatcatccagatcaaagacatcgttacaggatcagcggaaaagggcattatgtttttttttttgcctgaacatatctaaagtattgaaagaaataaagtttcttgcaatctggttgggccacgtcatccataaaacagggaccgtccgatacaactgctggtaaacgaccaccgtcggatctgataagagaagatttcagaaacaacccttcaagaaacttctctcagcttctagtcctcctatgcctgtgtattttcattttccccctccctctcctgtgtatcgctgcgactcttcgcacgcgtcgcttcgccacctccgctttttctccttccaccgccaccgctgtcttctcctcccggccctcactgccatcgctgcctcctcctcgtccccagtgccccacagcctccgcctcctcctcctctccctctcctctcctctcatctccgtgtaacactactagatcatagcagaggaagaactagagtaggagaggtgaagaacagaggaggaggagacagagtcgaggaagaaaggggcagagcagagttgagaggagagattcgtttttcctttcttcatttcacacctctctcattacagggttccttacttataaagatcatacatgccagcctggccgcttggccgaatcacacaacacacatgcgcacacacccacccgacacgttactgtaaacgtcatcctggcattgtagctcgtcacgcgtgtggcacaggcgtgacatcccgccaccgccgctgtcgctggcgccaccccctcctcttcctcatccctatccccaacacaaccacctcctatcagggctggattcggcaattgtggggataatctggattcgagaggcatggctcgacccgacagcgacgcactggtggatcgctgccacctcatcttgcgcatttttccacctgagcgcctttggttccccaggacctcctttgtagcgcctcttctcatcgtcctccaatgacgatggccaagggaaatacaaaaggtccgaggaactgcaccattatgtaagtatctaaaaacctctagcttctcacggtgtttatgttggtgaagcctgtacgatgtgtcctaccacgggcttcacctagcgttaagaagttgaatccatgcatgccctaactgctaaattggaaataacagtacatatcaattaagttttgtaataataatgtaagtagtaaatttagactaaagggtgatcaataagttctataatggagttcttaattaagcctctcatgtaatttcagtttttgagtgtgcaaatttcaattaagagcactataaaaaagaatgcatcctatcaaatgtatgtattgatagttcaggttcattataattataaatatttacacacacaattgtttcaatagctatcaaagatatgtgtgataactaatggatttcaaactagcagaaaaatgatttacaaatggattgaaatagtattttgctccggatgcccgaggtccgactcgctgaatcaagccaacggcagtggctcaccgggagataactaatactaataatcccccccccccaaaaaaaaaaagaagtaatactaactattcatgtatttagaaaaaaaagaaaaggttgcccctaacattatataaatgaatggtgtatttctagatgtgtgtatctatatatgtgtgtctaacgagcaaaagttgtagcaagcagaggagtggaaacctagaaaagatagttctacaaggtgatttgcttaactgtaaataaagtactattaacgatcagatgtatttgactctaagctagcctctggtttgctgtgaagggtgtattcactgattcaataatgatttctgtgaatttatgaagcaaataataaagcaatcaaatatggtattattaagtatctcttgatgttacaagttttaaagcagcaattaaaatgactgcaatattgatttgcattattcgttttcacctgaagtgacattaatgaattaaatggcctttccaaacttgtggtttcactttttgttcgatttactgccgtgcatctaaggcctctatatgaatcatgaacattagtacattttgaatggtaaaaactggataggagttgttgaggaataatgttgtttcatagaacaataaatttatttttgctgactgtgtcataaatcaagtcctttttagttttgctgattgaagttttctatttaacataattgaaattttctactctttcaccacttccgtggtaattattgaacaggaaacagaaagcagcaggaagaacatctcagatggaaagcttcaatgtgttcttaattatgctttcgtttggtcaagagctttattccctgagcctcttaatacattacaaccagttctcaactggaaattaaactgttacaaacggataaagatggtctgttcatgctccagttaaattcatatcaaatcattgttagcatacagtgacgtttcaagtggatttacaatttagtgaggtggcgtgaatgcatggccttaaaatgtcttgatttgtgggaaatactttcatgaggcaaagttactgatcttgcaatctatagaagctttaaagtttgcatccaacctgttttgactggatggaagaaaaactaaaagtgtaatggcccctctatatttgaattggtttcagatttaataaatgccaatatatagatgaactacttgcagtaaacgaagtgtcattcagcgcgt

SEQ ID NO: 94959 - DNA, 624 bp, Oryza sativa
ccggtggtggaccgacaacggtagcatcagcagagggaacgaaagcaacgacctttcactcctctcccctcctagaaccaagcttcgggtgcatcgtctcgtcgacggcggctccttcctgcctcgaggtgctcttggcaacggcagccatgatggcatcgacgatggcgacggggggcggatctagtggcggtatggttggagaccaccggtagtggaaggagtagatggggcaccgcagtggcttccccactcccttccgcttgcctccctctcccaaatctggctgtagggggcgactagggtgtggcggcggcgatagcagccgaaggggttggtttcggcaatagctcgtccacggcagcttcagcaacctccaaggtcaccgatgatgacgacgaccagttttgatgtttatttgcatgatatttcatttgcatgtgttaatcttggatgtcaatttgaatctagatctctgaatgttgattgattttttttttccttagtgatgttgcctataaaaattaattttctcaggtgatcatcttaagtgtttgcaaacaaaaaatctattttcgtaagcggatcgcaacactgctagtcaaaatcatttattttcaatag

SEQ ID NO: 94960 - DNA, 992 bp, Oryza sativa
tagattaatttatttgattattctatactatagaagacaaattataatcatttttgttgtcgaaatgataactgcatacgtcgaaagacgtggttactcaacagtggttggaaggaaacgaagtgtattgaatcttgaatttcttctttttttctggatccccccattacatggccctaggggactatttatagcccaattacaggttcttactactagggtttaggttgtacaggggaatttacatgattactcttacaaaagggacatttacaggggtacataatgttataggggctcatgggcccctgatgggccgtctggcgatcgccggccctatagcccctaggcttgatgggccggaaaggcttcttcggccctcgcgggggcgaacttgccatggcgaagtcgtcttccttcggcagatagtcttcgccttgcacccttcgcctgagacgcctctggcctggcaaggcactcgtacgactcttcgcctcacgccgttcttgctccatagctttcgccacgggtttcggcagatttggtcgaagggcctcatgccatccgccaacaagccccttacgggtaagggtgagattggagcttcggccgagaccgtgcaaagtatgtggtatggtatgcggcgccccctttcaaccgatgctcctcccgaaacctacattattcctgcgaatgaagtttgctacttgtgcgcctattattattttgccgcgcttcgcctcctgcgattggtggttatatattttcttttcccgggccgaacggaacagtattggactttcccttcgtggggtttttactgtgccgctcggttggtgggaatttaccgtttcgcctaccattgcgacacgtggcgctttattactggtgggtaggcgaacggtcgcccgggtgagctatatattcccactgctctttccttttcaccgccacacttgccattttaccgtgtgcgctcttttcctccgttt

SEQ ID NO: 94961 - DNA, 1355 bp, Oryza sativa
tttgtatataacttgaaaaaagaattaacctatatattcaccgtatgattaaaatttataatctatctaaacctatactaattgggcattttctagagccaccactttaattagaaacttttggccattgattatctagactagattgtgttttcaaaaccgtagattgtaaaatcaacagcacgtttaatattggggccactgctaaagtgttgaagtccgtataaatattgtacgtacatgattgttcatagattgagaatccacattaataaacgtgtttgtttctatctggagtttgtttgttgttttaccgtatatacaggattttctcaaagtttctaaattatctctcggacttgccttaatctaataaattagtgttttatacactattacagccaacagaaaggcagagagccatatataggtggtcgatggcatcagcaagggacctccttaatcaccatgtagctaatcctctttggtacggtattgtatttgtggatactcatctttacctatatctttacctctactattataaaaattgaagatatttttaccggtactttgttacgttatccgtgtttgagtcaattttttaattttattttacgttgtctgttaaaaagaaaaaacagtccgactcaaagaggtaaaaaaaaaaagtgtccgactcaaaagcgattaaaaaaaaccttctgtcgtcactcatcagtgaaaataggaaaaaaatcatctagagtccgacttccgtaaaaagtcttgccacgggtattttttccgactttttacatgcgattgagtttttttcgcacgcaattaggctcttggttttttttctcttttttttaatccgatcacgcctccctggcgcttttgttttttttatcaattttttgtcaccggttttttctcccgtgcgattttggtttttctcatctggttttttaatccaatcattcgccgcacgcctcccgagttgaacccaggcaccgtgccgccaccatatcgattgtgcgttttttcctccaatttgattgcaaaaatcgattcctcattcctcccttatcattttctccattatttttcctttcgattcggttttaatttatcggatttaatctcctttaacaattgcgattcctcattcctccatcatcattttctccattattttccctttcgattcggttgtaatttgtcggatgtaatctcctttaacaattgctgatgatgatggcgatcttccccgatcatttttatcccgagttttgcactttgattttagaaaaaaatgaaaagaggtcattgtggatcaaaaaacctaaccacatttgggtgatcgagaa

SEQ ID NO: 94962 - DNA, 772 bp, Oryza sativa
aagttcacatcactaatcaaaatttctaaacactgcaaatcccatatacaagtacaaatttgaataaaaggcgtcacagatataacaatagtatcttataacatcatagccaactaatttaacaagcaagttcaaaatgagcaaatattaccaccagtgccggaggaaggaaaaaaatttaggtgtggcctatgaattaccacggaagttagcacagaacgaaaaatctcaatgcacgtcattatacgacacaatatcatctcaataagtctacattaagcatggcaaacaagaactactcacaagttcatgattcatcatccatttgcaaacaagtgtagatagaagaataggttctcagaaaatatctcatcttctcaagattcatgttttcaacaacacatcacatataggaactacagtactaagaatagatagatatatatgtggaatctacaaaacaactagtaccaaagattgattaatgttcacatatgtagaatctgttgatggagtgatggatacttggctagttggcttgcttgctgtcactgcttggtgctgcacgcctgcacagatgttgtgcccttcgtcccaccctgctcgcaggcccccctggtccctggcggctggtcgcgctgccgcctggttggagaggatgccgcagccgcagctttgcgccctggaggccggaagcctggcagccacgccctccacacctcacccagccctccagcgcgtggcgagcaccgcagcagccgccgtccactga

SEQ ID NO: 94963 - DNA, 803 bp, Oryza sativa
tctggatctcatccaggagctgctcatccatcaccaccactaataacaaaacttactagtagcacataagataatttgctactatattccccttccagtcctctacaatcaactacctactcttgcatacccaaaatccaaaatctctcaatcctcaatccaaatcccaaactacgtaccaagctcgtctcgttagctagtggaagaaggctaattaatcaataagcttagcatattggaggaatcaggaggaaggcaagttggctatcgagtgaatggaagagaagaagaaaaaggcaagctaagccatgaaaaataaagaaatctaattcaatggagctagccaggaggtatttgaggatcagtcgggaagctatctctttgcccaaatcaccgttgccaccgcccacatcgactctgacaactccgcgcgacgtgtgctccaggtgcctcgtccatgcgtgcgctcatatgtctcattgtgcgaggatatcggtacataacatttccttttttaaaagtaattacactataattgggatgtaatttatattaaacttatatataattgatagcatagtgcgtgtggctggttggctagctagcggatgatcttcttttcgagctatttttgttatgtgaagcatattccaaacgaaaattgcgaaaaatatagagaagttattcatatttacaataacaatgacacacactgctattcttttttttcgagataatcacataaagagggtcatataaatattattaagattgagaaaaaaaattaaaaaaagaaaatacta

SEQ ID NO: 94964 - DNA, 720 bp, Oryza sativa
ggagttgcctctgatttctgtataaaaattatcagtggtgagaaccggttcgtactgtttgtaagagcttgatggagagagattcttttttattatgaaaggtgtcatccaatgtattgggtgtcaaagaaagcgaccttgacaaggccataccgtatgtatgatgtataagcaatcaataagttttttttaaaaaaaaggaactttacatggaagtccatgtaatatatatatatatatatatatatatatatgtattccaatctgtcttcaactttcttgtatttatatttaagcccttgattttaagctttacactaacaaagtttcatcttgtttatcaaagatatagccttttaacaatcctaatagtttcatgtggtatgaggtatggtatagtaaattaacaataaattaagagcctgactagaatgtatttctatagctatggcttatgtagccaaacatgcgtgatcgatcaactaaaaataatttcgagggcaatactttcatacttctactcttagactcctagattgattctaaaattaagttctaaaaggagttggaatagcttcaaccattggagggaagaagaatgagcacatgactgatgggggttgaaattggaaacatttttttaacatattcatagcaaaacttttgtagaaatagtcccctcaaaacagcaaaacataacaatacaacttttatatcgtg

SEQ ID NO: 94965 - DNA, 1937 bp, Oryza sativa
caccggacctccagccgatgtgtgctttaaccttcggatcgatgcttatttatcatatcattgctagccgattggtttatactggattatattgttattttattgcatcatcatcagccgattgcctttatatcatccgatgtgtgttcgatttttttttcgtcaacccagatgtgttagcaaccaaatttggtaatattggcatcgggaaagaagattagatcgaagcaaagtcggaggcggagatcgagttcggaaacagagcaggaatcggctggagtccagatcggctacgagtaggatcggttgggtctgagtcgggctaggtaagccgatgcagccgattccgacaatgcaactgtatgatatcgggttgaattgaggcgcttcaaggtgattgccgcacatgatagagtcatgagaaggcaattgtatctagtaattaggatgttttatgtaattaccttagagatatgtttgggcaaaagtctgccgcaaagacttatggtatcttagagtttgtgagagatagtagtcgtgtccataatggacatatcttgtaattctcgggtataaatagacccgagccctatgtaacttttaacacatacgttcaatacaatctcggcgcatcgccaccctttttgctttagttttatttcgacgagttcttgcttttgggttgagctgcatcggtttcgatcttcaacaagaggtaaaacttgttatgatgaattatgttctcgggattagtgcttccatctttatgatactctaatcttgtctatgtaattcgtcaagttatcatatatcttacataatcttcgacaatatcgtcatctaacctacaatcggctaacatctgttaacagaaggcagccgatttgtttaaatagcgacgttgacctagattatataagatatctactactctatgaaacttccagcggcttgattgtctagatattgttcttattttcatacttaatgctacatcagtttgagtttgatctataaagtcaatggcttaagaaatatcaattttctagcctgcccctctggtcgccgattagagtagcgtcggagtttcagccgatcttacctgatttaatcgtatttgctctatatgcttcaatgatacattaaatctgccctttatgtcaagatcttactgcatttaagtatattaggctcttgtttgatatattttacttgttttagtatcctgatatagagtagtatcggagtattagccgatacatgctagatctatctgatcagctatgctattaagatatataaggctgttatcaatatatattttgatctaagtgattcatactgtctcggcatggcgaccgatctatcccagtcacttgatttaagtatatatcggtataggaactatatattgttaatatttacagctgatcaaacagatttagttctttattgcctatttacaaccgccgatcgattcacatatgacatcggctgccagataaataatgtgtcatcggcacctagccgatcggctatcatttatagatttaactgcggtttctttgcttttatttcttgttgattatatgatcaaatcaactggcacgctcatacattcgaaggcgagctttggacctgcactggagttaagcaaatctcccagttctcgtgtttttgtcaacagtcgtatagtaaattttgcctacttaaaaacatgataaattctagcggtgtgattaaaggttattttagacgtaactttattaagggtctattgttagaatattattaaacatgtttagatgtatgtttcctttttattattaaatatataaaaattggtggatatatagatataagtacttttatttttagtacctctttatagctagacatatgtggataattctccacttttagcatataataataat

SEQ ID NO: 94966 - DNA, 1204 bp, Oryza sativa
aaaaaaattataatctatataacaagaaagaactgcttgagatgtaacagcttcccccatataaatcttcatactacatatcaccttaacacgcggaagtcaccgatacgctcaaacaattttctgcgctgtcgatgcttcaaggcagctgtccaaacaacattcacctgcagttcatagggaccttgctcaaggacacattcttcatcattgtgtccaagaacgagctcaaagattgagccagctccttcagaaacacagacattgagcaccagttcatcatccaaattgacggctacgaaacagcgagtcagatcgactgatccatcagctccaagaactctgttcctgccttccacttcactgtcatacaggatgattttgttctgatcatctccagtagtccaagcagtcactttgccagtgaaaaacttggatacaacccccttaattttgactgcaacagaagcttccacagctaattgaacaggactatacacaaaatcaattctactcaggcagctctctagcgataaagtcatcggctgctttgtatagcagatggcattgtgttctcgcacacctttgcagaaatctttgtcgacatcaccgtctctaatcttcaaattgaactcgaaatacattttgtctattgcacccagcgctcgattaggtcctgtcagagttagtgtgtcctcctataaatagattagggaaaatcatgtcagaaatgccaccagaaacactaggctcgataagtcaaatacagttcagacagtgccaacaatatgttaagagaaatttgggtacataatacatacagataataattttaggtctatgaagttatgaacagcctgtgaattgcatttcaaactcccatgttcaaatgagcaacatgccaatataaattcttttgtttccacttttttccagtacaaaacgtacatgatcccagagcactaccgttgcactggattaacaaaatagtataacaggtaaaagtaccaggatcttgggatatagaaactaaataagtaaatcaaatctcacaaaaaaaaggggaagtcatggattgattgatgttccaacagtaactgtcctgaccctcttagacagcaggaatggactaccaggcaatcagattcagtggatatatgatattgacagcaaggtttaagatctggcagtagggattttaatg

SEQ ID NO: 94967 - DNA, 781 bp, Oryza sativa
cggcgtgctagggttcaagagattcgcactcgcaccacgtacggtacgctcgcctcctcgatcgatcccctcttcctcttggtatgcgatgcataaaagaacaaatctaaatattgcaatttttgcttctcttctgaatttatagctgtggcgatgacagcattggcaagatgggtgaactaaccaagaaggtcaccatggagaaggaggaggagcatggaggtggtatggctgctgggaaggaggagaagcagcagccaactctgaaaaagcagcagcaggtgggaaaggtgaagaagaagttcctggattttggacaggagttgacatgggaggagaaggtggtgagcgttcttgacatcgttcgccgctatcagttaactgaatacgaccccaagttaaaagaatttacccctacccgggtcagtttctgtttctgcaacatggcattctttgaccacgacaaagagtgtgagtatcctttcacttattctaaatttctaaatttgcacgtatcatttcattcacttgtctaattagttctcgatccgtttattcctatgaatacatgtaaattcaagcaatatatacttgtgaaaacttcttcctccctatctgttgagtctctagatcgatgtcatgtgtagtaataataatgttcttgtttgatttctgtttctggccctatttttgcagcaaaaattagtcctgggtctccgattcgcactatcccttcctccaagtttgtgatgttggaaggctctgttaatgtcattgcaat

SEQ ID NO: 94968 - DNA, 2017 bp, Oryza sativa
gatctccattccttgagtctaatccccattctctgattttttttctttgttatttgcgtgtgtgcaggacagcgggaacgagactacgagagtctaacaatggtagagcaccttgcagactggatagattgatggtaatgcctcgtccaataattagtacatctttattcactgcaaattgcaaatttatatcccggttcctcccctcccaaacgtgaatgcaccgaaatccccatctctttatacactatcatgagctggcattttaactataatgtacactttctaccgttgcattgagtagtattgccttcagctatgcatcgaaagcagttacgatctagacatccagtgttcaatcagtaaaatttattagggtagcaaaaccttgataaaaaatttggatgtcgttaggtttagaacctttaggatttaagttttgatattagttgtggtctttttattactgtgatatgagtttagatcattttatttgtcagataaagttagcaaagaaaactgggattagctcaattttttttttggcatagtgtaggtgctgatctgatgatgagctaagaacaaactgaaggtactgagatctgagggattaacctgtttcaaagaaaactgggattagctcaattttttttggcacagtgtaggtgctgatctgatgatgcgctaagaacaaactgaaggtactgagatctgggggattaacctgtttctgatctgatgatgtctatgttaaacgagagtattttcccttctcaggcataactgactttttttgttcgtttgatcgtactaaaattagtattttcctttctcaggcataactgaactttttgttagtttgatcttactaaaattggaggcaaatccaacacccatgcacaaaaataaataaattaattttaaagaatatatgagacaacatcatagttttcagtttgttgttttcttaggaaaaaaaatacatgtatgaagaatctgaattctgatataatgctactactagagcctggagaaactctagccatattctaattcttctttctttctctttttttttttacatccttcaaattgtcatagttcgatttccatgagcctgtaagcattggaggcgacgaaatggcagttggtagagcataagcatgaacagtggcagacatataaaatttgtcctaatgaattttcctactacagttttaaaacaatcgatatttgacaaaatatttatgtgttccatcttgcatattagaacaagctatttgatccatttgtgttctccattttattgaaattcagggtatcgttggtgaggtgtaacttgccaaggactgcatcttcatcattgcctgggtgtccacctcgctgatctcgtccacgccaccataactccatcagcaagcctcactgatctgctccgcttcgcctccgggactccatcccctgcttctctgatctgggacgccgacgagccatggactcctgcatcgaagcactgccacctcctccgccttgagcatcactgtcgccatgaggtcattgaatgcccatgcccccttttgcaaatacctacttgtttttcaagtttatgttgaatgaagctatcagttctctttctgttcgatttgccaccactatttgataacctaggaatggcaggtaatgccaatgctcccaggttgcattgctctgtttttttcctagaagatagagtattatatgttgcttcactgaaatagtaggtctggccattattaccatgcacccgctcaaaatagcatgtctgatctggggcctgggtgcatatccaagtcactatcgatcgcctgctgtccggtctccgtcgccccttcatcaggttgacgtcgatgcgtcgccaacgctgcgccttgctgcagtacactctggtattgtagcccatcctctttcacgtttatacattctctctttgaagttgaaggaaagtaaattacaattttctgtgtatacgttgcatttt

SEQ ID NO: 94969 - DNA, 657 bp, Oryza sativa
gcagatcgttaaggtatggtcataactcataagtatgcaatttgtaggcttcgaaaatgttaatttttagctatcagaatttcagtaaaacatttggaaagatttatgcatggcaagaggcacaggccttttcacacacgccgtgtacggaaaggaagacatgtcacttgttctaaagttgcatcatggtgcactatgattttttctgcagagttacatgcgtgcttgcacgagcagcaggtttatccttgcagaagccaagtgctaaaagataagggagaggtacaacacctacctaaaaattcagagaaagcactgcagaaaattgagcagatctcacttcagtttgcaggttgcaatcaaacacactgaagttcctttgcatgtggagattgagtagtttaaagccacctgcttcaatctcattgctccagtagcttcagagttcagacacagcttgcaactatgtccagaagtaggattttactcggtgatttctgattaaccatttgtcttgcttccatatgttgctatgctgcataaaaacctcatgctaaacacaggctccagaaatggggatctagcagcaactcttcttaggtatcgttttagtatgagcatttaaacctaaaggcatttacatataatagggtggta

SEQ ID NO: 94970 - DNA, 882 bp, Oryza sativa
tgactagttacctgtgacgggtcgtagctggatgcctcaccgatgacggcatcccgtatgacccgtcagaggtgacggtcatcagtgaccatttcgtttgcccgtcacaggtatcccgtcagagatgtgaggatctggtgtagtgagatatggttatattttgaagtggaggagaaagtgagtgagtattatttctcctaattcttgatctatcggttgagatatgagtagcactctacaaaattatcagattcaatctgatggtgtatccgatcccaatgcccgaaaactacgcctacatggttccttttcagaacgagtagcagaagaaacttgcgatagatcgatcgggatggccgatgcaaacggcaaggcgctagctgctcgctatactccgtgctccataaatcaagagctagctagctagctactcatacctgcaggggggtggtggttagtgggagtacagggaattggctctcctactgatactgtaattattcggagaaaggcgccatgaatcaatccatccatcgatggagctagctagtgcaggtagccgtccacgccaccggtgcgtggccaatgcatggactcgccccgcccgcgcgaagtcaatggctgccgttttgtggcccgcgcgcgcgtattaatcacctcatcattagctctctactccgatcgatccaccaacacacctgcaggaggatcgaagtcagcgcgcggccacacacgcgtcgtacgtacgtacgggtcgcgttcgcgtgcacacaggcgcacagcccccgtgcgcgcggtctcatgaacggtgagccatagagccagcgcggtgatgcaggcgatcgatccaccgttagaggtcgtactccctccgtttcgttt

SEQ ID NO: 94971 - DNA, 596 bp, Oryza sativa
tccagtgttaatcgcagagaaaggggtaaaataaatttcgctatgctcactggcgtgaaggtggtacgctgccgtggcggaaagctccgcatcgtcaagcacaagtcgtgccgttataacttcggcgaagactacacccctgattatctactctaactagtagagtactcctacttagtactgtcctaataaaaacccttatttgattaatcctactcttatgcaggatacatattcatcggttagttttaaaactctgcattgcatagctctgtaaactctgttagtagagatgaatgatttcaaggaagcaattctattgttaaggacctgaaaaaaaaacatttataacctgaaatacttatcatctgatcagatagcagtctaagtgccaaaaactaatactagtgacaacaaatggcagctgccataacagataagcctgaaagcaatatgtcagcttccttgatgatgcatatgtggccatgcgggttagctcgtctctctataattttcattcctttaacaggctgcataaatgcatgtagtattgacgatgagaaaaacacaatgcttaaatcatcattgggcaaaaa

SEQ ID NO: 94972 - DNA, 695 bp, Oryza sativa
ttgaactgagagttctgaaggtatcagtgttctatcattgtacatctatctttgaaagcgggtacaattgcagaaatatccattatgaaacaatattaatatatatgacacatttttttaagactatgtctaagttatatcatagacacactttcttataggcatacagcctttcatagaatttcatatgattgttcaaaccaagaagacaatattacgggagaaactaggtgtatactgtataccatccaaattttcttctttagaaatataccacataccacaaaaaataaagtttactttaataccgtccaaacttcataactcttgtaaattgaccactatcattaccacctgttggaccaactaatagctattgaactagatggctgatctggtgtggcttggctttgggtaagaaggattggcctctgtctagtgcctcactttccttctgcggttctgtctactgtcctggtttggaagaagtcaaaccaagccagatcagccatctagttgagtctctcttaggagattggacgtgaggtaacgggaatagtagttgatgagatttgtgaagtttggatggtcttaaagtgaacccagcaattttggtgttatctatcttaagaggaaagacttgagtggtatacccaatgttgtattctattaatagcaaaacacatgaagatgaa

SEQ ID NO: 94973 - DNA, 739 bp, Oryza sativa
cttaagcatggcattggcaagagaagacagtagtgcgacagctttgtattgccaagctaccaaggggatcgttttgtcctgtctccacctcaagctttaaaaaatgaactgtggttagttttcaatacttcttttttgttaggttagagggcaaacacattgctaatcacacaagggaacataaagaatggagtgaaccatgtgtgctgcatattcaaggactaaggagtgcattggtatgtaacaataattaatatatgtacagttagaataattaaggacttgctatttattttctttatgagtatttttttattattatatatgaaagacagctacgtgcacacactacacttatgcattggtgagtactccctaaaaaaaaccaacttttggcaatgcgtctagttcattgctagaagttggttttttatgggaataagggagtacatgagtgtggatggaagtgctcttgccatatcaatttaagatgaaaaacattgatcttgatcggtggcgtttaagaaaaaaaaagtaatttgtagtattaaattaaactgcaattttcaatataaaagtaagttgatagagtatttgcagcaaactaaagttgaaacaaaagcatcacattgtttggtttgaagaatgcaaggacattttagtatcatgtactccctctaaccacaaatgtaaacatttcaagcgtttaaatttttatccaccaatataagtattcata

SEQ ID NO: 94974 - DNA, 675 bp, Oryza sativa
gggtatctagacatgaggaagagagaagaaggaagaattgaagaagccagggatgaatcaatcaaaaaatttagtggtggcatatcttaaattactgtaaaattatagtcaccttttacagatatacgaattataataacccttagaaaaaagtgaaaatctgatgttgcccgtgttgaaccttggacctttatgacctttactctactgccaaaaactaatagttcgctttacgatgaattttcgcacatgagacagatggtccattgtttaggcacgctcatcttcgccgcaggcacatatccttttctttacagaaaagaatgaataagcatgcacatactgttatgctactttactatccgttgttctttgacgcaagctgtgcaaagcaagatccattctgcacgtggttggaacagagaccacgtataaacagctcataaacaataggttagtaggagattttaattgtggacaaaaaaacatccctcagctaaccattttcgaggccagcagtcagcagaacaggcccgcaccccttgccccgttgtcagattttcagtgggtttcagtttggtccaatgcagccatgcagccatgacttgcatgtcactatgaaggaggaaacatccgaactcaaccgattcgccgctcttaattagccgcactgta

SEQ ID NO: 94975 - DNA, 658 bp, Oryza sativa
gcttattcatgatcgtctcatcctcgatctcaactgatacaatcactactgctatgccctcaagcttgtccacaaccaccattatatcgacctcgctcgacattctcgttaaatgtcttgtgtagtttgtcttcaaacatatatgctctcaagaaagtggtgaggaagaagggtggcaaaagatgtaagcttgaaaagataatgcatggcttttaatagtaggacggtaaagatgagaacaaagatgattctttatagtaagatggcaaaagtgaactaaaattcctgctatatgtttaaaatcgtaatatatttactgtatgtcaattttgtctatctaaaagtataatgtggaaacaaataccttttgcaacctattattatctgtaccaatctatattatctatgattatggagaagattaaccaatgaccacatgaatatatatgatgtgcaatttgttctgtgccttatttcaaggctctttttacattatttctagtaggattttttgttgttaaatgtgtatgatctaatggtgtagaggtccaagtggctgtttatgttttgtttgactcgctgacgcatcaaaatctaatccttacgatctagatatattatgatctaaaaatgtagatttttcttttctatagcagat

SEQ ID NO: 94976 - DNA, 665 bp, Oryza sativa
tgtgtggttgtatataattcgttgaaaaatgtttcatgcacctaatatagccaataatagtgccttcatttttctacattgtccttacatatttctaatcaataacgatgcttaatccttgacttttcattgaaatatgaaagatcataatagctatatgccaacgttatacgactgctataaaagtcacattggcaacagatacactgagctatcttaagatcagatttgagatgttagtatccatagcattttcatatgaggtggtcatgcattcagacttgagatctcagagtgtctaatcggctgccacgtgcaccttctagatgctaaactttttttttttgcaccactactcctaccgacacctcatgtacgtatgtgtacaaattaagtactcccttcgtatttagggtaggacgcaattgactttttaaccaacgtttaaccattcatcttatttaaaatttttgtgtaaatataaaaatatttatgttatgcttaaagaacattggataataaatcaagtcccaataaataaatgataataatatatttttttaataagacgaataacagcgttatattaaaacacggatgaagtataaaatactagtattccgtactatgcacagtagctaaatacagtattgtttggggagcag

SEQ ID NO: 94977 - DNA, 2567 bp, Oryza sativa
aaactagtgtaaaatactagcctgtatttcttgtccatctagactgtaaatggcacctagatcccccgtttctcgaaaaaaagttccagctgaaaaaggcccattacaccagaaagaaagtaaactcctccagaaaccacacatgaaaaccatggtagtcaggctcctctcttcttgccttgagcttgcgtagccctctcctctgcgtctcctatgtggacccccgtttttataacaagaatcattcgtgtaaacagtaccatttccctggatcaagtagtctggtacacacgagttcatagctgaaataccagatgcacatacacgagaatctagtgctaattattacatcataaacccgcaggcattgtcttaaattatcggaccgagcggtccggaatacatccaaaagcagaaatagataaggcagcggaattaaggcagcggcatgccattgccacaggcaacgaccgtactaagacctactgagcgccatcgtcttcatctccctcctggtagtaggcatagagatcctccggaggttcatctcccgcttctgattaattttatatttgcaagggtgagtaccaaccgtactcagcaagccaccacatcaacaatgcatatgatagggtatttcaaaggatggctatggttcttttgcgcaaagcaaattttgtaattcttttcacaagcctaagacctagcattgactgatcaaattttagtaccagtgtttgtattaaaacaacgacggttctgtccaccatccaatgtgatcccaaggatagcttcctgccattgagtcgttatggttttctgaggacgcccaccttcccccttctcaggaagtggctccaacaacataaaaattcatcatgcaataacccatcccacacaaattaagaatttaaagactaaccaagagtaatacatgtcccggtgctcaataaccgcgagcacggctattcgaatagatttggtttactcacactgcagtggatgtacactttacccacactccgtgactgcccaacacatgagccttgtctcaacacatgagacacgtcacggcaaagcttttcgataacctcgcattggcagtacccgctccatgaacttttgcatcctcatgcactctaggcgtacacagtttctagcagtgagaggagttctggtgcacccgggaagggaagatttacacccatgaattaagttataattaggttccactcaacacacgacagtcctaacaatggcgacaccattgtagagcccctgccttacacatgagaaaccactatgcatggatattgcctccgctcggctatttattccgctaggtctatccccattcaagaagtgtggtcgtacggggtcgtttcatgcttaacttcatggctcggtccttaattgaccggggacggtactagcctttcccggatatcacccaaatccaccgtccgccccggtctaaaacaaatgtttaattcctttcatgtcatcattatcatggcaatgtggcgctcatgtctccacatgccgcatctcaattaccttcccaaaggtaattgcccaagcatataatatttgataaatatgagtatgcaagatgctaaagtagcatttctaagcaattgtcataattgactagggattcatacgtaatcatggttacaaggatttaaaggtgaacaataaacaaggcatggcataatcacaaataggatgttcatcattgcatgtaatcttatttgtaaacaagaattaatttcgcaatagggatcaacgtggtcaaagaatagtgatgatttgccttgctcaaggtcttgcgggtcttggccttcacctggatccgcggctccctcggtctctatagttacgtgcgtaagaacaatttgaattcgattagaattcaaacaaaatccaaataatgaccgaattgaaaaacgagcgcgagaggtgaattctatatcggctattttattcgcgaagtggaatttttcctcctcctaagatgttttgcgtttcctaagaaattttgtgatttaaaattatgtcctagacttcatctaattatttagttcttaattatatctaaattactaccgcgaaattgattccttatggagatgactaagaattaatctataacaatctataagaattcatctaattatattttcattaatcctataattaaattctgatatttttgaatattttgaatctccccctaatttttcctttcttttctctccctctctcttttcttttcttttcttttcctctcctttctttcttttcctctttttcttttctttccctcccagcccctttctccctcggctccttctccctctctccctttttctgcctaccgagaccggctggggaaagggaaaaaggcggcggcggcacggtttaccggcggcaacggcaacggcgcggcgcacggcggctgcgacggcggcggggaacgcggcacggcctaaaagggtgacggtggcgcggttgagatggggaggggggggggaaaattggggaaatggtgtggggaggtttgg

SEQ ID NO: 94978 - DNA, 1316 bp, Oryza sativa
agatatacatgcagaacttgatatctattaatttcttatctcctcttactccatcatccatactttttgttcactatagtttgctattatgtttgttcaaaagatacgaaaatagtgaattggtactgaaagatgaggtggtatatataaaaggacgacgaaatatataatgcctctatgcatttaatacccatctatatatgttcgtagcaggaggtagtaattacatttctctcatcaatctgttggttaattattttgaattaaagtgtgaagtaaatgtatatataattatgctttctgcataaactttttgtgctattccttaatcacccttgaagagctaaaaatagcgaagaccactttgtatacatgcaccatagtcaagtccaaactaagtatatagtggccacaatgtaagtcggattgcgcacaaccggcactgaagtcagccaggcatataaaggttgacaccctaaaatagtcaagataactaccatttggtaccataaaaacaaaatggatgcacgggaatgcatgtctttattatagtgattttagtgactaacgattacatgtcttcccgtggatcccctatgttataagtatgttacctttgttgtatcaccttaaagcaaaatcccaaaacattagaggaaaacaaaggattagaacggataagtagcaggcatcatgctcagcataccatgaagaaaagaaaaccatagtacctggcattaagttccaatttttaaagtagagatcatgtagatgcacaaatttaatttatagaccactgctgaagaaatgatctttatactggtttgtaatcccctttagtaccagttgtagcaaccgtgaccaacaaatcgagcctaaagaagatctttagtaccggttctaaaatgcatattaagtcaaaaaaaatgtgggggatacatattcaaactcaagacctctcacctcaaccctcacacacctaaccatcccaccaactccacatatttgacttggatagagattatttctttttaaactaaccctagaggcatgtttagtccgggttggtgttaccaactgggactaaagatctggttggtgtaaccaacctgtactaaattaaagatgcatttttactacctattggtaacaccaaccggaactaaagatgtttttggaacttggacttttagaaccagtactaataacatattagtaccagtaccagttcttaatctaaccgatatatttgtgtttttgtgtcatgacaaaagatcagttatacagtagtggataagacatttttttgggtatgc

SEQ ID NO: 94979 - DNA, 764 bp, Oryza sativa
aacagggagcagtcgcgcgaagcgcttcccaaaaaccttattgccgccttctcccggtgcaggacgtcgaaggcagaggttccggagatctgctctcccgatcgctggtgcacgccggcgagcgggatggagtagtctacgagcgacggcgcagtacagagtagaaggcaaaccctagattgattttgcgtatatactgcgtgaagacggcgggtcggtttatatagagaagggtcgcttaatcagggcgcccgcacgatctctactgcgcgtaaccgaaccggataagtcgcgcgtaacttatccggactccatgccgtttgcacgcaccggatttttcggaacgtttccaaaacaaaagcgaatccgaatttgcagcaaaacaaaactgcaaaaggaggctgcatctgcgcaagggtgaggagccaatttttcggaccattcgacgcgtacgtcgtgcacgcgctgccctgccaggccaggccaggcgagcgagcgcgcgcgtgtgtttcccctcttctctccaccacacatgcttcaagtggctaggaggacatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatatac

SEQ ID NO: 94980 - DNA, 659 bp, Oryza sativa
aaaatagtttcgttcacgcggggaaggggtgttcccgatattgaagaattggaaagtgatattgcatgcataggttataattatgaactgaacatatgcaggtagcctcacatttctttcatcacaaaaattcttaaaaaaacattctgtagatcgtgaatgtcaagcgtggaaacatggtgtcatccacagtttaccatgtgccagagcaacaattcatccaactgaaaccataagcttgcaaggtcaaattttcctggatgcctccttgtccgatcaacctgagatatacatgcagaacttgatatctattaatttcttatctcctcttactccatcatccatactttttgttcactatagtttgctattatgtttgttcaaaagatacgaaaatagtgaattggtactgaaagatgaggtggtatatataaaaggacgacgaaatatataatgcctctatgcatttaatacccatctatatatgttcgtagcaggaggtagtaattacatttctctcatcaatctgttggttaattattttgaattaaagtgtgaagtagatgtatatataattatgctttctgcataaactttttgtgctattccttaatcacccttgaagagctaaaaatagtgaagaccactttgtatacatg

SEQ ID NO: 94981 - DNA, 672 bp, Oryza sativa
aagccatgtgccgaagcacgcaagcaaaggccaaaagacctaaatccaagctttgcaatcaagagaactacgcaggcgaaggttatatgggcgaatggcatgtgacgaagcacgaaggctccgcctggactaggatccatgcgaaggagaggaccagagggccctccagcccagggaagccccttccgtcataaccaggcagaccaagttggcccatctagagcccaaaagtgtaaaggacactgtgtgccctcactaatgtccctttcacaagggtatccatgtaaatttccctgtacaacctaaaccctaggaggtgtaagcctctggtctaggattataaatagcccccttggaccatgtaatgaggggatcctcaaaaatttttatcaagttaatatattgttttactattcaaaacatccaaccaatttccatgttcttcgacgtgacgcggttgtcattcgacaacacacaacatgatttgatgttaacatagccttgaaatctgtcgttaacaaacctactatcaattaataacaatacaaatctccttcacattcgcaaaagtatgcacaactactttgagatttgtgattggtcaaagaaacttctctcaaaatttctcattgtctgtggtcttgtgcatgtaagacttcatgtggagcttca

SEQ ID NO: 94982 - DNA, 796 bp, Oryza sativa
atatgcatgtaagacctcagaagccggtgtatcaatcgaaaatcgattgattttttttctcacaaacaaggcatatgatagataaatgatcaattgaaaatcggttgaatttttttctcacaaaacaagcatatgatagataaatggtctctgatctttccagcctacctaatttttttctccaaaacaaaccgttctgttttttattctatgcgcggtcgacaaaaaaaccatgatttcttaaaatcgacccaatctgaacgatcatcctgggcttaataatttttttgtccaaaataaaccgatctgctttattctatacgcgatcgaccaaaaaccatgattttgaaaaatagacccgatccggacggtctcggacttaatatttttttccataataaacggttctattttattctatgcgcgatcgactgaaaaaccattttttaaaatcgacccggtccgaacggcctcggacttatttttcttatccaaaataaacagttctgctatattctatgcgcagtcgaccaaagaaccatgatttttttaaaatcgacctggtccaaacggtctcaaacttaatatttttttttgtccaaaataagctttattctatgctcggaagacctgaaaaccaattttttttaaatcgaccaggtccgaatggtcctggacttaatattttttttccaaaataaactatcctactttattctttacgcgatcaaccgaaaattcttgattttttaaaatcgtcccgatctatacggtcctggacttaatattttttcta

SEQ ID NO: 94983 - DNA, 748 bp, Oryza sativa
ccgcccgctccctccctatactactagatacactcctcccctactacagtacaccacacaaaaatttaaaaaaaataaagagttagaaaaatttatgtatagaaatactatatataaaaaatttaaattcaaattcaaatttgaattgggtatgtaaactttttgacttataaactttgggtctataaaatttaggtgtataaactttatatgtatagaaatacaatatatagaaaatatttgaattcaaattcaaatttgaatcagatataattcaaatccaaatttgaatcgggtatgtaaacttttgacttataaactttgggtctataaactttaggtgtataaactttagatgcatagaaataccatatatagaaaatatttgaattcaaatttaaatttgaatcgatataattcaaattcaaatttgaaacaggtaaatttgaatcggatataattcaaatataaatttgaaacatgtatctaaactttagatgtgtaaacttgaggtgtataaactttaggtctataaactaactttaggtgtataaactttagatgtatataaatactatatataaaaagatatttgaattcaaattcaaatttgaatcggatatataaacttttgacttataaactttgggtctctaaactttaaatgtgtaaacttgaggtgtataaactttaggtgtataaatttactaaaataggaaatcaggtggagggagggaggggggagggg

SEQ ID NO: 94984 - DNA, 1112 bp, Oryza sativa
atagttccatggtcaggtctatagacttgttcttgcagttctgattctgactttctgaccagtttgtgatgcccccaggtacatatatatagtaagaaaaatctgggtattgatcaatcctacagttaaaatttcaaggtatcattcatctggtaggctggaagcaaatcagtagttttttttatctgcagagaaataataatacaagagtagatatattttttggggggggggaaacaagagtatatatattgcctttggaaagtagaagtgacaattacatttttgttaaagaatatcaattgcaagtgataaaacataagacgtgatcagttactaaactatgcatagaactatctaatccaacacggcctgcggtgaagcatggctagttgctgaatgggaacatcccagactaatttctgcagcagattattggttaatacctacaataaatgaagagatggagcattcttgtttttatatttccagagcacgctcagcatgaccatgtaattcatactgtctgggtggaatttgtaggcacagggccattctgaattggtcgaggctcttcgccatcagcacgttcgacactcccatggatatcctgggaactgtcaattctgaacttcatggaggtgtatatcagccacaatgcaacccatgctgttctgtgcttgattagattcttcatgtgcattgtttcgaccacccacatcaggactttgcacatcagaatctctaatttgggtgtaattggcaagaattgacatggagaacctaatcatcagcatgagagttgagatacaccagtgatgataaaaagaccagagaaactccgcaaagtgagaggtgctgaatctgtgttgggaattgcattacttggagagacagcctctgcaccaaaccatttcgtttccatacgtgacccctcatccccacttgttacatccaacatggcagttgaaagattatgcaccagtggaaaaccaggaggaaacacctgaaggggaaccaaaaaagaaaaaaaacatgatcatgccagttaggccagaaaattttgtccagaatgtagcatagctcttaaaaggatgatgagtgaattcagt

SEQ ID NO: 94985 - DNA, 1998 bp, Oryza sativa
ccaatgacatataagggaattaaagagccaattttcaatgacatataaaggatcagcctaattttcagtggtatataagggattctcttcttatgatatgttccgtagaagggataggagagggtttataattaccagcattatgtgctgcctcggtaagttctccacgggagtactcccaaacgtgcagtgtggtagagctcatgatcggatgcttgtggtacaactcctccaacgccatctcgatgcaggtgcggctcctcctccccgcctcggtccgcaggtgtaccaccacgcccaccatcaccggcgccgcgttcccacacgacgacgacgacgcgagcagcaaaacgagcagtaaacaacaatgagcaagagcagtaaaccggctgatgatatgtgtaagaaccatcatcatatactagtaataattaattaagcttcctctaaacgtatagtactaatttctctcaataggtttaaggagttaaagacagcatacgtatatatatagtataggcatgtgtacacgttcgtcgatcgatcgatcgatcgatctccctgcagacgagaggttgacgctttccatgcattcacccggtctgtgaatacgtgtgcgtcgtcgagcgatttgtttccgtctaagtaatagcctgtagtacgatatgtgtgtgtatactaattaagcgcgtcttcatccaagtggttatagcagaataataagcaaattaatgaaccaaaaacagtgacctggtttatattcaagatcgatcgatcgtcgttgacgacaggctagcctgcaagtagctaagctaattacaatacctttgtgcatgcattcgtaatttcgcggggaaatttcttttatataaatgcatcaaaacatatcatgggcaccatatatcaaaaatatataccttgtgaggtgattagtactaccggttgctaaatccgtgggttacaccggttattagttactgttgacagtattgccgggccggccaagaaaggccaaccaaatttacttaagaactgttgacagtacaaacatcaaaattttaataacatgttaaatacattggtttctagcaaaatatatgctggttattttcaaagtatataggtttggattaaaaaaaagagtctagcagttataactgctaaccaagttaatttcaaaattcattagtaacttttatgaacgagatagtacatcctaactgctgagaaatttctctcttgctacctactccgatgcgtctagataattacgcatgaaggttgattttgggtttgaaaactccttccctcgaagaattcagggttctgcacatttcgctatttagagctgtcaatgttcaggtctacaatcagtatatcttccaagcgaattaatctgactttcttgcaagcagaaaagagtggatacacgtactgatcccctgattcaaatgatcaacaagaaaagttagcattgcttcaacttatcacagcctgtatctgcattggggaatctcatctgacaagttacaaagttcatcatcggttcatgtttttatctcactaactggtaatttacacaatattttacatatttacatcgacgcaataaaaccgtcaaaacagaacaactttagatgatgaataaacccactaaaatatctactcctacataactatatccaaccaaattaaggccctaatttggattgcaaaaacattcagatagatacaactattcagaccatgcaaaatcaggaaaaaattcccgcgtccaaaacaaagcccaaatgccatctgttttttttgcaatttcataggggtactgtacataaccacgctgacatatcatccagtgttcatctccatctgagcatcatgttcaggcacagtgccattgtgtctgcaattctgcactgggttaggcctttcatcgccaacactaccctgcatcggttgggcaccctgaaacccatcatttccatcttcttggacagc

SEQ ID NO: 94986 - DNA, 1460 bp, Oryza sativa
gggcgtgacaggccgggcggtgtatggcggccctgtcgcactcgtcggggagggacgaggctgttgcggcggtggcaacggcaacggcggtataggcgaggcgaggcgagcgcggcagggatgtccgagtcgggcacgcgctcgtcagggcgggaagaggctgcggcgacggtggcaacgtcggtagaggcggcgcacgacatcgacgtcggcggcaacgacggcagaggctgcggcgcacgatggcacttccccctcgccgtcttcgaggccccgccgccctgcaccagagacgggattggaagatagtggcgggcgggggcggaggccggtggctcgcttgggcaacagacggcggcgcgcgagaaagtgcggcgggcgggggcaggcagtgggcgaggacgggcgggggtaggcagagggcaaggacgggcggaggcgagagcggcggacggcggcgcaggaggaagggggcggccgccgcagtgccggtgtgtccgagctctgcgccgccgcgacggtagggaaggaggtcgccgtcgccgcctcactccacgtcccgccgcccttgcctccgccgccgctaccactggagccgaagatgaaaatgaagataaagattaggtgtttcacacgaaacgaggcggtaataacatgtgattaattgagttttaattattacaaacttgaaaaatagattaatcttatctttatagcaacttttatatagaaagttttcgcacgaaatgtaccgtttagcagtttgaaaagcgtgccatttttatccaaaagtttatccagtttttgttggagaaaagaagagggccaatttataatatacaatgcattcaataagaaaatacttatgatccatttcatcatctaaaagaaattagacttagtttgttttaaaaacaagtaggtgtaaattccttttctttatggaaagtttaggggctctctctttttttttcacaaatataaaagcactattgttgctaataattatgtttaattgtacaatcaaattagtcctcccttgtagcgcccgttccatcgtggcgcctagcgggaaaactatctcttaaaaaccctatttacgaaatccgtttctttgcttgttgtctagtgtccatgccatctcagatctcaaatccccaatctatcgtcgagttcaatcccgaatccaaatccttcccaaatcaaatctctccgcaaaagtctattttgcctccctcgggttcgatgggccgaactcctctcggcccatctccccctccctccccggctctctctctctctctccctctccctctcccccgctctacccgtgcgctgcgcacgcgtgcgcgtgagccgcgccgagccgagcgctctccgccctcgctgccgattctcgccgggccgcccgttgatttccgcgcgcgcgcgcgccatggtggtcgaccgcctggtcgcca

SEQ ID NO: 94987 - DNA, 963 bp, Oryza sativa
cgaagtttccattacatatgtgatttgcactatatattttcccgggatgaaaggtggcgagcacttttgtttgtccgaataaaggacgcacgcacggcgtgcgattgtgctacgtgcttctcgtatctgctcttgtacgtagagcccacacagattgttgggttggctagggctgcgttctatacccatggtttctaacttccgtcacttattttccgcgcgcacgcttttcaaactgctagacggtgcgttttttgcaaaataaattctatacgaaagttgctaaaaaaaaccatattaatccatttttgaaaataaatttagcaaatactaaattaattgcgtgctaatcgtactaaatactaaatggggtaattgcttatttgaccctattttgaaagctaactaccaatttgaccctattttttttcagtttgcttatttgaccccgcttttcaaaatcgaagaggaaagctgaccctattccgttaagacgagttaacaccgttaactaagtggtaaaatgacgaaaatacccctaatacatccatctatcctcttaccactcattcttatccactctctctctactctctctctctctcaccagagcactgccgacggcggagggagcggcggcagctcggcgacgaggcggccctccgtcggcggtggaggagcggcggcggcggctgctaaggagcacggctcggcggcgcgatgcggaggaccgccactggcggcagatgcggagggctgcgtacgagcggcggtggctcgatgacgaggcggccctccgctggtggcggaggagcggcgatgaggggcggcgagaggagcggcggctggacggcgcgatgcggagggccgccgctggcggcggatgcggaaggctgcggaggagcggcgacagctcggcgacgaggcggccctccgcttgcggtggctgcgaaagagcgacag

SEQ ID NO: 94988 - DNA, 1478 bp, Oryza sativa
tggaagtataactttcggtctatgcatcatccaagaatacacacagccatatttcggtaggatttcaacttggtaaataaagtcaccacatcgatggtagatttgcaaatttcaatcagtcaagagcggatctagcgtgggacggtgggggctcgagactcctactggcaataaaaccatgagagctcccataaaaccctcactaatttttttttatcatagggtctgttcactttgccaccatcactttcagccctaccatttcttttgttactaaaatttggtaaggtacaaactaaacaaactcttgccatcatcactttactaaaatttggcatttcctaaaacttcttctcatacaaacactagtttagtaagacacatccatcatatatagtcaaaatttgagaacgccaaagtgtgccaaaaatttaacattgtctagcttattcaaatccctagctcactattttttcttggatctgtcactagtcacatctaaatctgcagcctgcaaaattctgcaataaaaacggtcacgtttttaagtgttctgctatgcagaacaattctccgagaatactgggtgaaagcgtatatgcaccaattacggatgcaagctggaagatactccaaaaacagatctgggcgtcttccatagtttcagaactgaaacatgaattcgatcagacatgtcatgcccagtctctgaattctgatgcctcaaatcactcactacatccccgagactaaaatctgccgcagtgctgccccgttggcccaatcctgtgcaggcccaaaaactttgggctgtaaatcttggtctccatggaccaacgagaccaccgtgcggtgcgcccatgcgaaaattaaggagccatatagaactactacgtcggcagcgataactgcacgtttgtggcagatccagcggcggccctcctccacgcggatctagcggcggctgcgctcccccgcaccgatccgacggcggccgccctcccccacaaggatccggccctccaccgtcctccctggcgcggatccggtgacagagggtgacattggtggtagggtggcgaggcgaagctcgttgactgctatagcgacgacagactacggcttgtgagcacgacgacagcattggtggcggcgacaaagagctagggattgggctagcggcgggctatggtttctgccggtggcaggctagggctcagggatgaatcgaggagctaggggtttcaaatttgatttttggaatttttgttttttggctaaaattattttcgcatgaaaatcttatttttgcatgcggttgttttgctcatatataaattttgattttcgcagacaccaaggtgcatcgagccacccagctgactacggaaatcggtttttggccatatgcaaaaatcgtcttttactagtgaattccctattaatttaagcaacttataaataaaaatattaatcaa

SEQ ID NO: 94989 - DNA, 1178 bp, Oryza sativa
tttgaggcacctccttctggagctttccctcaatctctttctatattctaactctaccatagagtagcctaaatatgaaaatgagttgtactctactaaagttgtgttatgttttgagagaagaatgaaaagatccttttataggtagcaatgatggttactatggcggttgtgaggtcagttcacccacagccgctatagggaaccaatctctatcctccacatggaaggtggggatagtggtgaatctaggatgaaaatagagggggtgctcctaatatcctatgttcaacccataatgcaatgaaaacatactaaaaatatatatttcttggtctcatgcaaatataatttatattttgttcataaaaaaagaaaaataaactaaggaatcaagtatcggtaccttgttaatcaaatacgatgccataaacacataaaaatccatcaatggcctgcatatcaaattaaattaaatggcctcacttgatctctaatttccttaggataatcttcattttgtttgcgacacgctggatcagcaacaatttcactaggatctaaaacatgcctcaacatgttgttctcatttgttgtattccttcgtgggtaaaaattatgcaatgtttgattctccatccttgcaaattaagttacctatgtgtgcctaaaataaagaattgatttactgaaaattgctgcagtgataatcaaataaaactgaaactgaacatactattagagagcaaagagattgatttacctgtactggttggatgtggcattgtgctgacgagtggacgtcgtgctggccggccgggcagcagatgagatcgctgaaggctgcaagcaactcgtcgtaccgtcctgcaggacctccgcggctctgacgtcgttgctgccgccgccgctctcgcctcgactctttctgtatcgcgccttaatgatcacggtctagcgctgtgatggttcagattcccggtcgccgacccaatgggctaagcccaacgtgcgcgtggtggtgagggggagggttctgtcaggtggaggtggggctctagccccaacgatacatccgccactgggcggggatgagtggccgcaagggtaattcagccaaaccttgttcggccgaccccctagcaccgccattccccctctcttttggcgtggtcatt

SEQ ID NO: 94990 - DNA, 906 bp, Oryza sativa
  unsure (1)..(906): unsure at all n locations
ctggcatgatgaccatctgntcggacacnnccttcatcaaaataaatcccagaaaaatctaggaattatagaattaagcaaagtatttaatgaaattttatctggccccattttatattggaatttattaattaaaattagatcttctcttctaggcttttaaaataaattctaataattccaattaaacaacaatttataatttggagatttttagggtgtgacaactagttaagttataataacccaaggtatcaaggaatagagtaatcaagaacaaaagggctataacaaggcaataggttaattccacccaatgacattcgaaaataaatgcaatagttgaatagaaacaatagctttaaacgggatcaacatgctcaaagggttgtttgggatctgtgtgacttgccttgctagccttggaactcttcaaagtcttctcctgcaaattcggactctccaggaacgtcggactctaaagagaaaagagcaaaatcaccaaaacaacacataaacaagcctgaacagtacatgtggatatttttaacatgtagatctcaattttagaaaaatttagagacttgaaccaactaaatccgagctaagatgaattagttatgaattttcatagattaaatcggattaaatcatttatatagattttaattgaattatgacgcaataatgaattatttttgaaaaggaaaaagggattattgcgtcagcggactcggctcatggtggaccgggtgcacggcggcggttcacggaaacgaacggccgagatcgatctatccaaaacggacagccaagatctaacggtctacgaccggtctacgaccggtctacggtggacgtgatgagctacttgcagtagaagccgagatcaatcaaangccctcg

SEQ ID NO: 94991 - DNA, 730 bp, Oryza sativa
cagtctaaaagaaaatttaatgtaatccctataataatattaaatgcaattatgaagtgggaatacatatacaaacaaaggtcatcctaattctctaaaatattttgtgcaagataaaatcatggaaaaatttatgtggatagtgattagcacaaacttatcctccgtaatttggtaacgtgttaacactcaagttgatacctcaaattaaacggtcaaagcagacaactaaaagaaatcaaattaaattttaatcggctaaaaccatgtttcatccaaaagtacatttaactgcacataagtgaacatgggaaataatgtattcaaatactagactagttatcatgcctaaatataatttttctagaattttcctcctctctttaagcctcctaaaaattcaatctagctttctaatagcccatctttgtttaatttctgtgagcagtccacccattatttttttagtgcaaccaaagaaaatggaatctaggtgtaatcatctaccaccagtaaaatctacactaattcttctggtctacacattgaattatgtagttacaaagttagaggagaaaataattccgaaaaaaatgatctaaaaatcaagtttacccagaatcttacccaaacctctcaccctagcctagtttgccatgacctggacccacctggcagcctctccagctcgcccttcctctgtccctcatcctcagccgaccaagaaaca

SEQ ID NO: 94992 - DNA, 920 bp, Oryza sativa
atttttatttttctgtgcgagcgacataagcaaccgcccggaaaaatccgattttcgcgtgtgggagggccacccgcacgcaaaaatcatgactttcgcagacgaagtgttgcgtgcgggccattcatccgcacgtggatatttttttttgaccgcacggaaaaacccatcccgtagcagtgaatgtcatatcatagtgtcaatgataatatttttaacatatcataaagaaaactggaacatctttaatcaatggcccaacctcggtgctggcaaccttaccaatgttttgctttacccaaaagaattggattgttcatctaacaacatgcataaaaatctaaaattaatacttttcagtcttattattgcaatcaaaattaggatcaatcaaatcctatattgcctcgcatgattaagtctacacaaaatagagccacgtgcactcttctctaaatatcaattaaaaacatatttatttttaatattatttccatataatatgttataaagaatagtagctatggtagtatgataattgcctacacagacatgcagggctatcaatacaagagaatagatgaggaaagagaagccgtgtagatggaaaaaatcgatggatcctatctaacccaaacgtccattaatttgatctcgttctcagaaaaaaaaaaccgaagcaagacttgtcttagttccagatgtcagaattcgacttacgctttaaaaaaaccaaaccgacgtggtagacgatgaacaatacaaatgttaagaatccttttcacggaattggatgttttttctttctaaatttagacagttttttcgcattgcatggtgccaaaccagattcttttataaaaggtggcgtttttctcacgttgagtcagacagttttttcaaatcggttattttataaa

SEQ ID NO: 94993 - DNA, 827 bp, Oryza sativa
caaacatgatcttactacattttagtagtagctttcttgatgaacttgtactgctattaatactgccgtccagtcaattaaacaggctgggacagaggatttattattggccacgcatccggcgtgtaaggccaggccagtagtactactcgagtactacagtaccgagtacactcactggtgatgttgcgatctatcgatcggtgatgatcacttgatcgggattcaggagtggttggcagctcgtgtcattctccctagagccaacgccatttcttccacattccagttccaagtcagaatttttttttatgtttgacaaagtttataaaaaaaatatattttcaacacaaaataagcatattatcaaaatatattcaatgttagatttaataaaactaatttgatgttttaggtgttgctaaatttttctatgaacttgatcaaacttgatacttcctccgtttctaaatatttgacaccgttgactttttagcaaatgtttgacctttcgtcttattcaaaaaaatttataaaatacgtaaaactatatatatatatatatatatatatatatatatatatatatatatatatatatatatacatagaagtatatttaataatgaatcaaatgataggaaaaaaaataataattacttaaattttttaaaataagacgaacgatcaaacatatttaaaaaaatcaacggcgtcaaatatttagaaacaaagggggtaaaatttgactaggaaaaaagtttatttgtcaaccatggaacagcataattataatgattaaacagtgatcctgatctgtaatctgg

SEQ ID NO: 94994 - DNA, 703 bp, Oryza sativa
cgctaaacagactcaagagtccgaggtagggtccacattttgtccctaatattcgggattttgtagctcttctgaaccagaattttcaataatatcccacccaatatgcactgctttcaatctgcccgctagcaagctcatcctcccccacgcgggcaagctcctcctcccccacgcgccgtttgcccgcacgcatctggcgagctcgctcgtgtcgtccccgagctcagccgtcgccgctccggctgccgccatggcgccccgagccatcgccagtccaacctccggcaccgcagcctcgagccgccagagctcgacgccctccgccctcccccgctgctcccctctcctccggcccttcaccgcgtgcgccgatggtggcgacgaatggtcgacggcgcggctaacgcgggcagcgacggacgggcgatggtggggctgacgccagcggcaatggataagcgacggcgcagctgatgcgggcgcgagcggcggcggactgacgacggtggcgccgggaggacggaggacgacgacacgactgacgccaggggacggagtggtacagaacgaagaaaattcacactctagtgatgtatattccgaaagtaatgtgaattgggtgataaattctggaagcagtgcgtattgggtggtatattctgaaaattctccctctaaaccgctcaaatttcacgaaatt

SEQ ID NO: 94995 - DNA, 768 bp, Oryza sativa
ataaatgacactaatattcatgatattagttacgtgccactgaaatttgaagaaattggaaccgtgccactccatcacgttttccgttagacccctagacgcgggacccacatgtttgttccatcttcctccatcctccctcttctgtcttccctatctcttccttcatgccgcgactgctacaaggacagtgacaacgacagcggcggctctcgatccctcccgccacggatggtgtcgaggacggtagtggctcctaagccctcccgttccagatggtgtcaaggatagtgacgacggcggcagtggctcccgaaccctcccgcgcggatggtgtcgagggaggcggcggcggctcccgagccctctctcgcggatggcgtcgaggagacgaaggtggcgatgcgggcggcggcccccgagccctcccgtcgcaaatggcgtcgaggatagcgacgacagtggcggcggcggctccggagccctcccgtcacggatggggtcgaggacagcgatggcggtggctcccgagccctctcctgcagatggcgtcgaggatggtggctcccgaacctcctgtcgtgaatagcgttcaggacggtgttggctcccgagccctcccgcgtcggatggctcggcggcggtggctcccgaaccctcccgcgcggatggtgtcgagggaggcggcggcggttcccgagccctctctcgcggatggcgtcgaggacgaaggtggcgatgctggcggcgtcccccgagccctcccgt

SEQ ID NO: 94996 - DNA, 2501 bp, Oryza sativa
tgacaatgaatcaataaaaaaagtatattttatttttttatggcaggcatcctattttaatgttttgtaaaaagatatgagagtaaagttaatattcaattttgaatgggttatagttgagataatattttttattctattttaaacttcagagatctctcaaaaaattatttgagattgctttcaacattggttatgatttcattgcaattaccgtaggaacacatagattgtaaactaaaattactatgaaactgtgaaatctttaccactattttacatgttgtgaacttatgggtacgtatagcacatatcttaccaccattaccacaaccacttctaggacatttgggtgagcaagtccctcattctccattgctccacttcctaaactattaaacaatgcatttcgtgtaaaaatatttgtgtatagaagtttcttttaaaaaataaaacaaatatgcaatggttaatagttacgtaatcacttcctaatgacttttgtagtttttgtgccgtggaaaatctcacccgagttgctgaacaaaagtgttcttaaacaatgtgccatactatgctgcaaatggggctaaggtgttacgcataagctatttctatgataccaaaggctagacatgctttgtacgacacgatatgatgctcggatcatctaccctttatccgttatttgactaaagactacagtgaatttaaggatggatgagggaacgcagtcaggtccctaaaaataatggcaccagcaattggtgcatagggcatctcaatattaaagttcactgatcatgtgtaatttcatagcaaaagagagaacttaattaagtttttttaaaaggcattagatatataaccatgtataataattgttctatcccgatttatgggaaaaaaagaaacagttatagcaaaagagagaacttaattaagtttttttaaaaggcattagatatataaccatgtataataattgttctatcccgatttatgggaaaaaaaaagaaagccaactgtttttctactcttacttcgaatttataggatttctaattttgttgaaataccaagagaagttctagatgtcttaggagggattagagtgtgtttaatggactttgagtagattttctcaaaattctagggagttggccgcgtactttgatgaccatccttttgaatgttattgcaaattattttaaaaattggacatgcaaattaaggataaattgaagatcggatgattaccctattaaataaactaggaaggaagcccgcgcagatgcgtgggcaatttattattattattttatgaaaaaaagtcatatatcaacataaaaaccatatattgtcttataaccttactgtaaaagaataaaatatttataccgtgaaatagaccatagattgtttcagttatatgtaaacttacctattatcatcctttgtaaacataatatgagtgatgatttttttattatattatacatctaacttccctatacatgttcatgggtaatatacaaaggaatactctatattgtcaaaaatatttgtactaattgttagcataatttatatgagaacaacataattaaaaaagataaaatatggttccatatgacattttggattgtacatatgtatgtaaggtttttcttgcgaatggcagtctctcatatctacatactttttcatgtttttttttacaattatttttctctcataggaggtaggatctgtgtatgtgcattcatagggtgggtgtgcacatgtttatatggccgtctatgattgacttttacattgttagttaaaaaaaatactttcaagaaaattggccagagggcatgaagcagcgctatggcagcgcggcttcttcgtcaacctcgcatagagtggtcactacatatatgcataatttgaggaaaaccttagggctacaaagaaaaaaacagaaaattaacagacggggtggaccatatatgcattcttcttttttgtttttgacatctcttgtgtatgcacgtgcatatagagggattagctggttcttaggagcgagggcttacctgaatcaatctaatttaatggttgaaaataatggattcaccggtttaagtgcaaatcgatggctatatgttttgttttcccctatattttttcttaaattttcttctatttattagagcatctcatggcatcttcaagtgtttgtaggagtataggacactattactcatactcacaatctacttgtagtcaactattgtttattgtgattttgtggcaatctctatttacctatgatttattgttaatggtttcccacttagtatcatcttttatctttgttgctttgatgacacacgtgtttactgcatgtaaactaattattaggtgcattgtgcagcccaagcagttgaaaacatatatttttaaatcatatatttttattgtatgttttttaccatatttgtggagtaata

SEQ ID NO: 94997 - DNA, 2073 bp, Oryza sativa
atgaactcggtatataagttgacccaaatctatctagactctccatgtggagctcttcccaccaaacgaacacttgggtctaaaccggaacaagaagagtcgcgcaacgaaacagactaaatgggctggattttacactctcactccttcatgggttgatgccctagctgcctagcagctcaccgctactcaacagccaaatgcccagggtatcccctcggtgctacggcgttgtgcctgtgcgtcgtgtccccctccatgggccaacacgcacgcacacttgtgtaacacgggttgaagttctaatatcacatgtaacacccgagacacaaaatcaacaatagtccactctacccgctaaatggacccacattcacattacacccaacttacacttttcatcatcactttatgtaaaaaagtaaaccaggaggtactatggttatatacacatgtgtatatattacttccaatatagatgttgattaaatgtgctagtatcaatttatgatttaggtgtatatcatgtgtctgagctataatgtgcctgtttaattgcaaggtagttatatgcatttgtttttttaaaaaaaaatcttgcatatgctaattatgtttgtttgattaatgatgtaggagtatacatttttattacgtgcttaaagtgcttgttttggtttaagggtagctatatttataatttgttcctttttgtgaatcttagatatgtcaattgtgtttggttcactattcagtagaatttaatttttgatatgtgtttaagcactaaagtgactatttccttgtagcgtagacatatcccttagtttgtttgtgtgaattccataattgttgattgtgctcaattcacaacttagtaggatttattttggtgatgtgtttaagccccaacgtggatgtttgattccatactgaaatcttgttatggactgttgaacgattctaatgaaaccgattcttttttttttgtaataaatataccaacttgatccactatctcttgatacagaataatttctacccaacctaaaaaatgtggtgtatttaattacataaaaaaagtgggatatacatttcaaaaatagatgtgtgagattatgttgtgggttatatatattcttgagtatcagtgcctcgcgtagccttatacactacgattgttctcaagagtaaggaattgaggattgaagaattcgttttgatatgtagctcatgatttgcaccgcatcgtctgaatttcatgaccaacaaaaacatcttgatttcaccttgtttagtgaaggtatgttctaatagcatttcttaaacaacatggcccaccttcgaagggtttgactattagttttattaatcatgaaaaggatgaatttcattaatcagaggaaggtttttcacctttgttggtttctacacatctagtgtttttagtcatgtatcatataagatctatattttgcatcattgaggctatgatgccaggactactttattggttttagataagttttatactttggcacaatgtagaaaattccatcatcattcaaccagttactttagagtcaacctactagaatggtttccctggctgatcaaattagtaatacatggattgtggagctgacactttgtaattttgagggattactttttttttgcattggtggaaataatttgttagagataactccattcattgtggtcaatttttagtcttcacttatgataaacgctcacaattcttagtgacaaagttcgagccgttaggcattgacaagatgtcaacccactctactcacccttcaaaaaagatgatcattagaactaaaagtgatgaaagggaatgcaactatcacatcagaaaaaatggctcccgccattaaggagaataatggaaccgtaggaaagagaactagaaatgtagattgtcttgtgccttgtggaatatagggtccatgaagaagttgtttgaggctaatgttttgaaaagtgctaagagaaaatgtgcaggagctcctgttggtaagtctaaggcaacgtcaacaagccata

SEQ ID NO: 94998 - DNA, 819 bp, Oryza sativa
ctaatatcacatgtaacacccgagacacaaaatcaacaatagtccactctacccgctaaatggacccacattcacattacacccaacttacacttttcatcatcactttatgtaaaaaagtaaaccaggaggtactatggttatatacacatgtgtatatattacttccaatatagatgttgattaaatgtgctagtatcaatttatgatttaggtgtatatcatgtgtctgagctataatgtgcctgtttaattgcaaggtagttatatgcatttgtttttttaaaaaaaaatcttgcatatgctaattatgtttgtttgattaatgatgtaggagtatacatttttattacgtgcttaaagtgcttgttttggtttaagggtagctatatttataatttgttcctttttgtgaatcttagatatgtcaattgtgtttggttcactattcagtagaatttaatttttgatatgtgtttaagcactaaagtgactatttccttgtagcgtagacatatcccttagtttgtttgtgtgaattccataattgttgattgtgctcaattcacaacttagtaggatttattttggtgatgtgtttaagccccaacgtggatgtttgattccatactgaaatcttgttatggactgttgaacgattctaatgaaaccgattcttttttttttgtaataaatataccaacttgatccactatctcttgatacagaataatttctacccaacctaaaaaatgtggtgtatttaattacataaaaaaagtgggatatacatttcaaaaatagatgtgtgagattatg

SEQ ID NO: 94999 - DNA, 1005 bp, Oryza sativa
ccatcccgctgttcacggacgaggcttcacgtaaagtcagagggacatggctattgacgtgtgggcctatgaaagtgggcctcgcctatcatcagggacccacgtccctcggactttacgtcaaaggagctcgctccgctgttcattgccatcacgcatcaccagacatcatcgttgccatagtccactctcttcattttttaagataaccccctctctcaacttatagatgccaaattttaatttatatatttatgaaatggtataacatatattgatttatcgtgtcaatttgttttaaaatttttcataataatttagacaacatgctagagagagacatatcctcttagagtttaaaagcaatcccccccaaaaaaaaacacccacatgcctcctaattgagatcctctgcagtaataccagggtttaaaataaaaaaaacgtacggttatcgtgattatcacgtacggtaacattctcagcttttgaaactctagtataccttgcggtaactgtgtggttatcacggtaaccgttaaaacgtggggtgacaataacccaccctaacggtttagtaaaccctaaatacacactgacatgtgggctcaaggatctattgggcctacatatcagtgagcagcattgtacatacagacgctctctccacgactccacgcctccacgcggacatggacccacccgcccgctacgtacgtcccacgactggcacgctctctcacacacatctgctcacacgtctgctcactcgaccacacatgcgccgcgccagcccgctcctcttctccgctcatgtcacacgcgtcgtgccgtttgcgttgcacgacagggcttatttttggaatgttttttaaaagggcttcttgtaaaaatgttctgaagaaaaataggctgtgttctacccttcattttcccaacccacctctctcgtttccacgcacacgcttttcaaactgctaaatgtaatgatttatgtaaaaactt

SEQ ID NO: 95000 - DNA, 1237 bp, Oryza sativa
ggacggatggagtagtaaaaattgagcgctatttgaattttgaaaagcaaaagtttcaccccaagctgtttgatttacgtactattgcaaactaggaaacccgtactctaaattggccctacttttgtcgctaaattaggctgtgtttagttcacgataaaattagaagtttggttgaattggaacgatgtgatggaaaagttaaaagtttatgtgtgtagaaaaattttgatgtgatggaaaagttggaagtttgaagaaatatttttgaaactaaacacggcgttaatgtatggccactagtgcaaaaacccctgtaggcaatagataccggttttccagccggcaccaatgactaggtcatagaaccgacactttgtgctctctcggatttacaaaaaaatgaagccgtgtgctctctcggatttaaaaaaaaaaaagaagccggctccaagcatggagccgagccgatgcgcattaataatccccattcaagcatgctttcacagatcacaaatcaagcagatgaacattaataatcccaattcaagccatctctaatccaatccatcaccaatcacagatatgaacaacagtaatttccatcacaaattatcaacaaacaacaatagatcccaggccagccatcacagatgaagaacacaagcaagatgcacaaactcactcgtcaatccacgaaggtcaccgtcggggtccatctccacgcgaggtcaccgccgaggtccctatctgcacgaggtcgccgccaaccgccaggtccctctccgcgcgaggtcgccgcgggccgtgggccgctgggtccctcttcatgccgaggtcgccgcacccatccatctccgtgctgaagtcccgcgggaggctggctgtcgctgctcaccggctgggggagggtcgcggagggggagggggaggagagggtggcggatcggaggaggaggagagggggaagggggctagaccgtcaaaggggaggggagggggagggcagggcacggcggagcagggggccagaggggagggagcggcggaagaggcgaagagcccaagggggcgagggagagggcgcggtggagtaggaaaacgcggataaggatagagaaaattcgacccatagcacaagaaaaaaagcggtaccaaaaaatagcacaaaaagttttcactttcgatctatagcataggccaccgttttttttcaccccgaagcacttccgtcgta

SEQ ID NO: 95001 - DNA, 1075 bp, Oryza sativa
aaataaatgaggagacagaagggcagcgggttacagatttgtagccagctgtagcacggactccaagacgcagcgtgtgtatgacaggtgggaccagatattaatagtgtagtatgtaactattgtatgaataagctactagattgactataaataaattggagtcaataatgggctatattattaaacttgctcttatagtgattggattcggttctaagcacgatagatcctatacatgcatcgatccatttccatgcatatattccatccccataccggtggggggacaaacctccgcgccgttgttccaaaccaaaaccaagcaaccaaaaccgccaaagcttaacccgctccggatcttctctaccgcctcctccaccttctacttcactcttcccgatctcaataaatacaaatcatctaacaatgctgctcactaacacataaacctgagaaacgtaaggagatttttcggttagctccacagggtggttagtcagggtttatttggtttggagcctacttttacaaccaaaatcttggtattaccaaaatattggtaaattttagcactaccaaattgagtagtattcaatttaaattattgtggatagaatttgatagcaaactaaacatacacatgctattattgaagttatcaaaattttggtagggtaataaattggaatcaaatcaaaccggccctcagtctgaattcgaaatattaccccttctttttattgatattatgtttttttcatgatattcttttttttactaacacgtactattctcgagtccacatatatctacatgtagtacatgtatggcagaggatctcgacgtacgcgacgcggacggccacacggacgcccacgcgggatcctcgcgatgccgacgctgctgcaagttggctgcagcagcactgttgcattttgtacctccaacgtcacggcctttgctgcagcaggaaattccccaagtgtcgctgcctgtgtatccaagcaagcggcggggccggggacgatcctccagctagtggcctggtggatggtgagatggtgactatact

SEQ ID NO: 95002 - DNA, 1731 bp, Oryza sativa
ctggcgacgtcccattggatgacggcgccagccactctggcgccccaaaaaggaccatttctgggataagttttttcaggggtctatttgcgaaataagtttttcaaaaggaccaaaatgtgaaaaatccagccaaagatgccctcgtttttcaagtgggattgaactgtcgtgatcgcaagggaatattggtattatattccaggggtcttattcatgtgattttgcatcttttgcattagcagtgtaataacttagtactaaacaacctatgatatccataggtccagaacacagatgagcaaaatgataatgtaaacctaattaacaagcttacgcatgcaattacatggatcaacaccgatcatgcagccacaataatagagttcttacttagcagtgacgatcaaatattgactaagtaggtatctgcccaagcatggtttaattagtagcagtagaataaaattttcacctctggtttttataatccaccagagcaggacatggttttgagtcccacagtatcacaaccccctctcgttgatactaactaacatggtgatgacgcactcatatctgatgaagccacctacaccatttgtcctattctgcaccgtctaaaaagaacgcacaaacttttttttttcagatagcaggtaattcagagaaacttgctgattattccacgtcatacaacaacccattttccaagtagtacaagtctccatgtcataggagtgtacataaagggtgatgcaagcccaggatgaagtgtgtgcctccttttctcttcttcagttttcaactcaaataattaaatgctgaagagagctatcatcaataggaagcaaggaagaagtattcaagaattcaagagttggaggctcaaagagacattggcctctgccttttcttgccccttttagtggcctttgtggggctctctctttgatgctttcttctctttagctatcacccatccatctatctaggaacataatctttaaaatcctcaatttccttcttgcatcaattctctgtattttactcttttttttaaaagaaaaataaaactagttttccttcttgcaccaattcctcttgtttcttttcaaaaaagtttttttttgcttgttgaaccaattctttgtttctttcaagaaaaaaaacaattttccttgttgaaccaaatctcctcttttttttttctttgtttgaccaaaaattggtatatttggcatatataccccatggggccatccccagtgccacaagggccctggtggtcatggggaattggggagcagtgcaaatggtggcttgagaggatggaagacggcgagaagagcaatggaggagaagacggcggcctgagattctccctccagtttgatcccggcaagctcggccttgaccgtgccctgctcggcctccctgtctccgctctgctcggccatctcctcggttggagcagccagggggcgtccatggcggtggcggagggtgccggcgagggcgagacggcggcgggcgtcgccgccctcgcctcagctttcgccgtctacctcgtcgcgacgtacgcgtccgatcaccggcggcagccgcagcagcctcgccgtcctctccggctgcggaagcgtgacctgtcgccgctgaattcttgtaaggtttcgtttcttggatttttcttttctagcttgctcttgtggtgtttggtttgttttgtga

SEQ ID NO: 95003 - DNA, 1393 bp, Oryza sativa
cgacggcaaatgcggcgccgggaatggtggcggtggccaccaaccctagaatggcgcccggcatggcgatggtggtgactccatcgaatcgacggaggaggtggcgaaggcgatgaatgcggtctcggcgatggaggccgagaacggcatcgaggatgaaatcaaggtagacgtacttacgcgatttccttagtttcttctgtttctttcgcttttcttgaaatcaaaagcgatgtttccttctttcacttcgtgatctccttcgcgagagcgaaagtgctaataacgtgttgaatgtggatagaattgattgaacgagagagattgagagagagaatttaacacaagaatgtatcgcgaaagtgctgataacgtgttgaatgtggatagaattgattgaacgagagagattgagagagaatttaacacaagaatgtagggaatgaatgagcggatcctttattgataacagtgttacaatatacagggggagagaggcgacaactggaggcgcgaccgttgctagaatcgccgtgaggcgagaacatgtgtggggcacgaccaaccgttgtgtccctgagttggttgttactctatccatatatatagatgagatcacccaaatatttcataacagtttgacttttgttccgttgattatttcggaaaattactccttggctatataattgcaagggctcaactctgttttaccacaaagttaactgcaattataaatttagaagataattgagcagtatgtacatttaatttgccacttatctcatcgtatccctttgattttactttggtctgccttttctgaacttccatattgtggatcaattaatatacccacatgccacatggtacccataagaggaatacacaggaataaagcctctccccattacctccctcgactctattgtgctcgacctagtcgctaccaactatactgtatattctcgctctcagaaaactaatgtcatgtccgtacgttgcaacagaattagaattatacggtttaatcttttctatccggtttgttgtcttgattttttgtgtgaaaacactgattttctttttgggtggggtgggttttatagggaaccggtttttttacatgggaaacttcaatggtgcggaaggattatagagatataagccacgaccaccaaatgcagcttcgcagctgaatcagcgaattgaagtgggaaaatctccttctctgaaatttacaatattagcaagagcactaatctataggaccattacataatttgtagaactaatgaactgttttcactaaattacataaaaattcagggactaatataaaattgctgctaaaataaaattaaaaactaaaataaaggggtaaatgggtggt

SEQ ID NO: 95004 - DNA, 651 bp, Oryza sativa
cttctcaattattatttgtgctctgaaaattccactaaaatttatttacgcattttaggcttttaggaaatatacaaaaatcctccaagccttatttgacttttatatttgcacattttaattgttggaggctttcacatgaattttaattattctcggcacaatttcgaggatgtattttagagtcgttttgggacgcgacaatcttctacctccagccgccggcacaggccgagcccaagccgtcgcccgagccgctttcttctcctctcaaatccgctccaatccggcctcttttcttccggatttttgaggggttttgatcctctcgttctcctctatcttttcccccaagttttggagcaaatcgttgtgtatcttgttcgaatcaaactcgttttcgagtttatctccaaaaccgagttttgattttctcggatcgattcctctcgtttggagtctgatctcttcaatccaaggctatataaagcatcccctcgtcgccctctttcgtttgccccctctctcgtcctcttccgtgcaccgtagcgccgccgccgcgtgcacttagccgccgccgtcgccggccggtcttcagtcgtgtcgcgtcgtcgcctccgccgttaggtgcgccgtggtgaggagaacccc

SEQ ID NO: 95005 - DNA, 1186 bp, Oryza sativa
atagataacactttattccatcattggtgatgtttaaacttcaaaataaggttattaatttcaagatttgtgagtgttaatttgtttgtacctcggacatggaggtgtgatttggagcgtgttcgtggagtgcttccaccatttgctgcttgcagtggagttggagactgaattgaagagatgttcaatgggtgagactagagagtgtgagaatggttgagattggcatggactatatatagccgattatgcagtcttgcagcatatatgtagacgttgtgattatctgcgtatatgtacatttgcacgcagaatgtatatgtacatgtttgttttcattttgtttggtggtcctgtaaattaggaaaggttgtatttttcacaatatttccaaggatcgatcaaaggtgaaagccattcaaatcggtgtgaaactaatttgaatttcatagatttgctgtgataatttgtaatatctcatgcctaggcccatgttaaatattaaaggttggtgttttctcataattttaagctttgagtcactaccatagagccacctagcattgctggttcaaaaccgatatcactatcggttatccacccggcaatcggctggggacagtgttgtttgggagcaacactgttggttttggttctggaactggcagtgatactccattctctccggtttggagtctatctatttatggggtaacgagtggacttgattggtggtgtacgagagagattgaacaccgggataatgcgcctgcccaatcttgtaacatttgaaatcgtgaatcatttgggggaaatgtgatcaggtaaatactatagggagaaaagttcaaaatatagtaaaatgtgtcttattatataaccacaatgtgtttggtgaaaaaccaaaaaagtcacacgtgcatgaatgtgtggcatgcatatttgtatacctatttagaacttccaaacactataatcatgaaggattgctgtttcatatatcttatatattacacttctaatcgggtaaacgtgataaatttttgaaattttgcttggggggtatatttaaaactcctccattttcgcctgatttccacctatatagtagttcatactcaattaatttgcagatcaatatactacctccgttttttaatagatgacgccgttgactttttcttac

SEQ ID NO: 95006 - DNA, 1406 bp, Oryza sativa
agtgttcgtagcggagatcgacgtatgcatccagcaaagctccctctcgcttcaaatggttctttttatcaaatttatcagttcaaacactagcgaatggcattgcacgcatgcaaggtctagtactctgaataaaaccaacatggttgatactatgatgatcaccaataattaatgtcacttgaagttagatttgcaatcctttggctaggaagttgattaatttagaggcgagattaattaattagccacacatggttgggagttgtaagtagtgacatatttattgggagaaggagctagctccattttgaggggacaaaggcagtggaatatattgtgactagtttgtgtgtcatatcgagtgccccagccctaaaacttggtgggtctagagctactccttgggcacgtggcctggatcaaataatgtgaatcctgatcatatcagcaacgagtaaataaattatgctctttgagatagaggtacaactttgatcaccaatttattataaaatatatttacataccttaatgaatattataaaagtatttttttagaagaatctacttacaattatgttttttcatgtatacattctaaaaatttcaagattttaatgtttgaaggttttagagtttgatttgaaagaaatacagactatactctcccgtcccatgaaaaacgaatctaggaccgtatgtgacatattctagtactatgaatctgaacatatgtatgtctagattcgtagtattaaaatgtgtcacatccggtactaggttatttttttatgggacggagggagtatatgtttccgtgacgagctgagtgagctgtagcaggatgcactactgctcaagatcgatatggatgaaaatttcagtaagataagttggtcctccaagaaaaaaatagagttggtccaccacacatgcatcttagatgtaccctagctagctctacattttggacatgctgcaccatatgcatgccaactcatggagtcgtggtggatcttgttatatatactattaattatcatcaattgatgatatgataagataatcttatgatatatatgcaaattaaagaggagcttctatgaatggtcattgagaggatacagatcattgaaaagctctcaaattcttttttaaaacacgacattccgataattttctgcagggggctttgccttgttttttagacaatcaaatttacagccagtggatttgtagattttgtagaatctgaagagtgactgtgagaaggttgagacttgaaaggcattaattaattaattaattagctgtatgaccaggtggaataaaaaacacactaataatccaacttcacttgagcatttgcaaaatatatacaacattaacctcttgtatctgca

SEQ ID NO: 95007 - DNA, 699 bp, Oryza sativa
tttagtaatgttgctaaaaaagtggctacatttagtttgctaccaaattttgataactatataagaaatcttgccaaaattttggtaaggttttttttggcaacaaagtgaacaggcccatcgtagatctctaacgtctcagaaatgtgcttgtcttcttttaagtaaacacaaatgtatttatcggtcaaaccccatctggaagaaaataaattcctactgaatacctgaaacaatttttctgatattccaaacaaaaatgtatagcgcccgatcgtctattggctttcttttttgtttgcttgcattctctgcattattgtggttgacatctgcgtcatatttgtgaagttggtttgtatggagtttttggtttgaaagccataccaaagtattggcactttacatagcatagtcaggggttgtctagattaatgctatttcaaatcatactcttttttttataaagttgtcaaagatgtgtgtacatttagttttttacccaactttggtaaatacataaggaattaggcaactatacaatagtggctattctgccaaaacttgcaatattgtcaacttactaatgtcaaaatttgataagtttattttggctataatctgaacagcccccgagtttgtatcagtctttaggtcgctgaggatatctcggatcatgagtaatgaaatttctggttt

SEQ ID NO: 95008 - DNA, 987 bp, Oryza sativa
agctcggtaccccattgcaacataacaatataaaatatgcaacaatgtcgaatttctatggttgaaacatatatatatatatatatatatatatatatatatatagaaaataatcctaagtataataattctagattcattactactagtttatgtcatatcctattttaatttgatttattttaggacggataaagtaggggtgctcacgggataaatgaagattgatattcctaagcataaattattcaactgcacatgccaatacttgcattttgctgcataaaaatcatgtgcccataatttgacaagcatccataataagattcagataacttccttcggtcatcccgataaaaaaataaaataaaattaacaatcacaaccatagtgcttatcaaaacaaaaacaaaggcctatttgaatagcatgaatagaaaaatagaggaaaaatagaagaatatgaaaaagacatgattcataaaatagatgattagaaaacatagaaaaaacaaatgaataaccgtttggttggaccgaaagaaatacatatgaatttgaagagggataaagacttaaagaaaactttctcaggttctacattatgttaaattttctataaaacttgcatggaatgaaatattacataggaattacataggactatatgattcattcctttaactttaagggctatatagaaaaaatcctataaaaatataaatactccaagattcatatgattttcgttcgaatcaaggggtcatcagcagttgcaacacaaattagatccaactcgatttaatagtacgagtacttgacatgtactcactcctcctctccccaccacgcccgaatttattgctactctactactcctacgcggccaaaccgcaccactaaccacagccggtatggcaaatgactactcctactcctagtagacgcatcgctttccaatcaaaatcgccgaactaaaacagaaag

SEQ ID NO: 95009 - DNA, 751 bp, Oryza sativa
tacattccaactactgttgagagaaccacgcctttcgacgtggcattgttgtccattcgacaacagctggcgccgtccgtggggaatccaggccgaaacggcgaaatgggacacctttcgccacactcacaccctttcgtcacagtacccgcgaggtacggcgacaagggctagaggcgaaagtgagttaagtccaagctggggggcttcgaagccgctcaaggctctggacacctttcgccacacgccacgcccttcgccatagtgccaataaggcacggcgtcaagggctgtgggcgaagaggtttcgccacacccacgcccttcgccatagtgccaataaggcacggcgtcaagggctgcgggcgaagaggtttcgcccacccacgcccttcgccatagtgccaataaggcacgacgtcaagggctgcgggcgaagaggtttcgccacacccacgcccttcgccacagtacccgcgaggtacggcgacaagggctgggggcgaaagtgagttaagtccaagctgggggggctatgaggccgcccaagcctctggacacctttcgccacactcacacccttcgccacagtacccgcgaggtacggcgacaagggctgggggcgaaagtatgttaagtccaagctggggggctacgaagccgcccaagcctctggacacctttcgctacacgccacgcccttcgccagagtaccaataaggtacgacgtcaagggctgcgggcgaacagg

SEQ ID NO: 95010 - DNA, 2382 bp, Oryza sativa
tatccacatagaaatttatagttaattagcacctattagcgaatgcatgcatcgtattgccaaattcataccggcagctaaattcatcatcaattaagcaagggaattcggaattcaaacagggtcaggaattaaacaaaaattaaaattaaaatcttgagagaaacactttgaaaaaaccacgttatcccgtcctttttccaaagtctgattctcctcgaccatacccaacacgaggcagaaagagtatatttttccaagagaccgtaatcccatcacgatcaattactgtttaatagcagtagcctatacactagttgaagttaacgtgcatagcggcatgttgcatacatttgcttttgtggacaaatcttttgcgttggttgggaatcttcccttctagcgcgaaaaaaacggagcaactcattagcacataaatagtattatttattaaaactaacttgaaaaatagattaatataattttttaaagtaactttttatagttttttttaaataatacaccgtttaacagtttgaaaaccgtgcatatcgaaaacgagacagagaagacggggacaatcggaagacagacagacgaacgcagccagtgtcaatatatgcaatacctgtctctttcgctctatcgaaaacgtaattaaaccattaagcagctacgactctttgacttttttttccttagaaaaaaatcaataagttgaacattgtattttcaacggtacgttaaattgctcattaattaattgcacgggccagtacgtatatttgaagatgtatacactatacagtgcatcgtacagtaatttgacttttacgttattagcgcatgggatttttggatttataggttgatgctaattaatccctcagtcagtctagtgcagttttgcattgttcatgttcaacgtatgaccggtttcatcctattttaaaaatttttatgattaatatttttttattattagatgataaacatgacattattttatgcgtgactaattttatatttttttttataaatttttcaaataagacggacagtcaaacattagaaatggatacccagggctgcatttattttagaatgaaggtagtaattaaattgatgggcttactaatcttgatcgtatcaaagggcgatatatcatatcgagcctgttgttggagatgaaaaatcaatatatctctaactttgctccatgtttgtttattttggccaataatgcccgcctaatagatgcaagccactaatttgaatactggagtagaactgaagacaaagaaaatttgaatttccgtggcagttgtacaagtcccggtcaaatcaaatcaaatcagtatgtacttaattacctgcaagttgaagtaaaaaatttgcatgcgttaggttatcttgcaattaacttatcaaggatattgtaattaagttgtttatcttggcaagtaaacacagcagtagctttgtctcaagtgtcaaccttttattgcacaagtcaagtgaagtgatggactgatggtaggaaacaccaaagcatgcatgatccacggaagaaacctgatgttaattataggaaaaaaaatacgaattagttttgtaatgaattttggatacagaagcttggccccatgataggacaaattgccagtacaacagttggagcgttgaaaacgttattccctagttttgtgcaacaagaaacaagaagaattacaattatgttggaagttaaatacacctatgtttccaacaacaatgttggctatgccacaagtgcgacaattttatttataatattgatgagccaattaaacgtagtaagtagggataaaaatgggtcggcgtcttcctttttaattcgtaagttgaattcgacatatatagatacagacgtattattttagtttagaaaaatggtgtcgagtcggagccaagacggattgaaaatggaattaaaaattgctggatattactggtctaaagactataggaagtgcagatccattatttgaaaaaaaaagtagttctctcctggcctctaggctccagcaacgagcagagtagcaactcaaactgcagaccaatgggtgtcatggcgatagatcaaagcccgtaaaacattctagagaagacagattttttaattgtatgccatattgatatatcacgtccaattactaaaccacccctttttagtacaatttagagcgcactcaccaccatgtgtaagcacatgcatgtcctctacatactcttgaaatagaggcatcgaaatcttatagagtatggtggacatgctaaatcacctactgagtacataatcataaaattggtggacactagtgctagatctagaatctgaat

SEQ ID NO: 95011 - DNA, 1405 bp, Oryza sativa
aaaagagcagtcaaacttgtgttgattcttattcatgtggcaaacagtaggaaccgtttattcccgatgctggccttgtgcaacccactcactttgtactcaaatttcagatttatcgtcaattttcagaaatttaagatatgcatattgatcgctaataaagtgaatgcctccatcaatctccaacaaaattggatgaaaatttggatatttgtgacacgcttttaaattgctaaacgatgtgtcccgtgcgaaaactttctatataaaagtgactctaaaatatcagataaatatatttattaaatttgtaataattaaaacttaattaatcatacgttaataccactcgttttacgaaaacactcactcttaatcttcatcttcatccacgtgagtttcaaactccacctttgtgtgcttatatggcctcattcttttcagctacacttaccactttattatcatggattatttgctccacaactttaaaattatgtcttcttagaaaacaattctactgcattgctaacgctacttgttctaagctagtagtactattatttgctaaatttgtttgtacatgaaaatatttaatttattgatataataaatagataattcgtggtaacttggcaacaacatctatttgacacaaaaaaaatctctaaatttgaaacattatattggggatggtttgtgttcagtcgtactctcggaaataaagaaaaaagaaagcacatagaaaatggtagaatttccagagaacaaatcaattccaacaggttctcattgacgcgaagtacttaggaacttcccccataaataaagtttacaaaaagcagagtaattcctggaccctcaaaatcccacatatgctttccaattatcagtagattatgatgtagctgctactgtcattatgcactaagcaataatgttcaggtatcagcaaattgcacggtccatatataaaaaaggaacagcaaaagtacacataacactgcaacatgtgtagaaattttaatccggccatgatctttgtttcagacaaattgcagtcctagtacaactagtctgcttgcagaagcagcagagaagtttcccgccaaaaaagaagtaaaaaaaaaggagaggagatgcttcatcgcttgcgtttgactgcacattctgaagattttttggagcaatcagagccgtccaaataagcccaaagcaacgaccgcaaaaccaacggtagtcgagcatgcagacaccctgcagcagcaggcaaaaaggagaaagactggattgattaattaattaattaatttgcttgagtgcgcacttagcgattgataattgagtagttaattagtttcagctttgcttggctaccagtgctgtagtgtacaatctatcagaa

SEQ ID NO: 95012 - DNA, 857 bp, Oryza sativa
acatggaaggaaaaaaaatatcatttttgtaagggatatgatggcatagtcaaaggatttcaatgatggggatctgattaggctcagacaataagaaaaatcacagtttcaatcattaaccattggtagattctctgtaacttagacaccttttgtagttcttttttcttattttggaaataaatttatttaaataaaataaaatgatgattttccctgctatttcctggtaaaaaaaacttaggttcctttggcattgctccagccactaggttcttcagagcatctggaacctcatgagatgctctggaaaagctagtggcatttgatatagctccaaaaattaaggaatccggagagacgaatgtagagctggcgttgaattctaattaattttgaaagggacgtgtgatggcatagtcaaaggatttcctttttgccagcatggatgctgaggtcaacgggattccaatgttaagaagtcacactgattgcgacaatagtaccttttaggacatggcccatggtattggatgcaagttgatgcaactggtcataatccaaaaaacaacttttttgtgaactaggtacataattttaatatcttggagggccaatttggttactcataataacaatacattggtctattacataaaacaatttatgtgttggtctttattataaaaacattgtcgtattcgtaggtggatacccctattacaataggaataaccatttgtggagggacataagtgtaaattaaatatgcatgtctcgagccaacaatgttccgagctacaaacggcaataaaaagtaatatttacagttgcgatatactatatcatgcatctca

SEQ ID NO: 95013 - DNA, 6594 bp, Oryza sativa
aattaacccacttgtaaaaaatcagaatgccagttgcctaaaattagagacaaaatcgatcaaactctgcatttctttttaagatagtacaagagtgatttgcactttgcaattgtacgtatattcgttgtaattttcaattttttgacagctgttggctatatacactacgccccctttttaactaatatttggatgatattatttaaaaaaagggacgtaatgtatatatctatcaataactgtagagttattatatggtgagttatcagttggagtggcacacacacggttactttgcaatatgggcacacaaaaaagaagcgtgccaggcacaggccagaacactctacgtgccagatcattcaagcttggccatgactgttacacgtcactgcacccttgctttcttccatggctttcttcctcagcacataaccacaaaattttttgcttgctttctccatgtatgctgctactgataattcccctagctagcttggactgctttatttgcttcaattaacagtcctgcatttagggagagagaacataattgttcttcctttttttcatgatcttttttccgggtttaaagcttggtatctaatgaacccaacgcatatgcatgttaatgaatatataattagttgataaattcagaagctatttactccatccgtttcacaatgtaagtcattctagcatttctcacattcatatagatgttaatgaatctagatagatatatatgtctagattcattaaaattaatatgaactagaaagaaagcccgcgcagatgcgcgggcatgctatttattgctcataaaagaaatgctaaaagaaagcctacctcattgtattcattattagtacgataaactaaatataatcagaaaccactaaaaaaataaatatttatattgtgaaatatattatagactttgatatctgaatgtcatattaaaaaaattcactttgtcccaattacatctacactcaccaatcacgactatttagtatctttgccttgtaagttgagtccctttttatatatgaaattacattagtatgacaaaaataagcataatacattattcatataataacaaaatcatttccactgtgtggcagtttaggagcatttgtacgagtgccatgtgatagcctaagtacgttttttcaacttcacataactaaatggcttaactaaactaaaagaagctaaattcgactatatttctcctaagtcgaaagaaaagataggaaattatcgtcccaataaaaagattatttgggtgatatatcaagtttagcggtgcatgtttttggtaacttatgatggtttaatttatgttgagtttgattttaagttttttttaactatttggataacatgtaaattaaggggtagaacatagtcccacgtgcctctttttaatcaaaacatagcgttaacctagataatttttagaaagctggtagtttttgaattccattgtccaacaatttgccttaaaatatcttggtagtaagaatcatatgaaaaaaatattttctcgagcaataatccctcaccaacaaatgagtcaatttgtgttttggtatttcatccctgtattatagatgtaatatagctaggcatgtatgtagggttaatatcgaaaatatgtgtgttaatatgggttttgatattttttctcttctattatagatctaatttagttataatttatgttgtcagttttgttttactaactataagactttggatgagaataatatgaaaatggatatagtttagttatatgcgatatttttaaataaaaatgtagttaattaatacatttgtaaaatttctacagaaaagatgagtgttcaaggttcgtaaatgaatatagtgtctgttatgaattacttaaaaacaaacaaagggagtagttagtaagaatatttggatgagcaagacataaaggactaatatgtttccatgtgatattttttaattaaagtatagttaatgtgggatgtactcgtaatatttttctcttgcgtaatagatctaatatgtgttgtggtgtgatataaatgcaatggcgatgagaccagagtgtttttctgtttgtggtagcaacaaactggaagagcactatataacctctgaactaatatgcaattaaaggtgattaactcactaaggataaaattacctttttaaaataacatttatgatgttaggccattcatcttctttaaaatccttaaaatccatgcagattttttcttaggagggtatcgaagcacatctcatattatagaaatatttttattcggtgaatagtaggagtacatatgtacacgggatttttttagctttttcactggtaaacagtactactatgtatttatatgtacacgggataattttttgggtttgggaggcattattttttttaatagatctgatctaatgatacaaaataatccaccgatttaagtgaaaatcgaaggttggatgttttgtttttttagaatttgtaggacttcctattataattacatattttttttactaatacaaatataaattttaaaccaactgcacactactccctttgtagcttatatatcgaatatatactatgtggagaaagtcatagctgctacctttcttctccaacgtgagccccttcgtatttggccatggtttgcgtgcgtttcctgcatgcttgcttctgtggtgtgctattagcaacttatctaccgtgctagggtattacaaatgaaaataaatatgaaaggaaaaaaaataggaagttaaaaaagatgggtatatatgtacgtaacctgtgaactaacagggtgagggaggcgtacgtacgtacatgcgggaagatgagagggggaactaatttttttaatctaatataatctaatggtctaaaataatggatccactagtttaaatgaaaatcgacggccagatgtttctaatatattaaaatgccacgtggcagcataggagtgtttttagaagtcccgtgtggcggcttgagagcgtttgtaggaagtttaatggacttttagtatataatagaagatagatgtggaaaataatagaatgacttacattgtgaaacagaggtagtagctagctagctagctaggatagcgcatatgcagcttgtactgcttcagtgacggtagctttgaccgtgtttgaccgttgttccaagcatgcgaatttgattaaatctactagctatagggccctgattgacattaagaaagtaattaatcggaggccactgggagatgcaaagaacggctggaggttgtgcagatgtttgcagtgatcgatcggctgccagcagtttgatatcttcctttttggaaaaagatatatagctctctctgttgcatgcatctggtggtgtactccactctgaccttagcttatgatcatcgatctctctttagtttgtaaccgtgtttgacgtcggcgaggacgtatattctccatgggaattgtatagaatttcgagtgttattttcttcaggaatatctcctttagtttattagtcaacactgttgtgcacactataatacccaactatggagttgtagtactttttaactagttgtctgacatgcatcgacttggtatatatatattgaaataggattgattgtcatgatatttttctgatactatcatttttacggtcaaagtattttaaatactgatgtatttatggcacacatccttcatatataaaagcaccaaatatgaaaagaattcatcaagtgggagtatacactacttgttttatatatagtacactgtaatttagttaagctaggaatatgttcttctcccaagttatgaattaatatatatcgactgtgtatgcaaattgaatcaacaaaacctagccaagtgtcgcaaacaagtcttaattaatctggggacatgattaatttaaaggttcttcagatgatctcccatccaagatgtgcccccacctttaattaatttcccattttccctgatgacatgcaagctagggcacatggatttcattgcctgaattcctgaaagccgtcttgtattacatcgtaccatcagcagcatgcgtgagcccttttgtttttcaggtgctttccagtgcacatctctgcttcttgcgtatacagcactactgacaatatatcattgcaaattaatcatcgataggtacgtgatcaatctggctgcaatctttgtaattaagccgggctgaacctgcctgactgacgatcgaacaatgcagccagcactagtactctactaattagtctagggctcaccacaacggcgacatgaatggatcaaatcttagagaaaaaaaaagagaaaagaaaaggagtataaccattatccatctgtatctgaacagttttaattaatttcgtccctaaatgtttttttaaggacaataattggctactgaaaattggtataaccatattatctggtttaactctttttcaccattgtgtgtatatattgaccaactgagcaatactagtagtcgccttattttgctgatgtgtcaatatatatgatgttggctgataatataagaaaaaataattcgtagtaaacataacggtacatatcgctatttgatgcttctttttggtgttcgatctacgagtaatccaatatttaacatacacacaaaaataacggggccacctgcaaatcgtgtgcctaattttttggcaaaaatcaggcgctattccaccaaatagatcagaaatgtttcactaagtagatcaaaaatgtttcaatcatttaaaaagctgaaacacaaccaaatcacctcatgaaatatttttctacaacgtatgaaacaacgtttccaaaaaatcgtacgctgtttcaccctatataaaaataatattttaacaaatagcgaagaatgtttcaattcttaaaaaaagtggaacatggtcagatcgctagatgaacaatttggttaaacgtatgcaacaaatgatttaaatccattgcaacacttaaatcccgtatacatcaacaaaccatgtgtctatcaagatgaaaaatattaaatagtataaaaaattcactgcaacatttcatccatacgtagtgaaacatcacaagtagtacacttgttgaaacattcttggtggaaaaaaaaaataaaacggattcttttaatagggtgtttccattatatccgggcgactgttgcaacggtgacgagtatggtgtgggacgcatgcagcgtggtggggaagcctggagcacgcgtgtgggcggcgggcggtgcggtgcccggtttttctctcacccatcaggtgtccgacgcgtggcattttcgaaaaataatatttgtatattgcattgttttttttattcctcagttttgttaaattatccgagtttttactttctgtcctttccaaaaacctaaagttgtatattctgaacaaccagcgcaatatccaaaataaatatctccatatcaaaaatatccaaaatataaataatccagcgcgtctgcgcgtgcatgatattttcagagtttccaaaaaaaagatggatatccgaagtaaacaaacgccatgtgccatgattctgatagattgtacactacagcactggtagccaagcaaagctgaaactaattaactactcaattatcaatcgctaagtgcgcactcaagcaaattaattaattaattaatcaatccagtctttctcctttttgcctgctgctgcagggtgtctgcatgctcgactaccgttggttttgcggtcgttgctttgggcttatttggacggctctgattgctccaaaaaatcttcagaatgtgcagtcaaacgcaagcgatgaagcatctcctctcctttttttttacttcttttttggcgggaaacttctctgctgcttctgcaagcagactagttgtactaggactgcaatttgtctgaaacaaagatcatggccggattaaaatttctacacatgttgcagtgttatgtgtacttttgctgttccttttttatatatggaccgtgcaatttgctgatacctgaacattattgcttagtgcataatgacagtagcagctacatcataatctactgataattggaaagcatatgtgggattttgagggtccaggaattactctgctttttgtaaactttatttatgggggaagttcctaagtacttcgcgtcaatgagaacctgttggaattgatttgttctctggaaattctaccattttctatgtgctttcttttttctttatttccgagagtacgactgaacacaaaccatccccaatataatgtttcaaatttagagattttttttgtgtcaaatagatgttgttgccaagttaccacgaattatctatttattatatcaataaattaaatattttcatgtacaaacaaatttagcaaataatagtactactagcttagaacaagtagcgttagcaatgcagtagaattgttttctaagaagtcataattttaaagttgtggagcaaataatccatgata

SEQ ID NO: 95014 - DNA, 896 bp, Oryza sativa
cgtcgcagatgtgcgttattacaacccatcatagatcaagggttctgtcgtaggatgtgatttcaatagcaatgtaatgaaatcagagatttaccactgcttttgtctcttcgaatgtgtgaacgtgtattaggagagcacatgcgggtgtgtgattttggtacacatgcataatgatgtctgcatttcttctatgtaataggaataaaacgttatacaatgaatagatagagccttttagattgaatttatacttcgaaggtcttctacaacaattacaaggaaaacacaaaggaatccctgtgatcttttgaattgaaggatacttcctacataccaaatgtgatcaatttagcatatcacagcatgttccgtggttttgtttgtatcctttttctccacgtaaagatctctggcatccaacaagcaatccaaatctgtggctaactgcctagttagctagagagatattgggtagacaaatacttgctaaacatagcttgcctaggcataccaaagaaataactcttgtcatcaattttttttccagctccatctatattaatatctcattctgtatagataacaagcattgacaattaactgtaaggagaaaagcatgaagggttctctatgtcatcttttaaacctgcatttaacatctctatctttgaactaaggcatggtcacaagttcaaatagaacaaaatgcaataaaattattctgctataaaaacaatacaatcacatgtatttttttctccatgaaaattaagatatcgtgcattcaaactgtccgaaatcagtggctatctagagagattttgagctggcaaatacacattgaatttaacttggctaggcgtaggcataccacatactccctccgtttcaca

SEQ ID NO: 95015 - DNA, 1852 bp, Oryza sativa
atctttctccccccttcagcaaaaaaagctttggagaagaagtcttaggtggagtcttggcttataccccagttgagcgcctgtgaagatggagccgtaggcccgttagtccgctgctgtttattttgattgtcaggccttaagtgcctttgtaataatgtaaatattatcgatataataaagatgtgtcttttatatcatgtttgtatggtgtaccccggcttttcctgggacggggattaatacactagcgttcgggaaaaggcaattttctcggtcgcgacacctgacctccacatccgccatatcatttactccctcgccccccaccacgtcttcctcaatcaattcttccttcctactacacctctccgacagttcgtgacagctaatgggtgattctatgagtggactttcattaaggtctataagttctttcttccctatcctaccatctttcttccatgcaaacacctcaagagatttgaaatgtgaccccaatactatatctatatatgtttgccattcgatctctccattcaagtctaacataaatttatgtgacatgacaccgccgcccacatcgtatctcccttgcataccaaccgactcatcattccaatccaattcatgcttgatgcgagacattaactcctcaaaggtaggcttcgcaaaaaacactaattgtctaactgtcattccctcaaattggcttccatgtgtactttcatctaccacacaaccaccataatgaagccggaccaatctatccatctacaatttttaacccatgcataaacattaattacttgaaaataatatgtaattaccattgcaataccaatacttcaaaagctaacaacatgtctaatttttccaataaataagtacattactcaaatactacacattattgataaaaaaaactctactcctacaaattacctacccttcaccacacatcaacccctttcaaaccctctcaatcaccacaaatccatcccacatcctaggccatcaccacacatccatctcccatcaaaccctagtgcatcaccaaacatccatcccaaatatattttgtcaaatgtatcaataacaaccaaatggataaagatatgccacctccacacttcatccccacccatattatccatctaataatccatccttagccaactattatcaaaccacgtctacaaccaaaacaatgcaaaatatccaataaaactttggggaacttagggtttatagaggggtttaacttctcttccgatcccaaactcaatgccgcacaaatcaccttcgattagagaggattttgggggagattgggcgaggagaacgcggtggcgaccgaaccctaggcgggcggctggggaaaaaacggaggaagaactggctggggcggcctcggccgggctctaagtagccaaggtcagcgccaacttacttggcgctgaggttgggcacctcagcgccgaagcggttggcgctgaggtagctgccacgtcagctaggggatcggcccggccgccacggtggcacaatgtcagcgccagtcccgttggcgctgacacggccaacctcagcgccaatgcgcttggcgctgagccgacggcctagttttggttgaagtttttggcaggggttagtttcgaattaagtttttgaaaagggtcaatttgtcaaaaaaacgggcatttttaagtacaacctgtaataaagtatagatctttagtattaattggtgacaccaaccagtactaaagatcccttgcgccgaccgggggacctaacatggtttgaaaacagtgaaccagtaataaaaaccaattttagtactgattgg

SEQ ID NO: 95016 - DNA, 650 bp, Oryza sativa
aaaatttaaaaattcaagtacactttatgtgattaaaaaaatagtaagaaaagaagggaaacagaggcaacagagactgcagtctaaaattctggatgatactgtagcaactttttgcaaggaatataataatagcaatgctttactttgagtacattgagagtttgagatctcatataaaacaccatcatagtgcttgatagaaaacaggatcatatttatgcatgatgaacaaaataggataaggttaatggcaaagagcaagcttgttacctgttgcagaggcatgagttgaatggttttatatgtattttttctcaactactgtaacgtgatattccaaaactcagtttattattgatcaaaagctaacttccaaatctatggggcaaggagatgaaaaatactgaaaatactcgacacagtccttatctttcatgcgttttattgatggaaatttggagattactatcatatctaaaaataaacaggagtcacctaaaatacaaagattcaggactaacgtcatgcaaattgagtggctgacctgatgctacctcccatatgaggaaatgagattcatgaatagttgattaattataccctttctcaacacatgaggaagaataacatgatagatgaatcaatag

SEQ ID NO: 95017 - DNA, 943 bp, Oryza sativa
tcggtttttgccacgaacgcacgcaacacacttcaatatgtccaaaaattttgttttggcgttttttgaactttttgattccggtcaaaaacatcgcaccctcgtgtgccaacattggcattaattgacaaaagttcgccgcgcgaatcacggagtgaatttttgctatgaacgcacccaatacactgcaatatgtccacaaatcatgttttggcgctttttgaacttttcaaaagttcgccgcgcgaatcacgaattgagtttttaccacgaacgcacgcaacacacttcaatatgaacaaaaactttgttttggctttttttgaacgttttgataccagtcaaaaacatcgcaccctcgtgtgccaacattggcattaattgacaaaagttcgccgcgcgaatcacgaagtgagtttttgccatgaacgcacccaatacactccaatatgtccaaaaatcatgttttggcgttttttgagcttttcaaaagttcgccgcgcgaatcacgaagtgagtttttgccacgaacgcacgcaacacacttcaatatgaacaaaaactttgttttggctttttttgaacgttttgataccggtcaaaaacatcgcaccctcgtgtgccaacattggcattaattgacaaatgttcacagcgcgaatcacgaagtgagtttttgccacgaccgcacccattacactccaatatgtccaaaaatcttgttttcgtgctttttgaactttttcattccggtcaaaaacatcgcaccctcgtatgccaacattggcattaattgacaaaagttcgccgggcaaatcaagaaatgagtttttgccacgaacggaccttttacactccaatatgtccaaatatcatgttttggcgttttttgaactttttcattccggtcaaaaacatcgcacccttgtgtgccaatgtttcc

SEQ ID NO: 95018 - DNA, 1163 bp, Oryza sativa
catatacatatatatatatatatatacctatatatatatatatacaatatatatatatatacatatatatacctatatacatatatatacatatatatatatatatatatatatatatacatatatatacctatatatatatatatacatatatatatatatacacatacatacatacatacatacatatatatatatatatacatatatatatatatatatatatatatatatatatatacacatacatacatacatacatatatatatatatacacatacatacatacatatatatatatatatatatatatacatatacatacatatatatatatatatatatatatatacatatatatatatatatatatatatatatacctatatatatatatatacatatacatatatatatatgtacatatatatacctatgtacactatatatacatatatatatatatatatatatatatgtatacatacatatatatgagttggattttttgcgcgcgagttcacatgtaccgacaatgtacaccctatatgcagcttgcacgaatcttagggcaaatatattaggtgctaacaaaatgtaacatgcatgatgtttacgttatactatattttttacaagtgtaaaatacgttgtttatgtaatttttgtatttcttgtatgcaaaacttgtttatgtaatttaccttgtttatataaattaccatgtttatgtagtttttgatggtaggatatatatcattttgtaagtatcatttttgcaagatgacaatttggtgatatagtagatatattgttttctcattttcactaaatatcatgttataaacaaaataagggttagagaaatacaatgcactagatatataaatgtcatacatatgattattattgaaaaaaattatttggtaaaaaatacaacatacatgttatacatattgtgaaccaacctaatcctaatcttttctccctatagtaatcattcatttggttaaggttaggtacattttgcagcacgaatcttggaacacatcaacggtgtagattgtaggtacatgtgaacccgagtgcaaatatgcattttcctatatatatatatatatatatatatatatatatatatatatatatatatatatatata

SEQ ID NO: 95019 - DNA, 1031 bp, Oryza sativa
tgcagcccacgcaaaacgaggtggtattaccgtatgattgattgagttttaattattataaacttgaaaaatagagtaatatgatattatagagcaacttttatatagacagttttcgtacgaaatacaccgtttagcagtttgaaaaagtgccactaaaattttaatcttaattcaactcttgttgaaaaaaaaacgagacctaagtaatataggaaacaagtgctttgtgctagcagcacgcattgaggatagatatcaactgtcaaccaaagatagtacatgactatgatttttctttgtattaagctgagttctttttaataacttgaaacggtttaattttctctttttcgttagcacttttttagaaatgctaaatggtacattgtatgtaaaagtttctatatatatatatatatatatatatatttttaaaaatcttcttaagtttaaaataatcgatacactattaagcatgaggtaatgactcttcgcattttcgtgcccggaaaatcaacgaccatccaacataatcaaaatagcccttaggctatgttcttcaatttctttcccaactcatttcattctttttaggcaaactttttatgtccacacgcttctcaaactactaaatgtgtgtttttttaaaaaaaaaattatgtaaaaaagttgcttttaatattataagactttttagcattgcccacattcatatatatatatatatgcgcgcgcgtgcgtgcttagattcattaacatttatatgaatgttggcaatgctagaaagttttataaactgaagcggaggtattacttaattaatcatgcgttaatgaggaacacccttttttcgtgcgggaaggtggagtttcgcaaactcagccttagtcgttgtttgctgtattaacgtgcactaaaatactgtaggagacattttcacgcaaaatgtagccggagttggttcttttcttgaaactggtcacatggctaggtttttttattttcaagcagaatcaacatactatttt

SEQ ID NO: 95020 - DNA, 2112 bp, Oryza sativa
tcaaacatgtgagaaaaagtcaacggcgttatctattaaaaaacggaggtaatattaaactgtggtgttattttctcctgaagatgaagatgaagttttttttacgcaaaacgaggtggtattaccgtatgattgattgagttttaattattataaacttgaaaaatagattaatatgatattatagagcaacttttatatagacagttttcgtacgaaatacaccgtttagcagtttgaaaaagtgccactaaaattttaatcttaattcaactcttgttgaaaaaaaaacgagacctaagtaatataggaaacaagtgctttgtgctagcagcacgcattgaggatagatatcaactgtcaaccaaagatagtacatgactatgatttttctttgtattaagctgagttctttttaataacttgaaacggtttaattttctctttttcgttagcacttttttagaaatgctaaatggtacattgtatgtaaaagtttctatatatatatatatatatatatatatttttaaaaatcttcttaagtttaaaataatcgatacactattaagcatgaggtaatgactcttcgcattttcgtgcccggaaaatcaacgaccatccaacataatcaaaatagcccttaggctatgttcttcaatttctttcccaactcatttcattctttttaggcaaactttttatgtccacacgcttctcaaactactaaatgtgtgtttttttaaaaaaaaaattatgtaaaaaagttgcttttaatattataagactttttagcattgcccacattcatatatatatatatatatatatatatatatatatatatatatatatatatatatatatatatatatatatatatgcgcgcgcgtgcgtgcttagattcattaacatttatatgaatgttggcaatgctagaaagttttataaactgaagcggaggtattacttaattaatcatgcgttaatgaggaacacccttttttcgtgcgggaaggtggagtttcgcaaactcagccttagtcgttgtttgctgtattaacgtgcactaaaatactgtaggagacattttcacgcaaaatgtagccggagttggttcttttcttgaaactggtcacatggctaggtttttttattttcaagcagaatcaacatactatttttcttcttttagttgacaagttcaaccagatggtttgatcggaattttcgaaaccatagatgttatatttttaatgtgacaccgcttacaagaatactatatcaatatattattaccattccaattagttccttaccatcgtatcatttccatccctataataatctaaggttgcgttcgtttgaggggttgttaaacaaaacggagctgtgaattagtatataactaattaaatattataaaaaacctaataaataaattaatataatttttaaaagcattttcctacatagatttttcaaaaaaaaacacacagtttaactgtttaggaaacgtccacgtgaaaaacgagacacatacacagtatacactaattcaaacaatatttcactcatgataataaaaattcaaatcacaaactgcacttcccctcaaataatatcgaaattgatgcttgaccagtcaacactacttaatcacacacaccacccagagccaaaccagattaaatcaaggtcgggggttgccttgcctaaaccaatacaaacaagctgctaatccaaaatcaatgtcccgtccgatcgcgagatcgcgatcgcaaactggcaaaatcgcacccgcaaaaatatctcggcacgagtcgacgcgacattccaatagcagcagcagcaagcagcattcgcattggccttcgcgcgcttttgcgtttacacccctcgcgccccctcaaaattgcagacgcccccctcccctcccctctcgtgctctcctctcctctcctcttcctcctcgcctcgcgtcgcctcctccgcggcgtaccctaaccctagcctcgccttccccccaatggcgcgtcacgcgtgaggagccgccgccggagcagcaggagcgggagcgggagggagggaggaggagatgtacaagcaggg

SEQ ID NO: 95021 - DNA, 820 bp, Oryza sativa
aaataaaccttaccaaattttgttattaccaaaattttaacaatttggcaatattgctaagttttgtcaggatttattatttattttttagagtttggtaagaaactaaatggatgcacatatttgacaactttgaaaaaaaaaatatggtttgaaatggcattaatctaaacaagtgcttaaacaagtgcttggttttgatttcgtggaatcttccagatgggaaagttgaagggaaacattaccgtttgaccctgtaaaaggcaaggagaaaaatcttgcatggtgttgcacgcatattctgctataaattattcctgaatatgcagtagtatatctctcttaaccactaatgttgatccttttatcttctctatcgatcaataaggcaaatattttgccttaatttcaattttcttaaaaaactaatgttagaaaaaagaaagttgtttgcatccgaatctctacatctatgtttacgcagacataaaggccaatgttgatttgtgtttccataaacattttttagttatttatacatgtatctagattatagataatttaaattagtagttgaatacaagtgctttgctacagataataaaacaactttatctgtctaaaaacacaactacctatgcccttgtctttaacaaaagactaaatttgggatgataaatgtttgtggttgattgagatgagaacataggtggagaaatggttgtattttttagacaaatttaaattctagaagtagttatattctaaaatagatggagtatattataatattacctaaataaattataaatatattttc

SEQ ID NO: 95022 - DNA, 1865 bp, Oryza sativa
ttcaaagttcccctgtgcaaagaaacatggtaacatctgtaagccaatacattcacatatctttattggcaaatgtaacaacaaatatttagcataagtaaataaaaaggtggcagagaaatcaaaattgagcttaattgccatggcttcaaacatttactaacaagaaataatcgctcattgttataacaatagaagggaagataacttcagtatcactaggtgagttggcattcaggacagcacaaacacatttacaggctaattggaagaatttcatcccacttactacaggttatactgcactaaaaaaattattttttacatgcaaaataactagggatcaggaaatatttgaaaatattctttgccaggtacgtgagattggctgtacattgggaatcagcagtaatgtgctataaatttcaaacgttacctgaatcaaatagtatcagtgacaactcaaacttggaatctgtcacgacctcacaactttatgctaaagaccactcaaaggctcactgatctcagagacttttcatattgatatttagctggttacttttcaaggtgttatggtctaaaggatggagttccagaaacaagacttatggaaaaaagcagcagcttacactaaccatagcagatattgctcatattcctaggattgggatcatctcaattaccctgataaaattggcaaaactaccaaaaggatttctctcacatttgcaggattagactactcaaaacaaacatttgcctgagatatactccatgttgatgcctgaggcttgatggagggcattggcaatgctgttcaacatcccttaccacctaggttcaagtcataggacccatgcgagtgatcaccacttttttaataaatttttgctagtctacagttcctgccatgtttaagatattccctttttagatctatagcaccaaaagatttcagttcacttcaatagtactgaaagttgccattctgatttgtaggaatccattcaatttagttagctgtcacccctcaccatattactcttcccttcagtgaaaagcagagcagagcatggtagaggctacaaaaccaactttggatggtatagaaccaattctgcggacaaggcaaaaatactttgagctagttgatcatgttaattagaatgcaatactgggatatctagagtagatatggttaaaaggcagtcccattagggcatcttcgatgcagaatgcctgacgaggtgctttggaagagaaaataatcaagtcccttgtgaattgtgccctgcaatgcaaggtgctcagaactgcttccaatctgattcatgcagggagttgtcctcctaaatcggcagccatgcagattggtagaatcaaaaagttgttggttccgttaattaagcacttgaggtagcatcaactcctgaagaagcatcgagcgcctaggcttaacctgactatggaaaaaatccggatttatttttgtaagagcctccctagcctacagaaattgcttaaaatcatagccaaaatctaaaaaaggaaatgttttagagcaccgacactggtagcaagtgaggactattgtgtatcttttcttaaagaaagatgtgctggaataactatggcctggtttagttcccaactttttcttcaaacttccaactttttcatcacatcaaaactttcctacacacacaaacttccaacttttccgtcacatcgttccaatttcaaccaaacttccaattttagtatgaactaaacacactatatatcatttagtaaggaatgcgatggagcccatactcatgagtcaaacaaatgatatcataccgagtaaggctgtgttcgtt

SEQ ID NO: 95023 - DNA, 1807 bp, Oryza sativa
gtatagctctggaatcgtgtttacaaaatagctttgaacaactaagtgtcttttaatgctgtttactgcaaaccctaaccctttatattataacccccttgtactcccttgcatttatcctgcacttgggggtgtgtcttggtgaataccggtggttgtactcaatcttgctcaatttttcccaaacccagaagaagagcccctggaagataaaggctttggtgtctaactcgggcctgccgtcaagcgcctgtggtcgtcgccctagtcttccgctgtttcccgtttgtctttgtgtgtgctgggccttcgccgcccatgtaataaattaactatttacgcttccacttgataaactctgaaatgtatcaacttttggtgtaccttgcctcctgggacaaggaataatacacgcacgtaagaaacgcccgttgggttaattccggtcgtgacaggatttataacaatagagtggctcttaataaaatttgaaatttataagtagtttttgtcagccaacccgaggataaatcttaccgagtctagtacaatcactataacgggatcgcttatctctaacgggctgaaagcctcatcactatcgggtaaggcccccgttagtgggcaaaggtcactgatgtgagaaaatatctcaatcgggctaaagcccgccacggatggatgctatctcaatcgggccgacaaccaagcccgtcacagatgagtacgaccaatcaaaccaccgtagttaggagcccgtgacggatgactaatctcaatcgggcacaccactaagcccgtcacggatgagtagtcatctccatcgggcatttagccagagcccgtcaccgataggtttgaccccacgtgttaagtcaaactagtcccggttcggatgacttatctctatcaggtgtattacaaaagcccgtcacggatgactaatcactaacgggcttgactctatagcccatcacgaatgagttatctctttcgggcattagctaaatgcccgtcagggatgagtttagagccaaaaaaataaaatttgtctttttggctagcctcaggcctttgctagccacgcccgctgcaaaaatgacagaagcatatatatatatacatagtcccattcccagcaaccccattcccagcatcaattcacatataccatcacagccaatttatatagacccattcccagcatcacatcagaaaattcacattcatattccatcacagcacagtcaattcacaaaatcaaacacatatacattcacatccacaacccattcacatatatatgtcattcacatccatttttctctccaaaccgccgacatgcatcaaaacctgcaaaactaagttataaattggaacaattttatatgtaactagaaatgcaagtatatacagagacgatctacctaggactttactgtaaagaatttaattgtattacaaagaatatttacaaaaatcaaatgtttgtcgcatatgcattgcaaatgttctgccatttcgagacgagctaactaggacttcactctaaacatccctttcggtgacaagatatcatctagtatgaattgtgctatctcctctctaatgatttcgaagttgatttccggaatacttgaaataaattcctgcatgttcggtgccaagttagtctacatacttgtaaatttgttgtcctatgtgtgtataaacaattgaaatacacacctcagggtcgagcaatgtcaccttttctgcgaagctcctcatgttatggcagacatggaacccgcactggtcgccaact

SEQ ID NO: 95024 - DNA, 1929 bp, Oryza sativa
aatcgatcgatcgagctcccaaagcaaagctaggtcgctctcaattctccagccactcacattaactctgaattgaaatctcaagaactgtcaggcattcaggcaatggctaaactttggggttaggaccacctgacctcaggatcatttagttattcagagagtgacctcacagctgtaaccattttcgctgggaatgtttcaaagcattgttcaggccaagcaaagcacacatgtataatttgaattgccagtgatcgattaagtagagcagtacttacttcgctgcatcagtagtgagattctcatgcactggtgtgctctaaattggctgcccaaatcttcattagaattgaaagcttcagtggacctcatttgctactacaggttttgcagggcagaggcacgaggcagacaatccttcagaaaatcagaatgaatcactgcttcttgttcagagatcagaaatgccaaggatacagtgctctgattcagtgcaaagtatggcaagtgaggaatttcctcgctgttagtgaaggagtaaatcaaatccatcacattcacaagccacaagtggcactgaagaatgtcagagtgcatggtttgcctcaattctactgtaccactagtactaatagtagtatatttttcccctctcaggacaggaattgatcccaaatcaaggacaggttgggtctttctctccaggcacataattttgcaccattttcgaatcgaaaacgtaagaggtgggttacaatgcttagtacaaccaattttagtctgtttatttcatctaatccaatggatcaaatctatatatactaccacatcaactactggtagtaaaaaaagaattctattgataatataattcatgaatcagtggttactaatttatgaattcataaatcacttctactaataataatactggtaacagaatattaccaacaaagagcaccgtaaagttacttaagacgtaaacgctggtaacagaatattaccaacaaagagcaccgtaaagttacttaagacgtaaacgctggctacccaaataaaggaatggtcagtagttcatcagaaggtcactcaagattgtgaggtgattcatgtgagtctgcctagagaggacgaaattcgtttaggttgctgaatttaagagggacggcgcagccagactgcaggagaaactgacagcaacatatcgtcatttcctcattggattggagtgtgcaataaataggagcctgcgcttctcattcttgtgaaaaatgaaaaaaaaaaaagctcatgaaaaaaaaagaacgaggttttattgcatgaatatggctgaaaaagaattatggtggcatttcctcccctctccatttggcaacaaaatagtgcagtgtatatattatgtaccctttcatagagatgctttttaggatttgtttattttagttgcaaaaagatctcttctttcaagatttaataaccttgtgggaccgcctatacatttgtcaacaaattttcttctaaaaatttgaaaatttgacagatgtaattatagtacaatcgtagtgtaattacactgtaacttgcatgtaactacagtgtaacttgtatataagtttcacgtaattttgaatcgttagatctattataaaatttgttccggtgaggaagaaaaaaaatcacatcacacacatatgtgaaagaattttttctcacaacctccattttaccgaaataaatgttagagtaaatttcacaaaactacatgttttatggttcaagttgcagaaaaccacacatattttgacacttggtacttaaatacatatattttggtagtttagtttcacaaaatcatactatcaatgaatgaattcacccatgatatgacgtggttgtttcatctaggatatggacgtggcatcctat

SEQ ID NO: 95025 - DNA, 2387 bp, Oryza sativa
  unsure (1)..(2387): unsure at all n locations
cgtgggtnnnnnttgattaagatgcacatcctgcnnnnnnnnnnnnnnnnnnnnnnnnnnnnnnnnnnnnnnnnnnnnnnnnnnnnnncgatcaatcgatagccaataacgcgcgattggtatgcgcggcgcccggccggcgtggcgccagcgctcgcgaccggccatgtcgtcacggcggcgggagcgggacgagcagcgagaggcagccgacgagccaggccacgagcgccgcgaacagccgtggcagcggggtcacgggcgccccgacgcccgcggcgccaacgatcacggtcgccccgaacagcatgaggtacagcgcggagaggcgcatcggcggttcagcacgccgccgtccgcgggcaacggcgagctgctgcggcggcggcggcgcatggtcgtcgttgctgctgctgccattgccgctgccgctgcaagtgatgttatcctcggcagccatcgcgcggtggatcagaacgcaccggccacggcggctgtggttgtctagctacttaattaattttgtggttaattaatttttggaagcgagcgcgaggcaagctagctagctagcggagccgtatagaatttataccaccctgatcggcggttgctatcgatcgatcgaccgggatgatgatcgataattcgatattactgaccaggtgcggatgaatccgggacatcaagatggaagggaagaagcttcatcggaatttcgatcgatcgaggcgtatgtgggtcatggccgggtgaggtggccagggacgaattttctttgttttggtttacttatatctatctatcttctatctattatatatatatactaaataaaagtccattaaacttcctataaacgctctcaagccgccacgtggcactcctacaaacgctcctagaccgccacgtggcaatgtctaattacatcgtcgattttcacttaatcggtggacccaataatttggaccattcgattagattagatgtattttatttaaaaataaactaataccttactgttcaccagaaaaagaaaacaaaaacaaaagtatatactccatataggtacgtacatacataagactaaaaaacaatcaatcttacctactgtttataaaaaaaaaaactatgcacagacttactatagaaaacaataaagctaaaaaaatatacatacatagtaccattgaaaaaatcaattatctttaaaaatggagtattctactatttaaatataaaagctattactctgtaaatttaagcaaatatcaccgtcgatttttaacccaatattttagaccattagattatatttattttattttgaaaacaccatattactctatgtatgtatgtatacgggaaatataagcagtcagtacgtgcaaatgacctgggaaaagaaacgaggtttacctactgtccttcggaaccaagaaaaatctactcacggtggttttctgaaatagtattttcaaaatcacttactataaaaacaataaaaaaatatgtatcattggaaaaagatcgatggtctttttgaattagtattatctactatttgaagataaatatattgctctacaaatttatgcaaatatacgtagttaaactaaatttatattataaatataaaatattccatcaatgatctttattcgttctatcttaacatacaagactaatatatataataattaatgctatgatattttttatttcatatcatattttaaggtgtcaaatatcacttgatgaatatacaacgctaatttaaatgaaaacaatttagttgtttcattttacaccattagattagatttattattgacaaataatacaactctcctatatacggatacatgaaaaatatataactgttgatcggaaaaagtactctgtacgtagttatgattgaaaaaaaacaataatgcttacatatcgtctgacggaaggaaaaaaaatacttatgataaagtaaaacaatcggaggtctttaaaaaatatttttctacaatttaaggataatacctaaaaaacaatttaaggataaaatataataatcttcaaatttacacaaatgtaaatataaaatatccaatcaatgattttaagcgttctatcttttaaattattttaaaattatatatctaatttgtgattcagttgtattcctttaaataaataaactattaatatctataaccctaaatacatcacaaatatggagccggcatgtaataattaatgttatgataataattccacatcacattttagtgtaagaaaccacttgnnnnnnnnnnnnnnnnnnnnnnnnnnnnnnnnnnnnnnnnnnnnnnnnnnnnnnnnnnnnnngatatatcaattcacaatggggagcg

SEQ ID NO: 95026 - DNA, 1520 bp, Oryza sativa
cggtttattgtaacaaccaatctacaatcaatcaatcgaatcatttttcatattgcttttagttttctcttagtttgtccatctttgtcgatttgcgccgtaaatcgtccgccgccactgcgagagtgtgacacctctttttaggtttgtcctgaaaaccttccgttttgcccacgagacgggtagttatctataataggctccgctagccggtttagttataaaaaccaatcttagtttagcttttgctagatcgaggtggttggcgactctaggatcaccgcaaggtgtttatgtgctgcgattgtgcttgtcaacttgtcacaaaaagtttccaacacacggttgcaccggagccatgtgtacacgtgtcaacaagcggattgaggtgcatatgaaccacaatccatatatttatatatatatatatatatatatatatatatatatagggtacccatatgggactccatggtgcccggcaccatgattgaaattgagtatatatccaattcaaatgagtatgaaactttttcaaatatttaggtattaacattaactactttattagattttgaacttgtttgaattgaatttgaacttgtttttgttagattttggttctaggtatatagcatccaaacatataattagttaggtatgtaatcatggattgttaaataaagttaaatttgagttgtttttttttgataggtataggtatgaatcgaattcttataactaggtatatactcacaatttgaaaattttgaaaattttgagtgaatttgtgtatttgataccatggtgcccgggcactatggtgtctcttatggatatatatatatatgagttggatttttttgcacgcgagttcacatgtacccacaatatacaccctatatatagcttgcacgaatcttagggtgagtatattaggtgctaataaaatgtaccatgcatgatgtttacgttatactatattttttacaagtgtaaaataccttgtttattgtaatttttgtatttctagtatgcaaaacttgtttatttagtttaccttgtttatataaattaccttgtttatgtagtttttgatggtaggatatatatcattttggaagtatcatttttgcaagatgacaatttggtgatataatagatatattgttttctcattttgactaaacaaaataagggttagagaaatacaatgcactagatatataaatgtcatatatgattgttattgaaaaaatttatttggtaaaaaatgcaacacacatgttatatatattgtgaaccaacccaatcctaatcttttctccctatagtaagcattcatttggttaaggttaggtatattttgcagcacgaatcttggaacacatcaacggtgtagattgtgtgtgtattatagggtgagactattctacacccagggtatagaataactattctacacccccttaccctttttatcccgtatccctcccgccctcccgatccccccttcccgt

SEQ ID NO: 95027 - DNA, 1633 bp, Oryza sativa
caaataaaatggttttcctacaagtaatttgtttataatatatctgagatttcatatttatgctgtcattaattttcatgactatctagtgtttctgatgactgttttgattgaagcaatagatgaatgtagagcttgccttgctggactaatgtaacattaatccttatttgtctactttataatgtataaagggctttttcatgacctgaattttgaatttggtgcatatgttagtggcaagatattttagtgtacaactaacatacttctaaatgatcagtgtagttaaagccttaggtgcaaagagaaaaaaagcctgtgccttagactcttgaagtgcaattataaaaacatgaatgtttacccctagcaacgaagcttcttgaagctattatgacaaacaaatagttaagaaatatataatgtgtcgtaatgtgagattagcaaactgcaattgaacaagtcttaggctgctctattatacatagtatacttctttctaagatagatagaacaagtgagtgtgttgttgggccatattttgggcccataggccaatatcccttctctagtttctattctttctacctggcaactagaggaggctggagcgagcttaagccctcaaggcacgcaattcgctaatggtgctgcacctgacactattcaaggcgattcagctgcactgccccttgcttttgggcctgtttgtggggagctttagatcctatgaagcagctggtaggaatctagttggcttctggcttctcgttcattttctagattctgcaactacagcttcttagaatctggacaaaaagctggattgtttaggggagtttataattatgggagaagctgcagctaccaaaagctcttccaaacaggccctttatacctaggcgaccgctttttgtgcttttggctgcgctcaattactactgcttctagtccaaatactaggtagttggtttgacttcgcacattgtccaacacaccggtttgactactcattctcattataacatgctagtaaaacaaaaggttatgtgctagtaaaagaaaaaaggtcttgattctacaaactaaaatatttttttatgagtgatttattttatgtgtccaaatctaaatatggaaaatatgttagtggccaaaatcgaagaatgtttgctcacgtgagtcataaatacattgatttttggactggatgtagacatgtatgtgaactgactaatttatcaaaattaattctaagtggtcatttatgtagtgttcaaggtgaatgctccgatgctaagacttcatatgcaaatctctatgttaacacttgtcactgatgtttcagtgctgggaagaagctcacgatatcctatccctgtgtgatgcttaatgttgatgttgcgagaaacaacactaatgatcaatatcaagtaaggaatacaagtgttattcataaagttattacatatttagaatgtgttattttgcttactgactattggaaagttgttcactgattgatttgtttattatcctaccagacattgaatgacccagtaaataagctatatacaacacacagtgaatgttccattgaatttgaggtagatggaccttacaaggtaaa

SEQ ID NO: 95028 - DNA, 723 bp, Oryza sativa
caaatgcatgcatacaaacgctaatagatttttcatgcatatgcactgtgccatcttaaaccatataggattttcttttgccgggtaaccatataggattttgatgtggatagagctggattaactctctatacaaataggagtagatcattaaaaagctcagtagtactagcagtttgatagcggtaataactaacaccgtatagtaatttaataaggtccaagaaattgagagaactactactagtactgtatgttagctacctgcatgcccattatttgatacgaagacgactgacgacatgtgtggctgtcatcaatgtgtgaggtcgcaaagccaccaaattacagtactttgacaatgaagctcataggtcgtcaatcactcatgtgaactaattaaataagtgtatatagcgcttacatgtacgtgacatcacggtcacgtaggtacgtaaaccttcatcactactactactgctgtcatacgcaagctagcagacttgtctccatgtgtactacgtcgccaagaaagtatcttacccagtatacgatgaagtaattaatcccatggattagcgcgtaggtacgttccttgtcaacacacaggatcaaacgtacgaattactgtccactggttggtaaaaccatggaagaaaactccctaatgtaaccatcacaggttagcagccaaattaaggggtaccgagctcgaattcgccc

SEQ ID NO: 95029 - DNA, 1637 bp, Oryza sativa
gtggtggaatttggaaacgggcaaacttttgtaggttcactgctgcataattttttattttcttgattgtgtagggcctataccttctttcatttgtttatctacactttatcatatcatttgtttattataggccctgtatctttaggatttgtaactggctctaaactaaaggcgagatgggtcattcaagctgcatattcttatgcgggagcttttagaacagttacatggatccattgcatcgttgagtagctaatgtgatgttgatgatgtgatatgcttgattgtttcgcccggcgatgttgattacatgttacatggcttgattttgctgtctggtgcttgtttgggtaaccttttagtgcgcccacactgtgttgttgatttaatgcgtacatcacctatagttggtatataccttgtccatataactgtgtctatgctgtaaattttaataaaagttaaacagcatagagggcattaaaatggcggcatatcattcaagaattaggtggaggtgtcatcttttactgtctgttatttacacacctaatcactgcttattattcatttccttttatttctgtagctgatggtatttatttatccatgtgtggcaagcaatagaactttagttgctctagtttattggtggctccgtacagaatttagtgccaactttgtcaaactaggacctgtgcctcagtgctaatttgaagggtttcattctgaatatcatacaaagtataatgtttgtttagatttgttcatatattctagcattgtgtctaaaatattaatttatatgtttttgctaaaacagagttattctgataggttatggatttaggtattaggtttttgtgttggttataggatttggtcatttggaggatcaagttataggatgatgttccatgtatattggaagttgtaactgaaaagagttccatgtgcatcttgattaagaggatcggatcgttaggtacaactctattgtggttcttctactaggaatttgtgttgtagctaggataaatgtttgcagcatggaaagcaggtcacaacctcattatgctcatctctatagttcagttcactattcctgttccattctgtccatgttagagtattcaaattgttggtcttctgttgtgaagatataacaatgccatagcctggacaagtgttttcatgtatcagaacatggtagtaattattttattggtggcctggatggttagaaatatgataattgataaggattgcagtaaaaatgtcccagctatattctgcttctcatcccatataagtggtgccacctagccatcctcccagtagtatttaactatgatctagtgaatagtgataattacaaaaaggaatagctacataaagccaacattatgtttgaatgttggaatctttagtaccatgatgtgaaccaggctactggaattttggagtgtatcttcatatcttgaggtctagtcctatttttcattttatgtttgttatacagagtgcaagaacaagcgtcctcgaagaaccatcaagccagcagcgaggaatgtttcgaaaagtgcattgccttccggtcttgatgccctaaacccaaatagaagaacgcttcg

SEQ ID NO: 95030 - DNA, 1690 bp, Oryza sativa
tcataaaaccaaatagcatgtcaaaaacattaatacaatagaactttcgaaaataaagaaatccaacaaaaataatatggtttaaacgaaaggatggaaaatgaagcatcaagggagaaaactagaaatgtttgataaaatgaaaccatgattttcataaaggcatagatatgcaacaaaatgcaagggtgcagctcacgaaaagttatggattaaaaatgaagcgtcaacggagaaaccaataaatcgttccgaacaagcaaattatggttctcataaaatcaataggatgcaaccaaatgtagatgtctagcatgtaaccaatatattattttcgataaatagggacacgaaactcttgaacttagttctaagtctacgattaaaacgccagagcacaaaaaagccgcaaggtttaaatgcatgcaactatttccttttcgaatatgggtcagcctacttaggaattcatattatttatgtggctcttacgatgattttgtctttggtgggggtggtatgagaacctatccttgtttggttggtggaatacgatctaaggtgtaatggctatgttgttttccaataacaatacgatattattgattttaaatgtttataaaacttttcaagaatacttgatttagaatctctaaccattaggatgtaacaaggttcaagtcttcatggtctacagtcatgatctaaccttgttgatctcacattcgataaatttaagttttaggacagcaagtaagacggttgggaaaataaggataaattgaacaaaactttgggttacatcttaggggttggcaatatttgttctccgggtgctaattagtcatatgcaatctaatccaaggtgttctaggaatatttgtcgagtcatattggatgcatcaggacggtctcattatgtgcatccataaacttgggtcgtggtagaaaacgggatgctatatggcatgtatagcaataacttttctttttctcaaaaaggcaaggatggatggtatgatgtcatgatgaatgaaatgatgcgatgcatgtatgaaatgatacaatgcttatgaagatattttgtattgcatacatgccatagaacaatcctttcgggaaaattgttcatgagactactgagcctactcaaggtttttcatgggcatgggaatagttgcaactctttataggctttaggctaggataaggtgacaaaactacaaaaaatttactcagactcgtaacaaagttctccttatctaggaaagagatggtagaagtttttaaaacctaaaagtcaagttcccaaaccatgtttgtgagttgctacgatgtgcaaatcttgcatccgaccgtaaaggggcacaaaatttgcacactgagccatctcaacttaaattacatagtttgcttacgacttgttcctagtatgatatttccatttaggcttgtgggggcttgcaaaggttacatgttgtctctggtttgtaaggtcatggcactctatcccccttaaaataaaataaaataaaattttgcaatggggtttatcaagaaattttaatggaagagcaaaataggtgtatgtgcccatatgctgtactatccagtcccgaggcgcaaactgaagcaaaagactatgctagatgggtgataaattagaaaaaaaaaagtatattcatgatcc

SEQ ID NO: 95031 - DNA, 5273 bp, Oryza sativa
  unsure (1)..(5273): unsure at all n locations
attcccacaatcaggaaaagaatgtagtggctcagggtctcatgagcagatttggtgtgtgtgtgtactactctttgttctatggctttatgcactacctcacattctcacaacccggtctttttgtgttttcttgatacatatatatttggtactggcgttttaaataaaagcaaagtaggtagactctctaccaatcgagggatcgaagtatcacatcaatgaagatgtatttgtggcaattgctagttataagtaacttgctccgcttaactcagaagtatatgcatgccccatgtaagttctaatggagagtaccaccaatgtgtatgttccatacaaaatttaaaaatgtaaagtgtacataccaatgtgaaaatcgtttaagtatccatggcccaacttttcctttcattttttttccacgaaaacagtccctgaggcactgttttgttaatccccaagaggagggtattgaagggatttatctgacacctattgtggtgtggaataattctccttaatctccataaatcccctccaaactgaacaaggcccgatgtggagaaacctaatctaaattgaaaatcataaaagtcccacctgttcttgatgtcatacaagtgtacaaaccgaaaccatgttcattgttccacctggtcagcgtgctcgaatgcagccttttcttgccactgctcatcctggagccaaccaattcctagtaaaaatctaacggacatatgcaaccatgctatagcattactgttcttctagtccccaatatttttcatggtggtagaattcacaggcatgcatggcgatgcccaaggctgagccgatcaaagcataaagcagccattcagagatgcctatatggtgttctgcaaacagtgagaacagcagcagaacaccatagaggaatgggaaaaaacatctctattgccgtgaataggtcacacgaggaggagctttcatccccggtgcctttcatgcccatgtttggctgagcatggactaattaaaattaaaaaaggaacttatcatttgccaggcatgtgtgcatatgcatgtgtggtagctgctgataatttgcgcactctacctgagcaatagtgtgacgtttgctatgttggagatttgtcaatgtaggattagagggttgcatagagatttgtcactcatgatatttttttagcgttatatttagattttagggtgacatggagaacagaggaagattttctatgtaaaataatgtacttcatgaatgatactccctccgtttcacaatgtaaggcattctnncnttnctcatattcatattaatgttaatgaatctagacatatatatctatctagattcattaacatcaatatgaatgtgggaaatgctagaatgccttacattgtgaaacggaggaagtagttataaaatggccaatcaatttaggaccattgggagtagtatgagaggtacatgaattgagatggtcatggctagatagctgcctcttgataccacagttgcagtaaaaagactctgcctccagataaagttttaatatgctgatcattaactggcgaatttgtaatttggcttatggagagaaagacatatcctatttgttacggccttaaattccaatcagctttcccatatctatgttttctttttcatacgaaagcatcaagtcatcccaaccattatgttctctaatacacagaaagaggaacccgctcaatgtagaaaaactttgctagaaaagggtgaaccaaatttatcggagtaatcagagtggtagaaagtccaaataggccatatcaagaggccttttatagtaccttccactaggaggtggtagtagtgtagtaggaataaatatcgccgctgatttcgatggtcaatttagtcatttgtttaaattaggtgaaagggcaattaagtaatcattggcaggccctaagagcctgtttggttggagggagttagtgatgggaatgggagtttatgatatctgggagtttaagtctataatttggttggaagacttggaaattcgagggggtttgggatagggaattaagaggtccaattcccaccacggcttgtttggtaactcgagggaaggggattgagagtttacacgagggaattgatgatgagattaagatgggaatttgatttttaatcccaatatcttgtttggtagaggtgatggaaattcatagggagtttatttggagattaggtcattaataaaaacggatggctgagatttgcttagaaaaagtaaaggaggaattccctcccaattacctgcccctacctagatattgaaaaggagggagttccttcctcaattccccatccccgtcccaccaaaattcccatgtctcccaaccaaacagaacaattaatagcctcgtccctctaaactcctagtccctcccaaaaactcactccaactaaacgggccactaatctcttacctgggggaggcctgttaattcgtgagacttgtagggaattcgatgtgaaaccaaacaatggaagaggactaaaaatataactcctatgaccaatcccaccatcaactccctcttgaaactcccattcctctccccttctcttgccaaacaggccgtaaggaggacggctcaaacatcagtcaatcgttcccatggccaattcgtcgggcacggcgcacggcgagcacgggcacgcgccgccgcctgttcgccgttcacccctttcacttccaaccccgatgtgcgccgtcctttcactgccaacagccggtgcgcatccttgcgcaagccaacactcgacaccactcgccccgtccgcctcctgacgccgcgctgccacccgtcgacctaatgcgcccgcgcgccggcgccccctctcgctctccttgcgcccggcatgaagtgttgattttaatatatccagaattgcggcatcaagtgctgatcttgaacatacatgttttgctcgcagcttcatgatggataatcctcaaaagctatgaaattcagtcttcataatataccaattgattatcttgactagtcgcaaacaaaacctgaagattctgaaacttatttgtttcctgcgattctgctaactaatcacaagggatctaaaccttaattattttctgcaactgtgctttcagtttaattaactctttcattaacgaaagtattaatgatcccgcaaaataattaaatctgaatctttaatgtgccctcatggttgacggtagtagaatttgtgtaagccaggcgtcaaccatgcctcaaatcagaagtctgaatttctgaactctggcatgacctgaagaaagtttcatagaaaaaacaacctcaagaaaaagcagtacggccggaagggaaaagaatccgacgagcgtgctgcctccggaggtggcacagcagtgatggcctgatgggagcagcggcggtgccagtgatgggtgtagggttcaaaaatcacgatctaaagctattgattaattatttttctttttatttcataagtggactgcatttttatagacccaagaacaaatcacaccctctgccaaacctaaattttcaaaaatgtcacaacaattttttcttccagaattaccattctactacactcctgcaccctgttacactaggtgcagtagcaacgtacatcctccgttggatcccatccttgaacggcccacattgatccatgggtactttaaaaaaaaatcccaaattaagcgctgaacaagaacggtagaatagtagcctcattcttacacaagtataccatgccaacttctgccgtacatcttgtgcagtagatccaccttgttgactgatctagattcatgatatcaacagctcatgtggcatgggtaactagttttacacagatcgagtcaacaggatttctagtgccacccatgcctacaattgaattggaaatggaacattcctttgttttcttcattgcagcacacaagaatatggattatttcaacatagagcgcatgcggaattttgccttatagtagagggggctggactgtgcgtgctctagtgctcgggcaagctatatatatatatacccgataaggttgtagtatatagttgttggtatattattctttgcaaccagccaaccacacacagctactcagctcccctgctcttttctcctttgtgcaactagcatatactccgcacatgtcattaactaaagacgtactcaaaactccatcaaaggtagttatacgtacttcatgtgtttgtggaaagtggggagcttagttcagatcatcagagagttctttaattttcccgttttgtgcagttattgccaattatgagctgtctctggtaataggctatcacagtttcagcaaatcccacgcactgtaccgggagattgttttatgtcttgaggtgatatccacttattttgttatgttacctaaatagttattaaagctttttgaaaaaattgataagataggttaatatgagatatatcactatgcaaacatgtaagcttaaattcgacttctacaagttctaacaaatataactgtgaatttacatcaactaattttaattaattttcttttattataacttgtaggttctaaatttgaccttgtatgtttttttagtgatatatctaatattccactatcttgttattttttcttaatttttataactatttaaacgcatgtaagatatgaggggatgttgaatagtataggatattccttcgagggatgaaaaaaccatctcccccaatgaaaaatagttttggtctatattttttaataagcgcaattgattttactaaatcttaaatttttagatgctttcaaatcccctccaaattgggtaagaccttgttaaatttttcatgactttgataaccacaaattttgttatgcttttgatcccagcaaaatttgctaggagtattaaatttgctttgacttggatgtccaaaattttgtcattgttagagagaaaacagggatgcattagtgtgcacctcattgctcaaaaagaattttccagcacgcaacttaattgtaataggatatatatatatatatatatatatatatatatatatatatatatatatatatatatatatatatatatatatatatgcactacacaagcagtacaaattccatccgatcgatcgagccatccaattttacatggatgtatgctagattctacagcagatcacaatt

SEQ ID NO: 95032 - DNA, 1538 bp, Oryza sativa
ctgccggcacgccgccggccaccaggccctccactcgccggcgctcatagaggagaaagaggaaaaggagaagaggagttagaggagagaagttaaaaggagaggaggaggaagaggaagagatatggaggaagagatatggaggaagagataaggccagtgaggagatagaatatattaactgctcctcctcctcctcgatctggcctcgtactctccgccgcccatgttgcgcatgccgatcttttattccggttggtaacaccaaccgggactgtaaatagatctttagtcccggttggtgttggtgactaaagataatagggatcttttgttccggttggtgttaccaaccgggactaaaaatagatcttttgttccggttggtaataccaaccgggactaaagataaaaaaaaaactctaaccttttgaaccgggactaaagatatctttagtcccggtttttattgcaaccgggaatattgtgtattttggccgaccgaccaaaaatggtttttccaccagtattatgtgctgatagagttgggtttttatttgccgatttttcatcaattaatcgtatggttgtttggttttttggcccatgataaactaggccaactcctttttcttcctaatataaaacatgaactccctgtcctccttctcgaggtttaccccaaaaagaaaatgctttaatgctttaatatgctcatatagacatatatatagatattgtacagccccccatctttgagaatatatatatatatatatatacatggattgggtagataattcatgtatgtaatatttttttctgaaaaaaaaactttcaaccctcaaccctcttattgttttgttggttggtccaagcaagataatttaagtaagtgtggttatgcttctatatatgcaagctgaattaagctagcatttcatcgagacctagctataactaatttatcgatataaaaatgttctcgagggcaattacacatcattcaaaagttggacttgggggctgttatttttctttagttaaatgtgtcaattaattatgtaccagaatcttttgttgattgaattgcaagttaataattacttgtttggtatacaagaacgaatgccactatatatatgccggtactggaatttcttagggacgatcgagaataatcaattcatcccaaatcggattaattcttccatattcccagtgtggcatgcgttagccattctatatgctcctttcgttaaaaaatatattgtgtattattttgttttgttagggcaagactttgacaataattactctagcaagatatatatatttaacacaaaattaaagatacatgttaaaattgcttacttacaataattgtttttatataaaaaaacaatggaattttttttaaggtgctccaaatgttttcactgtccattagactagaatccaatggtatattaccttgttctgggtaggatctcataataaggaaagaattaatattctttaaagtggggccgcaggaa

SEQ ID NO: 95033 - DNA, 2215 bp, Oryza sativa
ttttgaatctttttctaaccatttcattgacatgtaataaacggatggatgttcacccgagtgcttaaaagaatttcccatatataaaacccaaatatacttttataaataattgtgcctatagaaataaagatttagagttgtatattcaacctaactctacgtgaattatatagctctgcgcaaaattgcaagaggacatcccctagttgctagaataggaagaaaattctaattatttgtgtgattccatatttccattgtgaagagtctaactttaatgtccttgtctaagaaagaatctgatttgttttgttaatatgtactactacctaaatttgtgaccattaattggatataaaatgaacctcgtcactctattagttcatataaaactctcctcccgttcccaaaccttagacactgaccacaccccatcactagtaccgcaacgctatgcaattgcatattgcctttggtaagctgccaacaattcctctcccaagcctttctcatccactcccatgatacatcatttttccaaattgtttttcattcttatataggacgagattctctcatgatgtcactatttcctccctacgatggttacctggccgaatactaccatattcttcttttttattaaaaaaaatataagatagcccgcgcacatgcgtgacatattatttaatgtttcttgaaattttattatcaatatttatttgtgggtaattttttaaaatatatatattcatcctatcctaaacctgttcttttcataatttttttgggatttttaaacgtcgattatgactctcttctaattacggttgcaacatataagttataaatcttttaagtaatactttttgtttaggttaggctgtaacaaccctaaaatttgacaacattttaaaaccgatttagcttactttgattttctaaaaatataaccgtcgagttagtggtttatttaaagtattattttgcatgtttatttctgatgtttcttttctcgtttaattttgtcgcaaagtgcatatcatccctcaaataattcctttgatccgatttaattctatcccgaatgtcggactatctaaattccgcaccaattcaaatcctatctattttattcttccccatattttcttttctctatttccaccttaattttcttttttcatatatatttttttcctttttctgtttttcttccctatccctccctttctctgtttttccttttctttctctctctactcggctaggccaagccagaccgagccggggtgctaatgggcgatcgatcgccagggccattgcccagcaatcgcatccccccgcctccctcctatacgcagttctcccacttcttcccttcctcctccccttcttctcttcctattacagtaaaccacaaaaaagttttaaaaaatcaaatagttggaaaaatttatatatagaaatactatatataaaaaatttgaattcaaatttaaatttaaattcaaattcaaattcaaattcaaacttgaattcaaatttaaattcaaatttgaatcgggtatgtaaacttttgacttataaactttggatctataaactttaggtgtataaactttagatgtatatagaaaatatttgaattcaaatttaaatttgaatcgggtatataaactttagttctataaactttggatctataaactttaggtgtataaactttagatgcatatagaaaatatttgaattcaaattcaaatttgaatcgggtatataaactttagttctataaactttaggtctataaacttaactttaggtgtataaactttagatgtatagaaatactatatatgaaaaatatttgaattcaaattcaaatttgaatcggatgtttgaattcaaattaaaatttgaataggatatttgaattcaaattcaaatttgaatcgggtatataaacttttgacttataaactttagttctataaactttagatgtataaactttaggtgtatagaaatattatatataaaaaaatatttgaattcaaatttaaatttgaatcggatatataaaattttggtctctaaactttagatgtgtaaacttgaggtatataaattttaggtgcataaatttactaaaataggaaagtaatgcggtgacaaaaaaggaaataggtggagggagggaggggggagg

SEQ ID NO: 95034 - DNA, 2914 bp, Oryza sativa
tgatagtagtcttaaaagaatagcatttgtttcgaagacaaacagtattcttttcccctctttcccaactcacttctctcattttccacgcgcacacttttcaaactactaagcggtgcattttttgtgaaagttttttatatgaaagttgttttaaaaaaatcatattaatctattttttaagttttttaggctaactagaaaggtagcccgcgcagatgcgcgggcaatttatttattgtttacaaatataattggtaaattttgagataagtctaatggtttagaaaatttgaagattttttttcctaagagagtaggaaaggaaagaggagatgaggagagtacgtccgtaacagggaagggtgtggagaaggtgggtgcatatactttttttattcgatctaatagttaaagtattggacccaccaatttaaaagaaaatcaatggatagattttagagtgtcacttggcttaatccaaacaaattaaaattaaatcaggtctacttgaaaaaacacaactaaattgttttactttttcgcaattacgtagtacatttatgaagtgatatttgacatcctaaaatatgatatgaaattatttaaaattatcataacattaattattatatatttgcccaagatgtggtgatgtatttagaaccgcaatataaattttataagacacaaatattttatttaattaaagaaatacaaagggatcataaattgattatataatttaaaataatttaaaagatgaatgtttagagataattgatttgatattttttatttatattatagatctagtttatatttgcacatatttgtggagtaatatatttttatatggtaaaaagttatattttaaagaccattgattttggtctgacggtaatatgtattatcgattttaaattatttttaatctaaaatggtgggtttaataaggtatagagaaacagttagattagatataatatgtatagcttaaaataactaataactgtggttgtttttttttatcataactactaaaaaaatatagatcagtggagggggcagaaagtgttgtgcgtgtctaatggtggggtgaggtggaggggactttgtttttctatttttttctaaatcatttaggtcaaaaaccaattatcatgtattttgttttttagaaaatcttttttaattttaaagtcatcataatgacttaaaaaggtaatattagatacaccgatttaagctggacgatttaactggagattgcttggttcaaattagctacgtaatatcccggtaaagccatgtaaactgatttaattagctggatatgttatattaccgttaatttccttccacaaatcatgtataataactaatttaattagctatgtataatcttcgtgttaatctcctagctcccatatatatacacatacatacatacatacatacatacatatacatatatatatatatatatatatatatatattgccgtgcatataataaatatagctatgattagtagtaatacaatatgacagctaattaatctcaacttctaacaaccatagatactaatcatccttccggcaaaccatacatacgtacgggagaaaggtagatctaattcattggtataaaataatgggtccaccaatttaagtgaaaatcaatgacagataaagatctaatctaacaatgtaaaataatgggtccacaatttaagtgaaaatcgacagtgaaattatattgtgccatatggcggcctaggagcatttgtaggagcgccatgtgacggcttgaaagcgtttgtagaaagtttaatggacttttagtatataatagatagatacttaattaatctcactataatcgcgtgctttgttttctgtgtcgggaggcaaggttggtaaccatgcttccgaaagtgtttgtaggtgagatgtaaggtgactttgtttgaagcaaaaagtcttgagtttgaatttttcttagtacgtgtatatgaatatgggcacatgtatcatgtgatttgtgggaacgagagtatgaattttgcttaccacgtgtatatgaatatgggcacatttatcatctgatttgtgggaaagagtgtgtatatgaatatgggcacatgtatcatctgatttgtggggaagagtataatggtatagatgcctaaaaaatacatcaaatatttttttttgatttttttagcacctgcaaaaataaaaaacgggtgcacccctacacctataatactggttcaagaaccgacggtaattggtgccggaacctatatatgatataaacttttagaaccggcacattagtgcacggaagcaaggaatacatgtccctccgttaatatctcgttccatttatcggattggtatttcttatggaggcggtgtgctggtgcaaaccgagccgccgtcgtctctttgccctccggcgaggcggcgatacctccatcagttcgcgttcccgtagtagcgatctcagatttcgtatcggtctcgattgatcaatgccgcgtagagcagaatcggattcagaaggattaaccgttaatcacagcctctaagcaccgacttcaactcgaactccgtctccgacttgcttccttcaccgatttcaactcggactccgcttcggctgccgataaatcctagcgcgccgcccctcaccgtctccgcattcaccacaattccttccacccatcctcgcagcagcgctagctcgtcgtccatggcgcttccccgtcgctcgagtccccgctcctcgcgcccgatcatccaccgcgccgtcgacgccaaggggagagtagtctccaagaagccatcagcagggtcgcccgtcaagaagatgtcatccgcgccgtcgacggcgacgcccgtgt

SEQ ID NO: 95035 - DNA, 686 bp, Oryza sativa
tggagcgcaggaccaggaactgggtaatccgtttttgcaaggttcaatggagcaaccacgccgaggaagaagctacttgggaacgtgaggacgagttgaagacagcccatcccgatctcttcgccagttcttccgaatctcggggtcgagattgtcacgtcccaaaacgactctaaaatacatcctctaaattatgcttagaataattaaaatccgtgtgaaagcctccaacaattaaaaggtgcaaagttaaaagtcaaataaggcttgggggatttttgtatatttcctaaaagcctaaaatgcgtaaataaattttagtggaattttcagagcacaaataataattattaagaaataaacaaagttaaaatgattttataaagagaaaaactctaaaaagtcccctttccctccctctccctcttgggccggctcggctcatctccctccccctccctctcctctccctgcggcccatccggcctctccccgcgcgcgcgccgcttacgggcgggcccgcccgccaccatcgctgacgggtggggcccacccgtcatccccttcctcccgccgctcccgctgcctcgcccgcgccctagcgccgtcgccgccgtgaatcccgccgcctcccgccgtctccgcgtgcaataaagagggggaaatcactccccgtgatcccctct

SEQ ID NO: 95036 - DNA, 941 bp, Oryza sativa
tagatggaagagatgatggttccgcagataaaattttggctcatccatgactgagtctaatgaagcacggcataatttttggtaaagcggattcttggttgttagaagaggaatcaagtcattgagctgaggaatctttgttgttaattggagtttgaagaatcttcatttgtgctttgcacaggtgctaaagccaaaagttaactgctatacggtaatatgatatatcaaacccaagttggttggctaatgttgtagtgaagagaatataacgtggctctaaacaggaaagctggaaagaacgatatggttgggtggaatggattagtttggatggattctggataactcggttcaataagggcctaacgacaccaaatttgtgacttgaaggttagcttgtgtgtcgactgggaattggaacctgatgcatctcactctttgcttccgttccgtcaagcttcaagatttacctctcaatcgagtattgctttatacttgtctcagttgtctgatcttattgagaattgtaggatccaagctcgtgcatctcggagccagcatttggcaacaggaaaaatggctctaatgaacccagaaatgcagaaaagcggttcgcgtcatggtcctgtttctttcagcttgggattattataatccagattattagtagtaagctgaaagaatcagacaacttattgaagtagcttattataatctggagcccagcttattataatctgataagctcatttaggtgagctttttctagattattgggtgaaaaattacccaccatatgccaccccactccctcattatacttgcaaactcaataatctaggctctaataatctaggaaagaaacaactaacagcttattctactatagattataacaatctagtttatagtagattataataatttcaagctgaaag

SEQ ID NO: 95037 - DNA, 1094 bp, Oryza sativa
ttcatataaccgtaccatgtaataattttttttaggtagtacatatatacgtacattcctctccatccatatgcatagaataggaaggatcttttttgtttttttttctatttatgaacagtacatcgtacctttctctccatccattcgcatcagatccatattagaaggaatgattttaatagatttaatttaatggcctgaaatatcggactcactaatttaagtaaaaattaagggctatatgttttacttttttctcagaatttataggattttctctaatttattagagtgccactatagcacacaacatagtgataggttgagagcgtttgtagggagtttatttgatatttactatataatagatagttaatatagcatttcttattatttatgtgctgagctgctagctagaaaatttggataaaatagtgagcaggtgatgtaacaatgatatgatgtttttctttttttctcagaattttttagatttctctaatttattagagcgccacgtgacggcttagtagcgtttgtaggagtcatgtagcggcttaagagcgtttataaaaagtttagtggacttttatatataacctggttttttcggctttatctttataatttccgatcttacgatcgtacgttaagttcttacgaacgtaacatgtaatttgttttttttctgtgttttaggtagtacatacgtacattcctctccatccatatgcatcggataggaaggatcttttttggttttttctctgtttacgaatagtacatcgtaccttcctctccatccatttgcattagatccatattagaatgaatgattttaatagatttaatctaatggcatgaaatatcgggtcctctaatttaagtgaaaattaaggctagatgttttgattttttttctcaaaatttgtaggattttctctaatttattagagtgccacgtggcggcttaagagcgtttttaggaagccacgtggctgcttgagagcgtttttagtaagattaatggtgtcgacgggtgatacccgtagaccggatatagagggtattggggtacgtttgtacaaggg

SEQ ID NO: 95038 - DNA, 5817 bp, Oryza sativa
caagtatcatatattgttcgtaggtggtgaaacatagaagatatatatgattggtagattctttaagtttctgatttccagtgtacatactaattgctgtgtgaatgataatagcatgaatgatatccatgtacgagcgcaattccatgtttttcacgaaatagaagatcatgatgaggaaaatatgaattaccagagcagttgcgggtgacattctgccatgctgtccataataaagctaaataggaaaggggggtgctaggaaccagagcagaagggaagttaggaatatcttgcccgattaataatccatttcatatacgtgccggatatgatttactgattgtaatctcgagtttagcccaaattctgaatacctaccggatactgaaggttcatggattgtttgatttactgccaatagaaatatcggcaaaggggcaagaaaatctacatgtttttttttctttccaaaattttggcattcccaaattttcagtagcaaaaacaaatgaacatttaggacattattcccacagtatttttttatgtaaattactgccacgtgaatttcactaaaggaaaactatttacatagaggattgctatggcacgggattccgttccaacgggatactttatgaatcttccacctctcgtcttcccaatggtcaagctccaatgttgaagcaacagcaacccctagcctcttgcccccatcgaccacaacagtagagggaggaggaaggcgtcgatgagagggagaagagaagatgagacaacaacaattgacttgctggtcagccaaacggtaacaacgcactctctctctctccatgccttgactctaccggataccacatgtacccgaactaatacctaacaactgatacctatgggtactggttggtacctaaggtatcaggcacgatatcctgagatgaccttggtaggctggtacctgggtaccaggcatgatacccgaggtactaaacctagtaccaaggtatcaggcacgatacccgaggtaccaaccctggtacctaggtatcaggcacgatacctgaggtactgatcccctgatacctaaggtaacagttgtaacatacctatacacaacaccggtgagtaatgaagaaaaccgacaacctctcatccatttcatatacttcaaggtcaccatctatgtcgataccggccgcatccaccttcctgtcggtgtccagggcctttccttctcgtcacacatgacaacccccaaacctcacagccatagttggctctctcgcatgccctctccaacctccactctctcacatgctccgaatctggtgtaggaaggaagaaaagaggataggggatgtcatcggtgttgacggtcgttacagacaaatttcgacgttcaatataactaaaatattggagaattagctatgcttgcaatgtatatttatttcagaaaaatatagttccacatgtacttggagaataatatgttgcaggaattatcaaataaaataaagagaaagtgaagaaaacctcactcctaagcaagcttatggataagagggcccacaagtcaggtgtaactgtctggaaaccgccttaactaccacaaccgcctaaaagacccatctgtcagtgagcagaccgaaactggaggcctgttgggccggcccaggttcggccgaacccgaaacctggcggtgcccaaccagcttggccctccacgtgtacgctccagatgctctctcaatgtcggttgcaggggcaaaatggacatttcccatggctacaaccgtcataactgccctataaaaggaggagctcacttcacttctcaacccacttaagcaagctcaaattcctcttcatactttagtattagtatttttgtgctaagtggagtagagtagaatagtattcgaagtcctcgaagtcttcggaagagttttggtagctcttgtactctcttttgtaatactttcggaattaatgaaatactcttatttatgcatctacggtactttgttcagtctgagtactattcaaaatttatatctgtgtcatactaattgtgtgggtagcctaccagagaggtgctatggtgcgggtttaatgtccaatttatcggttgctctatgttgtgtgcacgggtgtagagtagcatttagtaatgtaagcgcgatgctaagattattaaatatcattaattgggcatatatgatgtgggacagtagaggtgggccgctgatggtgacagctcagtatgggtattcctccacgttagtatatattcctaagacaaattcctagggagggtactcctccgtatttagccccggtcggatagctattacaggttgtcgtaaggaactcggcaacccggggtggtctctcgaagtaccaggagggcattgtcaggggtataggccacacgattgtatgctagcagatgtaaattagggattgattgtatactagaagtataggaattgattgctttctatttcttcttctacttagttaaaattgattatcatgaggatttgaatagcttcgcttcgtgtcactatatccttatattaaaattaacccctgcgtagactttgataagtacacataatatatgtataaagtgtattagcatagtccacttctattatcttccctttggataaaaaatacgataccttggaatacttctgggtgaaatgctacaatggtatatccgtgcgcttgcggattacttctataaccataaatatacctggactgtttctgcgtcattgttgggaatgaatatctctagtaatgtcattaagaaataccaacagtcgacgtcggagacgatagtcttggagtcgaggagggagaggaggaggaaggccatttggatggaagagtggatggaggagtgatgaggacacaactagctcggatataaccatgactaccttatgtattaattaacaaaaggtgcatatgttctatattagatttacttgttatatatttgaacaaacgttgctacacaattagttttgtgtgttttcatttgtagaggtacttgcttgggcgaaaaaaaagagaccgagcatacggattgcatggatgattgaagaagttgattggggaccaaaccaacaccttctccaagtcttatttcatatcaccatgtcacttttggttctacacgttttggattcggattcgagtctcctgatagcatcaacttcaaacggacctagctgctgatctagaaggatttcatggccaataagtacttgttggaaagcttatgaagtctactttcagatggttttggtcccacgtcagaattcctaccgagccacgtacctcatctagtccgaatctgatttgagttttggaccttgtagttgtgtcgtgggcttaacccaagggggtgtgcaccctagggcaaccctaggacgtccctaatcatatttattcagtagccatcatcgtctagagtcgggttttgcttacattaatctgtcaagaatagtttcgccgcttgatcagtttgtggaaccccaaattcaagtgcttaatcattcatatgcaatttggttgcaatctatcttattcttccttgtgttcttcgtttcgcatgcagggattagccttctcggcgaggtcaaccgcgtttcggcatagttgataaccagaggagatgtggtgctgcaattatgtggctcagtagcgtgttcgttcagaagccagatcgagttctgtcgcgactccacccaaatcaactatttatcaatacctaatggaagatcggaacctaacatccttatcagttggtatcaaagcgcgattacccgttaggtaatttatcttcccacaactagaaaattgccacataaaaaaattttattctttacctaaacaatttgagcaattgcattgttgtattagattttgcttcgttgaattttagattgcatcatcgtgtcaactgctggtttagttctagatttaatttgtagttttgagtattgcgtctgtcatcacattgagtctagggttgatcagtcaagtcggtgtgagttgtacgtcaattttgggtccagttttgcatttcgtcggttgttgccgggaccttgaaaaattgaatctaatcattgtcgggtttccgtttttgggatttggagaaatttttgtacaacggttttggagttgctcgatttcaggagttcctttattgcagtcttagtgcgcgtgtgaggtagaggaaatctgatccatgctgtgactagtcccacctctcccgtccgtagcattaaaattgttaagtagcggatttgatatattttaataaaaatggaacctacgtgatgtgagcattccatttttgaggtgatctaattttagttttgtactttgcatttgagtccctgtaatattcatatttatatttgagtccctgttcaaggtcagtggtcggttcttgttgaaaaaaatagtaaaaaattgaaaaaaagaacaggcagaaaggtgcaaaaaaaagaaagaaaaaacggcacctaaaaaaagaaaaaaagggtagaaaggtgcttaaaaaaagccgcaccaagaaagaaaaaaaatcatttatcctttgagatgttttcagagtgcagagttgtgcatttattcatatctagtccgtagtgttgtcgggtgcttgcttgagctagagttgagtctaggctaggccagcacattgactagtactttgaactattattcaactttgcattttctgattagcataattgtgttcctttgctactatatattgtgcctcccaagctccacatatatacttctggtcagcaccactttgatccttgcaatcgccatatcacgtccttcaaggtgtcacgaaccaaccaccgattgtactgtccttagcacacttataagagcttggtaagcttggtatgtctgataatcttcttgagtccgtgtaagtatgttacaactttatcactaccgagctccacatatcagcctatagaatagggataagattggcacaatctgccttggtgaggatccacaaagacaaaaacatttgagtggcaagagagagagagtcaacaagaggaaaagagctggtttgcgaaaattgataaaaaaaactccaagagtctgacaggtgaagcaagaaggactggaatcgagatcgttccatttatcaattacccaagatggtaagttagccactgataaagttcacaggtacaggtatggttttgaataatttatatgcttgaattatatcttggagaatttcattctacactgacctttactcaaggatgagtaaagagctaagtgttgggggttttgttggcggtcattaaatgccaattctataccgccaacatctgcataaagtctagataataaaatatccaacatagtgataggtgttaaatctcacataatccatatgtgttggtatttatttgatgcatgtaataaacctaggagttaggaggaaaattggaccaaagtgagagagaaacatgtatccatacaaggatgggttgtgaacttcatcaaaataccggagaatcagtccaaaattcacagaaatagataaggacgaacaaagggagtccataagctggaggccaggccatgagggcccagcccaggcagttcaggcagaggtttggcatggacgtcccacattactccctgacgacggttgcggggcaattcagacaattcacaaagaggacaaccgtcgtacctgcctatataaggacatcatttcctccactttcacacacactt

SEQ ID NO: 95039 - DNA, 1733 bp, Oryza sativa
  unsure (1)..(1733): unsure at all n locations
ccatgttaactgaanactgatttgcaacctccnacccggcgatctcttagagtctacctggaatcaacaactgaaattctagctcatctctaatgactattaattacttacaagcttcaaggttttattttatacggactaaaagggatcttgtccatggaaattacaaatgccatgctctgggtaaactactctgttacaaagacgtattgtccttgttagtgccacctatatgcaacgataaatacctggcatatgctgaaggagaaaatacctattaaaactccattcggcactcatacttatcatacggtgtgaatggctaaataatgcgggccttttctttattactccacctaacaaacatatgatgtactgaacagctactcatgcatacaacgccagggttaacctaaacacgactgagcaaacatacctctactaattggaatatcactcaatactggcaagctacagaaagaaccggctgttaatttgatgggttggattatcatgaccctagattatgttgagtagtccatgctaatatataaatcagctaattggaaatactatgtcgctgtttgggggagcttgtcccagctgtagcttttcccaaaagctgcttctgctagaaactgcccctaacagtccacagcttttgagaatatgtagttaaagattctgaaaaataaactaagaagccagaagctgggtttcagagcttttccagattcttagaagctggctaccaaacagctacttttcagaatctaaagctccccaaacaggccctatgttttctagcttgagccaactcgatctggctcacgagcctcttcacttgaacagttgcgaaacagacaagcaatgatagacattggagagattgaagcataggtggaggccaagtctagcgcaccacgccccttacccaggcattcgaacttgtgactcataagttgtaaactacacctgcgaggacaagctggcaaggagcggcgacgttatttccaatttcaattgagggggaagcgactagttggttgcgttgtcagcgtaggcgtaagtcaatattgtgtaatcgtacaaatgtggctcccttctacgctattttctgtgtgcatgacttggcggtgtagcatgagtatgcactcctgttgcgctgtcatctgccccaaaagaatagagagaattagggtttttactagtgcttatctttgagctagacaaataaaccaaactataataggctggctagcgcgagctaccgaataactcatgagctagctcgaacccagctcattctagaaatgaggttcggaggaggctttggctctgctcgtttggctatcgatcgagccaaaccaaaccaatataagcctgagtgttttttcctacccctacaaaggtttaaactcttaccataagcacagttgaaggctatcacaaaatacaagtttggtaactagtactccatttcaaaaaatagatttattctcttttcttttcgaatataagttgaatgaaattacgtggtttctttgaaacgtcagaaatcagtttaaataactctttacagcgtcgatcgctctgtccagctaccatttcacaatttttatgggataatagcagcatgaccggtagacacatgcacatatcacgatgatatcatatcttttttcaacgaccaaaatgaattttggtcggtataacgtggttgcacgcatatg

SEQ ID NO: 95040 - DNA, 673 bp, Oryza sativa
  unsure (1)..(673): unsure at all n locations
tctgttttttgtttaggttntagttgaaaatgaaatttttttattcccctcttgttgtagagcatgcaaattgatgtggacaatttttttttaaaattacacagtacaatgcagacaattcactcctaagaatgcacgcacgcaaaccctagattatatattttgctaatacttgttatccttggtaattatgaagttctccttcactagttcactgtgacttttattattttggtaacctctatatccttttgggctttatctcccaccgttactcgtgatgaactataaaagttgccaaaaatatcactacttagtactccctccgtattttaatttatgacgccgttgactttataaccaacgtttgaccactcgtctgattcaaaatttttatgcaaatataaaaatacttatgtcatacttaaagaatatttgatgataaatcaagacacaataaaataaattataattacataaatatttttaataagataaaaggtcaaacgtttgtcaaaaagtcaacggcatcgtacatattttaatatggagggagtataacattgcttataaaggggccgggcacccctctcaatttggctctagcgccgcccctgcgagccgtggcaacggacgatgggctacgacaggggacgatggaggctgctcggcg

SEQ ID NO: 95041 - DNA, 1302 bp, Oryza sativa
tatacgatgcacttgttttgctagcatgaatgatagaagacgtgagaaaaatgagcgaaagcagctcctctaacaatggagaagtgttactgattatgtggagcccactttttatgggccccttgtccctctaatgtgcgttagaggagcctcatcgctgacctgtctcttcactaggagacaattgagtaaaatatagagagatatggtattaaataacctattcatctattatttgtatcattttgtatatagcaaattttaaaagtctcttgatgatagtacatacaacttaagtgaatacactggactcaattggtgttgaatgagtgaaagattctaatacattttttttactgtttaggcctacatgtatatgtggttttctgatcttccatgtttcacaaagatcatatttttgtggttgtatgctaaggatatatctcaatccggttttgttcaagaaaggaaaggaatttacgatcttgagaagacaataaattttacattagaaaatatataaggttccttataacatgtacaacaacaacaaagacgtttcttagctatacaatgcagttgttttgctaacatgaatgctagaaaaagtgagaaaaatgagcgaaagcaactcctctaaagacatacgtgtgttactgattatgtggggctcactttctatgggcccacatgtccctctgacgtgcgttagaggagcctcatcgctgagctgtctcttcactaagagacaattgagtaaaagatagagaataacctactcactctattatcattttgtatatagcaaatttttaaaagtctcttgatgatagtatagacaatttaagtgaatacagtggactcaattggtgttgcatgagtgaaagattctaataatttgttttactgtttaggcctacatgtatatgtggttttctgatcttccatgtttgataaagaccacatttttatggttgtatgctcaggagatatctcaaaccggttttgttcaagaaaggaaaggaatacaatcttgaggagacattaaattttacattagaaaagatataaggttccttataacatgtacaacaacaataaagacgtttcttagctataccatgcagttgttttgctaacatgatgatagaataagtgagaaaaatgagcgaaagcaactcctctaacaacggagaagtgttactgattatgtggggctcactttctatgggcccacatgtccctctaacatgcgttagacgagtctcatcgctgacctgtctcttcactaagtgacaattg

SEQ ID NO: 95042 - DNA, 628 bp, Oryza sativa
tcgggtcttctatgattgatctattattttttatcgtttatttgcctatcgctttctaacaggagccgccgcacactccctcgacacatcggtagccaatgctacggatgatgtgctcgcatagggcgcccctcgccgccgtaacatatgtcaatggcgtaaccaggagattttccttgggcagtactagttcacaaatgcacatcacatactacaattttctacaccgaaaatatgatatacaagtacaaaactagtgaaaatatgatattattataatgtcttaaaacatcataagtggcttacttaacaagctaaaatgacacattcactaatcaatatccctgctcctcttcatgttttaccaatcctgcaaactgcaatgacacatttacttaacaaactgctctgcgctgatcttggacgtcgaagccgccgcacgcgcactcgacgcatcggtagccggcactgctgatgatgcactcggacagggcgcccctcgccgccataatatatcaatacagtggcgtagccaggagatttccttgggtagtcatagtttacaaattcacatcatatactaaaattttctacacctaagatatcatatacaagaacaaaattagtg

SEQ ID NO: 95043 - DNA, 764 bp, Oryza sativa
tgataatgtgattacctaaagctttccttgttccgcaaaacagcaagggaaaaagcctgcagaagagacgtgcgatgcaacgactaatatactactcaatccgtttcgaaatgtttaacgccgttgattttttatcatatgtttgaccattcgtcttatttaaaaaatttaagtaattattaattcttttcctatcatttgattcattgttaaatatatttttatgtagacatataattttacatatctcataaaagttttaaaataaaacgaacggttaaatatgtgctaaaaagttaatgatgtcaaacatttcgaacatttcgaaacggagagagcgctatagtacatgatacgttgcgaactgtgtggtacagtagaaaaagaaaattaatactcgacgcaacgacacctcattcactcatccatccatccatgcatatcttttctttcgtatacacaaaaaaatcacaccaatcaaaacaggagtaccaatgttttcggtagcgtagaatatagtactatcaatttatagttattgatttgataaatattagtagcaattcaaatatctagtattcagtattgctaaatgctacagtagtagtatttgattttggcatcaaaccaaatttaacccaaaagagggataaactaagaaaatacacgtccaaaatccgaatgggcttttagctaaaacggcccaaccacagggcgcagggagagctgcacagaaattaaagcataatcacgctcatcattag

SEQ ID NO: 95044 - DNA, 700 bp, Oryza sativa
aacagtcaaagcgacaagtaatatgggacagaggcagtaataaagagagcttagatgatgttttttctcccgaagatgaagattaagtttttttacgcaaaatgaggtggtattaaagtatgattgattgagttttaactattacaaacttcaaaaatagattaatatgatattttagagcaactttcgtatagaaagttttcgcacgaaacacaccgtttaacacagtttgaaaaacgtatcataaaattttttatcttcattcaattcttgttggacaaaataacgagaccctaacaagttcaagaacttaaagccgtttcaatggacgtccaaggtttccgtggagtgatatgtacatatattcaagttgcatgtttctacttttttattattatatatgataataaataagacacatataccgcatcacattggacatttactctagtgacatttgttgaagaaaaaaacatcttaattcaggccatgcattttcttgggcatctcaatgcaaaagaggagaatgacctcaattggatgcctccaaagatatattcttacatatcacattgagaacaaaagtgaacacattgatggccacctccaaagcccccactatttcaacgttgaggtacctttcatcgaatttggataatggtgtcgcaacatgtggacacttattccattgactattgcg

SEQ ID NO: 95045 - DNA, 820 bp, Oryza sativa
agtatgaaaagaaagacaatatctagacaatcaagccgttggatgtttcatagagtggtggatatcctatataatatatgtcaacgtcactacttaacctaatcggctgccttctagtaacagatgttagccgattggaggttagataacgatattgccggagattatatgagatatatgataactcgacgaattacataaataagattagagtatcataaagatggaagcactaatcctgagaacgcaggccgccataacaagttttacctctagttgaagatcgaaaccgatgcagctcaacccgaaagcaagaactcgtcgaaacgaaacgaaagtaaaagggtggcgatgcgccgagattgtattgaacatgtgttaaattgattacatggggctcggggtctatttatacccgagattacaaaatatgcccgtgtcggacacgacttttatctctaacaaactctaagataccataagtctttgcggcagacttttgtccaaacatatctctaagggaattacatgaaatatcctaattaatagatacaattgccttctcaggactctatccatacgtggcaatcatcatgaagcacattaacccaacccaacaacgcatgccgtgtcatattgtcggattcggcttgatcggctaaccctgtccaactcggactctaccgatcctgatcgtagccgattcgaacttcagccgatccttactctgtttccgaaacgatcttggacttggattccgcttcgatctgatcttcatcttcgatactcagattaccaaatttggtcgttaacaactatg

SEQ ID NO: 95046 - DNA, 713 bp, Oryza sativa
aagtgtgtatgcacgtgcaaccgtagtagaccgtatagaacacatcatctccaactcagcagagttatcatgacatggataaactcagctcgctttggcttgcaaagggataaaatctatggccatttggtataattttgtttttggcttttccaataaatcaaatactctatccgtcctgaaatatagcaacatagtatcaaataatatcatatttgatataacttataagaatatgaaggaagtagtaattaggatatatttagtactaattagtactaaaatttttaggatggagaaagtactaatttgtactctcggttcaaaatatagcaacctatgactgggtgtgactcatcctaatacaatgaatttggacatacatacatatatatatatatatatatatatatatatatatatatccatattcgaatttggacagatatatccagattcgttgtactataatatatcacatctagtccttcgttgctatatttgggatggaggaagtaagaaattagcagactagcacaagtaatgtgtatttttttatgtattttattacaaatcttaatatagaataccttgaacatatgagccttgcaagaactaagataggtcaaccacaagtcttcatatcaattttcataactataaaaaaagtagccaaatggttacttattatcttttgagaacaaatccatgaa

SEQ ID NO: 95047 - DNA, 1905 bp, Oryza sativa
ttaaatgaaaattaccggttagatatttttcttttttctcagaattttctttaaattattagagcaccacgtggcagtttaggagcgttcgtaggagtccacgtggcggttcaagagcgttttaaggaagtttaatggacttttagtatataactaggaaggtagcccgcgcattcgcgcgggcatgtatcgtgcactgtatttgaaaatggatcatatttatcagagagcctccgccatgttttggaagtgcatttcctcagcaaatattcttcgtttcatcactttgataatttctctatgctatatactatatagtatttaattaatatgtataagcaattatatataatcttcatcatcatctaaaaaggagttagacctagtttgtttagaaaacatgtttatttaattaaaagcaaggtgttttttttctttgtttgttgaatgctatgggccctattgatgaaaatgtaagacctagctaaattcattgttccttttcccccgccatacggttttatgcagctcctagtcaccgtgttgagatgtggtcattgcacctacagaggttgccttgtgattcatcgcagttgtgatcacatttttggtggagcttagttactcatatttctatgtcttgttatatcataaaatctaaatggactccaaagttaatcatttaagtatatatatacaacaaaatatatttgcagatgattaatgtttatatatagggatgattcaccttttgaatggtctatgagcaaagaaaataaacggagttacccagaatgcttagaaggccaaaacaacacgcttgaacatatatcaatgatatactaaaagtgcattaagcaccatctaaagtcaattagatggtaacatagtttaaagcaaatacacggaagatcatttagcttgcttggattattttagcacatattttttaaaaaaatcatgaagtaatcggattttctctaactaaagccattggattttctatgcattggtggtttggacttcatattttagttagttgtatttgctgagacaatgtatatctaatttagctatgcatgtttgacaaacaacatatgatgatgcaacctgtattggattatttcgtaattcttttacagcaattcaaatcacacgtaaaagggcagggtgttctcccttaataaaaaaaatgtttcatagttcactttgtaatttttgtttggataactattgatttaatttagctatacatgtttgcagaatgatgtatagtgatgtaatatgtgcagccaacttgtttaaggtatttgaatcatatttggatggtatgcaaagcacatgggctgaatgtgtgttgatgtgaaaaacacacactggcctaggagatctgcttaactccagtgcagatcctaaatcttacttctgggttcgtcgtcaacaatgtggtcgaatgccatattttgtatataggaaaatataaggatacggatcttaaattcctagtttaattataaatagagcaataattatattagaaatcagacatgtagcttaaaaactatggttgttttaacatattgattatttctcttttagtttactcctacccaaaaatagggatgggattggcagtggtctgcgcgcatgtgaagggggcgaggaggtagatgcgatttatttttataacttctccaaataatgtaacttaaaaccaatgatgataggtttaattttttctcaaaatttttaagattatttatgattttcaggacatgacacgtggcagcgtaagatttttcgtaaattaaatctaatggttgaaaataatgggtccatcgatttaaatgaaatattttataattttaaaatgtgacatatggtgacttaagtgtgctctaaagg

SEQ ID NO: 95048 - DNA, 739 bp, Oryza sativa
atgcggaagagataaaaccagatgaattaagagataaccaacaaaccaattgattttatctctataacaaacttgatttagttagttacttcgcgcgagcgctggtgaggcgcttatcaccagaccgtggcccagcagcagagaaacaaagcaaattacaaatcagatatttgacgccaggagaagctaagagataaaatcaaataaggatatgaacaaataacaaactgatcgatcaagccttatctgcaacgaacttgacgcggaggaaacggcgcgcggacgcggcgagcaccgaccccagacccctatataaggcgtcgacccctcggcagccaggggcattcacgaactcatccacacattcattcaccaacgcatctagcatccacaagccacccatcatcaacgcatctacccatccagcatcaacacatccatccatcaactctcatcggcgatccatccatcaactctcatcggcgatccatccatcgacgacacgcaccggcggcggcgagctacttcggccggagtcccggcgtccggcaggagagggcgtgcgcggtgatccgatcatcagcaagcgcaggagaggagcttgatggctagtccaggtaaaagctagcaagattgtttcgttttctttcatctaaacagcacgcacacatctatgcatagggatccatctgcacgtatcgtcgtcgccggggaagtcgcggtggccgattcatctacg

SEQ ID NO: 95049 - DNA, 654 bp, Oryza sativa
gaagctggtagtgtgggtgatatacctgatgctatatagttatataggggtcgacctatgttttgtttcagaagtttggttagatggagtccgcttagatggttttgaaacttatgaactcttttgaggtgtaatcaggggatgttgctaacttgggggaagctggcttatgagtctcttaggctttctcaacttgttgtcaattatgttggaattcaggtggatgatatacctgatgctatatagttatataggggtcgacctgtattttgtttcagaagttcggttagatgaagtcttcttagatggttttgaacttatgaactcttttaaggtctaatcaggggacgttgctaacttttggggaagctcaatgcttatgagtctctcaggctttctcaacttgtcaattatgttggaattcaggtggttttccttctgattataactgaatgaaagtcacaaaggatgtttaatgtttgttaagattttactatctctttggtttgttggttcggatccagatcctccgacattacggagtaatgtcacagtgtgacattccttccatccggcacgttcattctaaagcaacggctgtggattatttagtctataataaataaaattaatcagcagattatttcttaaata

SEQ ID NO: 95050 - DNA, 1111 bp, Oryza sativa
tcctaatttctacctctaacaaccatacattataaaaattaattatacattaaacttcctacaaacgcttttaaaccgccacgtagcgctcctacaaacgctcctatatcgccacgtggtaggtggacctaatattttataaaccattaaattatactaattttcaccattacatcttatctccaagaaagaaaatatgtacacgctccactttctgttcgcatattcatcacgtaatatatttgaaaagaaaaatagaacgtgcacatatatgtacgtactctccctccctccctgtctgaccctcttcccttccgtctcttctctctcctaatttctacctctaacaaccatacattataaaaattaattatatattaaacttcctacaaacgcttttaaaccgccacgtagcgctcctacaaacgctcctatatcgccacgtggtaggtggacctaatattttataaaccattaaattatactaattttcaccattacatcttatctccaagaaagaaaatatgtacacgctccactttccgttcgcatattcatcacgtaatatatttgaaaagaaaaatagaacgtgcacatatatgtacgtactctccctccctccctctctgacctccacccttccgtctcttctctctcctattttctacctctaacaaccatacatagtataaaaattaattagttagctaaataatctattagtacatatgtttttatataaaaattataatatatatacccttaattttcggtgacaaacccagaaaaaaatattgggacatcacttggatatataccctttcttttcaatgtcaaaccaagaaaaatattattatgacactgcacatataaattatttaattattaattgatattattaattaatatggcatgaattagttaaaatcgaataatctaccttgaaggtgaatgtagttacgccactatatattttgtatagcaaccaaatagcaataagatattatagaaatgaacatatattttgacatctggaaccattcgacaaacatgaaccatgaataaattttcatataaaagaataatttatctagcggccacaaagaaacat

SEQ ID NO: 95051 - DNA, 1538 bp, Oryza sativa
  unsure (1)..(1538): unsure at all n locations
gtgagagaatagagaagaaaggaaaatgtggactgattgctagatgtacattagtaggctacacagaacaccaacctgagcatagtgacccaattctgtagtccaagtatagtcttgataaattatctagcacatcacaactggagtttcggaacaataaaaaggttacaaatttgtaagcacatttgtatttgtaaattattgtatttctattagtatagtttaattaaatctcgacgcatttgacggaatacaacaagggaactagacgcgtagtctggtcagttgggagcgccagctatttttgatttaactacgagaattcaggcaagcgaacctttgatcttgatgatttgcactattttgcatacacattggtttgcttcatgaaactgtcaccttgcataaaatagatttaccaaactataagtcggatatataaggatgatgatagatactgggaggggcagttgatggagaaactgatcaccttcggaccttccaacacttattagggtgtccacagatggggattgactggaaacgggaccctttacatatggctataatataaggactaaaatcactctcacatgcatatgtgtgctgtataaaaatcatgtcaaccatatccttgttgcaaggcgagcaacgctttgtatcttatcaagttcttacactccgcatggtgtgtaatgatagatagtgctaagatgggagaccctataaaccccatagaacattagtacttggatgggagatgatataaaccccatcaagatagtagcacgtggtggagtggagtgtaatgtgctgaaataagagaagagcatctagctatctattagtccattaaatnttctataaacgcttctaaaccgccacgtggcgctcctacaaatgttcttatatcgccacgtggcaggtggacccaatattttataaatcattaaattatactaattttcaccactacatcttatctccaagaatgaaaatctgtacacgctccactttccgttcgcatatttatcacgtaatatatttgaaaagaaaaatagaacgtgcacatatatgtacgtactctccctccctccctctctgacctccacccttccgtctcttctctctcctattttctacctctaacaaccatacatagtataaaaattaattaggtagctaaataatctattagtacatatgtttttatataaaaattataatatatatacccttaattttcggtgacaaacccagaaaaaaatattgggacatcacttggatatataccctttcttttcaatgtcaaaccaagaaaaatattattatgacactgcacatataaattatttaattattaattgatattattaattaatatggcatgaattagttaaaatcgaataatctaccttgaaggtgaatgtagttacgccactatatattttgtatagcaaccaaatagcaataagatattatagaaatgaacatatattttgacatctggaaccattcgacaaacatgaaccatgaat

SEQ ID NO: 95052 - DNA, 701 bp, Oryza sativa
gcgccattttaaataggggaaatcacacattctacttgcagagagcacatcaacctcaaaatatcccatcttaataacctcctatccaaatgctgcaagtctttcaccacagagaagttacctgggaactcggcagaggcaaaggctggggagaaccattgggacggcgagggccggaggccgcgggagaaggcggcagaatgtcgagggtgtggagccgagggtggggattggaggtagcgtgggagaggcatctgaattgacctgatcaactgcagagcaggaaactcacgttcgctggactgaacaattgtgtggggtctcaacggaagaagcaaaccgaaaaatcaatctgcatccacacactgcaaatttgtatcgtcatcaaacaaaacggtgctccaaataactatcaatctatattagatgaatgcacactaccatgctcggcaatcgcatttcttggatttttctcatcattgattcattgggcaacaaaatatcaagtcttaatctccctaaaaaaatatatccaatcttgaagcaagtaaaacatctgtgagttaaaagcatgtgaacaacgcaagcagaggaaaaaaaaagatgatatcaaaatagaaaagtttggttatagtaagcttaagagcatgtatagatctgagacaactatagtctctcgtgcactatagacgataccgaaa

SEQ ID NO: 95053 - DNA, 1574 bp, Oryza sativa
cctaccttacggccgggttagtcgacgcgcttgacaccaacatcgtataagttatcctccctaatgtcatatgtgccatccatatactgaccacctcgttgaaaacagtttgtgaccctcagatattcgacgtttcgccgaaacaaccgttgtttcgtggcatatggtaagtaatttctagaaaaatctctggggtccaactctccaaatccagtctctctagggtggggcccgtgattctgcagccatcataaaaaacctagctcgattccatgaccgaaaggcaaagttatcaaggtttaatttgcacagaattctccatctgcattccacagtgtcgcgcccgccagcctaccttaacggcgcggttagtcgacgcgcttgacaccgacatcgtctaagctatccaccctaacgtcctatgtgccatccctatactaaccacctcgttgaaaaccagttgtggaccctcagatattcgatgtttcgccgaaacaaccgctgcttcgtggcctatggtaagtaatttctagaaaaatctctgggggtccaactctccaaatccagtctctctagggtgaggcccgtgattctgcagccgtcaaaaaaaacctagctcgattccatgaccggaaggcaaagttatcaaggttttaatttgcacagaattctccatctgcattccacagtgtcgcgcccgccagcctaccttaacggcgcggttagtcgacgcgcttgacaccgacatcgtctaagctatccaccctaacgtcctatgtgccatccctatactaaccacctcgttgaaaaccagttgtggaccctcagatattcgacgtttcgccgaaacaaccgctgcttcgtggcctatggtaagtaatttctagaaaaatctctgggggtccaactctcaaaatccagtctctctagggtgaggcccgtgattctgcagccgtcaaaaaaaaacctagctcgattccatgaccggaaggcaaagttatcaaggttttaatttgcacagaattctccatctgcattccacagtgtcgcgcccgccagcctaccttaacggcgcggttagtcgacgcgcttgacaccgacatcgtctaagctatccaccctaacgtcctatgtgccatctctatactaaccacctcgttgaaaaccagttgtggaccctcagatattcgacgtttcgccgaataaaccgctgcttcctggcctatggtaagtaatttctagaaaaatctctgggggtccaactctcaaaatctagtctctcttgggtgaggcccgtgattctgcagccgtcaaaaaaaacctagctcgattacatgaccggaaggcaaagttatcaaaggttttaatttgcacagaattcttcatctgcatttcacaatggtgcgcccgctagccttacttaacggggcggtttggtcacagcgcttgacaccgacatttgtttaagctattcaaccctaaacggctatgtggccatccctatacttaccctccttctttgaaaacccaatttgtggacccctaaaatattccacgtttctggcgaaaattat

SEQ ID NO: 95054 - DNA, 1849 bp, Oryza sativa
  unsure (1)..(1849): unsure at all n locations
gtatagggatggcacatagnacgttagggtggatagcttagacgatgtcggtgtcaagcgcgtcgactaaccgcgccgttaaggtaggctggcgggtgcgaaactgtggaacgcagatggagaattctgtgcaaattaaaaccttgataactttgccttccggtcatggaatcgagctaggtttttttttacggctgcagaatcacgggcctcaccatagagagactggatttggagagttggaccccagagatttttctagaaatgacttaccattggccacgaagcagcggttgtttcggcgaaacgtcgaatatctgaaggtccacaactggttttcaacgaggtggttagtatagggatggcacataggatgttagggtggattgcttagacgatgtcggtgttaagcgcatcgactaaccgcgccgttaagttaggctggcgggcgcgacagtatggaatgcagatggagaattctgtgcaaattaaaaccttgataactttgccttctggtcatggaatcgagctaggttttttttgacggcttcagaaccacgggcctgacagaagagagactggatttggagagttggacccccagagatttttctagaaattacttaccattggccacgaagcagcggttgtttcggcgaaacgtcgaatatctgagggtccacaactggttctcaacgaggtggttagtatagggatggcacataggacgttagggtgtataggatcgacgatgtcggtgtcaagcgcgtcgactaaccgcgccgttaagttaagctggcgggcgcgacactgtggaatgcagatggagaattctgtgcaaattaaaaccttgataactttgccttccggtcatggaatcgagctaggtttttttttacggctgcagaatcacgggcctcaccatagagagactggatttggagagttggacccccagagatttttaaaaaacattttcccgaacgctagtgtattaatccccgtcccaggaaaagccggggtacaccacacaaacatgatacaaaaggcacatctttattatatcgataatatttacattattacaaaggcacttaaggcctgacaatcaaaaataaacagcagcggactagcgggcatacggttccatcttacaggcgctcaactggggtataagccacgactccacctaagacttcttctccaaagcttctcttactgaaggggggggggaaagattgagcaagaatgagtacaaccacagtactcagcaagccacaccggtggatgcatgattaatgcaagggggtacaaggggtaataatataggggttaagttttgtagaaaacagcatttaaaagtcacttagttgcccaaagccattttataaagacgatcctagagttacacagtgttattaatcaaggccgtgaaccctcacgaacctgccttaacccaaggcctacgatgattcagaccgaactggcaacccgaccctgggtcccagctcgtcccaagccaacccaggccaaccattccacattttagttgttaagcaaattttaagaactaaaacactaacttgggtacattgctaggcttgcccataaccgagggcgcggctattcgaatagattatactctgatcagaggtgtacatctttacccaaaagacacatctttctcacgtgtaaccacgtgccacataccaccacggtataccgacggaagacgtgacatagttcccaacccatcctagccataaacaagagtaccgacccaaccccacctaccggcggaaacccccggacaagcaggcaagattgaacccctaacaacaagaaacat

SEQ ID NO: 95055 - DNA, 1592 bp, Oryza sativa
acggagtgatttttcgacacggaatcacccaacaaactccaatatgtccaaaaatcatgttttggtgctttttgaagtttttcattccggtgaaaaacattgcacccacgtgtgccaatatatatcaatattggcattaattgacaaaagttcgccgcgcgagtcacgaaatgatttttcgacgcggacacacccaatacactccaatatgtccaaaaatcatgttttggtgctttttgaaggttttctttatggggaaaaacatcgcactcatgtgtgccaacataggccaatattggcattaattgacaaaagttcgttgcgcgaatcacggagtgaattttagacacggacgcacccagtacactccaatatttccaaaaatcttgttttggtgcttcctgaacttttttattccggtgaaaaacatcgcacccacttgtggcaatattggccaatattggcattaattgacaaaacttcgccacgcgaaacacgaagttattttttgccaagaacgcacccaatacactccaatatgcaaaaatcatgttttggtcctttttgaagtttttcattccggtaaaaaacatcgcacccacgtgtgccagtataggccaatattggcattaattgacaaaagtttgccacgcgagtcacagagtgatttttcgacacagacgcacccaattctctacagtatgtccaaaaacatgtttgtgtgctttctgaactttttcattccggtgaaaaacatcgcagccacgtgtgttaatatatgccaatattggcattatttgacaaaaagttcgtcgcgcgagtcacggagtgatttttcgacacgaactcacccaacatactccaataagtccaaaaatcatgttttggtgctttttgaagtttttcattccggtgaaaaacatcgcacccacatgtaccaatacgggccaatattggcattaattgacaaaacttcgcgcgcgagtcacagagtgatttttcgacacagactcaccaaacagactccaatatgtcaaaaaatcaagttttggtgctttttgaagtttttcattctggtgaaaaacattacacccacgtgtgccaatatatatctatattggcattaatttgcaaaagttcgtcgcgcgagtcacggaatgatttttcgacacgaacgcacccaactctctacagtatgtccaaaaacatgtttgtgtgctttctgaacttttccattgcggtgaaaaacatcgcacccacgtgtgccaatataggccaatattggtattaattgacaaaagttcgtcacgcgagtcacggagtgattttttgacacgaactcacccaacatacttcaataagtccaaaaatcatgttttggtgctttctgaagtttttcattccggtgaaaaacatcgcacctacgtgtgccaatataggccaatattggcattaattgacaaaacttcgccgcggaatcacgaagttattttttgccacgaacgcacccaatacactccaatatgcaaaaatcatgttttgatgctttttgaagttttttatttcggtaaaaaacatcgcacccacgtgtg

SEQ ID NO: 95056 - DNA, 1679 bp, Oryza sativa
aaaagattttgaacaaataagacccttttctagaaaatacaatatatactctatgtctagatccatagtctgaaaagtatctcatcggttcaaaattacttaatattttattttagtacgaatgaagtagtaattgtgatgcaccagagccacccggaatttctggctatctatgacaaagctgacctttgcaaatttgcaaattgcaattcaaacccattaatgcatggttcacgataactgcaaagttgactactgaactcacggtgaaaattggcaattttttaattcatggctgaattagtgccagattgccacttagagtgataaatagttaaatatctcacaacccctctcacaacaacctggacggtgtcgctgatggcgtattgagctagctagctagtagcttagttgtcgaataccttaagggcaactaggaatggtatatatagagaagtttaattactataataatatacatagaaaagttattttagtatgataatgcatctaagaattaaagtcaggttttgatgtctgctaattgcttgcggtcctcttatttggaaagattggcatttaacacattttttcaaattaatactatatctttgtttttaaaatagactgggaaattgacctgtggtataacgttgaccatttattttattcaaaatttgatttcaaaaactttaaaaaatatataattcatgcttaatattcttttagtaataaaacaattgataataaaataaaatatgattatataattctttttaataagacgaataaccagacacgtcaatattatgctaaaatttaacggaatcatctgttagaataatctatttggagtgttgtgtagagaggatcctatcctgcgagagtgaccgacgcgacgctgggtcattgatttggacggctctccaacctgcaacgcaggcgctatttcagctagaaaattgaattgccaattttcgcagtgagttcaattgtcaactttgcagttgttatcagctatctcggggaattagtatattgctgtgcttaccatgcatacacgtgttgcaatgaacacaaaaaaaatgtcagcggtatcaaggtttcaagttcatatattgttgtgtttcccaaacacacgcaacatctgattaagctctaatatctggtatagtcaaagaagaaaatatcattacttgaattaatcagtactacgtcttactactatttatgtagggggtgcatctacgaccccttctattattggtggtattataatggtacaaatatatatctactagttgatttttatgtgctttaaaaatattttatttaggattttactaggaataaattggtattgttaatctgtcagaggtgaccgtgcgttgcaacaggaaaaataaaaaattatgacaaacattggacgagtagacaaggtgtttaatttattcagatagataagacagttaatttattcaaaacagtctatttctattatagctctaacatcaattaagttcttttgtaaagaaaataaaacttaactttgtgtaaattaataaaccaatccttgccatccacaatgcattacccccatttgaagttgtagacttgtagttgtgcctcagtaggagcagattaagttttctttttagcaatatatttcttgagaa

SEQ ID NO: 95057 - DNA, 663 bp, Oryza sativa
tgagggtagctagctcagattctttactggacaattatgtaatgtattgctctctcgtttccttcttgattaatgatcaatcagttcatctcctctcttgaaatcggcctgtgctctcctgatgctccatgccattgttgaaggcgaacattcaggccctgccgccgccgctgccgaagctctccaccgccgacgaacggtcgatctgcaggcacgccggcgagtcaggtttcagagtagactgttcatttcacttcctacaagtgtttgtgttcatcgtgcagatgcagaatcactgattcatcactcaccagagttctcaaggagattctttttctcatttgcaaaggtcatattcaaagaagcctccatatatgctggtgtgtgtacagtcctggtctcaagtctcaacgatgatctgcacaaataaaaaaaggatgaacaatgttagacaattatactgtcacttttcacatttcagatatcttccttcttttatcagtgtttactgtcaaaggttagattgctacaaataacaccatttcacttttatcagtgcaatggaaatagggagttctcaagcatcaagaaaccggcgtgccatattagctacagtttctgtataaaaacgcatgaatactttgttgaggtaaaacgtaaaag

SEQ ID NO: 95058 - DNA, 2047 bp, Oryza sativa
aaaaaaatatttagtttacaacatatatagatttgtctttatggtaaatgttatataaaaatatagtcaaagatatattttaaagaacatgttctaatttaaacgttaataattatatgaaaccagaaagatatgataaagatatgatgtatatagattggtatgaagaaaattacttcgggtcgctgtatcaggatgcttacgagatggcaggcctagacatgatgagtttgggccttggacatgggctcactatgggagagtaatctttttccatgtggatccataccttctaaccgttaatgttcgataggagagaagcgttatgccatcgtaaaaaaatatcgtatgtatagcagtgttgatttggctttcactaagaacaacataacaattttgtttagtttttggaaaccaaaatgtggagaataatccaattgtttggtttaagtttcaaataaataaatttggtcacgccaaattcggtatattttggattacccatcaatgttttattgaagaaaaaggaaaatctttttggcccaatagcaatatttgtttttcaataccattaaagcaaaagtgtggggtaaggttggcaaggttttgataggaatttaataattgggcgcttaaacacctttttagttttgcccattggaaattaaaaatgttagcttgccaaggactttactttgatcgtagaaagaaatccagttccctccttgggcactactagcagtagtttttccaattcgaagtaatactgattttctttttttaccatatccatgttttctaaaaacgtagtgtcccatatcaacgtatcgtatggtgtcggatgatgctccttacaagtcatgtgactttgttaccaacatgtgagcttggtgatccatgaactcacatatcagtgacaaaggcacacttactttgtaggtagattatttcaatccatcaataacctctcatatctaacaaagtggagaaccaaagtaaaactagaggaatataaaaataaaaggaaattgctatgcatacaacccagctgtctgactcaccgtacgacttaatttaattaacggttacaaacggctgcattgcaaaaaaagacatactattcatcgtaattgatccatggtcgtatatatctttactggacgctcattcggattggtcgcccgatcgaatttgagaaaaatcgggcgctgacatcagtccctgatttatgtgcaaaaactactttaaactgttttttctcttaaattacttatccaaatcatgatccgattgcaccattaatttcgttgtaattaaatcttcaaaacaagaccacacatggatatattccgacgaaaaaaatagcttattattgaattatttttaaatgttgcatgatatattggaattgttttactaagtagattgaaaatgtttcactcgtttaaatcgggtgttgtttcactttatataaaaataatgtttcagcaaatagcgaaagaatgtttcatttcactgtaacattagatctatatatagtgaaacattgtgagtacactaggtgaaacatttttcggtggaacaaaaaataaaccaaattcccttaatagggggtttccaaaatatgtggatttttcgttgcaatagaatatttcgttcactgcaacattagatctatatatagtgaaacattgtaagtacactaggtgaaacattttcgatggaacaaaaaataaactaaattcccttaacagagagtttctaaaatatgtgggtttttttgttgcaaaagaatattttaattcaatgcaacattagatctatacacactaaaattatgaatacactaggtgaaacattttttttgaaaaaatgggagggagaagtggatgggcccacgaggtggtcacgtagggggagggcgcgggcagggggagcgcccgatccgacacccccgcgccggtcacccggggtgaatcattttcgatctttacttgtacgtctagttgttaataagttgtacgagtagatagttacacaaaccgag

SEQ ID NO: 95059 - DNA, 3426 bp, Oryza sativa
agtcctccacgtggtggtggtggccaaggacattggcggtggccaagggtggtggcggcaacagtggtggtggtggaggtggccctctctctgcattcgtcttcccccttctcctcctccagatctgccagccgacagcagtggcgatggtggtggaggtggcccttcttctgcatccgcctccccccttctcctccaaatccagtgacggtggtggagaaagctggcgcagagagtgaggtggcagccggaagcctaaaaggaggtggtggtggaggccgtcacactcctccccccctcgccaagcacttcgttgttggctccattgggccttttttttattatctcattgaatactatacatgttggttgtggggtaagaactaatacctataatttctgtatgtactggtttcagaactcctaggtatagatgccaataaattagtgtcggcttgaaaactgacacttactggcttttaaccagtacctatgttggtttctgtcgtagtggcggccatgccctcgatcttgtggaggagtctcgtgctcgccggccactgtgctggtggaagatcgagcagagaaaagcagcaaagcagcactgaattcctccttgcgtgacgccattagcgccatagttgcaaaataacccacgcagccgttgcaaagattaacccgtgctgagctcccccccccccccaaaaaaaaaaaaaatctttctcttgagcttgttggtgctagcatctgaatggagcctcgctgaagaatgagccggtggaactcattggtgcaggcagagctcaagctagtgctcgggtccgttgtgctgcacggctcatcgtacgctctggaatctggatgcctcgcacagggcagacagagagggagcgaagagaagcagaaggaaagaggaagaagaaggccctgaaaagctggctctccattactttatttttttttctaaccaggcataccaagtagacgaaaaccacgcaaatgctttgcgccgagcgtccgatgcaagaagctatcgtcggacgcgcgcggcttcgttacatatctacatagatatatgtttgatgatgtcacagtatacaacatgcaaagaaatagctacaaacttgattttcaaacaacattttctcccgtactatttattcgatttacgatttgattgcaccgttatattcgttacaattaaatctctataacaagatctcacatgatcatattccgatgaaatatatatatatatatatatatatatatatatatatatatatatatgtttcaatcgttataattatatgtttcacgtatgagaaataaatgttccaattaggatttcactttgttgcaatttttaaattttctattgcaaccgatctttatttaatgtcaccgatagtattgttaagatgtttcaacatgtatttttcaatgtttcactattgcattcataaatattacctacaatgcatttgtcgagacatgcaagaaacacctcgtgcaacattcacaaatgaaataatgaaacatcacaaaatacctatttgaaacatcctgtgtgtgcaacactaaaaaacaccattgttaaaaagacatgaaaaatatacaacattgtcgagttccagctgaaacatttgttactcattcatgaaacattgaattataatgctggaaacatatatttttttaatcaaaatataatcatttgagatgttattgtaaagatttaattataaagatttaattataataaatgacatgaaaagtaagtcacctaaaaggtttctaaatgctaatataatactaatcaatacatgttagacttgttacaggatttgctgcatatagtgcacacgctgacacgcatgttgcatgctacagagttacaatcacaggcgcacggcaggatggcatgcatatgtcagcactcagcagcaagcaaaccaggcatccgatattaggaaaaatatcggacgtccgatgcggagtcgcctcccgaaaaccactctaatttggtaaaaactatcttagaagtgtaaattaaactgtattgatagttgagagcgtacgatatcaggttttaaatttaaagggtgtgatttagacaaacgtgatagtttgggatgtaaaatgggcttatcccttatcgctcaccttcaagagtcttgatgacattacgattcattctcatttagaaccctagctactttccaccccaaaatcttccttggtgccaccgcgcatcccctcctttcctcctcctccgaccactgtgcctcccctcctcctcggccaccgcacctcccctcctccttttctggccaccgcatctcccctcatcctccaaagctctggtggcgtggattgatgtttggttttgcaaatcgagcttggtagcgtgaatcgatctccgagggcgctagtcagacgctagcggatgatcgagctcgggtggtgtgaatcgatctccggccatgcaaatcgagcaccggtggtggatctagaccaagcggtgtggcaggtcgatcatgggcggagcagagaagtggacgatggcgagctcctctgcgcggcggtgtagtttgggggacggcgagctccctcccaggtctccatgatgagctccctcaccggccaccaagatgagctccctctcttccctctctccctttccttgcagtgcgggtcacaaactataggctagaactgacgaatcctagcacatcccaacgaggaacttgtgcccaaactaggatccgcgtacttcgcagagtaacgagggacgcagacgtggcatagaatctttgacatagctcgttgggggtagaatgacacctaatcacactgtgaaaagccctaacaagtgaaatatcacttgtccttataaacaccgtgctgttacggtggagttgtggatagatgtcttcactcactaagttcaaatcctgatgcttaaacatattatgcacacaaaggtgagctttaactaaaattttagcgagttgaaagatgtgccgctagactccatttctttaagtttatgtgagaagacaaatttgtgagtgtatacgtacgatgctacgtgtgtaatagtgtgtgtgcatgtgcgtatgacatgtaagtggaagaaactttacttgtccttggagtgccctgttattctttgtccttccccattcctcacctcaaacttaaacatccgcacggtcaccaaaaggacaacacgggaggaaaatgactgaatcccaaatcttgcttccctatgtttaaattgtagttttaaatttattgccaacaaatcttgcttaccgatataacctattatctccattttgaaatataaatgcttctaacatttaaaattagtactagatataaacacctctagcactattaggagtggggctgcaggaa

SEQ ID NO: 95060 - DNA, 852 bp, Oryza sativa
aggtttgaaatttcagttgaacatgtcattttcaaatttttattgttgattcgttgcttgaatatcctttatatgataataaatatctaaatattaatagtcttttccatcagtatcatatttcatttatggagtgatgtacttatatcatctaaatagtaacctggaacacatcacatatgttattgtgctatgagaagaaaaataacatgcattattgtagcttgacatgtgcaatatagtgaccactaatttgcacaaaggtttgaaatttaaaagttgaacatgtcattttcaaatttttattgttgatccattgcttgaatatccttttatatgataatcaatatctaaatattaatagtcttttccatcagtatcatgtttcatttatggagtgatgtacttatatcttctaaatagtaacctggaacacaccacacatgttattgtggtctaagaagaaaaacaacaggcattattgcagcttgacatgtgcaatatattgaccactaatttgtacaaaggtttgaaattttgaacatgtctttttcaaattcctattgttgatccttgaatatccttttatatgataatcaatatataaatattaattgtcttttcgactagtaccatgtttcatatatggagtgcggtacttatatattctaaatagcaccctggaacatagcgtggtcgttactgtggtacgagaagaaatatatcgggcattattgtggcttgactttggggcaatattgcggctattaatttgcacaaaagtttgaaatttcaaagttgaacatgtagttttcaaattattattattattgattctttgcttgaatatca

SEQ ID NO: 95061 - DNA, 3162 bp, Oryza sativa
ataaaaagactattgtgtctctcattaaataaggacctccattcctaaatacttataaatattactttctaccctatttagtggatccaaaataaaattaaagggatgactcatcttcttcctcctttagcccctcctattctccctccctttctcccttcattctatcattttatcaatatcgatctaacacccacgccagatcccctgcgagtagaataaaagatattgcgcacctctcattaaataaggctagatggtttgggaaacagagagagtggttggtgatagaaatacactagctagtagtagtactcatctaaaaatgcttttcatatttacgtacaaaatttaaatcctacaaatgtatatttggaaactgatgcaacaaaaaattgtgacttgtgagtatatatgaactatagggccgtaaaattgtagctttatattacacaatcctttaattgggacagtattatactactccagaaaaaataacttaaatgattaactaaacgtgacacgtttaaaattaccagaaaaaataattatcagatctgacacatgcagttagcaccacaacagtaggagtattaatttggttagattaactcaattagttaatgcgtgcgtgatccttacttaaatgcggttgctcccctggttggtcaaagagtctgcagcagcagcacatacagctagcaatggtcggtgcagaaaagtaaaatctggtttatagtcaatcaatttgcacggttaattaatcatctactactagcatctctgaacattttagtcagaaacagcgaggcaaatgtacatgtactacgtgcaagctagctagggtggcagaaggactgaaaaaataattttaacagcaacacattctcttttctttgggggtccaaccataatataacgtgtgtgtgtgttttcagttaaatattgctttccaatccaatggtccagatctgtcgttctatgatgtctattggaggctttactcattacacacatgtatatatttaagttcactgaattttgctattgatcaagtcaaaatattacatatcctgcatccaaaaaagctagcccaagtgcggatttagggctcggtgagacaccgaatggttacccgggctcgcagggcccaaacattgaatatatatatatatatatatatatatatatatatatatatatatatatatatatatgggggcaccatggtgcccgggcaacatggtatcaaatacacaaaatcattcaaatttttcaaaattttcaaattctgagtatatacctagttataataactcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttgaactagttagtaaagtagctaatgttaatatctaagtaattgaaaaaatttcatactcatttgaattaggtatatactcaatttcaacaatggtgcccgggcaccatggagcaccaaacaaatttactatatatatatatatatatatatatatatatatatatatatatatatatatatatatatatatatatatatatatcccaaattaaatgtttatttaattagaccgggcttcgtccaagaccaaattaatattcctcgtatatgaagggacatttataactggaaattaagggaaattataattccatggccatggaaatctggaaaagccagcactattccatgttatttttgcgaaattataattcctaacggttagcttaattataaatgtgtggtggtttagcttgcttgcacgcatgtgcccacaatagttaggagtttatatatgttaacaataaaatgcagggccagccatgcatggtcaatcagcattcatgagccatatatatatactattaagtttggtatacaactttttgttgttattaatataccaaatatttttggaggtcacacacacattaattaattcgcgtgtgcactgaggttaatggagctagctgtcatggtaattaattaagagattttccattgtttgtgccagatagatagccgtccggctctccatctggaagattagcgtagctagctcacagtggcctccctcccaacactacacgttagcatctctgatgctgctaaatatatgcttagtgtcattgttggtgatcaatggtgagacagtgatcaacatctatatgtaggagtgtgtgtgtgtgtgcgtgtgtctctatatatatatatatatatatatatatatatatatatatatatatatatatatatatatatatatatatagagagagagagagagacagagagagagagagagagagagtacagctggggatgaaagaaagctaatcaattaagcaagctaggatgattatgatatatcataggtgctacatacaactatgccaaatggatggttattaattgacacttgatgccaattttcttgtgaattcacgcaattgttggagtgcccacacaattgtatgggtggacattactaaaacatacccatcagatggcgttatatgattttgtagtttcaatggatgggtggttttcatcgcgatttaacccttaatttattgtcatatgggcgaatggtgtccagtcagtttcttttcacaaaattggcatcttaacttacgaagtgaactatataaataggatattaaatcaatatctatatatcatttcaaaagaagataatggttgtcaccctagcaattaactctaatgtatagagcattgtattaccaactgctttattaatactacaaaatagtcctcctacatacgatttatttcaagcaattaatattaacacacatgtataatttattttaatctatagcgaaacacgagtattaactagtggcttaagaagccaaaagggaattgaggaagacataaattaatgcagcagagtaaacattaattgacatcagagtatttaaatatttttcttgagtacctaaagtgcaccaatttcattgaatatgacatgagaaaaaactgctaaaaacggaactttacaaggaaaa

SEQ ID NO: 95062 - DNA, 1243 bp, Oryza sativa
tctcgtgcgcgccgccgctgtccctccccctcggtcgacgcgccgccgagagcatcgccgggaccagccggtgtcgcgccgcccggcgcttgcagccgtcgccgcgccgccgggagctgccgtcgctgcgccatcgggagccgccgtcgccgatttgtgtttaattgctcaagcactgatttgatgtgtttctttaaccggggacggagtaaccacgggaaaaaattcaccgcgtggtgatcgggactggtgaaaatatagccccattgtggttgacggaggcggggacggtgaaattttatcaccgcggtgacggggacgccgaggtgacccccgacggtgaattcaccggtaccatctctactctcactgctagtacaaaatacaacacgacgcatgaatcgcggaaccgatcggacggcggatgcgctaggtgccgttgcactgtacctaggtctagaaagcgagaccggggagagaagctgccgccgccgccgccgccgccgcgctcatgctcgaggaggaacaggttgctaacgggcgacgacgacgacctgaacgccgtcgaacgtacgcggcggcggcatttgctcgatcgagttaagagagacatcagtggagactggagagagacccggtcgcatacgtcatacgtctatgcttcctttttgaatgggctcatttgagaatcgaagcccatttctgtactcgacaatgttgggccaactatcttccggcctatgtggtataagttcactttaggtccctctatttgtcggtcagtccgattttcgtcccttcaccacgaaaccggtacgacccatcccccaacttgtgaaaccgggcaaacgaggtccctcggcagtatggagggtggtttttgccgacgtggcatctacatggcgcctacgtggttcctttcactagttcttcgttccacgtggcaatgacgtggcgtttacgtggcaattttatctccaaaaaataataaaaatagtgggacccatatgtcagctacataaaaagtaatttaaaaaggtggggcccatgtggtcccacatgtcaccctccctcttctctctatcccccctctctcccccctatacactgccaggagagaaggttgagcggcggcaccgagggggcgacggagcaaagcggcgcggcggctggcagtggacggagcgatggtgggcggctggcggtgggcagcgggaggaagcggagctgagcagcggcgggg

SEQ ID NO: 95063 - DNA, 807 bp, Oryza sativa
ccccggggcggcaaacgcgtgccccggcctttgccgcatgtcctggcagagacgggcggtggcgacagatcgacaatgacggtggactgtcggctgcgactgtttgaagggagggtggtgcggtgccagctgatggcccctgtgcgcccgcgcttcccatcccgccttcctggaccgaaagcggcggtgggttgaaaccgagattgtatcggcccactgcccagttatcttcatttatccaaaatttacattctagctcctgatctttggtcaaattactttccgcaaataatcagagactatacatttgctttcagcaccatgtaactctctgttattataaatatgagtttgttttagcattctatgcatttccatgtcctttatttttacacacgctttatttttttatgaatttacataaaatggcataaatatgccatgatttatcaaaaattttggctatcacaatgtaggtgagatagcaaccaaagagtttgatatcctcgctcttgatagttccaatgtccctgcttgggcaatggatgtcaaagttaatctaacaaccaatggactatacaaatgtataaataaaacagctgaagggaacgttgccccctctaacatgtctaaatacactgccttgaaagttatgaggaatcatatccatcaggatttgaaaatggagtacatgtatgaggacccatgcgctttgtggacatctttcaaaaatcgatatgaacatcataaagctactcttctcctagaggcaacgcatgagtggaaccacttatgcctacaggattt

SEQ ID NO: 95064 - DNA, 1070 bp, Oryza sativa
gagagagagagagaggttttattaaccacatggcgatgctatctgattacccatttacccatcattcaggaagcagcactaattattgggtagaagaccatttgggagtggttcgatacagttggggcgacatgcagtccggtcaaagtcattttagatgaatgctgtgctttttgttctgctacaatactaatatggtaggagtagcacttggttagaggactctacatagtttgcatgtcaaatatagataatatgctgaattcttgatgctgtgggagtcattgctaaatctagttatgaccttatttccatagtgacagggtctttcatattttttaatattcggagcttttggatttatttgtattggcgattttgtgctaacagtgatacttttgaaagcttgtctgattctagctttggcaaggacataagcaagtgaaacagacttattgtgtgcaaagtatttgtatttgataaccatctgtatctaggattgtcatgatagtttcagtgttatatatttgtctctgtaggcttgaagctaatatatatgattttcctgttgcccgtattactagcctgctatagagtatagacatgaccattaactttatatagttcttttgttactatatgtttggtgaaccctacgatagtgttatgacatctctttttttttcctatttatttcagattccttgtgaacatgctttctgtttagcctgtgctagaagtgattccagctgctatctgtaagcattctcctgaactttctggaacttgatcttgttagtttattgacttattctcagtaggataacatgcagtaacaaagtgatctttctgtatggaatgaagtttctcgtatgatctctgagaattcctgattgatgtgttaatttccttcagttgttaagttttctaccaaaatgagtttcaactgagtagatcataagatatactccctccgtttcaggttataagatgttttgactttgctcagagtcaaactgctttaagtttaactaagtttgtagaaaaaataataacattttcaaccaaga

SEQ ID NO: 95065 - DNA, 2120 bp, Oryza sativa
atgaatcgtatcgtcacttggattaagcaatgaatcagaattagtctcctccaaccctaggtccctctctcatccttagcaggcgtctaccccctatgaaccctaacataaagcgatcgaacactccagttgttttcttttaccacacaaaggccaatatataaccactctcggcacgagattacagaacatgctcacattatcaacaatcaaacacataaaagctgcagttttgaccacccaacatgcatccctacaaatgatatgccaaaaagtcggcaaaatcgtccacacaggcgcactcagaaagggagtgtgcgcacattaagtcttgacctgaaacagattaatcgaacacactagacgaaaggaggaggagaagaagaaaaaaaaagaaaccatccatcctttctattgaaccgcaattctttccaatcttcacatgctgctgctgctgctactcaaataaatccatgaacctgtctcgttaaggttaattggaggggaaggggatcaaacctaagcccggattggctcatctaagagggagaagaaggagtaatatacctttgagcccgatgcggaccgggatggcgcgtcgcaccggcgaacgaggccgcacagggaaggcgaggaggggggggcggcgggtggcctgtctctctccgagctccggctgccgccgcggatcggaagcggcggcggaggcggagtcgggaggggtggagtcgtggagaggaggaacgggggagaggagaccgatgagggaggaggaggcggctgccctgacgtggttggtgtggggcccacgcgtcagtgacacgcgcctccctctgacgtctacaattgaggaaccgcttttggaattcactattttttttttctcagctttcggctccaaataagccaaacggtatatttgcaaacaataaattatttgttaataaaacttttatatacgtgttttcagtgatctaaaagtaaaggccgaaaaataaatttcgacgaaaaatctcaaaatcaacttcaaatttaaagttgaaaattcaaattttggctgataagtataagtataagaaaaagatgaggtttgtttttttttcttcccatcccttgtaccatgcatgtaagatttttctctaatttttttcttctctatttctctcacctactatacagttaatgtattttttttattttgaagtatgtaaagagctagctctggtatgtgagtcgatattttttatttttctaattctgttaccaccacgtaagttttataattgacttatagtttactagtattaaacttgctctaagggtgtgttcttccccctactttctcaacttatgcatcctcgtttttcacgcgcatacttttcaaattattaaatggcgtgtttttaaaagttttctatataaaagttgctttaaaaattatattaatctatttttcaaattttattagtaatacttaattaatcatgcattaatctatcacttagtttaccagccgaacacagtctaaatagggttagccatcgaaattatagaccaagatttccacagtttaagatttatcgatttcccctgaaatttttggcttttctaaatagttaacactgttttacgtttcattgatcgccatgatctctactttctatggaaaatggcatatacttccatcgtccaatattaaggatgctcacatatactccctccataaaaaaaaaactcaacctagtaaagaatatgacccctcttaatacaatacatttggactacctattgttcagattcgttgtcctagaagggatcacattctcttctatattgatttttttttacggacggtttttgacggacggggtataaggcaatatgctcgctgggatgcttgcatatacagggcctttttttttcaatgccacactttgacacccgaatattagaagcgccacagtttattgctgattgtttagtgcacgtaaggtccatttatatataggtttaattagatccatgacattataaattttaccgttttaaaatatatactccatatgtttaactgttcaactataaaccgtgaaactttatatatatacaaaaggagctgg

SEQ ID NO: 95066 - DNA, 2566 bp, Oryza sativa
tcggcctgggcagggcgcctggcgactggcggctggggtggggagggttgaccggttgggatgggaaggggaggtgaggagaagagacagggttaaaaatgtgggcttttatttgctattgggctaataggcctgaaatgttgggtggtgggagggttcagtttagttttcttttaagttttgaatgggtataggttttttttttcctgtatatacatatacagaaaacctagacaacgatatcccgatagtaccttttatgagataccttttatgagatagtacattatacctgttgtggtaccagctgtatgatacctgatacctatgatacctattacccggtacctgtgatacctaggacctaatatatatgatactcatgtaagagaataattaatatgccttattccgttgtaacgggatcccgttttatagcagctctcgttacaatgggcccgccccttatgcctccgtttcccgatcgagggcgcacgcattgatttgacaaggaggagacttacgagctaatcaagccgggacaaccacaatcggcttggcacgccccgcgcacggcccggtccagccttatgaactattgggcctagagacaggcttacaagaggagatctcgatcgggatcgtgcattcgttccgtcctgcacgatccgatgggggtggttttgccgtcttgcctccgagccgacgccgtgcggtgccagtagctgtcgcccctggtgatctgcccgcgacggactggcggtgggccggtggctacgcgcgatgggaaggtccgcaaactggcctctctctatcttctcccgccgatttggccggttttttgggttatacgttgtacttgtacatgtccgaataagggtagatgatgctccattagcaacctgacgcaaagcctgctttatacagtctcgatttttgccctgagttggtcactgatcttaaggctgcgttcgagcgcaggagaaaggaagaaagattgtttcgttttccgtgcgcatgctttccgaactactaaacggtgtgttttttaaaaaaatttctataggaaagttgctttaaaaaatcatattaatcctttttaaagtttaaaataattaatactcaattaatcatatgctaatggctcaccatgttttgcgtatcttcctaatctttttaatccccttctcttcaaacacaccctcagggaagatagagaggaaatctcatggactgaaagaaaaggtcgtcactgtatacttctacagccttaactaattaacttctaacaggtgtcctaacagcacattctggaattcatccttgcaccctagtcacgtatcacctttttcttttctttttcagaaaatctacaaaacggaatcccgtctaaatggatagttaataacaacctacctattagagtatatgatagttagagtcatattatgataggattgatttgtgtggaatcattccttatctccttcttatgtactcctatatatactggccccctgaggctcaatacaattgatcgtattcctctctccctatactatcaaacatgatatcagagcgggtgatctagtcgcctctctcacgcttccgccgccatcgcccccgggagggttctgatctcccgggggtggccaccaatttttctttttttttcgttgtctgcaccgtcacccgggaggaattgatcttctaggcggctggttgtcgtccatctgcgttgttgttgtcaagagggatcgatctcggtctcctcggtcggcaaagttctttgtcgcatcaagcaacttcagtagcagatcgatctggagtgtgcgggcctgcaccatggaccgtggtgcagctgtcccctccttcccatcgtcagtgtggcacagggtctgggggggatccgtccctgccgtctcctcctccgcctgggccgcaaccgcctgcacccaccaggccgccggttcacgtccaacgctgtcagcccgttgccttgcgccggccccgcccacaccacagcactctcctcctactaccgccgggggaacgcagccctctgttacatccgtcggcctgccggcgctgatggtcgccgctggctgctgcctccccgcaaccgcattgtcctctcctcttcctcatccgtctcttccttatccactccctcctacagcattttcgtccaggacgccgtctccctcactcccctctatctccctttctcctccgccatgtcccaagggtgtagcgcccgttccgtcgtggcgcctagcgggaaaattatctcttaaaaaccctaattgcgaaatttgtttctttgcttgttgtctagtgtccgtgccatctcaagatctcaaatccccgatctatcgtcgagttcaattccggatccaaatccttccaaatcaaatccctccgcaaaagtctattttgcctcccccggggtcgatgggccgaatctctctcggcccatctccccctccctcccggcgctctctctctctccctctctccctccccctccgctctgcccgcgcgcgtgcgcgtgagccgctcgcgc

SEQ ID NO: 95067 - DNA, 1289 bp, Oryza sativa
gggcagaagtgctcttctcctgtctttcggccttcagagactgattctgctcccaaaaaaaaagaccccaaccacaacactgtgaagtgagtgaacgctgaccctttggtgtgctcaatgtttgtgttcggtacctccgtttcaaaatataagtattcatgcatgtttttcaaaatgtatttggacatttcttcctacagattcattctggaaaacacatataaatgtttctattttgaaacggagggagtaattatgatggtttttttacttgcgattgtgtgattggagaattgaaataatatttaataaatttactcggtagccgtatgcctctatcgtacaacaatcaacccttttgttgtattagatgatcctaattactcagtcccaaaaatacctatataatctattacaacaaacaatattactgtcagacctatctacagtaacgctgatttttcacaatcacgatacagtattactatagtaacgttcggagaatatcgtcaaaaaaaaggagcatgaagggacgactaagtttctattagttcgaatcgcttttcatgcagttaaattttttaaaaacattaggaacgagcatgaaaggatccagcagtttcttttaggaggaacatgaaagcagcaagtactttccagggaaaatttgaaccatgtactctcttggacccaaaataaatacattcttctagttgaactagagaagttcatttatttttggaatattggagtaaataattaaggattgagaataagcatcgaatgaacgagcaatttcgaaggaacagcatatggtcaactttcaagcccaaatctgtaggagtgtcgcggaataaactgaattattaattagtaattaccatcaatctaacttcgcctatctatttaagtttgtagaagcgctgaaatggatcaaacagttatagcaccatatgaacatttacacgctacttatatgtacgaaatgtaatcacggatcgaggacaaacattttagatagtttctttccatttataattagtctaaggacataacagcataaacattgtatatttaaagttttgttcaaagtacatcaagatcatcgtaaaactcttagtaattgataataagcttattacataaacatgataccccaccaaaaaagtttgtacgatcggttctccaacctttgaatgttgttctgtttttactgcactatgatccaaacctaccgtgtcagacaagtggtaagaaagatctatgtacgccgataaattatcggtcgg

SEQ ID NO: 95068 - DNA, 2384 bp, Oryza sativa
gatgtgcggcgacaacggaggggtggccgggcttcacttcgcagctgtgaatccaatggaggcagcggcgaagcttggcgatgacgggaggagcagcagggcttcgccggagatcaaaacgcgacggcgagcttcgggttgacggcgatgatggagctccggtggatttcggcttcagggagatggctgccgggctccctctccttcttgcgaacccaacggcggcagaggcgaccaaaagcggcggctaaggcggctgctagctgcggctggagatcggaacatgacggcaacccactggttcatggcgaggacggcttccggcgaagtttcggcgcaaggggaacggcggccggggtggagctcgaccttgcggagccgatggaggtgacggcgcaggaaggaggcagatgaggcggcggctagggacggctggagcggcgccggcgtttggagagagaaggagagcgcggggagagcgtttccggcgacggcggcggacgggaaatgagaggatagggagaggacgactagggggtcctttgtataggcacgggagctcgggatcaagcccacaacgacgggaaaaactcgggaaagtctagggttctcgccggaaaaaggaaggatttgatccgcgaaattggaaagaatttccatagaaaattttggggatttcttggggaaaaggaagaggagattgaggggattccattcccgcaactaatttggaaagaggagcaacggggaggtcggattggtgggaggaggcggcggcactgtgcacgagcacggctggctcggctctgtctggaggaggaagatggagtactgtagcgcgggggaggcaaaacagactttcggccgggctgagaggaagggagggaatgggctgaattcggcccaagactaggaaggatgattttattgcttttccaaataaattaaccaatgagatgatctttcaattgttaaaaatactttcaatgctcaaataattccaagaaaaatcttgaacatacttggacactcaaagtatttaatataataatatccagatcatttaatgattaatttattatttaaataattgctaaactgttctttgtattattaagaattgagctctgaaaaatccaagaaaattccagagagtataattaatcatggagaatttaataaaaattaaatccaaccatgctttacatttaggaaattttatttcccacatttaacttcacttgtaaattcgattaataatttattaaataatttataaatccttaaacgaaaatcaggctgtggcatcatctaaaggagcatcatcccctggagtgtaatcactgtcaggttcaccgtcagaaggtggctggctatcaatgggtgttgactcaaagtggtcaacactatcctcctatatggtgtttactctaccattgctttacccttacatccactaccagcagccttagtaactcctttacctttggatacatctacttcaacatccttttttgcacactcttcttcactgtccatttttaattccatgtatgcctcataatcactgtcatcatctgacccatcacacaaatcaataatttctggctcttcaacatacacatctaccacatccaattcaccagtacaatcacatatcaatttgcaagccttgtaatcataaagagcacgaaaacatgtttgcaatgctcatgcaggtgtccaaataatgttccagtgcagcaatgcttacgtaggaaacaaccagtgcagcaatgttctagtcatcacattgcaatgctcacgctggtgtccagataactcaggcaatgacaccttatttcaatctatatatgacagtgccttaaatccatcacaatatttcttctcaataccatctagaacatatacccccttcatatgaaacctaaccacaagagtgttactcgtccatgatatcgaaccccttcatgcagaacaacaaaatagaatgatttagggtgatattaaatttctgctacagatatgacaagtccaaatcccaacttttgcacagaatgccgaataaaatatccccttatcaagtacaacactaactaaataactcccaacctacaccaaatccaagataaaaaaaagacatctaccaatatttaaaattgttcttcccgcatcccactaataccatgcagccacagagaggaaagggaatacctaccaattgcttcggacttcggattacgggggaatccttgctgacactacccttgttggctgtcgcgcgaagctccaacttggcctctaggtcgcccaaggtggtccgccacatcctaagccatgcctagctgcaagtcgagctcgagctcatcagtgaccacacccag

SEQ ID NO: 95069 - DNA, 5374 bp, Oryza sativa
cccagaagcaacaagataccagtccctgtccaagaaaatcgtgttctgtagtagtgattcatgaattccttctctacttgatcgatccattttctttgtttcttttttggcatagatcgaacacttggtggtgcgctcgtcggcgttcccagtgtccagagcgccaccatcgccccactttgtcattcccgtcgactcgaatcatctccggctgtaccattgcgccactgacgtcgcctaggtcccaggagaacgacgcccacatatgatcaagccaatacgccgccacgaacgcggtcggtcgccgttgctctcctactgcctctgcttctcttgccgccgagtcaccgacatgtgggcctggctgtttagccacttcattaggtgctaaggactttaattagtagaaatttaaatcttgtaaggttctttttgtaaaattgctttgtttgccatgtggacttatggacctaaatgcaattcacctaatgcccagggacttttttgtatagggtttagggcttaccctaaaacatgaaattactatttcatgcattcattacttgatataatagcttaatgagtatattgtactcacccttgctttaacccctctttcagaatcaatttggagtttttgccgaagccaggagtttaatcagataaattggtttcattccaacttagttcccaagtatagattagatagatggtttaattctatagcaaaacattagacttggctcatcctatagcttctacagtaatagttagccactaccctattatttcatgtaaagaaatctcctttggagccttaatcaaatgtatgcgatgaagattcagattgttgaacctgtatcaatctactaatacaggggttgatacagtttaaatatgtcggttaccgaatctttaattttgggacccgacatggtgtgtgggtgggggcccctgcgatttgggagcctagagcggccgtaccgcttgcgccccctcccccctgaggcggccctaactacatgggccttaaaaggccaaatggcatcttatgacgaattctgggcttgatggcgacgaaaatggatgccatagactctatgacgacagaaagatcgtcactagattaatgacaaaaagataagctttctttatagaacgccattagagacgcatgacaggtgacgaatcatattcgtcacacgaatgtcacagatttcatagcatgacttgaaattaaatttttatgacgtaaatgagcgtcacctatcataagattcttgtagtgatggcttgtttggctattagagaggcagtttgagacatacagcacacagtttcataccgtgtgcgtgcctagttggcaactggatcctagtagatgcaaattttgaatcattcaacccaacccaatccttcttctcttaatcttctcttcctacacttgtgtatttgtgtttgtgtgtgtgtgtgtctaagaggctagtagagttagctatcctaaaattttttgcacgttgcagctactaactgtgctgctggcttgtcgtcctctgcttcaacattaaagagagaactaatagatcggtgatccactttggtttcttggatgctatccagccacgtcaccatgcatgcgaattttgtggatggagtcagtggctctgcatgcacggagctgatttaattaattaacttgttgccagctagtacctaattaagcatgtgtgttaatttattattaattactttgctagtgttaatttatccttagttttttttattccaaactacgagtagcatgcatgcctttgtcagagagagaaaccgatggaatatgcctcgtttcaaaagtccatgcataatgtgcatgctttgtggattcgtgctgtattttcctgggtagataagaccaaagaatcccacttaccaactaggttttttaaaagtctggtacatcgtgaaccatgctgcttcacgtggtcggacctatatacgttaggatcaaatgtgctcaacgtggtctggcacatcatggaccatgctgcttcatgtggtcggatctagatgtattaggaataatccttttcgtagtagtgaaactaaagaacttcacatgccaattagtttttttagagtccgaacaaagatgaaactttttggaaaggtgctccagatgaccaagttcaattcaccaactgaaatcgcacattggattttacatgaaaaatgcaagatggacaaaaatgatttctttcggttctaaattaatactcccggccatttgggaggagcaatatgtacatatgcatgcatcacacttcagcatttttgtctttttttttccttggagttttaagaatgctcataattagggcatgcaagttgatccattgatatattcgcaatatttgacgatttgtttttcattttaaaaattgttgacgatattagcttaattttggtaaggaaaatatcggttaatttatccccaatttttatcaagagagaaaatgaaccatgagaattggggtgctaattaaccacaagcaaatattcatcttaatttgttgtatatatatatatatatatacacgagcatgcatgtaaagatggaaatatgtgaaaaatataatggtgctagtagatttgtctaaaacacttccataatactatgatcaggacactcgataaggacaaagttcaattttagggattgtgtcattatcaaaattatcaatgaataattggccatagggccgggattagcaagggtctactactgtcctgccatttcattaattaattagattaagtccccgattccttgcatcccaaattggcctacgagaaccgacaaaaatcgcaagatgggaggattgtggtaggttatcttcagcaactgtgcctctcaagtggccataacatattagccagaaggataaataatcatcaatctgccttcacagttttgatcatctcatgagacatatatataaaccacccattagcaagagtctcctaggtgaattaattaactatgttgatacacatatacttaattggtataagaaaaattagtggtcgttaattagtataaaagcatcaatcaaatggagactattagctagctaggagaccgggcaagcaaagcaaagcattgatcttgatgaatcctccagagagattaattgcatattgccagttcctcctgacctattatatgcatgcaagtgctctctgtacttgtgcggtgcaacgacgagcaagagtgcgtacgtttatagtagaactgagggggtgcgccttatatacaccggacgagcaacagtgcgtacgtttgtagtgacgtctccaattttagtttctatggtagtaaaatattcgacgtttgacacctcaaactgcagaaaaactggagctgtgaaatgttttcttttttcatatgcgtggagctctaaaatattgacagttttgtttttttctataaaaaaagccaagaagagttaacgacttgatgggtaggcgctcctggatggagggagatgagcttaaaaagttgtagtaaatggacccatgcagtggaaatgcggaatggagtggagcagtaataaaatttaaaatgccacgcgcagggcatctcgaccacgacaggactctccttgagatcttcaaacagtgtgtgcttgctagctgaactgcagcagtggaacagtaataaaatttaaaacggatgtacagtgtgttcacagtggacgagtgtgctctgtgttctctgcatgtgaatagatatggcgatctctgcttgtgaatagatttggcgactactattactgggtatacgtggttaggacagatgttagtttgttctgcttgtttggagatggatttgggagcaaatgtacatggttagggcgcaaatgttagtttattttgctgtggaggggagtgggttttgctagaagtagacccatgaattttgctattccaaaattcctcaactagctatcagcctcatcgtttggcatattttctgaatatgccaaacggcatatttgcaaacgaaaatcaatttgtgaataaaacttttatatatgtgttcttagcgatctaaaagcaaagggtgaaaaataaacttcgatgaaaaaaacctcaaaatcagctccaaatttaatgttaaaaaaaatcaaattttggctgataagcatatgaatatgccaaacgatgaggccctatatatctagctccaacaaatctgtgatgcctatatctcactagtcttgctatgtgctatgtcatgtacacgtgggtaaatacctaatttatgaattttgctgtctcatcatgattatggcaaatatacatatacctaactcatgaatttttctatgcctacttctcaccatttatgctatgtctaagctagaagattttgctatggccatacctactcttaaatttttctatgtcggccttgactcagccgccccaatagaagtgacgaaactactgttgttgcaagagttggattccttcaagaaagtgatagatgaatctgaggcatcaagggagcagcaatcgaagaaaattgaaagtttgattggcctaaatgctccatattttgctctgaaaagttgacagttatgttaccaatcatgtatcattgtcattttcatagccttcatcatggcgttgcgaatattgtgaatattccaatggatcaacttgcatgccctaagtgtgagcattcttaaaactccaaggtaaaaagtcaaaaatgctgaagtgtgatgcatgcatatgtacatattgctcctcccaaatggacatcatgcaggatcgggactggacaacacattaaaggctctcatgctacacgcttcttgcagctgtagttaaacaagggcatcaagcggtagttcgataacaataagattcattggccccaacatacccccatccattccaataaatatggcacgcatgtattttaagatttatctttaaccaagaattagtttaaatttacaaagataattgatagaaaattagcatcatttcaacgtgtttttcaatacgaataccacaattctatttatgcattactagtcatcaacctgtgcacttgcatgggctaaaaaaattatgtgacatcaattaactaacgtggaagctttattggtgcatccaattactaaatatatgatttattctttgtttctcaattctttcggtcaaaaacgtgcatgtgtgttattcatagaaacgtatgtagtatttgtaagaagtacaatatcgaatttccaaaaggtttcgaccttgtgcgataatatacacacacattaacctacataggcaagctagctagacctaa

SEQ ID NO: 95070 - DNA, 1024 bp, Oryza sativa
agaattttaaattgtttttttcaatttaaataatgacagaaattatgttagtattattaaaattacttctttagctcggaaaatttcaaaaaaatttaagagagcataattaattattgagaagttattaaaactattccaagtcatattttacaaggtaaaattttatttcacatatcaacttgtaacatacaaggaatttcaccttgaaaaatttttgtggaaaatttaaaactttttgaattcaaaagtttttggtgaacatagaagcatactagagcatataactcccttaaataaaataaaacacatagtttttctggccaaatcaaaactaagtccaaaagtaaaagtttacaaatcttgtggtaaaaaattttaaatcaaaaattttgctttgaccataaactgaaacctaatcttctcggttttgcattttcagcctaactaaaaaaatatatttaagttaaatataaaataaatggaaaggtaggtatcaaaatacacaaacctaaatagagataaaaagaacttgcttgtatatgcatattattcttttaagattgtttttggatattcttggtgcatctcataataggttgcatatgcatgctttgtctaaagaaaattcctaaaaataaatgaagcaacaataaatcccaaaaaaatctcataaatactaaacaacaccataagctcccagaaattttagttttaatttatcacatcaattggtaacacaaataaatccttgaactcagctaaaaaatctggaaacagcataccaattagcctaatttgcaccttcaccaaaattaaaccataactcgtcttgcaaaatctctaggttgcaaaatgtaacctcgtaaaatgagagccataagttaggttaacagtattctggactatggtcaatagattaactagtcaactttactaaattaccatggtaaaagcaaaagtaattaaactttggaacttggcaccttgaaccatcaaatccttgtatctacctgtcaccccc

SEQ ID NO: 95071 - DNA, 1860 bp, Oryza sativa
attctttggtcttatctacccaggaaaatacagcacgaatccacaaagcatgcacattatgcatggacttttgaaacgaggcatattccatcggtttctctatctgacaaaggcatgcatgctactcgtagtttggaataaaaaaaactaaggataaattaacactagcaaagtaattaataataaattaacacacatgcttaattaggtactagctggcaacaagttaattaattaaatcagctccgtgcatgcagagccactgactccatccacaaaattcgcatgcatggtgacgtggctggatagcatccaagaaaccaaagtggatcaccgatctattagttctctctttaatgttgaagcagaggacgacaagccagcagcacagttagtagctgcaacgtgcaaaaaattttaggctagctaactctactagcctcttagacacacacacacacaaacacaaatcacagtgtaggaagagaagattaagagaagaaggattgggttgggttgaatgtttcaaaatttgcatctactaggatccagttgccaactaggcacgcacacgctatgaaactgtgtgctgtatgtctcaaactgcctctctaatagccaaacaagccatcactacaagaatctgattataggtgatgctcatttacgtcataaaaattgaattttaagtcatgctatgaaatctgtgacattcgtgtgacgaatcatattcgtcacctatcatgcgtctctaatggcgttttataaagaaagcttatctttttgtcattaatctagtgacaatctttctgtcgtcatagagtctatggcgtccattttcgtcgccatcaagcccagaaaacgtcataagatgccatttggccttttaacgcccatgtagtcagggccggctcaggcgggagggggtgcgagcggtacggccgctctaggctcccaaatcgtagggcccccacccacacaccttgtcgggtctcaaaattaaagattcggtaaccgacatatttaaactgtatcaaccctggatcagtagattaataaaggttcaacaatctgaatcttcatcgcatacatttgattaaggctccaatggagatttctttacataaaataatagggtatttacaagattgtggctaactattactgtagaagctacaggatgagccaactctaatgttttgctatagaattaaaccatctatctaatctatacttgggaactaagttggaatgaaactaatttatatgattaaactcctgacttctgcaaaaactccaaattgattctaaaagagggggttaaagcaagggtgataacaatatactcatcaagctattatatcaagtaatgaatgcatgaaatagtaatttcatgttttagggtaagccctaaaccctatacaacaaggtccctgggcattaggtgaattgcatttaggtccataagcccacatggcaaacaaagcaattttacaaaaagaaccttacaacatttcaatttctactaattaaagtccttagcacctaatgaagtggctaaacagccaggcccacatgtcggtgactcggcggcaagagaagcagaggcagtaggagagcaacggcgaacgacggcattcgtggcggcgtattggctagatcatatgtgggcgtcgttctcctgggacctaggcgacgtcagtggcgcaatggtacagccggagatgattcgagtcgacgggaatgacaaagtggggcgatggtggcgctctagacaccgggaacaccgacgagcgcaccaccaagtgttcgatctatgccaaaaaagaaacaaagaaaatggatcgatcaagtagagaa

SEQ ID NO: 95072 - DNA, 1098 bp, Oryza sativa
  unsure (1)..(1098): unsure at all n locations
ccgcatggcatcaagctcccctcccctcctcttccttccctccttagatcccgtcgaagggaaggggcgtcgtcgncggtccggccggagggtagcacggatccaaggcgaccggcgcggaggccgccactgacgatgatgatgttgacgaggaggcggcagcggcaagcaagagcgtcggcgccaccaccagattctagggtttcatttttaaagaaaatttatgttttttcgggtttttgttttcctgtggtggtgcttcacctgcacgcaaaaatcgtcattttcccagagccctaagtgcatgcgggccgtttacccgcacgcaaaaatcattttagccctcacacaaaaatcttggttgtagtagtgaatggtgaaagtgaaggtggaaagtgagagctaggtgtcaacatgaggggtagaaacgatttaaaggagttggcagtgaattgaggctatgatcccacttgtacttcactcaacctagcatgagtggctgtctagtggccccatgtagatgtttcctatgagaagatgagaggtatggtgaagtttgggtgtaaattggactttaattccctctctctctttctttctctctttgaaaatataatttaggatcaaagagatgattcgccaaggttgtttgtaggtatttggacgacaaataggcccatatatagatgtttcctagaaggcttggagtggtagagtggcattttgggtggaaattcaatttaaacccttctctcaccttttgagaaataaaagaagatttaaatgagagaagagcagatgatgtgttggctatggttgtatgatgagtgggccccacaaggacttggtcccacatttaagagagatgtagaaggagagaactagaagctctaaattttccatgtgttggcactatcacactaaactatattactctctttctctcatacatttaatttagaattaggggggtgggtgggggggtgggggacagggagacggcaaggtagacaaggatttgatggttcaaggtgccaagttccaaagtttacgtaatttatggctctcatttcatgtggttacatttcgaattagact

SEQ ID NO: 95073 - DNA, 3532 bp, Oryza sativa
tactgcatgataaatgcagtgttactatgtcatttttacgagatgaagttcgaataggtgggccataggtaaagtttgtaggtggctttgagcaaggtctgaattatgtaggagtgttttgaataattttatacatttggtaaaaccatgttactgcatgtatatacccctgttactgtaaattacacattctgttactgcatgtggagggctaaagttcaaaatgtcaatctttgaaaagcaatatctcacaagatatgtattattttttaaaaccgtttccaccatgatgttatcgtgttactgcatgtggaggattaaacttcaaaatgcatctacgtactcccctcctcaagaaccatttttcctccctcttcttaagaaaattggtttcctccctccaatatagcgttactgcatgtatatgacgttattgcacttttgaccgtaatattgtggtgaattgcagtaattcaggaattgaaacaaaaatatatcggttaaaagtctcagatactaatcatacacttgttactgcacaaaagtaaaagtgttactgcacgacaattacacgttaccacgtgtttatgcagtaacactactcaaaaaatgtagttagacgctttcttactgcaaaacttatagtcttgcagtaccgttatcaagtaattgcagtaagacactatgttacgtgaaaattataatcgttactacatcttgtagtaatgacatgatgtgattgcagtaacgcaaaacaggcagtagtaaaacttttgatatagtattactacttgtggagagttaaatcttcaaaaacaaatctttgaagggtaatatctctcacaccatgtactatttttaaaaaccgtttgcaccatgatgttaaaaaaaagtgcttaccaaaagtagatccatcataagtatattatgagtaaattttaattttgttaccgcaagtaaagcattgtgttagtacacgatgaacaacacgttactacgtcattccgagacgagagctaagaagagagagggtcgtggggaaagtcaccgacgggtttgacctagaattgaccgacgtgggggacctctggctggcctttgaccgaggtgggaggtgggttttgggcccttggggggagaggaggtgggttggtgggagggagggtatagaatagtttttctaatatatatatatatatatatatatatatatatagagagagagagagagagagagagagagaaaaactattctacacccgggtatagaataactattctatacccccctacctccagggggcaaaacccaccccacacctcggtcaaagctccccatctcggtcaaacccgcccttcactttccccaccacctccactcttatcagctctcgtctcagaacaacgtagtaacgcgatgttcatcgtgcagtaacatcatgtcttacttgcagtaacaatattgaaatgtagtcataatataatcatgacggatctacttttgataagcactttttttctaacatcatggtgcaaatggtttttaaaagtagtacatgatgtgagagatattacccttcaaagattggttttttaaaaatttggctctccacgatactatatcataagtattactgctgatctgctatgcgttactgcaatcatgtaacgccgttactacaagatgtagtaacgattataagtttcatagtaacatagtgtgttaccgcgattacttgataacgttactgcaagaatatgtatagtaagaaaaaaaggtgcagtaacatggagagagagagatgaattggctcggtttacttatggggcaagtgtcacatcctgataaattcatcccaaaattaaaaattattttctaaaaggaataatagaattaattaaaattcgaaaagaaattggcaaacactaaaatacgtatcagaaaaattcgaatgtggtccggagaatttttgttaaattctccttggtttaaaaggagccctcaaattttacttgaattttcagagctccggaaataattattaagcaacaaaaacaattaacaaagtttactaaaagaaaaactaaagaaaataaatccccctcctccctttgggccccaaagcctccctcccttcctctcagcccggccgaaagtctgttttacctcccccgcgctacagtgctccttcttccagctcaggcagagcccgagctctccagccgtgccgtgcacagtgccgccgcctcctccttccaaatctcgcctccccgttgctcctttttccaaattagttgcgggaacggaatccccatcccttcctgattatttcccccaactttccccctttaatcccgcccccaatcaccgggatttaatccctcttctttgaccgccattgatgccgccggccacctcctccggcgcggttttcggcctctcccgtgaccggcactccatccttgccctataaaacgaagccctcctccttcctttggtccattttgctctctcccgagcccctagccacctccccatcacctgcccctctctcctgtaccgacggccatctccggccgcccctgccgcatcgcccgagcgccgtccggccgtgccgccgtcttctctggcatcgcagcagcctcctctcccccggcctgccctccgttttgcgcggagaccactggaggtgcgcccccgccggcaacagtggcgttgctgccactgtaccacctccagccgcctctgtctccttgcctgagcgccggccgacgtcgccaccacctccctcggctccgcgatgccgccatcatccccggcatcacctcctcctcgcccgaagctcgccggagtggcctcctcgtcggcgtccagtacctcccggtctccggtcggctcctgtacgtcgccggtacgccgatcgacgtcgccgtctcctccgtcgacgtcgcagcgttgtcctctcctccagctgctcctctgtttcgccggaacgccgtcgcccgtgccggcctctccatcctcgtcgtcgccaacgtccattcggccgccccttcctcctccccggctcgtcggctcgctgcgccgccaccgtcatcgtcatcgcagcggcgtgttcagcgccgtcctcttctccgtgcagccgctgctggctgccctcgtcgcctcctcaccggccccggtggtcatcatcgtcgtcctctcgtcgttcccggtcgtcgtggcgttcgtccctccgtcgagccgttctcgtccgtcgtccgcgtccgccaagcaagccgcggcagccccgtcctcgtcttcgtcctcgactccgcgtcgtcaagccttgtccaaggatcgccgccgaagtcgttccctcgccgttcgcctccgtcatccccgagctgtctccgccgcgcccgttcgtcgttgtcgttcccacgcctcgtcgcgtggtggtaaggatccgtcctctcgcttccccgtcctcgtccttttggtgtcgcgccgtacccgttgtgcggttgtcgaccccggtacccgtgtacc

SEQ ID NO: 95074 - DNA, 875 bp, Oryza sativa
aaagtgggaaggaccattcatagtcaaaaagaagacagaaacgggagcattcaagttagcatatcttgatggtgatgagttaaagcatacttggaatgctatttctttaaagaaattttatgcctaaaaaaaaaggagagagagagagaaagagaaaaaggagaacacgggagctcgagtttgtagtatactcactcagatgtaaatacgaatgatatccaagttaatgtatataaacaggacgtagggtttttatccataatggaggcccgaacctgtataaaaaacatgcctctgtgtatgattgcaatagaactccgcacgctcggagtcaaatactctcgactaacaaagtcgacaaaatagaactccgcacgctcggagtcaaatacattcgactaacaaagtcgacaaaatagaactccgcacgctcggagtcgaatactctcgactagcaaagtcgacaaaatagaactccgcacgctcggagtcaaatacattcgactaccaaagtcgacaaaatagaactccgcacgctcggagtcaaatacattcgactaacaaagtcgacaaaatagaactccgcacgctcggagtcaaatactctcgactaacaaagtcgacaaaatagaactccgcacgctcggagtcaaatactctcgactaacaaagtcgacaaaatagaactccgcacgctcggagtcaaatacattcgactaacaaagtcgacaaaatagaactcctcacgctcggagtcaaatactctcgactaacaaagtcgacaaaatagaactccgcacgctcggagtcaaatactctcgactaacaaagtcgacaaaatagaactccgcacgctcggagtcaaatactctcga

SEQ ID NO: 95075 - DNA, 2884 bp, Oryza sativa
tattatttttttctacatatacattaatttggactaatactttttctcataattaaatagataataaatcatttttcatatttctcctataaaatgtgaagatggcattgtataatttgaaaattatattataagtgtatgtaatttaatgtgtatgatatgaacttatagcataagatttaactttttataaaaatgttgcacgatagtagataggtaatgaactaaacaaccataaaatatagggtaatttggaaccatgccattataatttttcaaaatttgagatatgccatcggtatctcaatgacatgtaggacccacatgagtcaatgacatgtgggtcaggatgacatatatcagattttgcaaaattataatggcatggttctaatttttcctaaaatatatagagaatccatcgtgtgttattgattttgtccttattctataatatgtcactaggtttgtcaagttctaatatgccatcgcactttgtttaacttctataacataccatcgttgtctacttagcatctgttagtattatataattttatcataatgaccgaaatagccatgggacgaaaaattccaaatatcagattgtaaaacttccaaagtttgagatgaatatcttctctgccttgtttataatatgatatttcagaatattcagccaaattttggaatttctgtcccggggatatttcggtcattagaacaaaattatacagtactaacgaagtctaaatggacggtgacgtatattatagaggttaagcaaaatacgatggcatattgtataacttaacaaactcagtgccatattatagtacaaggacaaagtaagcggcacatagtggattctcttaaaaaataatctagtcaaaaaatgtttctttattttattcaaaacaaaacatttttttaccgaacacattaggagaacttcgaaagaaggtaagaaaaaaaaaggaggtttagtcattagctcaaacacacgtgggaaaaagttactcacattcatggtatggtatatactcacattaatcaataatatactaatattaacaaaattgttcttcgtcttaatacggtgtaaaactaaagttttaatcttatattcttctgttgttccatcttcttctcgctttctcattcttatttattttttataataatattgctacaatcagcactagtacttgcacatgaatactagtagctaactcatatgtgtgtgctctgtaatatatattatctatgtttttacatgagtaaataataattagtatatttgttaataatattgtaattatataaggtacctaactagttttctaagaagtggaaagatatttttattaaacataatctagaatgctataaataatcatataattttttatagatgaattagagatcgacacttgttgagaatccaatgataataatgctctatatatactagttggcaccatgcgccttgccacgggatttgctagttttatcatcaaataaaatcaatgttttaaataattagatgtaactctgtatataaacaaaataaatgataatgtggcttcatatatagcctctgctattacaatacaattcatgttttattattttaaaacgtcattgtgtattgttatgatatacgtaagttattttcatgcacaatatacatgccgtcataattagagtagtttgcacatctttactttatctcaagcttatttcaaaaataagtttggattaataatgcctaattactctatgttatccaattgtttataacaaaacaaaattcatatcttatataataatttcatattaaataaagaagataagtttgcattatcttggattgcttgggaggagaaaacataatattatgtacagaatggataacaatgtcacgcctacttataatctaaaagaaggtgactagatgagtagcttcttgatccaacggctgataactatgtactaatgcgatccaacggcttagaattattgatgatgtggcttcttgcatgccatgacgtggtttcttgcatgacttgctttatataggaagatatgattgtttaagaagtgagtgatgatattctaattaggatgtgtttgcactacaacaaatataccttgtagagagattttactaatactatagagacatttttaaaatgccttcctaatactataaagacagttttaaaatgtctttacagtgttatagagacattttgaagagtgtctttttaaaacgcctttacatgcatttttaaaatgccttcctaatactataaagacatttttaaaatgcctttaccatgttatagagacattttgaagagtgttttataagtgccatttggtgaattttacggcaactatagcaaatcaatatgaaaaagaaagaatttacggcaaatatagcaaatcaatatgaaaaagaaagaaaaatattatcccttaccaatccttgaactcatgacctcttgagttgatcattttttatcttcaatgtactaaccatctcaacctcatataattaaatgtaaatatgtgatttgtgttacttatatctagttacttgatatatattaatatttggaaaaatgtctttacattattttaaatgccttaagaaagtgcctttacgtatgaggcaaattttaaagtgtcgaaaagatgtctctaaaagataaatttaacaaagtatcttaaaaatgtctctaaagtgtctctatagtaaaaataaatattttaggtgattttaaaaatgcctctaaaaagtgtctctagactatagagcttcaaaacttagaggtattttgaaaattgtctctacaaaagagcctctacaaaatgt

SEQ ID NO: 95076 - DNA, 787 bp, Oryza sativa
aacgcaggggatacattgggctgtcgcaccctcctcgtgcagcttacaagggatatatatagaagaaatttaggactcctaataggaaactaatcctataaactaatccgaatatattgtgagcccaaaattcggatcacatatttaacaggtcgaggtggcccattgaatagggcccacaatttttgggcctccaaattaagtatatagtattaatttcattaagtatatatttctatatactattcattaagtatatagtatatatatttttataggcattaagtatagtatttaatcagataaaagcacatcaaatccattacgtatatatagaagttgtgcttaatcattggttcgtagctctccgagtctcccgttggttagtctccctaattagatcactagtaatatgcgtggtaatgctacgatgatatttgaaatgcaaaccaaacataaatgtgtcatggtcaggattacgtacgtatcgtcgcagaggcacgccggctcagcaggacgcggcagcagggagcgcagcgcgtcgcgcctgatcagccgcgccggacggcaacagttctatccgcttgcaaattagataaagtttgttaactcttttccttaattaccagtttgttagctatttcttatagtaatttggttaccaattgtaagcctattaagaggtagcattcggatgaataaagcaagcaaattcaatctacaattctcatctccgattctctgttttctcatctcctgttgctgccgccacgggtcgatgttcgac

SEQ ID NO: 95077 - DNA, 2275 bp, Oryza sativa
ccgcgacgacgacctgcttggtgctcttcttggacgacgcggccatggcgcggtggcttccactccctgcaggcggcggcgttctcggcgtcggtgagagcggcggcggcggcggcttcttcttgcgcttggtgtggttgtggtggtggtggtggcggcggcggtcggaggtgtcggtggcagtggccgtcttggaggaggaagaggaggaggaggggaggaggagagtggagagcgccatgggaggggaggggatactagcttggtaagcgaggtggtactaataaattttcttctctcctagttagtgcaacatgggagaaggtgtgatatatatcaaggctcagctctccaccctattaaacatttcttttgtgaaaaaaagagagagaagaaatcatatatatctataaagtccatcccatcccccaagtatagttaatgcatatcacctcaattatttttagcctttggatgatttatcaaggatgtaaattgcatctcttcacatcaccttaattgtttttagcctttggatgatttatcaaggatgtaaattgcatctcctcacatctccttaattgtttttagcctttggatgatttgttgagggtgtaaattgcatttcatcccttcaaaagacacaccatacaatccaatcattataacctttggataatttataaaggtaaaaaatatataaatacatgaaaaaaatcgtatagtagataagaaagaaaattttagaacttgtatctactatattttcacgcaattctgcagcagcaacacgtgggttcccatgtagttaattaatatggcagtggatattgtgtgagaaatttggatctgaaaaaaattaatggagaagtgggcattaatgcaacctcaggaccagggtagtggggttggatgcatttattaaaatacccctggaccatagtgtgaaatgtttgagttcatgatcctttcattcagcaaagtactacagtgtaatgactgttgaaatgcgtgttgtggtaaattaacagagataatgaagatatacagcgcattgtattgtacttggggtgccatctcattctacctgggacaacatagcgtgtagatcatagatgatggtgcatccattgccaactctaatagagttatgtaaaaaatatagcaactctaaataggtgtagatcattgaagtcacgattatgaattggtttctgacatgtggatacatgttacctcgggtctatatgtcaatgacaaggtcatatgactttttgtgtcagaggaacctgatcccaaactgtattgtaacttctcttcaaccctaacgagtatatggtaatcggcccattgaaaaatcaattttttatctgcatttgtaattcatgcaatttcaattttctgcaagtttggaatgcaaataatatattcacagcacataaaaaaccatgtaaagtagacataaaaagtatagaactattggatccctggtaggtgagtcaaaaatgtgattccacgattgttgtttactaaatcaatgaagtaaatgtttctttttctttttcttttttttgctttgaaacacatagtcattaagtaaatatgatcataagtaccggaccaattgtaaagttaacttgtcaacatttagaattgttactctatattctcaaacagaaatgaaaaaaaaatggtttgcgcacatcttttcaaagaagaaatatagaatattgataaactgtattgtcctctccagcaaagatcgcccctattgacatttccttgtaggtacaggcttgcatgagacatcccaacatcatagttagcttagccaccaacaggtgagaaaacagtactactttctctgaaaacaacatgtgagaaaaaaaaagggggggggggtacatatatagtgcatagtatattgtcactaagtaccaatgaattcagcaaccattttattttcattgattggttaacttcagcaatgagagctagctatctaggtccacaaaatttgaccaccaaaagtgtttgaaaaatcgaccatccaccgcgaaagatcgcaggaaagaaactgaatttcttgggcttgaatcatgaatgccagatcgatctcgatgatttctgcctgcttgattcatttttttgcaagtggtaggagtgtgggacagtttcagaggacagctgtttgtttggcctgcaatcttgtgttgtggagtagctagtaccagaatgggtagagatcccctctttttgggttgcatactgaaat

SEQ ID NO: 95078 - DNA, 1194 bp, Oryza sativa
tttgggtcgggatttgagggcctgcagattctcatctgttgcaatgtttgatctttgagtaagttttggttaaaaaaaagaatcacatgttttatggttgaagatgctgaaagcccttagtaacatgcttgatttttcatgttacaaagtgtccatgaaatagtgttgaatatcaaaacttgttagtcgatattcttccagatatcctattattagatatgagatttgaacgaggatgaattctgtgaatctttaaaaccagcactatgtgccataaagtcaaactatcttaaatcttcctttttttttggcctccatcagtgaatatcttaggctttgtcctttttaaatgtggatttcagcatgtaactgatgttattttttttagtaaccctcgtcaggtgagacgtgtaaaccctagctcgcgaattccccatctaatttcgttgaaattttcttcgattgatttgatatatataatatatctcgcgtgtggggggtggtggtgcggggttcgtcgcgcatcggtgtgatccgttgatttggtgcgaatttgcccccatttttttggggggctttttggtggctgggtggatgaatgcgtttgtttagttggttggcggtgtgcagggtgcgttagggttcgtggagatctccgtggttcgtaagatagacgatctattggtgttgcgctgttgttgctcgcctcgtggggtttatggtttttttggctggaggtggaggggggctggaatggtggagggtgagtagatgtcaccatggggttggtgatgaatggaagtttttgggtcggtatttgagggcctgcagattctcatatgttgcgaggtttgatctttgagtaagttttgttaaaaaaaaatcacatgttttatggttgaagttgcagaaaacccttagtattctgatggcctgtagcatgtttgcttgatttatcatgttacaaagtgtccatgaaatagtattgaatatcaaaccttgtgttagttgatattctttcagatattctattattagatataagatttgaacaaggatgaattctgtgaatctttgaaaccgtaaaactgggcactatgtgccataaagtcaactatcttaaatcttccttttttttggcctccaatagtgaatatcttaggctttttcctttttaaatgtggatttcagcat

SEQ ID NO: 95079 - DNA, 2043 bp, Oryza sativa
gacagatctgagatgaatctgtgatgtatttgatttcggtgtattttttaggatttgtgatatatttgatttatgtgtataagtaacttaagatttgggatgttactttgaattagggatttggggatatacatagcactagattcaggagaaaatatagggactaactctaaaaaacaataaaaaaaggaccatctgcattgccgctaccctctctttaccaaccgggactaaagattcctctctttagtcctggttggtaacaccaaccgggactaaagatctatctttagtcccgagtatttgaaccgggattaaagatagcgatctttagtcctggattcgtactcccgattagaaaattgggactatagggagttaccaaccgggagtaaaaaggttatctctaccagtggcttgaatgaaaattacttaccttttcttctttttatgttcctaatgagtatgtttctgccaacaacattaacaaagtttgcacgctttcttcttctccaaacaagaagctatggtcatgtataaaactatgttaaacatttagtacatgtaaacatgcataaaccatatacacacaaaaatattgctaaaacattagagccacaagcccaatatgatttttatatcgtggatgaaccatgaaatttctaggttatgcaagtaaaatcagtttgtatattctttagatatatagtatttgttgatttgttacaaatattaggatgaaaaaaaagtagtgggaattagttagttcatcccaaccgttgttatatagagacgactgagatttgatcaaatccatcgggtggagttggagtgaactccagggaatccccacccgctaagatatgggcatgtttagattactgccaaaataaacttttctaaaatttggcagcaaaaattttggcaagttagcaacattgcaacattgctaagttttaggggttgttcagattggtgtcattttaaacaatataattgtttgataaaattcataaccatatgactacatttagttttctactttcatattataaaactttctagcattgcccacattcttatatatgttaatgaatcttactagaaggttttataacctgaaacggaggtagtactaaacattggtaatgtgaaaggaatattgccatccacccaaaacttgataatgttgtcaacctattaaaattttagcattttcaaatttttataaggtttattttagtagcagtttaaatatgctcttagtagaaatgtagaatgggttacatatgatgttgccaaaattccctagatattacaaatgttggcagcaaactaattgtcatatgattgtcaatttaccaaacaaatgatatgtttaaaatggtaccaatctgaacaggtccgtagtaacttgatacggtgatacataaggtacacagatacatatttactcatataatgacattgatagatgtataatttaattgtcgcataaaacaaggatagaaaataattttttggaattttgttcaccctacccatataaacacctacgaagatagattgacgaagtcaccataacagacgcttagtgcttatatacacgcacacacgatacactcaccatacatcttcgaatacttgattctcatgtcttagtattgacagagtcaccacaacagacgtcttgttgtcaacgtgtcgtatatcctgaaagaataattaattataaatatgagtacttatgtgattaaaatccggatgggtagtttaatcggttcagggttatataatattcaaaacaatggcagcatggttaggccaagttcgggagtgagggttagtaacctttactccagcacgtaaaacgaagtggcagatagagcatgattaattaagtactcccttcatcccaaaatataaggtattttgggtggatgggagtacttataaaatcatgctctatcagccacatcgtttgacgtgctggagtaatggttacaacccccactcgcgaacttggccgtaccatgctgccat

SEQ ID NO: 95080 - DNA, 1950 bp, Oryza sativa
catacgtaaacatggttacgaaggaataaggggtaaacaataatcaaggcatggcataatcgcaagtaggatgttcatcattgcatgcaattttatttgtaaacaaaacaatttcgcaattgggatcaacatgttcaaggaatagtgatgacttgccttgctcaaagtcttgcgggtcttggccttcacttggatccgcaactccctcgggctctatagtcacgtgcgaaaattgatttgaattcggttagaattcaaataaaaatccaaataaatccaaataaaagtcgaatgcgaaagtcgattcctttatattaactttactattcgtgaactaaggcaaacccaatttcgatttaaactattttgcgggtataaatattttgttgtcataagtttttcatttaatcttcccgagcattatatccatatgataggttagaaatttctatcacgagctaaatatcggacgaaatcatagaaatattatacgatttaatttagtatatgactaaattattaaatataatacacggctaaaatccctagtaattaaatctgaatttctaccgtgaatcgattacttatagagattacccaaaaataatctataataatctatatgaattcatttatttgtttagttattaattacatctaaattactgccgcgaattgatttcttatagaaattaccacgaataatccacaatttatattaaattttgcaaatctacgactataattaatctataattaaattctaattattttaaattttctaaacttccctagtctccctctaatttctttttattttcatttttttatttttttttcttttctttttctctcctcttttctctcctttcttttctttttccttctctttctctcctttcttttctttttccttctctctctccctcggcttctcccttcctctctctctcggttctctctctctccctacggaggcggcggcggcgacagcgcgcacggagggggggcggcggcttaccgacggcggcggtggcaacggcggcgcaaggcggtgacgcacggcgcggcggctccggggcgacggcgcggcgcacgaaggcggcggcgtggcggcacgatggcggcggcgcgtggagaaggaggagagggaggggaaatggaggggatgggtgtgggatggagaagggaagggccggattttataagggcacgggggaggggcgggcggcctatggcgacgcgacgggcggcgtggctagcggtgatggcgacaggtggccggcgcggcgcggggctcggcgcggctcggcacggtgctcggcgcgacgatgacggcgatgcgacgggcgagcggcacggcagtagcgcggggcgtgaggcggcgacacgatgggcgagcggcgcgcggggcgagcgacgtgacggcgggacggggcttgaggcgacggtggctcgcgcggcgcggcagcgggatggcgatggtgacggcgtggcagcggcggcgcgtggctcggagcgacgatgggacgtgacggcgacggcgcgcggcggcacggggcgcgagacgaagggcgcgcggagcgaggtggcgcggcgcagcagcggcgcggcagcggcggtggcgacggcgcgcggcgacgcgacggcgacggcgacggcgcggcggcggcgacgcggggctcgggtcgtggccgggcgcgcggcagaagagggtctagggctaggggaccacgtcgagcacttagagtgtaatgaacagtgtctttttcctatttctctcattttagtctatttcttatataaatttgcacacatacattttactcaatatttgtgttatctcaactaatgaattcaccctagattaatattactcatattttatttatataatttatttgaatttttaattagggttaattcttattccatcgcattttaaattta

SEQ ID NO: 95081 - DNA, 1678 bp, Oryza sativa
cagtcctaccaatggcgacaccgatgtagggcacgcctctccgcctacctcaacggctgtcccaccgtagcgcacctgcctcgctcaggggtgaaccatctatgcagggatactgcctccgctcggctatctaatccgctaggtctatacccatacgagaagtgcggttgtacgggggtcgtttcatgcttaacttcatggcttggtccttaattgaccggggacggtaatagcgttttccagataccacccaaatcctccgtccgccccagtcgaaaacagttgtttagttttatttctcctatcgcaaatcatgtcatcaatatcatggcaatgtggtgctcatgtctccacatgccgcatctcaattaccttcccaaaggtaattgcccaagcatatagcatttgataaatatgagtatgcatgattctagaatagcatttctaagcatttgtcatagttgactaaggactcatacgtaaacatggttacgaaggaataaggggtaaacaataatcaaggcatggcataatcgcaagtaggatgttcatcattgcatgcaattttatttgtaaacaaaacaatttcgcaattgggatcaacatgttcaaggaatagtgatgacttgccttgctcaaagtcttgcgggtcttggccttcacttggatccgcaactccctcgggctctatagtcacgtgcgaaaattgatttgaattcagttagaattcaaataaaaatccaaataaatccaaataaaagtcgaatgcgaaagtcgattcctttatattaactttactattcgcgaactaatgcaaacccaatttcgatttaaactattttgcgggtataaatattttgttgtcataagtttttcatttaatcttcccgagcattatatccatatgataggttagaaatttctatcgcaagctaaatatcggacgaaatcatagaaatactatacgatttaatttagtatatgactaaattattaaatataatacacggctaaaatccctagtaattaaatctgaatttctaccgtgaatcgattacttatagagattacccaaaaataatctataataatctatatgaattcatttatttgtttagttattaattacatctaaattactgccgcgaattgatttcttatagaaattaccacgaataatccacaatttatattaaattttgcaaatctacgactataattaatctataattaaattctaattattttaaattttctaaacttccctagtctccctctaatttctttttattttcatttttttatttttttttcttttctttttctctcctcttttctctcctttcttttctttttccttctctttctctcctttcttttctttttccttctctctctccctttcttttcttttccttctctctctccctcggcttctcccttcctctctctctcagctctctctctctccctacccgaggcggcggcgacgacagcgctcacggaggggggggggcggcggcttaccgacggcggcgcaaggcggcgacgcacgacgcggtggctccggggcgacggcgcggcgcacaaaggcggcggcgcggcggcacgaaggcggcggcgcgtggagaaggaggagagggaggggaaatggaggggatgggtgtgggatggagaa

SEQ ID NO: 95082 - DNA, 4187 bp, Oryza sativa
gaagatggtctccaatatgggttggagggagaaatgactccggacccgttagagaggcatgcacaccgtcaaggagacggaattacttgctgccaagctggacctcctcatgcaacacttggacgaccacgagaaacggccacaaggcaccgtcaaggccatggactcacacgttacgtgtaaggtctgtggcggcacgggtcattctgggaatgactgcccagaacccgtgaggaggcgatgtacatgggcaacaacaaccacaacgggtatcgtccataaggaggacaggggttgaaccagccatgcccatactatcaaggaggcaacaacaacagtaacatctctaacatactctaatcttgtttatgtaattcgtcgagttatcatatatcttacataatctctgataatatcgctacctaacctacagtcggctaacatctgttactagaaggcagccgattaggttaaataccgatgttgacttaaattatataagatatccaccactctatgacacatccaacggcttgattgtctagatattgtcctttttttcatacttatacttgtattagttgagtttgatcttatgagtcgtgattagaatcccaatctctagcctgtctttggttgctgattagggtagtatcggagtttcagccgatcttacctgatttaactacatttatttcatatgcttgagtgacatcttaaatatgccctttatattaagatcttgtcgcatttaagtatattaggctttcgtttggtatattttatttgctgtgatatcttaatatagagtggtatcggagtattagccgatacatgctagatctatcttgatcggctatgttatgaacacatatagactcgttattaatatatatttcgatctaagtgatttatactgtctcggcgtggcaactgatctatcccaatcacttgatttaagtatatatcggtataaggactatataccgttaatatctacagccgatcgagtagatttagttctttcttatttattaatgactgctgatcgatgcatatatgacatcggctcaaagataaatgatatgtcatcggcacttagccgatcggctatcatttatggatttaaccgcggtttctttatttttgttcttgttgattgcaggatcaaatcaactggcacgctcatacacctaaaggcaagcttttggacctgcactgaagttaagcagatctcccaggcctcatgtttttacatcaacagaatggcaacagtctgctgattctcagttcgccaacatcaacaacatgatgcagcaacagcacgatgaccttcaagcgtacttccgttttcaggggttcaatccttatcaaggaccctgagcgaaagccaagcttggggaagacacctctccccctccccactaaggtaacttgtatcacattacatatttccctctcctattgcatatttgctttccaattgcgtcttataaactgaaaacaacataaaaatttacaaaatagaaaataccaaaaggataggataggtttggatcatgctaggtaagacaagctagttctctttgttgaaatgatgaatagttgctctgttttatatctcttatatatgggttcataggtaagtgctctctcaaaggttaaatataagtagccaacaattatctaggaacctgaggtaaataggctgcacttgctaatctgagtctaggttgttgcgagatatgagatagtaaatgagagttactatgatcttgatcctagtttgacttaaatttcggatgttttgtttttcaaaatgataaatttgaaagttcctcaattgatataaattcctaccagagccaaaaatgtgctatcatgattgagccatttaaattttggttacttgccattccattgaactttatcaaactcttgagacttgtgtagatacttctcatgctctatgatcaagatcatacacccacataaatgtacatgccaaactcctacactgggagctaagcaaatattccattccattccatttccatgttaccaccaaaataaattctctatgctttcatgtgctttcttctcttaaaaagaaaaatccttttgaaaagaaaaagagaagggggaaaggcatggttataaaaaagagaataataaagttatgctccaccaagcatgagcatgatattgaaaaaaaaatgtagccatcccctctcctaatcagtaaaggaaagatttttgggagaagaaagtaagcacaaaggagaagcattttctttattttctctcataaaccatttccaccatatatcacacacacattgcacgatcttgatcttgagtatgtttagttatctgctttagtctaagcttttgacttagtaataaatgtgaatgcaagtatgccatgtttgatccctactgagttccacatatcaaaccttagagtagaaattaaaaaggcaaatcttgtgaggaattcatattgatacacttggagagactgagtggattatttgaggaacttggctttcttttgcaaaatcatttgaaaactttcggaataagagttgaataaagattggatgattggtgctctaattgttgttctatctttcaaccagccaaggcgaggagtagcagtgtcacgtgggaatcagggataaggataagccaccgcgccaaagattatttaatctgagagagagtgcatataccttgcacctgtatcttagagatatacagcatagtagcaactcctcagcacccgtacaaatgtgtgaggcaggttaggaaccaactgaagatgcacccggatggactcaagctccacgccacagcatcgtagtctcaaactgggcaagtgtcagtgaggaccgatggcatgcgcctcatgacatacattggggggggacaaccaaccttccagatcaagtggtgtgcctccatctccaagtaaatggcgctcgagttcctctcattgggacttgggtgaaatcactaggagaatggacacccttgatatgcagacaggagagatccagtacaacctcatggaaaatatagcacaaacgcaagaatggcaacaatctgttgacgctgagttcgcaaacttcaacaacatgatgcagcaacagcacgatgacctttaagcgtacttccgcttccaggggttcaatccttaccaaggaccctgagtgaaagccaagcttggggggggagacatctctccccccactggggtaacttgtatcacattgcatattttcctttccagttgtatgttttcttttcaattgcatcttataaactgaaaacaacataaaaatttgcaaaatagaaaataccgaaaagataggataggtttgagtaatgctaggtaagacaacctagttctctttgttgaaatgatgaatagttgctctgttttatatcccttatatataaggttcataggtaagtgctctctcaaaggattaaatataagtagccaacaattatctgggaacctgaggtaaatgagctgcacttgctaatctaagtctaggttgttgtgagatatgagatagtaaataagagttaatatgatcccgatcctagtttgacttgaattccggatgatttgtttttcaaaatgataaaatttgaaagttcctcatttgatataaattcgtaccagagccaaaaatgtgctattattattaaaccatatacattttggttacttgctattccattgaactttgtcaaactcttgtgacttgtgtagataattctcatgctctatgatcaagatcatacacccacatatatgcacaagctaaactcctacattgggagctaagaaaatattccattccatttccatattaccaccaaaataaattctccatgcttttaggtgctttcttctcctaaaaagaaaattccttttaaaaaaagaaggggggaaaggcatggttatgcttgatggagcatagcattctcctaaagttatgctccataagcatgagcatgacattgaagaaaaaaattgtagccatgcactctcctaatcaataaaagaaggagttttgggataagaatgtaagcacaaaggagcagcattttctttattttccttcataactcatttccaccatttgtcacacacacattgcacgatcttg

SEQ ID NO: 95083 - DNA, 1887 bp, Oryza sativa
atcttgcatcagttaggtagaatcaatgatcaaacgagaagaaagttacaagacattttcagctgaatcagcaagcaattactagtactccttccgtcccaaaataagtacagttttacattattcacgttcaacgtttgaccgttcgtcttatttgaaaaaaatttatgattagtatttttattattattagatgataaaacatgaataatactttatgtgtgactaaatatttttaaatttttcacaaattttttaaataagtcgaacggtcaaacgttgagcacgaatatccacggctacacttattttgggacagaggtagttctactttagtgattaattagaacggtcaaatcacaagaaaaatccaaaattgaaataggatgcaagctaagcaaacatgaattggtgaaggttgcaaatgaagaatagggtgatggactgatggtgatgtacagaacgtaaagccgtttatggtgactcagtcacatataaacaacatagattcatgtcttgaaaagtagagattgtcacctgaccgacttggcactgttaacatcagagaactactgagctgttttctcaaaccatgtaatttacaagaagaccttgatataaagtattgcatacaattatttgttcaaaatcatatttatcattagggcaaggaaagcccaaaggtttgaacagcactggcacctcggaacaagaccgaccattgcataacagagatataagcagagggtaacaattaattctcatacacactaataagaaatcttaaggtgataagttgagctaatctgcattgaacattagataacacaataggtgtagaatttatttaagtttatattttgaattagcacagtttacctccgggcacacacatgggaggatagcatatgcttttggaaaccgatcaaagtcaggacgcaaatatccacttgattattcaagcagtgcataacttaagcatgatttattgtaaatttcataataaatattaagaagggtgatgctgttggccaaacaatattgaagaagcatgaaaaggagttatatctcttgtttgtttgttttttgagatgggaattacatctcttgttagtacttgctgatgagacgtttttttttccatcaatgtggtaaaaagaaagacaacaaaaattaaatgcacaaatttaaacaacatgcatttttggttgtctagagaacttaaaagcctacccctgctagaagtgattacaaatagttacttcatttgccaggttggttaataatcagagcttgccatgataattaatatatgcaggaaatgaaatgatactgaaaatattttcaacaagggtcaagggagccgtgcttccaaagtttagttccaaagtttcaacaagggtcaaggctacggccctgtttagttccaaagtttttttttcaaactttcaactttccatcacgtcaaacctttcatacacacacaacttttttatcacatagtaccaatttcaaccaaacttccaaacttcggtgtgaactaaacacagctgtattctagcaccttgaattcatttgggacagaagttccattgaaatctctgttcctctgtaaatatactactccctccatcccataatttaagtgattttgacattttgcttgcactgtttgatcactcgtcttattcaacaaatttgtgcaaatataaaaaacaaaaagttgtgcttaaagtaatttggataataaagtcaaaaaaaaaataactccaaaattttttcaataagacaaatggtcaaacagtgcaaacaaaatgtcaaaatcccttatattaggggacagagggagtactatcagtgtaaaaaataaagaatgtgatctaccag

SEQ ID NO: 95084 - DNA, 1103 bp, Oryza sativa
cctaaccgctttcaatgctggcaaagtcaacgcgcgccacaccgcattaaatgcggtgtggtgcgcgcctgataggcctgcgaccgatcgatcggtcgcaggccgaatgacggatgggacggtgacaacccgcccacgcccttaccgcgtgtcaggcagcgtgcggcaagtatgccttgtcccatcgtgatgatgagctccctcgagccactcaccgcaaccggagtcggcgtggccacgccgaacgtgccctggtttgtgtatccggcgcagtcatgccccccaagtccttgttcattaaatgatcattgacgggggcatcccctgtgtcagccgacacgatttggtgggccccttacgacagccgatgcgaggatggcttctgagctaagacacgagacatgcatttaatgcagagaatattttcttcctctctaggtagctcttgaggcacatgtggtaacctcttgatgtataaaagaagatctaggcctactgaggaagggattagatatcacaaactctgaggagaggctgagcttgagccttcccaccatagattcagaaactttgtaagctccaaaaaacatcatatacaggagtagggtgttacgttccttagcggcctgaacctgtcatctcttgcatctctctcatcccaggggctgaccccctcgggagtttctttccctttttcccgtttcctctatgttcacccgctgccccccgccgaactaacaaagggggaccgcgcagtcccccgctagcagagttcatcctctgacatattagtatatctattattataaaattataaaacatgaatagtactttatacgtgacttatgcttttttagttttttttaaaaaaaattaaataagacggacgatcaaaattgagcacgaaaacttatgtgtgctcttattttgggatggagggagtatttgcttgcttgctcacaccgatgccccaaactccaaaccaatcttaagtctcaactgttcgtgcggatgttggctacgtgtgcgtgcggttgttggccgcctccattgatccctccgacctcaaccgtgtcgagggtatctacattgcccccccccct

SEQ ID NO: 95085 - DNA, 637 bp, Oryza sativa
gtcccccttacgtttcaaaggagtgacaaggttgaacgtgtttccctcgtcgcaattactttttagttttcgagctcgaatttgggtaaatgctttcgagcttttttttatgtcgtgttttcgagctaaggcaaaaccttgttcgaaaaccgccgtcccccatacgtttcaaaggagtgacgaggtcgaacgtgtttccctcgtcgcaattactttttagttttcgagctcgaatttgggtatatgctttcgagcttctttttatgtcgtgttttcgagctaaggcaaaaccttgttcgaaaaccgccgtcccccttacgtttcaaaggagtgacgaggtcgaacgtgtttccctcgtcgcaattactttttagttttcgagctcgaatttgggtaaatgctttcaagcttttttttatgtcatgttttcgagctaaggcaaaaccttgttcgaaaaccgccgtcccccttacgtttcaaaggagtgacgaggtcgaacatgtttccctcgtcgcaattactttttagttttcgagctcgaatttgggtaaatgctttcgagcttctttttatgtcgtgttttcgagctaaagcaaaaccttgttcgaaaaccgccgtcccccttacgtttcaaagg

SEQ ID NO: 95086 - DNA, 586 bp, Oryza sativa
agcacctggcggcccatgaacagttgcgccaggaaaagaaaaagaaagagaagagaaaggataagggaaaaaggaagggttaatctgtaaatttgccaggaaacctaatttaacatttaatatccaaaaatctagattttactcaaaagttgtgatggcacaattatatttccattgcattatttaaattaggtttaatcccaaatattagcctagacaattttgggggcgttgatatatcttaggagtttattaaaataatctaagtagacatagtgatggtgtgttgctccattactttacacgaccgtttattttatatgaatgaattttatgccctgagagacttgataaagtgttttaaatatttatttaaatattctagcgaaacactcttttataatgggattagtgtaatgaggtggtcattatttcatgtgagattggattcagatgaattcgatttaatcttactgtttccatttgttaaataatcaaacatggtttgaatatttaatatttgatttgtaatttatccaatagaaattactccctccgtttcacattgtaagtcattctagcattt

SEQ ID NO: 95087 - DNA, 638 bp, Oryza sativa
tcccccatatgtttcaaagaagtgacgaggtcgaacgtgtttccctcgtcgcaattactttttagttttcgagctcgaatttgggtatatgctttcgagcttctttttatgtcgtgttttcgagctaaggtaaaaccttgttcgaaaaccgccgtcccccttacgtttcaaaggagtgacgaggtcgaacgtgtttccctcgtcgcaattactttttagttttcgagctcgaatttgggtaaatgcttttgagcttttttttatgtcatgttttcgagctaaggcaaaaccttgttcgaaaaccgccgtcccccttacgtttcaaaggagtgacgaggtcgaacatgtttccctcgtcgcaattactttttagttttcgagctcgaatttgggtaaatgctttcgagcttctttttatgtcgtgttttcgagctaaggcaaaaccttgttcgaaaaccgccgtcccccttacgtttcaaaggagtgacgaggtcgaacgtgtttccctcatcgcaactactttttagttttcgagctcgaatttgggtaaatgctttcgagcttctttttatgtcgtgttttcgagctaaggcaaaaccttgttcgaaaaccgccgtcccccttacgtttcaaaggag

SEQ ID NO: 95088 - DNA, 812 bp, Oryza sativa
ttacagggaatcggggtgctggtcatgcatcaaggctttggtttattttagtgtgtcgactcgagagagctgggaatttgctgtgtgcttatgactttgtgctctgacttttgacttaattatgtgagaaaatgatgcaagtagaacttgcctttacagtaattaaaaccacagggtgcctgctctgtagatcctagaggccatttccataactacaatactcggcttctcaaactaaccaagccgctgttaatcaccagttctgaacaactcccataggacgtttgctgcaagctcatgcatgatcttgcaggctttcacctgctaaaaatatttgcccctgacgcatgtcctggaacacggggggaatcaacaaagaaagctactaaattatgatcgctccaatgctgcatcacagccgatctaatggaggtcggctggtcgaatttgccgatgcacgtatccatccaccatggaacgcgggtccggcccctgatagtatattggcgttgatcattcagagaagcgtaaaggaagcaggaaagaagcgacgagagtgtacaggcaggatctcgagtggggctcgtgcgtgtgtgcatgcccggtgtccgtgtccatgagctccccaggattcacctgggcgaggtcatttctcaggcaagctgcattcgggggtggctggatccggcagccaccaaatgccgtctccttttcttgcacctaagctggggttattaggaggtcaggaaaaaaacttcttttttgaacctcgatcaactaatccatcagcctgtgtttagcataacacggcc

SEQ ID NO: 95089 - DNA, 1243 bp, Oryza sativa
ttggttttgaaggaaaggagataaatagagcactcagaatacgagattttcacggataggtatttcatcagttttgaacgccacgtaaaaaacggggcattacactagctataatctcaaaagaattgtaatttagtaacgtttggtttggctttaaatccactattcacaggatgagaatccagagctgaagctttgtcgtaaaggacagtaatcgtgccctctggtaggcagtgcacctatttgctcgaaaacttccgtaagtttttttttttccttcaaaactattagatttttaaccattggattacctcgagatttgcgcatgaaagaattttttttctagaaataattttttacacatatcacgcgtaagaacatgatgctaactaatcaaaccatacttgaatacaagtttatataagttactatatcgtagttaccatgtaattacagtacagttacaatgtaattgtgtctcaattatatactactattgttatatgtgaaagtttttcattaaaagaattgagacatttttttagatactcccgtaccaaagttactaccactatataaggaaacatgcaatttatcaaaattgtagtaaaaactttatattagactgaaatcgtcttatatccgtgtgcatgggccataactttactcagttaaactagtttagcggccgtccatgaaatgggcctggatttagcctatataaaataggccgtacatgggccgataattggatctgaacgatactctgaatattaaattctcgcggagatgcgtcccgcccgcccgtgacgcgtacagccgtacacccattcctccacgctgtttgctccccgcgcgccacgaagtagagtactccatctcccaacgattaatgccaagtcaacaagcaacaattctttttgtcgaacaccagcaagcaacaaatcatccagtcagcccgaacacagataatgcagccgtcgcaacgatcccgccggccaccgaggttgagccgccgcaatgccatccggcagtcggcgtacgtggcccggccggcgtcacagctctcgccgccgtcggagtcggaccaacccgccttctggtattcgacggaggaatccgttctggaggaaagggttgtggaagatgaggtcggagatcatgcagaggcaggtggagccgaggcggccgcattggtggtggaggaggcgtcgacttcgagctcgtctgcggtctctgtcca

SEQ ID NO: 95090 - DNA, 636 bp, Oryza sativa
catgaagacgttcgccgggctggtccgcatcatatcgaccggtggctcgacctgacggatgggaagacgacgcacgcggctcgtctgcgaggtggacgtacgtcgtcgccgaaccatgcgaggtgccgcgcgtcctcgcgctccacctcgtgcccaagtggctcgtcaccgtcgtgctgcggagacgcgacgacgacgcctccgatgacggctgtgacggcgagtcggctaaggccttgttcggcacgcatgtttccaatccaggccaggaattgatcaaggccaggtttcagtggatccgggtggattcactggaaccacctgtggattgaatccattccttttttcaatccacctcttcaaaaatctgtgttcggtttgacctggaatggaatgaagccattcaagctgccgtggattgtcgatcgatcagatccagtgattcagaactcaaaacattcagttaatgtcatcactcattagaattcagaatcatgcacatttctaatttctaacagtaatagtatattgcaggagttaattaaccaaaattcccaaatagaaagacagggaacaccctgaatagcatcaggacaattcttcaccatattcagttgctgtcatcattcatcagaa

SEQ ID NO: 95091 - DNA, 970 bp, Oryza sativa
ttcatatttggtgaatggtgaaacaaattccatgctgatacgatcgaacattgaagtcgtgcggattatctaagcggaaaatgacccttgattttgacaataataattaagcagaagattgcatatagcctagtggctacagtgacctgagtagtaccccaaggttctgagttcaaattttctatggagcgaatttattgtttgcagaactaaattccctatttcaatggatgcatatattcggttggatatagaggccgggtaaaaaatacccttctaaaaaaagaagcagaagactgcattttggccttgattttgtagtagctagaccgtggacaaccgaaggcgacgcggcgtcggtatcccattccagaccaccatctaggtggaataagttcactttaggtctcttaatttttcgcttggtctgattttcgattttgaaaaaaaaaatagctagaccgtggacaactgaaggcgacgcggcgtcggtatcccattccagagcaccatctgggtggaataagttcactttaggtctcttaatttttcgcttggtctgatttttgattttgaaaaaaaagccagttacaatggatccaggagttgaatctggagtgtaattgttgagtagtctaaacctaactttgcctctctagttcattttataaaaatgctccaccgagcttcgcgagctccgctcttgttttagctagagctacaaatgtttggttggttcagctccaggacatgtggagctggaacccacaaattggtcagcccacaattgctgaggccggcccaacatatcggcacagttcacgggaatctggctcaggcccagatcgtcgttactgggctggtagtttgtggtctgtccatagcgcgatatcagcccaacattcgcgacgtgggaatccagttccgaccaatatttccgcacgtaggccgcattaccgttccggcccat

SEQ ID NO: 95092 - DNA, 686 bp, Oryza sativa
tagtcaggactcaagaacatagatgaagagcatcatcattttttgagtcatgacagaatagtttataagatggatttgtttagttgataatagttgagcaactgttgcctcttctgcagtcataagggtagaggtagactacatcactacactaaaaattatcacaatcatgttctactcttgagtcttgaccttgcatcagtgtgcagattatagctttttttctgaacagcattgcatgacttacttgtatactccaaattaggctaatacaggtaccaaattaccaagtataaaagccttaaaagtgtttggtcttgtcatcattatgatttattttcatcaaatagatcattatgattattgtctcacataatattatggacaactaattaagagctttctatttgtgacacatgatcttgttctgatatttttcctgggatcaataaatttatagaaagtaataagcatatcatattcattgctttaaataaaatacaaagaggttataggggactatgaggtatttctgctggcttgtgtgtatacagtatactgaacaagcagacattattaagtgcacactagcactgtataagagctttcccagcattgttgtcatcatgctgagcaattgtcattctttagtcctaaaatatcatgaactatcagactaaaatggg

SEQ ID NO: 95093 - DNA, 1597 bp, Oryza sativa
aagaggcgacggcatgcggctggcgacgcgagaggcgacggcgacgacgacccgcttcccatccgacgtccacgctctccgccgccttctcgccagtaacgcatcaccgtcgacttccttgttcctttctctccccggcgctagggttgttgcttgctagggttcttggccaccgcctcctcccctgccgctgtagcacgccaccgccgcctccttggtttttgcttgctagggttcttgtgctgctgctgctcttcttccgcccaaatgagggctttccaagggctggtgtttgttggggattccgatccgcgtagggggtggggatgggggaatcgtgatgggttcttggagatttggtctgtggtttaggttcttgcagtgttgcgggggattcttggtggaagagccctaggttcttggttctgtttcttgccctagatcttggctgaaggatcgatgtgttgcatagccatggatctgtcaaccagcttccctttcagtttgtcttcttctcgaatgaaccaggaaattatgctgaaaaaaaaacatgtcactgtaagtggactggtgctccatctctgtttttgtactcacccaagccaggctaagtcaagattgttattaaattcagtgttgcataagaaaagatcctttgataaccagtttttgtcagttcttgatggcatttctgttcattattcagattttgataaccacatgtcctcatggattagctgctttttagcttggatacttaattttagccagcactggctgcctcaacaaactactatgctaattataaaccttttctatttcatctttctgtttatgattcattaaatcttagccattttccatcagatgctttggtcccttctccctttctctgcatatatcattgtagattgtccttgttccgatggggccatcctctttctctgaggatcatcatgcatgacaatttgcacctcataaccagaatttgcaggaagcttcaggcgttttcaacagacatgaaggcctggcattactgacaactattgttgagggtggtgaaactgcaatcctgctagtgatccattaacaaaccagcccctgttatcagcaaacatcattaacaagcatatttttctgctttatttggagaagaaagctttgcgcatcgatgctgaaatataaattgaactgcagtaggaagatgattttgttgcctcttttttggctgcctcattctggcaactacagtgcagtatcttaacatttttttcagctaaattgcctcttatgtagtctgtaataaatgacaacaacaaataggctcatatttttcaattacatctaagtcctggaataggaccattttctttctaagctctgggtagtttaggctaattaaaaaactcaaacatgtgaataaatggaaattctctgttcattaccaaattttcttttgaatttacttgatattatgttgtattagacttcacatatctacttattatataagccgacaagtttggttttttcgaatctgaagatatcaaatgttgtgtccacataggatagcccttttatgatgataacacaaatg

SEQ ID NO: 95094 - DNA, 537 bp, Oryza sativa
cagacaaggaagatcagccccgttttcttctagggtgcgaagggcccagaaggaagagtttgtgagaagaacaatatttgtcagtgatatagaccatactgtaagatactgatatttccatggattgcaatgcgatgaattttattttctatggcttgcatatatggagtaatttgtcacatccaaatataatgtgtgacacttcatttgtttctgaaagataataatggtatgcatttgtgtgtttcaggttactgaggacatgttagctgaactgttcgggagctattgcagcgtacgcctcttccttcccatgtgtatatatatgtgcctgagtaaacatttttttagctccactattttttttatccttttctttttgcgaaacacagtgtagatgcaagcgtttatataaacacgcgcacacttagcttcactagttttctaggtatataactgtgatatgtatggtgattgagtaagactgctttcgatatatatgaaaaacttttgatattgtgatatatatcattcata

SEQ ID NO: 95095 - DNA, 718 bp, Oryza sativa
caatggtataaaataacgggtccactaatttaagtgaaaatcgacggtgagatttaataatgccaagtggcagcctaggagcgtttgtaggatgccatgtggcagtttaggagcgtttgtagaaagtttaatggacttttagtatataatagatagatagatatatgaaagcatatgacttgtgaatatatttgggggatattttgttttttagttctgacagaattgggtggagcaccaagcccttgtttagttcccaactttttcttcaaacttccaacttttttatcacatcaaaacttttctacacacataaactttcaatttttttcttcaaactttcaattttagtcaaatttctaattttgacatggaactaaacacaccccaaaatggggtcatgtctagtcaagtcaattgtgcagaaaataaatgaaaactgagttaaaattctcgtagcactaaggtcgtattctttacacattttacacgtggatttttgagggaaaacgtgtaatatgtggaaagaataacatttgtttttctaacaaaccttattcatgactctccttcgcccatatctagaggagcttaaaattctaaaaaaatagctggtgagaatctagtggtagtaatatggaaaaaatgggtttccccatttctgtcttctagttcattttgtaaattctacaactatatatttcaaaatctgaggaag

SEQ ID NO: 95096 - DNA, 704 bp, Oryza sativa
atcatttttagcacatccattcttctatgtgtcctttttagtcgcaactgacaaataaaacgtgtccgaaaaaggagtcaatactctgcgattttgagacatacatgcaattccagtgttctgtttgcttgttcaaattattggaaccttcggcaggcttcttttcaagtgaaaactatgatggacctaactagcatttgccgggtgctgcctggagtggagtatttcagagacgcaaatgatttttcagaaaggttaggcctacacctgcaccgatcgagatgattttggaacgtagttcatgcaatgagggaacgagaattgcattactcgctgctctgtatttgcatgtaccaacgagggtccaaagaaagcaagaactcatgccgccgaactttactcgcagagagagatttaccaatactattccctccatctacttttgatagtcatattttatcttgacacaatgaccaaggaaaaataattctacttatcatccatttaaacatgctactaattattcctcgtaaacaagcgattcattaatatttacatttctcgatgcccatgtagccaatcttgtgtggaagaatggagagtcacgcattaaatcatagaaagtcattaagaggatagatgattgaattgaaatatggctatcaaaagtaaatttttcagatttggaaatatgtctatcaaaa

SEQ ID NO: 95097 - DNA, 752 bp, Oryza sativa
caatcttgtattgagtaattccaaaaaaatcaaatccacaaaatataatataataaaaaacattaagatatattttgtgtgtaacttagaagcaaagtacatacgtctaagaattctaattttcatatttattaataagcttaaattcaatttattccaaacttctgaatactaaactagtgattagaagtgcgaaaagttcttttgcacgataacaagtatggaaatgagaactgttcaatactccctctgtcaaaaaaaaaaagacaaacttaggtttccgtatcaaacgtttgaccgtccgtcttatttgaaaaaaaatatgaaaaaaaattaaaaaaacaagtcacgcataaagtattaatcatgttttatcatctaacaataataaaaatactaattataaaataatttcatataagacgaacagtcaaacgttggacacgaaaacccagggtttgtctttttttagaacggagagaatattgaactagtcaaagagggcacaaagacgtacttagacttgggtaagctgtcacaaacgcgtgtcatgcatacaagcgccggcttttgccaaggagagagtcgcggcgcgaaaaaacctgtatatcttataggtactgggtttaacttccatggtagcaaattttctagatttatcggagttgtgcttttagtggtaggcgacgtacccgtcaatagcgagatgtctgtagtgacttcgtcaatcttaaggatttgatggtctagtc

SEQ ID NO: 95098 - DNA, 518 bp, Oryza sativa
gctcgagatcacgagtgctttaggtatgacctaataatctaaagaagaagaggttctacttcacttcaaatcgtgatgcatactttgcaaggttatacatataatgtacgagatctctttgaactctaagatttttttaggatttcttaatcctttgcaaggttatatatataacgtacgagatctcttttgaactctaagttttttttaggatttattaatccctgtaaaattcagccagggaaagttgcagtgagccatcttgctcggttcatcctgcaggagtagtaacatttttctattttctttgtactcgtggagttgtggtccggcgtagggtcggaatttaggcggtagccgttgccttcgaaaaaacgacaagcgacggggcgtgggacatcttctcgtccgtccacgctgacaaatccttccttccctccctctagtagccgttggaagccaacccacagaataccactagtactagcaacgcctcgccatctgcgccccacagctta

SEQ ID NO: 95099 - DNA, 936 bp, Oryza sativa
aggctatgggtacatatatacttcttttttaacgtctaatgtataatccattataccatgtcactgactttgttacctgtctacgatttgccactgactttatcacgttctacaatatgccactccatttagaagttaagcaaaaatcgtggcatattgtataacgtggcaaagtcaatggcaaatcgtagacgtgtgataaagttcgtggcatataatagattccctctctaagaaatatcataaagacggggacaaataacaattagggattgaaacataaattacaatttaagagtggtctttttttaaatgtgtagtgtgattttttgtatggtcgtctgaacacgaatctaatggcacatagaaattaggagtaactgttgtttaaaattttatcctaacaaaaaatatatttttgaacggagagtacttacttttgtagtctaaaccaaccatatatttctgagaaaattgaaaccataccattataattttacaaaatttaagatatgccattctgacccacatgtcattgactcatgtggatcttacatgtcattgagataccgatgacatatctcaaactttgtaaaaattataatggcatggttataatttacccaatatttctctgcacgttctgcaaaagaactcaaaactgtattctaaacatgcgagaccgtatgcattacagtgtagatatacataggattaattagcatggcaaaggaactaatactggtcggttagtagtgtgagtccaatcacagagagcgtgcgcgcttaacggctaaatgacaatcttgcgaagggcctaaaaatggcgacgccaaggcggcccaaccatcttcgaaatgcggcccatgacgagcccacctctcctctcgccctcctcctcctcctcccgtctcctcctcctccgcctcctcctct

SEQ ID NO: 95100 - DNA, 1161 bp, Oryza sativa
atcttacgtagtacatgcgccacatgagaaagtaattaacttgatgttacaataaaatagtaattgaccacgccgaccttgcatcaccctgtaaaggataattaatggtaaggggcacagcatatatatatatagcactattggtcggcatatttatatgccacccaccatttaattttttttcaaccaagtaaatttacattttcttttaccaccacgaataaataacatgagaaatcagcaccagttaatttaccaaattaacatccctacaaacagggctataatagcaatatcctctttgtgactttttcaagggtttggctagtacataacatgttataagatgttttgactttggtcaaagtcaaactattttaaatttaactaagtttatagacaaatatattaatatttataatactaaattaattttattaaattaataattgaatatatattcataataaatttgtcttgggttgagaatgttactacttttttctacaaactcccaagtcaagactttgaccaaagtcaaaacgtcttgtaatctgaaacggagggagtagtagcaatagtacgtaggatgtagcagagtcctactttgtgattcattaaaaaaacatctttgtgactttttaattagtagacaacacctcatcctgactttatgccatgaagtatttgtagagcgagtacataggcggtgtagatttgagtcttagtgcatgcgtttattagttcttgatcctcgtaaagattcatggtttttttgttttcattggtgtgctaccttgatcagtgcgtttttgttttgttcttttagaaactttttttagcttagggtggggcgcacatacgtacggtggcgcacttttggtctttgcggcaacagggccgctgtccatctagtggaggcggatttcattgggtgaaggcgtaaagccatctccttcagtagtcatgcatccctcttccatcatcgtggaccacgctgcaggtccatcttttgacttcctttccttcatcaaaggcctcgatcaatggtggagcatggaaggtagtactccagtatgaaacatgatcgacaggtcagcatcaagtaggttctttgcgatccacaatataatctggtacttttgttaattcggccatact

SEQ ID NO: 95101 - DNA, 1983 bp, Oryza sativa
gcgacgaagacgagtacggatccgtcgtcgatcggtcgctgagccacctcgagtgccaccttgccctgtccaccccattctgcgccgcggcggctggaggaggagaggcgtggcggccggacgaggaggagggatgcgcgacggaggaaatcagaaggggagagggaggcgacggagaggcagaggagctcgagcatgaggtcgaggccgacattgattcggagctggcaccgttgctgctcgggctgccccactgctcggcactgttgctgcatggaccgtcccgccgaccgccgaatttgccgatagagagaaagagagaggagagagatggaaggccgaaaagggaaagaagaaagagagaggggaagatgaaaagggaaatagatggtactggtgggacccactataattaacttggaccgtggaatatgtagcttaacacgttcttcgtctaggtgatatgtaacaacaaatatgagggacacactgctattgccctataaagacccatagacgaattcctaggcaattgtagtgatgttatttgataatgcggtgaaactttctctctgtggttaggagagaaccaagcaaccgatcgagtcaatatgtttattttctgatattgacatgtttaattgggtcgttgttctaatttaatcgggttttcacttattctaattaatgtacttgacagggttacatcttcaattaatatggttgactgattgttaccttaattataaggtttacttatttataatgtgctccaatttaagaaataagtgcttttatgatcaacatacatccgcatggcaaatatcatcgcagttaaattcacaaattccttttctcatgattgaagaatcctactctcttggcctagaaaatattcactattgcatgcaattttcttggtcgttgtattcaacaaaaatcaacttgcctactggctacagcatagtagtagatcacacatactccatctatcccataatgtaagacatgatcaaacttgacacggtcttcaagactaatgtttgtcttataatttcttatatactataaggtttgtagtaacaaaataataatcatatgaaagtaaattcaaatgtgaattcaatgatataatttttagcaagtaaaatttaatttatattgtactaaacgttggttaaaatgttttgaatgtgaaatcttgaaatatgtgggaactttatattatgggatggagagagtatataattgatccagtgcctaattgctcaataaacaactagacctccaatctttcggtagaatatatgtttagtatatatagcaagcaatatgattgatccatgagagcttgcaaaccacacataggtgaatccacccctccagctggaatgaagaggacatcttgtgttattgttccttggaatagatgcctttgctcgtctaagaatttataaaagcatgattccatccaagcttaccacatttattctacttgtctcaataacagcaaccccagataattaataccagtactaagttatactagtggtacacagatggagacccctccccaatttcttaagagtaattaatcatccagtgataaaaagaaaactatgtacttccctctgttagattttctttatttggtacattcaagtcaaattaactttaatttgtatattttaatcaatagttagtttaattacatgtaattgtagtgtgtacatattataccaacagtttcatatttcaatatattggttcttacatttatcaggaatatatgttatgattaatcatgggtcaaattttagtcttgaagattttttttgaaaaacaaaacccatcctataaaaagtggaggtagtatatgaaaattaaaataataaagtcgtgatgtccctaagtaggagaatactaaaaaaaaattgaagaagctacatgtacatttattttattttaacaaaactctcacat

SEQ ID NO: 95102 - DNA, 1109 bp, Oryza sativa
tgcagtgtcataattgcaaatcccccagttatatatatgatcattggaaacacatgttaggtttagctcgacgttggttagtaatatattaccataaactcaactagccctgatgggctaattgatattttcctaatgtgtagtatagttatggtagaattatataaagttttcgactcgaaaaacttgcaataatttttttaggtattcccttgctttaagtataaattgattgcatgggactacctatttaatttaggttaagtttgctcggaaagatcggaactttaccctgacttcaattgagtttgcaggcatattagttttcctcctaatatagcatgggctcaagtcattgttgaccacacagaatatacgagcaaccagaaaagacgctccctctcaactcaaatgcgcatacaactaaacacaaaggaggctcaagttatcccttctctgatacgcagcttacacacgcatggttatattctccataaagcccagcacgcatgagacatattccatggaacaaattgggttttctgcatacataagccacacgggttttctgcatcctagaaaccaataatattggcgaatcatgtgctcgatcgaccacaaatccagcatccaatccacatgcaattccactcacacgcttaattaggccggctatactacatggatcggcgcatatgcgttccatgtgcagatgaaatgacatgatgcatgtacattgacatccaccaatggttaccatcaagtcaaccacaatatatatcatgcgtatataaattaaacagcttataaaccatacattatgtgtgtccgtcatggcctccttatgtggtggatatgtcaacaaggactgtagatgctttattaattgatttatcaattaattgttagtgcatttcaagagtcaactccataggtcgcatgcagcactagcaacagatatagctacttaacactatatcagagcatgcctccagccccaatcaatctctctatgatagtgtgaagcccaactccccaacaatttcattcacacgtgatacatatgcacacgcgtctaatttgacctgctcgatcgtctaaattttgga

SEQ ID NO: 95103 - DNA, 554 bp, Oryza sativa
ataaattgatctatatggtgacaccgtcgagattatttgtagaaagttccataaacaagaatgattattagttgatacacactatcagacaatgattatactaacaaccaaagcatagaggtagcggagaacaaatcatgttaacgattgctacaaggaaaagcaaagtgggtttaattttgcctttttgctggcctctcagcattttgtccagctatgaatccatctgcattagctgttttaggttttctattatatatattttacaaaaaacaattgatgaacatataattgggttgcgatctgtaaccataaacaggtgaaaatgtatacgtataaacccggagtaataagaaactgatatgtttttcccactatatacgtgtgcttatgtacacatggtgcaatactatatatcaacaacgagggctcacaatactgaccccaacaaaatgtaaaaaaatcagataatttctaccaattttgatcaaatttactgttttaaaattgattttattgaaagccgtttgaaatcaccctcgaaatctgacttc

SEQ ID NO: 95104 - DNA, 676 bp, Oryza sativa
  unsure (1)..(676): unsure at all n locations
acttagagcatcactagcagtacccctattccattcccaatcatgattttttaagattttagttgaaaaaaaacaatggccaacagntattgccctgaaaaanttggcaaggtggcgtggcggcgangangagangtgttagtcannctctcatccccgcgtatatcgagggctcgctcccaaaattagctcgcgcgccttctctatccatcgatctcccggcagtggatcttgtagaggggccacatcaaggagcgagcactattggggcagaagctcactattgttttcggttgttagttcagtatgggcctaccttttagtttttttgaattaaattaaggctctctcttggagagatgggttttttcactacctattttcagtttaggaaaccgaataattaaaaaaagaagtggattattcacattctgttggtgatgctcttagccctcctaaaattgaaatgtttaagtgaaactgataattggcctcaattcaaataaaaaaggaataaattttacaaaacactagattttggggcactcataacacaaaaccctaggtattaaggtttgtttcgaagaaccctaggttttgaggcaaaatgttccaataaacctcattattagagactttgtactgtgtttataaattacatgggagggatatgtgg

SEQ ID NO: 95105 - DNA, 507 bp, Oryza sativa
taaaagcacaaaattcattttaaccaattaaaaaaaaagaaaacaaataaaatcccctcccctgccttttgggcttggcccaagccttcccctcctctcccgtgggccgcgtgcctcctccctctctcggccggcccgcgccttgcgaaagtctgctttacgtcccccggttccctcctctctctccatccggccgacaggtgggaccgtggaccccacctgtcagctcctcctcctacctctcgccagccaaccccaaccgccattgccggccacgtcccgccaaatccggcgccctcccgctcgcgccttcgcgcccaaaccaagtaaaatcggttcctcaccacctcctccaccaaatccctcacttttccccaatttttggcgccaaatcgagcccccacttcgcccacgatgtcgcccacgtcgccggccgttgcccgctcaaatccgccacgttcgggcacgatttctccttcccaatcctataaaaacgatccctggagc

SEQ ID NO: 95106 - DNA, 753 bp, Oryza sativa
aatgacgacggccgcggcgggggcgacggatccgatgccgccgccgacggatccggcaccggtgacgacgatgggtggcgggggcgatggatccgccgccggcgacgacgctgggcgacgggggcgacggatccgccgccgacgacgacgccgagcggtgggggtgacggatccggtgccgccgccgacggatccagcgccggcgacggcggggggtggcgggagcgatggatccgccgccggcgacggcgtgcggcgtggatgcggcgctccggtggcgggctagggtttggtttggggttttttcgattttattttttttgtttgctcaatttattttcgcatgcggccggtataagcaaccgcatgcgaaaataggattttcgcatgcggttgcgccggccgcatgcaaaaagggtgatttttacagacgatttcgtccatgcggttggcacaaccgcatggaaagatggttctcagccgtatggaaaaaccatatctgtagtagtgatctacccagaatattatttaatagattattatgtctattttataaggaaggtagctcttcaacacccaccctcctccccatcctagtaaacttaaaagcaaatattttccatttgagataatccattatatgccactgactttgtcgcacatctacgatttaccactgactttgtcacgttctacaatatgccatcgacttttgcttaacttctacgatttaccatcgccgtccggttagcc

SEQ ID NO: 95107 - DNA, 698 bp, Oryza sativa
attatttttactatggacaaatgggatcttgtgaagtggattcagagaaccatctcaaaggatgccaacttcaaagcaacagtggttgtcagtatctatgctgggttgaactttccaaaggttttggctcagatatattcagggttgataaggttgccatttgattaattagcaggtccatcctgcaaatcatcaacaattggaatgttgtcttgctaaccattctatcattctttgccaaaaaaggaaaaagaaaaagagaagccattctatcatcagacaacacttgctcttctagatatgagatgcaaaaaattcagcttctgttcaactccattttgatttgtctaataaaatttctgtccctaatatagcgcgctatgagtctatcttgctatttcacgtcaaaataattttcagtccctaagaaaaccaggttacaaagtgtcaatggagttgatggataactaaaaaatccggttgtgccaatgcaagagttgtggtaagatgacatgaccatgaaacagaagaaatgtgattattcttatttttcacaacagcgatgcttatagtcataggtacaagttaagaaagtccaacagagtacaataatttgtgggacctaaagatgaatttcttatgtttggagacttacatgtcaattcctctaaggtttaaacttaccattctttttgtca

SEQ ID NO: 95108 - DNA, 557 bp, Oryza sativa
gctccaccacgtggtccagcgcccggtcccgcacccacggcacccgcgcctccaggagccccctcgccgggacgcgcagctccggccccggccgccgctgccgccgcggcagccgcggcaggagggcgcgcattttcgctgcggttttgcgagggttttgggtgcggcgtcggcggcggcgaagacgacgacgagatgagcggatcggacggtgggtgacgcgcctgccgcttttagccgccgcgatgggtttttgggccgcccggtggcccatgttttggcccaaaatggaagcggaaatgaggaacagaaacttcgccgtgttgctcgcgcgcgcgtccatcccatccactccatatgctcgaattcgcagcgattcatttcatttgggggaaatttctccaacgagaagctgtgggtgattaatggcgtcgccatgaatccgatcaaccatccaggagcaccattaatggcggctacgaggtattcgtgaggtacacgatgagatcttcctcctcttgttctttcaccggagacaccaatctctctccgaattg

SEQ ID NO: 95109 - DNA, 687 bp, Oryza sativa
ttccggaatagagtcatggagctgtctaacttcacgtctagttcatttttaaagagcacatcactcaatttcactctcattttggatggagtttaaaccgtttggttgggattccgtctaagaggaaatagagctgacgctgtgccaaacgggccttcaaaaaccactttgtgcgttgtccgtacttcaaaagggctctagttgactagttcagccctagtactcttaggggtagatgtgtacgtagtgtgcttcttgaaaaatggctcagttctttatggcctacgttgccagtaatgaatatcagaaaaatcactggacaaatccgtgcatgtgtcagttatacttgtttcgttgtaagtaatataatgctatttttatccggtctcaaacactagtaccacttgttattttcagagagaggcttgatggagatcattagttagtttagcagcaactggtacccacaagtcagcaactcgatcagcgacggccaacaagaaatcaagtcaactcatactttttttttcctcgaatacacaggaatcaacttacatttcatactttagcactccgtaaaacgttgttatatttaactccgggagggaaaatatctcgtgtggtaatatattcttcaggttgttttcagctggtgctgctcggtgtgacactgtcctatctgaagat

SEQ ID NO: 95110 - DNA, 726 bp, Oryza sativa
  unsure (1)..(726): unsure at all n locations
atccgtttcttgataggtaagttatcttttaaaaatttgttcaaaccagtaaatttaattgtgtaatgcaagggtagctaactattcaatttccttaggaatttgtcaggtttttttgttcacctcttcatgtgtatatggaaaaaaatgaagaactgcatttactagctattaatgtaagccctgacaagcattgatcattcatatattatattttataattacaaatatttaacttataaataaatgtgcaggatggtgatgagctaagataatttttttttgctaaatctactgatgtaccaacaaaatgaatgtgaaaacaacatccctagcggcgcacgagattttcttaagtgtatcacaaatgcacaacattagggtagttctttacctatatggagtaatttaatttgaggtgatcatccttaggaanaccatatatatatatatatattatatatcctatcaattatagagagccaaatattaccagttcattgaaaaggtaattattcactatttttgtaataaagttatcactatcttcgtctactccattgacctcagcccctttcagcaagtcagaaagaaatgggttttcataatacactttcctatcggtatttgcttgctccctcatacaatgtatgtatgcactgatgatctattgattcaataaaaatctataattactaaagaatatcttggcaattaaattctaac

SEQ ID NO: 95111 - DNA, 578 bp, Oryza sativa
aatgcgcctacatgtgaagcatgacaaacagtgttgtccatgtaactaaagggaccaccaaacagtgtttggacccaaaaacatctgggaatcaaagttattaccctctttagttcatgcaacattcatatgcaaatccatctagttcatgcaagattttctcacaaatcaattgcagaagaaacctcaattctttcaaaaatatgtgtagcaatcaagcaatagcaaactgctcactaaccatcactccatcagagaacttgctattactcctttctataaaaagctggagatttctcttggtaaaaaaagggtaacaatcaatcagactgtgaaatgatgccttgaaaattctttgagatttcagatttgcaagctagagaaaataggagataatccaataattcccttgtgtttacagatccaacccagctatacatgcatgccaaaattcttcatttcaattaatcacctttttgatttacttatgcaaagaagaaaacaaaattcacataaacttattattattatctgacaaagatgaaaaaaaaaagaagcaaagaacctcacctgaaaac

SEQ ID NO: 95112 - DNA, 608 bp, Oryza sativa
agcagcaccatcccgccctcaaggggccggtctgaccgcgcatgtgccgccggtcagaccggccttatgcgccggtcagaccgccttcttgcggccggtcagaccggctagggcacgccggtcagaccgccactatgtggccggtctgaccgctcctggtcaggccgaacccagtgaagtgtgtgtgtgtgtgtgtgtgtgtgtaaaatgtgagcacaagtctaaatgcataatgacctaatgtggcaattaaaatcatctctttgctaggtcattacccctcttaatagtacggcgaaactaaaaataaactagcaaatttgatcgccctacacctcgatcaattctaaattaaagcgctagttttaccgtcttctttccctttgctttgcgccgtcaattttaatccatcgataaccatccatgcgcacgtatgacgtggacctaacttaaaatgtatagctcaaagacaacggttagtccacaattagcgcttgtcattagttaccaaaattaacaccgggggcctagatgcttcaatctctccctttttggtaattgatgacaaacaccacaaatatatataatcaaacatagagcacatggac

SEQ ID NO: 95113 - DNA, 2199 bp, Oryza sativa
aaaaaaacaggaacagtagctgaaaagaaattaatcatgtctgctaggctgtgcagtgtctgaaatctttccactaccaggatttcagcaacactgaaatcaaagcagagaaaattacaaaatactgatactgtatcactgtaataacaaagcaagggccatgactacaacaatagtagtgtgattgtgagtacagtgtggtcactggtcaggcaggctacacagacaaaggactcaaggacatgggcccggcctgcactactactctagctgaatgagacgtctccatctcacagaaccggcccagcccatcacatgcatgctatagtgctatactgcacactcaatgattagaaaagatcttgctactttgtactatgcctctaatatttacatatgaaataaagctggtaaagtagaataattttcacagaagatactgcggacttgctccaccccttctggtttgggtgatcaaagaatcttgttttgttatttgtaacatcatattaatatattatcactgatatatactagagagtagagattaggttgaatttgtgccattcaaactgttaaaaagaaggtgaatatgttctataagttttaaggaggcagaaaacaaaattgtagttgttaattctgtcacggttaacatgttaaaaattttgagcaattgtcatttgagacaagacgatctttgaattggagatgtgcctgcaggaagaacagacaaaagggaaaaaaaagttaaggaagagacaggtgatgctcatccagtctaatcatgtctactaagaatcatgtccagggaacagatgagctagcatcaagttctcccaagcacctctcttccacccaagaggccaagacaattatgcagattaacttacacacttcatctctcatctcagaaaacaaatttaatcagacgcttgaacctagtgaaacaaaagatattgcctagttgcaaggaaacatgaagtcccacatcttttcacttatgattatacttattagccaaaatttgaattttcgaccataaatttagagttgattttggggttttttcatcaaagtttatttttcagcctttgcttttagatcgctaagaatacgtatataaaagttttattcacaaactacttttcatttgcaaatatgccatttcagttattcccccgaataagtgaaacgataggtccggaaaatttctgaaaacaaaacaaagtccaaggaaaatcctgctactcatcatataatcttttagataatggattaaaccggtctctacatccaaacgaatgtacacagccaagctactcatcatatacaatccattgatcctctcttccagacagaagttttattttattattttttttaacaaatataaaactaatgcattataagtcccactggccaaaagcgtaacattacgaggttaagtgttagacttggtcatacacatacaactcgacccagttagagcctagagatgatttcatgaatattaacaattatacacttgcgtgtaatatcaaattatgtaaaactaatgtatggctcatggatcaagatcaaagaagaacatcaggaaattcagctactaagattcacatatgcctgaaaaaatacaccaacaccaaatcgggtatgacttgcaagaaacaaccagtaactttgtagtatgcatcctccacaagatgaataaaataaccacacataaaaattaaatcctatttatgaaagtattaagatcgatctacgagtctttagtccaacttgatgaataggaaattaacaatattgcaactagcgatataatttaatctattgagcaactgaaaaaaaaaattaagggggctatgagtttggagtgttatactgttatgttctgaattggacattgcacgttgtactcttttctatttccatgtggtttgttttgttcagttttacatatggatatgtcatagggtggaacttcaccccccctaattttttagcggttcttttcaaaaattgtggggagaggactgatctaagaataattaatagagtgaataaatgtatgcttcttgctgttctatgctggcaatgatggctaaactgagaaatggcatggtttccagagatgatataaattgcttttgacccccattaactatgatgttttggataacatttgttatgcta

SEQ ID NO: 95114 - DNA, 979 bp, Oryza sativa
  unsure (1)..(979): unsure at all n locations
ccaggaaaaagttcttttgttaataaaacaaagagaggtccttttttaaattaaatatccctcccactatgtgggacaagaaggataaggtttctacaggtgagcaccggaatccacacaactaaggatggtattggacgctaaaaaactggatctcttgagtgtcacaaaagttggttggatcatttaatttcttgggatgaaattgacaacttttttgtgtgctaatgggggacgcctcgcgaatgcataaggaccatatccggttgatccctatgaatagggaatggaggggatatattcttcaccacaagtgggtggaattattccccctcaattccctccaatcctcttcaatccccttcaaaccgaacaaggcctaagaataaggaatctatagacttcttaggattatctatgaagtcaaaccaaaatgttatgatcaaagctttgcaaacaaaatactattatatttcagaacgaccccatatcgaatattaatggtggatactgtgtgaatgcgtgataacttcactaacatttagcgatactggactaaacccaacaacaaaccctgtaagctagttatttaatttagcgaaagagcaactatgctcacggaaaaggacaaaggatgagagagatgacaaagaagggcatgaaaggaaagagagaatgagagagaggtgagagggatatatagattgagcctagggatgtgtgaaattaaaggctgcagggccttcacgaggggtggcacagctagcaagctgcagtatctccttctctcgctacttcacttctctcttctctactcgtttctttctccttgacactagtagagcagagagaagcagagcaggaagaagcaggagatagagagtatgtacatacactagtagctagtataggacatcgatcatcaatggaggggctgatgaactactgtcccatctagtggtccaattaaagncccacg

SEQ ID NO: 95115 - DNA, 821 bp, Oryza sativa
  unsure (1)..(821): unsure at all n locations
cgccctaacacgcaattaaagagatacatacaagcgtcgactttacagcgcttgtttancagnctgtgttnatcctcaatatttataccccctcnnccncnacgcaggcgacattgatgattgcnctgcacnnacnacannagcangaaaaaagcagctagcataangnaagaaaacgaagagncacaacanacgngcatnaattaacnatnaanccacgcacgacaangagggagggggcaggacaacccagcaaaacaaaggcggcaggcagcagaaaacaaaaccacgcgcgcgcggaaaacacccgngaacacgnacgnaggcgggaaagaagaaggaaaacgcaacaaaaaaaacggagcacccaacnaaggggaacgggccgaaacaaaagcgggagcaacgaagaccagcggcnaaaaaacaacgcactaactataataaacatgctaagtggactagctagctaagctaagctaatacagtacttctttcccacttgaccaccttagcttcctcctactttctcatactaagaaagaattcagaggcaaatttctcagccacctcgcctatatatacattccatgcctagcttaattccatcatccatcattacacaagtcactgaccagcagcgcaggctcattactcacgaagcatcaggtagctagcttaacttggacactacaccttcatagaacttagttaaataggttaaaatatacaagtggtcaaaggaagaactggaccaaaggcaatatcaaaggggcccgcgagaataaaggcgatcctccttccggcgctttttaatgccc

SEQ ID NO: 95116 - DNA, 1440 bp, Oryza sativa
tttggcattattttgccatggggatcaaatcatgaatgtgtgtattattgcagaaagcatgaatgccatcagaagtcaggcaaaattattttttacacatcttactaattcagatgcagcaaacactccctcaatagatgtttatcaaacacaaattatttcctacaaaaatgactggacatgctaaggacatatgtgaagccaattgagtctgtctagggtgtaaccactagagcatcctgcaagatttctatggaacctcagtggaccaacaaattctactaattgacagcaatgcaacaatgtggcattggcatctaaggtcgcctgtaaggttagcaatatcaattcattagttccattgaagaagggagttgctgttagtcttaacctgaacgaaaggtctcatctttttcctacatttcaaggatctaattgcactatctcaggttttgagaataagactccagctatgtttatgctgatttactaagaaagccaggacattacagataaatggtttcttaaaaaacacaatttttcaataacaatgactttcacaagatctgcattttagtgatattaatggatactaacatatatattgcatccacaggaaaaatcttccctaaagctactgaaagaaaaactgggctgtatggctgccgagaaacaaactgatacttgggaatagttcactcttgtttaaactatcttgttccatttaaatcattttgttcttacaggttattgcccttcactgcagactttgcttgctttgcaatcaaaagtggagcgatagactcaaacaaaacttatgatgataactatcaggctgccattatgtgttatctgtcaacatctgagtttcgggctgtgttgtttggtgccttcaaacaatgatcactaaaggtggatatgatctggtacctgttaatttgattcctgaagacacaaattcttatggtggagttaattaagcctcagtgaatgttgtcaggaggctggtaagaaccttgtcatccttttcgttaatgggaagggatggtcccaatacctccagagaattctggcatcattgatcttaagagactattcaacttttaaaaagatataatgccaggccaggcaaggcaagatctgcctttattttccttgctcagattggttgctttgatatacaaacaaacaaaacgttatcaatcatccgactttcattattgagttgatatttattgcatcgcaaatgatttcagcagcgcggctcagcgccagcacagacagagttgctgttgatactcttctatagaccataactagactgagagaatgtcactcagatgaggtaaataggcgtgtgtttggttctgggactaggtgggataggatgaaaccatctctgatttgaggattgggatgattccattcgggtgtttggtt

SEQ ID NO: 95117 - DNA, 1650 bp, Oryza sativa
tcatgagctgctgccgtcctatgtacgtacttgtatattttcttcctataccatacgacttattaattagagtttcatccgtatgtaacaaatattcattctactcgatggatcgatcggcagcataatgtaaaattgaattaaacgtgcccaagatcgatgatgacggacaacaggaagaagaggagaaacagaattaagcagagcagagtgctctgttaagttgcctttatcctgtctgtcctcaatctgcgtttcaacaaactctatcgcctaccttgtactccaattgatggcaacaaatttaagctgatgattcatatatgaacctaaatcaattagttattaacaacattaattagaataagatctgaagaagaagaagaagaagaggaggaggagggaggacaaaaattcaaaggtgggcaggagaacgagagatttgtctgtctgtccatcgatgcaagttcccatggctgtgggcatgaatttgcaagcaagcaaggaatgatgggtttccttgtacccgtacaaatctctctggcaatggctatggctatggcttcttccatcttttgaggaggcggcttcctccgcttgctcatccctctcaaccgggcctccgaaccacccaacaatcattcctcatatatgcccgtgcccacccctcttctttcaaggacctcaactactctcaaatcatccaatttctgattcctccattacaaacttcaccttgtaccatcctacttcatatttgttttttccgacaagtattatccagtactaatacttttaaacttggatgagttgatatgttttcttaattatttgcattggttcgatatatgtaaatcatacaggagcatgtacaatttgtcctaaagaaatgctacatgttcttttattttgaatagccgaatggttgaatagctgagtgaatttgtgatgattattcaaatgtacaaatgaatctattaagtagtacaaaattgaaaaaatgatttaaaaccatttttttaggaaatccatattaaaaagtttttacagaaatcgcaacgtttagaaactccagaagtatacaagtttatccacattctattcctcggaaaagaagtatacaaatttatccgcattctattcctcggaaaagaatgctcttattgaagttttatttggaaagccgtatcaatgtctaaaatggagggagggaggacggatgattcttatgaaagcacaatgccgttaaatcctgaaaaatttgctcccatgggaagtcaaacccaggatctaaggtgctattgagactcctgtaactactaggttacaggccctttcgcaaactcgactatccttagttgaatactctccacaaaattcgatctaaaatttaaaattatgacaatcaattttatattaaaataagttgataggtctggtaagtttataacattatgatagttaaatttttaggcaaattatttattttgtctttaaacgcttgtcaaaattttaaaaagcttaaccaaatcttattctgaacatgatggtgtatttcttttactagcctgaaggaagtagtttttttttaggattcttgttgaattggctccacaaacgagacaaagtatgttaatatcattacaatta

SEQ ID NO: 95118 - DNA, 765 bp, Oryza sativa
  unsure (1)..(765): unsure at all n locations
cgtgttcattgacttacacatgctcagtagttcatcacctagttacaacttactccctattgccacctgatcccatgcatcatctaccgattctgcaataaattccaccacatctctctctctctcttccttctcccaacaacacatcgagtaccaggacaacaacaagcagctaggttgaatagtctcattgcggttatgaaagggcaagtgaccttgcgtagtttttgggtgagaaagactcttttgtgatcgtacatttcatcaataaagaatatacattggattatatttttcacaattgattaatatatactccctccgtttcgaaattgagggaatnctgccgtttttttagtttaaattaaggaagtagtggtagctgaaatcttttagatcgatccaagttgtgaggcggagcataaaatactatgtttgaaacgtaaaaactctatttataaaaatttacagatgaaaattccttgtattatgggacggagggaagtagtcgttcatgaccactggttgatcatcgcatgagaagcctatttgatggttgagacgtgaaatctttggtcatttcaaagatctgtggtattgataatttgtcggccattggtaatttggctattttataatgcattcatggtgaacagtcttaattagtggatataatttcgaatttttaatccagaactttgagtaaaccctcaagtgtaaaactggcctctttccttggaattgatttccgccccgaacattgtg

SEQ ID NO: 95119 - DNA, 1556 bp, Oryza sativa
  unsure (1)..(1556): unsure at all n locations
cgtaggtggacnnctcctataaacnncaccacaggtacacattggctgcagcaggaaacctacgaaatcaatgcttgcattcgttacacactcatcacacatgtgctacatgttcacacaacacacaaagagagagagagagagagagagagagagagagagagagagagagagagagagagagagagagagaggtgcatcaccttcatgtaggatgtctagaatttcatctagcatgtctagaagaaacatgcatgggagcttgagcacaagaactcccatttaattctggcagatagttatcagtcaagtgcaattaacatagtactagaagttggactccatgtctccatgtcaaaataggtagatgcatatgcacctgcagttcactagctggtaataattattagctactagtaattaattaatcaagttaacatgtgtttgttgtcatggaggagggagcatgagctaatatgtcccatattacccctatttgcttattctccttccttgttctccccaaaattattatatacccaaagattttcttcttcttaatttgctcctgtgcgcgcccaatcactggcttccagcaagtagtacccatcggtagcgatgcaagtggggcaggcaatgattctttccctccctaattctagttaactctttttccaaattttgtactagctagccaataggaaataaattatgaagcatgtttttatgccggtagcgggattgccgacttgcatccttagccacaggagatggcccaacagccactatgtatagctagcattcatgccatgtccaacttgtgagaagaagggggtgaaataaaaggaagaatttggaacaccaatttaaggtttcagtgcacacttgtgatggtatatatactcctttagttccttttttacttcttgcatcaacaacactatgtaacgaatttttaatatactaaatattttgtatgtaatagagtgaagattttgagggttggttgcacgctttctaattaaatgaatagagtgtgcataaggggaaaaaatgatctagagcaataaataaaagtcacaaatcataaacgcgcagattaaggacaccacggaaaatcattaaggccttattcggttaatccccatgatggagggattggaggggatttattccacacctattgtggtgtggaattattccccctcaattccctccaatcctcttcaatccccttcaaaccgaacaaggcctaagaataaggaatctatagacttcttaggattatctatgaagtcaaaccaaaatgttatgatcaaagctttgcaaacaaaatactattatattttagaacgaccccatatcgaatattaatggtggatactgtgtgaatgcctgataacttcactaacatttagcgatactggactaaacccaacaacaaaccctgttagctagttatttaatttagccaaagagcaactatgctcacggaaaaagacaaaggatgaaagaaattacaaatatggccttaaaggaaagagagaatgatatag

SEQ ID NO: 95120 - DNA, 718 bp, Oryza sativa
  unsure (1)..(718): unsure at all n locations
tgctgtanagtgatcgactgttatgcagtagttcatcagtatggaaattgatgctggttccagcaaagctaagataaaagccagttctgcagccgttgaagtgacaccatcaccaccagtgctggcccagaacaatatattgagtaagcttaagattagttactccactagtttcctacctcatgaatttcgacatctgcagtgatccgcaaatagtggaaagtgcttttagtttactcagtaaataaatttagtttgtggctgtatctgcttcttggatgtgctcgctatctttgtttacttttttttccctcaagacactttccttacacgatttattaattggaaactcacagtgacaaaggacgttgctgaaggaaatgcgacaagtgaaaatgacaggccttcagcggtggacaatatggaagttgatgttggtgaaaacaaagctaaggttaaaaagaaccaggcttacctgtcggagcgatttgatcacgatgacctcgtcaattacaggatatatcggcagcgttgttttaaaggtgctcgtaggattaggatatgtgtgtttgtatttataaagatgagtatatgtgtctgtaccgcgtgtgttttttttttttttttttaaaaaaaaaacaggttcaagttagggtcaatggggtccgaccgaaccgtgccagattatatggacattggtcaatcaaggccctattcg

SEQ ID NO: 95121 - DNA, 3848 bp, Oryza sativa
tggagctgaggaagagatagagaagctgacaggccagaagtaagaattaaagatgcatggcatgcattttaattttatcgatatatatatcctttgttgtttcatatatatgtccgtcctaattgcaagggactccctccgtcccaaaaaaaggcaaaccgtggattgtcgtgccaatgtttgactattcgtcttatatgaaatttttttataattagtatttttattgttgttagatgataaaatatgattaatactttatgcgtgacttatctttttaatttttttcataattttttcaaataagacagacgtacgttggacacagaaaccagggtttgtttttttgggacggagggagtagtagctgctactactgtcagtcagtccggccggcgatgcatgcacatatatacgcatggtggagttagctttgtgatgagaaactttggaggtttccctgtaggttgcggcagctttattaacattctcttgtattcatgtactcgatcgtctagctagctgttagtctgttactgcatgctgatacaaaaatatgtgtatacatgatgtgcaacttctacatctacacatacatactccctccgtccccaaaaaataccaagctagacattgattagacataatctaggacaacgaatctggacagcatgtacatattcgttgcttaggtatgtcccatccatttataaattgtttttctttttagacagatgaagtacatatttatggggtaatttattagtactacaaatttagataaaacccacattatcgtaaaactataaatttaaaggtgggttcatcaaaaacctacacatagatattataaagctatatatattttactctctctgatcataataaatatttgatatttagaacaaaagattgattgagactttaaaatcaaaaccaccaataattctttaaatgcttagggcaaaaaaggtatatatataggtaggcttgtcttaaaaagtactatcacaatatcgtcaacttattagattttataaaaaaattaatataaaattgatggttggaattttaaaagtttatgagtactaatttatatataactcatgatcatcaggtgacgctttggtgtgacgttctatgtattattatatagggtaattctaccttccacttcaggcaatgattcataagaaagttttctgggattgattaaataattaagttgtatatcataattaattagcttttgcaagcagcatgtttgacctatggaaagtgcctgtataataataatattgtacttacagtaaagctagctcttttaattattttaccctgcatctgctaaactaattaaaaatcagctggaatgcatagcaagtggcatgtgtagggtgagttggttggcaaggatgcattcatgtcaggaggaaagacaagcttgcttcaaatgttagtgcatggcagccaactcgatgatgtcctcttaattaaaactttgctcccagctgaaataatatatatcaataatatcttcttctgtcctagtaaacaatatactgtctttctgcttcctcactctatattttatgcatgcatgtgcagagatatccacacaaatctgagctagctgcccatgtatagacatgtatatacagtcttgcatgcacaatctagcagcttatagctagctggacatacacatataatactacatgctgggtgccatgtgatgccccttaacttgattggaattgtttcctagattccaacttgcaatgcaacgcggccgctttttttttaaaaaaaaaaatcaatacatactactcaacaaaaagatagaaaaaaaaggaatataccacacatttgggtttgggtgtaacatgtacaatcacaatgtggatacaaattttattctgtccatctaggtatggacatgtagcaacatttttgctatgtgtaccattcattcatgatcgatctgcattgacaaaaattgaatgaagcagttcagtatgtgaccataaatggacctattcagatccagctttctacaagctgaagctgagaaagtaaaaaagaagagcgaaagaaaaggaagtcttggctagggcatatgcatgcagctagggttccacactggccgaactactttaatttgctcaaaagaactattcgccttaaaagaggcaaatatatatgaatattttaggaaccccctcttttagagaaagctcgatcatttgcagtgtcaaagtaaagcatatagggagcctcttgatgcgaaagcatgcatgcttgattaagtaccctccgatagctcggtccctaaagctttctaaccttcgcgtttctaaatagccgccaacaaaatatatgtatgcttgacgactagtttcaaccaccaagacaaggagtaaacttggcagctattttttactgtcaaagaaatcagctggccgccaagaaaattctggactatatagtgattgccagacatgcatgctgattgggtatagtactcatcaattgtgcatgcattattagccaaaaggaaacaagttccaaataaaatttggggggataatttatttttgaatgctaaaaatatctttttcctgcgtacagtgcagatggagtacttaatttatataaccaaaactaatacaagatcgatcgagccactaattaattactagaacacagtaaatagccttgtgtattaatgctagctcctgaactgaagctactcgatcgttaagatcagctgtgaattcaaggacatgatacgcatcagttattatgttcaagtgaagctgtcctgttgacttgactacaccttcgtacagatcagtgtatacaggtttcaagaagattaaattaatgaaccgatcgatgcagcagagaggcagtaattttctatgtgcatatgcatatgcatgccaagatcgataatactagtatatgcatgcattgtctgagcttagagaactgaggtgtgatggccacgtttgtcttgattccaaattgctccacactttgaaattacatttttgtaggtactacctgcatctctgcaggataatattcttaactaatttaattaatactttggttcaaaaggccaagtagatagctagcccagcaggttgatattatacagttgatcaaaagcatatcaatctttacacatttcttttcaccttaacaaagcctagcttaattgagtatctatatatctagcagcttgttatattttttttatctaatccttgttttcagctgaggaaacagcagcatatacacatgtatgtagtagaaagcaaagtaaggaagagatacatatataggttcttgtcggacaatatgcagctgctagtgttggatcgagatgcagaggcagcatgcatgatacagggaatgggtaagaatctctgctcacacatgacagtgtccatagaacgacagaatctatcaacacaagctacaaaatgaaattaattatctactagtaccattaattaggagtagttaacaatgcatacaagaagacattgatgaataattaaatggtcatttacatgcattgttcattgcactattcaactaactgtaattgtggtgcatgcatgcatgcaagcaatatcattggcccaaattgcccttgatcatgtgcagggacacaagaaacgatgttgcatgttaattaatcgatgtcaaaatacatcaaccatatatatagagtaccataatgcgatggttgagacgatggacatgaggagcaggaagtaggctatgtataggcaacaactccttgtccactcgcggggggggggggggggggg

SEQ ID NO: 95122 - DNA, 865 bp, Oryza sativa
ctgcacccgccttttactgtgtatgtgctgcagatctctaggaactgttgcaggtgtgcatgggcatcttcataagagaactgcgtaagatcataaaagatatgttcaatagaacaagggtgcatataaaggtaaatagctagtcttataccgattctaatcccagatggaaaagtcttacaacaaaatggctacttccagtagctggatattaacataatactagagttgctagtggttctactgctggtcggtaggtccaacagcatgggtaggtccagtagcatgggtatgaagaggaccactatctagcttctgatcttcaccagcgtcgttgtcatcctgttggccccgcgcagctggaattgaattaaacagaaatgagttgcatatggttaatgctctataacaagaatcagccgagaaaattgatcaaaagagactctataataagtcacatcatcaagattcagactcctagcgttacatggtaccgaaccacatcccatgaacgttgacttagtggtggcagcaaccacagatgtagctttgtgcttgagggactctatcagggacagtgcaacctcgcccgcctgctcaagagcttggagaatccttttagcgtatatgaatcggctgccagcagcaagagcagccatccttgtcttctgcacctccgatctggcctcccccgccatctctgctatatcaaacgctgattttgcatcctcaaatatggagagcttcacctcagcctccttgcgcatcctctcaatgctgacatgcaactcatccttgctacgtgcaatttgctgccgggagtgggacagaacctccttgaggcagttggcctctccgaaggagt

SEQ ID NO: 95123 - DNA, 592 bp, Oryza sativa
ccgtgtcactgtgcggtaatagcgtactgtacattactaattcattattattgggtacaaggtacaagaaaacgatggatacgcatgcaattgctacatagtccagcaccatattttagaaaataatcatttggtatatctaccagacctcactggtaaactacgtggtagcttctattgtttaccttgcagtttatagatttgctccggtccaacaaaaagtatctcaaggtaccagtacctctcggtatcaaatcgttttcgatcgttggatctaataatgcccattaagatccaacgataggaaatgattggtactgtgaggtatcggagcaaatctcttcagtttataagccactatcaaattttaaactttaaaacttaagcttaaagttgatattaggtttttttcgttatagtttgttttttaaacatagattttagaagtcactaaggacacgtataaaaatattactcataagttatttattttaccgataaatcgtaaaacaacttattagttgtaggccaaacgataggtaaaactcagtggtaaactaatagtgttatgaataattaaatgtatccaaac

SEQ ID NO: 95124 - DNA, 659 bp, Oryza sativa
gagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaagaattgactattgtagtcttaattagacttagcatatacgcacgaaacacttagcatacattactattttagtcttagcatgtaatattatttgagttttaatataatattactttatttgtaatcagtctcgacacccgaagtcgcaaatggttacacgagttcattttaagcagaagtcgggggctactatcagggttacgggttaggcataccctttacccttcgatatacgttacatatcgatatggcatacccacgcgcatgtagatatttcctgtatattctaaagaaacctttcacagaatctacagatgggaagaaacctactcgggcagaaccaagtcgttggcgtatcgtatagggtctgataccttcgagttctatgaggaaattctcacatctgcgatataaaaggggcccccccgggg

SEQ ID NO: 95125 - DNA, 523 bp, Oryza sativa
tcttaatttttaagatgtgcagggtgatggtttgggtcctacatgatatttaatttaatgtgcatatttatatatagaatgagttaagatgatatagttgttgtcatttttttatattgtttaatgactgcgacgctagggtctatgtccaaacgtatttcagtttttcctttaccttcgcaaaatatatgcaataccgatcttgatgtatttatttaattacaaataaaaatagcacaaatgaatttaatgttgtatataaattgagaatcatgcttatttagctatttaaaatttaaactattttgtattgagttgttagaaaataggagaaaaggggagggcatatggaatacgcatcacatatacgtacatacgtacagtggcatgcatgtacggcaggggaagggaagagatcgatctaataggcgacttagggcattcccaacccaatgactaggatggtgtccatagtattaaataagctgccacctaggataaaaaatgatgtggcaagtgaata

SEQ ID NO: 95126 - DNA, 671 bp, Oryza sativa
aattcctgcagcccgccgtcgaagaggccggtgatgtcgccggtgaagccgttgccggagacgttgagcactgggaggtcgccgcacgccgccgggacgaagctcgccgcggcgccgcccgccaaccggttcccggacacatctatcgtgcgcagctaggttaggccggggacgtacagcccccctgcgatgatgttgagctacaggctgatgtgctcgaggccgtggcattggacaaggtcgacggcggtgagctcgccgccgctgccgatgtctggacaggtcgagccactgtgagcgccgcgagccgggagaagttgccgaacgcggcgccgctgatgggcgaacccgacaggtgtagcgcctggaccctggcgcacgcgtctcaggtcacgccggcctagcgggacggatacacgtcggactgcggacaccggtcattctatcccgagctgaacatgttgttgagatgttgatacctcttcagctcgactagcacctgcctgtcatcatgtctggctaccaccgtgactctgacctacgaatgattcatcatggttgggtcaaatgctctgctggaaccatgcaactaaaccggaccaaaccaagatcagagagctacctgcgaagaggagttatctgaggaattcatgatgcacgggagacatggc

SEQ ID NO: 95127 - DNA, 538 bp, Oryza sativa
  unsure (1)..(538): unsure at all n locations
taccaaaatattggtagggcatgtttttggtagcaattcaaatagggcatttgtgtgtaagaactctgtagctcttcccctcccgtccacgccctccgagagaattttgcatatgtacctcagttaaaaaccggcttcgctacaatgccatcgtttaaatgggattcgctcaaacgccatcctcaagatgtgggtgttcgctacaatgccattttcaccattggttgcaattccaaaccattttctactaaaataattttttcgcggaccgttttgcccctagatctagttgaactgaaccacacataggggacgctaccactgctgcctagacgcgccgctctcctctcagcgcgacgacgcgacctcctctaccgccatccatgccgtagccttccccacctcgcacccggtgctttttccccctttccgaaggcccttttttcccgggggcccccccccccgtgccttccctacctcgtgacgccttccccacctcgccgccgcccaaaccgtatgggtgcaccnggcgcctctt

SEQ ID NO: 95128 - DNA, 540 bp, Oryza sativa
cccgtgaacagtaatgggcatgatgggccggtgtgctgttactttcgtcgtttcattgttcggccagccttaacgggaaattaccgttccgtacaccctggcgacacgtggcagtcccttactgggtggcaggcgaaccgtcacgcgggtgggttatatatacacttaccccctagcgtcactttcacttttacctctagtcacttttaccatctcctctgtggctggtatcgctttgtttctccttgcgttcacgagatttcattgcctacttcgaccagtgtgacctcggctcttataccgggctttccagacttttcatccatggacccttgtaaacctgctcctgcttcggccactggtcctgatccggggaagattggtgaaggtcacatcaggtatctcggcgcttcgcttatcgataagacggagttggcgaagctgttctcggccggggtcatggccgaaggataggcctttgctcttggcaaggcggtagtgccgaagcctggggacaaccaaaccgtggtctttgctgca

SEQ ID NO: 95129 - DNA, 504 bp, Oryza sativa
ccccccccccccccccccccccgtggcccgtacctcagctcagctcatcatcagtagactattatggggcgttcgatgccgttgcggcctcaaccgctgtttggtttcttgagttgcactcgccaaattgttggccctcttcatgcatgtgaggtgtatgatgtaatgctgcaccatgaacaagaagagagatgtagtagcgtcgtgttaatatagtttgggcgttatgaagaactggcgattggctgtgtacaactgaacatcatgaggaggcttgcatgacagtttgttgtcaattgggagttgggagtgttcatccaattagaggatttgactgattgctaagtgttccatcggttaatgtatttggtttagtttctgtgatgggattgtatgtttttttccccaagaaatgaaacctgatcaatagttaaaagcactaatataatgtgcttatcaattatggttgcaacactgattcatatctataatttacactccaga

SEQ ID NO: 95130 - DNA, 614 bp, Oryza sativa
aggccctcgcaccctcagcactgcccgcaagagcacccgacccccgagcaagaagcccaagccagatccagaggccactacttccgagccgtggggactcaggtttgcccgtgccagcgaccaccctctacctgccccaggatcctgcggatggttggatgactagactggaggattattgcagcttcgatctcgcttcagatggtttttggatagtatgcgagacacacccccccttacctagattgacgagtagcttgatggttagttcgatgcatcttttggatgaaccttatttggactgcgtatgtgtgcagtcgattgcatcatgatttatgtactatttgtggaactctatgatgttatttatgatattattgttggtgtgttataaatgagtttattccaccatgcttgcaaaacaaagttcacatcgaaacaactcccttaatgggataaaaccataagagctagttagaaaattaggatacttacttaatcggcctacacagatggcaagccgacgtcgggcgtcaaccagcaatgaagaaactttgacacctgacctaaccaccctggccagaagtatggccactgaaacccaacttctacaa

SEQ ID NO: 95131 - DNA, 506 bp, Oryza sativa
ggcgaattcgagctcggtacccgtacacaaaagcaaatactccttgtttcgcattatatatctggtcctcggtccaataatcaagaaaacataaaatcgtaatacagttgataaaatcagaccaaatttgatgccattagatagagtacttgtacatctatctaataaagcaacaattgttcaattccaccaaaaacaatagttcaattccacatttatctaatattgtgcccccttagtatgtacaccagaacaatattgtgaaatagagggagtaacaacctagtagagcttagcaatagaaaagctggaactctgccttgagaaaccggacactcaaaatacctggtaagttctcccattgcagccttgaacagtatgtagcaagcaatatttgttcgcaaagtcaaatttattgctgccaagcaaatggggcctgaaaagccagggaagtgtgatcagaaaagtttgataagactaacacaatacaatggcattcacctttt

SEQ ID NO: 95132 - DNA, 604 bp, Oryza sativa
attaatgtgtcgtctctgtctttcgttttccgttttgctttgtgtatgcctctctaaaattggcatttcgctgtcaagatgggaatatgggatgatgccatcgcaaaagggaaggagcccctgtgatgatgcgacggtgcctgctgggttacgaaatccctggggaaagaaaaagcatccactcacagggagctcgtgctacggttgatgaattatgatgatggctggctggttggctgctgtgtgtagagcaccccccctgacccaaacgtccagggtgcatcctcctatttcgtttgtatccaacgacgttttctttctgaagctaaacacgttacacggacaaatattgtaatggtacatatgatcttaacagaacaatcgatcactttaaaaaaaagaacaatcaattttagtactctctttatctcatattatataaaacttttgtattataaggctgcattctttcaaaggatattggggagagattggggagattgtcactcgttttccgcgcacacgctttccaaactactcaacggtgtattttttgcaaaaaaattttatatgaaaggtggtttaaaaattcatattagtctat

SEQ ID NO: 95133 - DNA, 565 bp, Oryza sativa
taccatgaaaattctactcgtaaacaggaatactagctacttacgagttctaaacttgttgctaatggccaatgggatgaacaatctgacactacaaatattgctccatgcacattttacaaaacgtttagctatttcagttatcctgggattagcatgcggtttcatgaaaagtctaactgtaatttggtgcagtaaaagataaattgactgtgcctttcttcaaaaaatggaaaaaaagaaaagaaactgattgttaatttagctgggtttttttttgctaccttacatttagattcatttagtatagtacccttgcccattgtgtcatggcaatggcatggaccattgtggaacaaacggagtataatgacttgatgcatgtaagcatttgcatgcatggttgcatcatttaatcaagtgatagattggagaaccaaatgtcaagtgctttgcatgctgtgcttaatcaatcagtgcttagtggtactaattaattacaataatttatggatttgattacctcgatgaaagtggtgaaaggctgcatgaagacctccgagaa

SEQ ID NO: 95134 - DNA, 518 bp, Oryza sativa
ttcttttatcacctgaaattaagcatttatcatgtggaaatgaatcaggcatcttactataatttatgcttacaacatatgttacatgcagacagatagtcatacattacacatatacagcatcactatttagtggattgtggattaaaatgcttgaatatacagctgttcttaagaaaaaaaagtaaaatgtaacttcttttagcacttgtaagtactccttattatgattccttattatgcatctccttttcttcatacacattcatgttatctttctactttttttttccttttctatttttgtatatagactatcatgacaacccgagttctgttctgaagtttactagttgtgcagtcatagtcacacagtctatttgtatacaggttattgagcaccatttttcagagcaacgcatctatgtcatgggctgaagctctcttacctgatgagattctttcacgtattatgtggataattggaaacacagtgcatgctaccttacttcagaagg

SEQ ID NO: 95135 - DNA, 567 bp, Oryza sativa
taaattggggttcacaaacagttaaatcaccgtagaacaatggaatgtactgtagcaattaatattgtccatccaaatttgatctaacggctataaatagcttatggcatggaccactgtagttctctaccattccaattagaatgacagaggatacgattccattaaattggtgattttggcattattccttcatgagttctggcgcctaaactagaggagtaatatggtggttttgaaggggaaaagtcatgataccgtatttctatttggactaattgtgattaaataacagaatgagtatatatatgtagcctagggcatcataactagccgaggaaaagaaaaaaaaaagacagaccaaaccaatttggtttgggtctaggttttatagcatagcacaaatgactagggccaagtttagttccaaattttttctttaaactttcaacttttccatcacattaaaactttcctacacacacaaacttccaatttttctatcacatcgttccaattttaactaaacttttaattttagcgtgaactaaacacactctagaagta

SEQ ID NO: 95136 - DNA, 831 bp, Oryza sativa
tctctcacaacgttaattttgaaagttcatgcattggaaagcaccgataatatgatggtgacatcatggatgcttaactcaatgtgctagtgttcatataatcttgatgcctacgaatgtttcccatatgtataggtacccttttaattaataatattctagtgagatcggatgtaccgctagtctccgcctatgtgaacatatattagagattgtattttatgggtgggtccttgtatagtggcgtggacgtgcatatgaaaaaaaagaaagctcctgcgcctatcttttgtgaaaaatattttctatgtgcctttattcacaacgtactcaggcggtgtgttgtacgatgatgatttgacaggatcttttttttactctagaagtataaaatgaaaacaacatggactgagaaaaggaatcaaatacactcatttgtaaaaaaaactagaaggtagctcgaatacgtaccattgtttttgcctttttgggctcacatttcctctttagagagtccatagagaatttctattatcttttatagagtacatacatcaacctgaaggtaccactttatgttgatcatgcacataaagttagtcggaaatcttaaatcttaatcctatttcctaatgttccaaagcttctctaacatattgtatgttcattgagtgttgaatcctaccaaatgaattactacgtagaaaataatagaaaactctagatcaaacgccaagaaaaccaacaagaggtggaaaaccaagaggtggatccctatctacactgaatcaaccaccttttttttttgttggtaggtgccgatacgaccga

SEQ ID NO: 95137 - DNA, 625 bp, Oryza sativa
ccggatcccgtaggaatctgctagtatatatacacatgcgtgaattgttcagtattgccgtgtgccatctttgaaaaataccttttcttttaaggattatgagagattttgtgtgagcattgtgtgaatctcacctatttcctgcttagcctctccaaatacaaacataccaatgtctagtatgtacgttgggtgagttttattagcttatggactcggttactttctcttttattataaacatgattctcaaaggactcggttactttctcttttgttataaacataacatgattctcaaactgctagaagatacattttggataaaccaatttaatatagaaatttatttaaaaaatctaaataataaaatatttaaagtagttaatatttaactaattatatgttaataatccattttgatttttgcaccactaactaactcggccaaacacaacctaagatgaatccatagatttcaccatagcgtaaagccgtaaagttataacttataagcatatattcaattgcctttacaaagcactccagtttacaatggaaaaaacacatgctacaaaaacacatatttcgatgttttaactgaaaaaaagaggtgacctcgttt

SEQ ID NO: 95138 - DNA, 616 bp, Oryza sativa
aaagtaaaaaaccaaatttcgcaaaagttcatatgatcttaaaggatcgcacttgagtaaattcccaagtgcaatggaccttacatagttacattcacctaggcactgttcaagatgaccaattcacagtggtttgcggtgcccagtttctcctccgtagtccgtatggtttggagttttgattcgcattgcgtcagtattaaatccggggtcaaatgccggacccagcaaagaacacttggatggagctgaatggctctgcaattctgcgttacaattggcaacacactgtatgagatgaaattatggacaggccctacattggtctctcattctgacactgcgtgagagagtgctcagggatttttgtcactcattccatttcttctaacgttcttgatcctgatttctgaataatggcactgcgacgccaatgtgggtggccctaagccaataaagatgcaaagtgtgctgcgccttgagcaggggaacgaggaaattgctagctgctgctccctcttgttctgacaacatggaccaccggtctctccgaataacagtgttgtagtagtatgaaattagtatatcagatctgtctatgtgaatgtgtgcagat

SEQ ID NO: 95139 - DNA, 578 bp, Oryza sativa
tcgattatgtcgattatgtcagttttctacttgtcaatgaactcctcagctatatatgagatcatttcttcagcatattataagtttaatatagatggataaaagaattaaggatggttcaaagtgccacaaaggtaaaagtatccgattcaaagtgaaaacattgtttttatggtggttaaaaacaaaacatcagtaataaaaaatgacccaaagtgaaatttactcctgaatttttctaaaaaaaaagaatatatcatacataaaatttttaaattagaatacatcataccgaaaatcaccaaataccggtagcatagtagtgtgtgtgtatatatatatatatatatatatgcaaataaataggaattaggcaacctatatgaatcttcacatttgctaaacctttcggccgtgcgaggacctcgctaattaatattgtcaaaccatcgatcgagagactgatatacacaccttgtctttttaggatgtcaactgtcaagtgccccataaattacactccatccctaaaaaaacgccaaaagataagcgaaagagcttcaaataatttttaatta

SEQ ID NO: 95140 - DNA, 1070 bp, Oryza sativa
gaggtgtgtgcccagtcacgttcatcctcgttgtatcttataaacttaatttaagacctacagattcgtgaaaatgagtagtgagcaatgaaaagaatcaacggtccaaaactccaaaagcccatcatggcctagcaatgtgagttatagtccatctatctcaatttctcccttctcattgcattcgtgatctttcctcaagaatgtcggaattttatattattctcacatggagtagtagtttaattcgtgcaaactttctttttaagaaaaatcttcattccaaagtttttaccacattagacctttaagtttaaatttttgggtgcatcaaaacataagcatgagtaatgtgcacctgaaagtatcacacgcgttcgtcatggatttctacccacaatagagaaatcccatatattatcctacacacattgaaggcgaaatgatttctcaggatgcaatacaaattaatttacaccaggggaatgtttcaccactacacatgcttataatataaagagaaaaaactgatgactaataccaccttaatgatgcggttgcataattttgcaagttaacttgccacttacacctatatatttagatcaaatcgtgacacactgaaactatatattgaccatataagcaaggatattagtaccgttagtagaaaaatttgtacctactctgatcaaactcattccctgtccaaatttaactgataccctgcccaaagtaagtttgaaatttgttttcctccaatccccataacccatccacaactaaacaaatatatctccatagtggttttgaaaaatgcaaagcaactgtgtatttatcctacagtgctaaccaattgctgattgccatgttgcattagcacaactaacgaccacatgcaagaaaagacactgtttctaaaatgctttcacaaagtttacatgcatggcacgggcgtctaagagcaggtacaatagcagactattagccagctataaacatattttaataagataaaagataagagagaagaacagcgggctacagatctgtagccggctgtagcacgg

SEQ ID NO: 95141 - DNA, 752 bp, Oryza sativa
aaaattttatataaatgttatttattttcattaaagaaactctaatttaacttgcaactttatatatttctactaaatttctagttttaaattttaacttataattttatatatttatactaaattttgaacatttttaacaagataaaagttgaagagcgtcgcatataaaaaaaaaacccggagttattagtatatttaatatttcaatacgagatcccatcgcagtcggtgaaattaatttgctggcgtggagcaagggctgctgctgacatgcatggcatggctcgcaaagagctaaaatccacgtaatgcatgtttgaccttggcgcacgtgggctatatgcatacatgtacatgtaatagatcagtctattcgcaattcacgggaatagaaaggaaaggagataagaagaaatggaaaaaaagaagaagaagaaggagaaggaggagtgttttatttttattttttttatgtgtaacatatggatcccactaacacgtacgtgtgactgaggagtaccacatcagcgcgcggagtaggttggagtccatttagactagctatggtacctaagacaagtttaagagcttgaaaatgtgtataagagtttcggaatctagatgatatagctgaacaagtttaggaatcatccatacacttcactgtttaatactccatctgtttcaccatgtaagtcattctagcatttcccatattcatattgattttaataaatctagatagatat

SEQ ID NO: 95142 - DNA, 580 bp, Oryza sativa
tcctgcacccctctacgcgacatacaaggcaaacaatgcaaacatgctataagactactaaaacagagaacaaaacattttttaatggattctttgcatttttcttgatttactgagacttgaatgggcttaaacggagcacagtggaccgagtccacgggactggggagaggagcaccatgtgacgctgacgtggcgccgaggtggcgcacacgctggcggccaagtgggcggaggcggctcgcagccggcgcgcacgggcggcttaagccggcccggcgccatggcgacgcggcggcggcggcgcgggcggcgacctgcggcgaacggctggcggcgaagagcggcggcgatgcggcggtgctacaagggggagagggagagagggagaggagatgctggtcctcaccgagggattcggtcggcatggaggaaggcgacggcgaacggcgaacggcgacgatgggcggcaagatgtcgacggtcacgggcgaccgagcttcgtggtaacctagggaacacaatggggagcgccggccgaaggcggcggccatggcgatgctcaccggcgcgaggtgga

SEQ ID NO: 95143 - DNA, 696 bp, Oryza sativa
ccaccaatggcaggaggcgaagcgtggcaaaataataccagccgcacaagtaacaaacttcattcgcaggaataatgtaggtttcggcacgagtatcggtcgaaagggggcgccgcataccataccacatggtttgcacggtctcggccgaagctccaatctcacccttgccgtgaggggcttgttggcggatggcatgtggcccttcgaccaaatctgccgaaacccgtggcgaagactatggagcaagaacggcgtgaggcgaagagtcgtacgagtgccttgccaggccagaggcgtctcaggcgaagggtgcaaggcgaagactatttaccgaaggaagacgacttcgccatggcaagttcgcccctacgagggccgaggaagcctttccggcctatcaagcctaggggctatagggctggcgatcgccagacggcccatcaggggcccatgagcccctataacattatgtacccctgtaaatgtccctttcgcaagggtaatcatgtaaattcccctgtacaacctaaaccctagtagtaagaacctataatgaggctataaatagtcccctagggccatgtaatggggggatcccgaagaagaaattttaaattcaatacacttcgtttctttccaaccattgttgagtaaccacgtccttcgacgtatgcggttgtcatttcgacaaca

SEQ ID NO: 95144 - DNA, 542 bp, Oryza sativa
gacgaacaagagagaggaaataaaggaggaagaaggataatttggtttagaaattttaggaattttggtttagaaattttaggaattaaattgaaggaataagtagtggtatatttcaaataatagcaaaattgtaatgacatgactcgaaatagatgaataacagtaaaattgtaataagatgactccaagtacatggaacccttgtttaaagcacaacggtctgcgcgctggttccctctctcatctctcttctcgggctcgcctgagatgatgctgctgctgctgcaacgctccccatcccatggcaagcctccagcctaaatcccgcagcactctcaccgtctccatcaaccgccgtccgccggtgcgcgctttgtgggcccgacctaccggagaaacaaattaccagcaagggcccgacccaccgtcgccgccattcctttctcggcttagtaccgcgtggggaacacggcgcgcaacaacctcgccaccgcttctccccttttctcttctcttctcgcttcccaatccgccattcc

SEQ ID NO: 95145 - DNA, 598 bp, Oryza sativa
gtctgttgttttaatttgtttatgcatgcattcagctcgaggaaatgttctggtcggacttaatcagacagctgacctatagtttcttgtgttatgagaagacctagagtttctgctgagcgaatagacatggacaatgccacatcttaacactccacctaaattacttgaccatttcttaaccaccattccacctaacatttctgtctaccaaaaaaaataaacacacatgtaatcctgtttatcacgctgactttagcaaaccggacaggttgattagtgtctgtgtgtgtgtgagagagagtgtcgaatggcatggtaattagccgggcacttgctttccgaaggagcgaaatcatgggtactaatcatggccccggtgcacgtcgcttcatgccttaatcatgaccctgcatgttagctatctcctcccaaaacctttgaccattgcctttcttctaattagcacttgtttaatttgcttaatccgctcaaagcggaaaggaatttgttgtactcacctttctagcttgcacagttcctccgtcctttcgcgccgattccatcgttagctctcactgccctgtttaataagtgg

SEQ ID NO: 95146 - DNA, 681 bp, Oryza sativa
tattctcatgcttccaactaaaacaaaggcttaactgatcaccttatagcacccggtaaatacaccaccagctgcggccaaccgacattaatcgaagttgccgggtaattcttgttatatgacatgggctcgtatacgagataaaagtatttgctgggactttacaatacatatttgaacatttggctacattaaaaatgttatggaaatatataacatctaaaccatgtctaatgtacttagaactataaaacaactgacaacaaagtgaattgtcacaatgttaatgtttacaataaaagacatgatcttacgtgagactaaaaatcagtggacgtgtctattaaaagacatatgcatgctgatataccgaacatgaccatatactgaaatcaaatcactgaattcttttaaagtcctgtaaaaaaggctcatagacaccttctctttcaatatatgcctctcctatatgatccaaacatttaagctatttttttacgtacgatgattgcagcatgtggagactggagagatattgtgcatgcatgtcctactgattaagcggttgaaacataccaggacaaaaagaagattctgcctgccaagaccattgaagaaccttacgcatacacgcaaaggaacctataatattggcgctatctacagattatgttggaacaa

SEQ ID NO: 95147 - DNA, 685 bp, Oryza sativa
gctctcatggctgcctactgctccgccaccataccagcgacatcttcagcctgctactattaccaatcgttggtgcatgatgtttctgattatctcattctgtacaatgatcttttcttcaaattttttttacaatgatcacattctccttgcctagcacgctcgcttgacacaacagttgttttgtctcatgtccattcaactagatccttccgagtgttatactatgtttcaatcatatccctgaaaatgtggatgtgcttagagagaacctgttacaaagatgtaatactctgaagtctttctcttgtttttgttcatcaaaagttgttatgggacatactaatttgtcttgtaacatatactataggtataataagtaacatatacatatactataggtatatgtgttacttcttctatgggtacctctggatttctttctcctgatgcttcccatcctcaagctcagatatctcttgagaaatggacatctcatgagatgcaagataaactctccaatgctagcatctatgttattcgtgagataacaaatgctcacttttcctttattatttggtttttatctcgtgttcgctctccatttgttatctacaacttgatgtttatgtatcaaagatgaggagacacaacaatgaagaacaggttggtgttgcattgatca

SEQ ID NO: 95148 - DNA, 569 bp, Oryza sativa
agatccgataacgtaagagtcatgaagaggccatcatagatgtcagtctaacatataagtaggtgttattactcaagtacctgcgatagcctttactaaatactaccaatattattatcagtggtagaagtgatttaagtcttgagttatgaattctactgccagtaggttaggtggaagtataaatagatgtgatttttttatggtggtctttattggtggtattctactagcaatattgtcaccaatagaagtaaccttgaccattgatttatgagttccactaccagcaaaagaaatattctactgcaaatagttgaggtagtaatagaaatagatctgatccttagattagaaaatatgagggctctagattaattctactaacaaaaaccattgtaaagcacctttagcttacatgatacatgcgtgcatgctagttttatcttcagagtttcatcaggtgtattgtcagtatctctaaaagtttcattgatcattcgtggcatatcataagtataaccatgtcaaatgaatgtttcaccaagttgtcatgaatgctttatcag

SEQ ID NO: 95149 - DNA, 691 bp, Oryza sativa
catcatactcaaagcagcccaaaatggttacagttgtcaagtttgcgccaagagcatacttgcatttacactttattaatattttcaagatcaaatgtgaattgttctgatcggttcgttcagagaacaatttgtacaaccaatgcacaatagtgtaaaagcctttccagtgtgatgtagattacagaaaaagatcaatgttgagtcggtaatcattagaaggcaaggcgcatacctgaaaatttttcatatagaaatcttcatcacgaaacaatgagatcttttcacatagcacctgcattgtgaaggatattttagtgtttcggcgcaataaaaacaacagtatataaccaaatgtatgtgcagcaatttagatggctgctgcttacttggaaagtgccagtgactactgagctatgtccaataggccaacattatgtccaagagttcggttttacatgcatgaagtggaaacaaaatgttgcaatttcgattgattaagcgcaaaaataactaatgaaatcataatgtcaagtcaacctatgatgcaaacttcatagaagtatatgtaaaaacagagattcaatttgaaagatgatgggtcagtagcaaattccagaaatatcgctgtaaggaaaaaagaaagaaagaaagaccccatgtgcacctattgaagcatattttttttata

SEQ ID NO: 95150 - DNA, 732 bp, Oryza sativa
attcctgcagccctgatacaaaagatgcacaatacttctgtgcattctcaaaaaaatcccatgtcgtgtactcgtgtggtttggcatcgcgctgcttctgaaactgttgcagatgtggataatggatgtggagcccaatcaattggcaaagagctgattatgtgttaatggcttagtaacgaattattattattattattattattattattattattatgtataaaatatttatatatgtgtccttggcaacttacaaattaatactgaaaaaactacaggcctatttagattgacgacgttttcaatcatacaattatttggtaaaattgataattatgtggctacgtttagtttgttaggcaatgtgtatagaattttgacaacattattaagccaatcctaccaaaattttgacaatgctatcaatttatcaaaattttggcatcatcaaattttgataatgctcattttggtaccaatccgaacagatcctacattgaaaataatttagcttgaaaattaatttttgaaatttaaattttgacagtcgtaggacaaacaataaggctacactggacgggtttcatttccatcttctcgcccctcgcatcgaactgccgttttctcaattatacggaagacgcgcacatgccaccacgcatgcacaaaagcatgtaccgcgattttgatgggagcgctagccatggattccaatttcatacccacaca

SEQ ID NO: 95151 - DNA, 1305 bp, Oryza sativa
ccagagtacatacatcaacctgaaggtaccactttatgttgatcatgcacataaagttagtcggaaatcttaaatcttaatcctatttcctaatgttccaaagcttctctaacatattgtatgttcattgagtgttgaatcctaccaaatgaattactacgtagaaaataatagaaaactctagatcaaacgccaagaaaaccaacaagaggtggaaaaccaagaggtggatccctatctacactgaatcaaccaaccttttttttttgttggtaggtgccgatacgaccgatgtcatatggcctgcaagagatatctatgctcacgtagtataattagttcagtagcgaagaaggtgtagccataacgtcgattttgttgtcgctttgttgatgtccactagatagagtgacgctcctatactaatcactaaagtcaaatatgcaatgggaaacaacatatttgtggtcatatgtatttatatctgtaactccttttaatttatacacgcattgatcattatgtttgccaccacaaccattacacatgttctttgacattattattttacatggaaaaaaaaataaatctagccttttgcccttacaatcatgcatccataccaaaatacttttacaatctctactaggggtgcattcggctggccttgctgccgcaacggctacggctgtgacattgtaaacggttgtagcacccagccggtttgaactaccacaatcctcaccaaaatacttttgtaaactactagggctgtgttcagttggccttgcagccgctacggctgcggcagatagcgcatgctattagggcctagttttataatctagatcaatactttgaatctattcttattttcaaatgtaaacaataaacaacctcaggttagaaagctgaggtctaaaaagaaatttagtaccaagtactagtatatttttaaagctgttataaaatcacacattattactaacataataaaatggtaatgaactaaaatagcaaggagtaaccctatatgacaacaacaacaacccaaaaaaaaaaaccatctataggcatataattgtgaggagaaccacagattgtcctgattttcacataaaaaacctactttttcccagcccaaaatctcccctttgcctggtacactacctaccctttcttttgttgtccaattcatttccatttcttgccgttttcttccacattcttctctgctgctggtgtctcttgtgggccgcgtggaaagccactctctcctcctctttgacctcgctatctatccat

SEQ ID NO: 95152 - DNA, 685 bp, Oryza sativa
ttctcatggaccataaaagttctcttttcattatttgttccaaaatagaagaagaaagactgtggacaaatgtcaagaagaaagcaaatgagagaatatttgtgatttgaagaatccatcagattatactagatattgttagcactatatagtccatccatccggtgtcccatgaaatgttcgtttctgaatctccgtgcgtgaggatgggaagcatcaggaaataggaaaccggaaagaccaggatgaatagtaagaaattgagtgtgtggtgtacgtatcaattcttctgacatgttctcttttcatgtaactataggccttatcgtttggctttcttgtaacggcttattagagaataaaaatgaatttgtaggtaaaacatttatatatgtgttctcggtgacttaaaagccaatgctgaaaaagaatctacgttaaaaatatcttaaagtcaatgtcaaaattaagtttaaaaattaaaatgttggcttttttttttttggctgaataggccatccgataggagcctatacctttttagggatatgaaacctagcactgagcaaaggagaggagatagagcggactatgcagcaacgctcttcgaagtagatgatgagtgtttcgtcatatttccatgctcccgtctcctttttcccttcttttttcaacccgacaataa

SEQ ID NO: 95153 - DNA, 688 bp, Oryza sativa
tcttaaaaaaatgaaatactttatccgtatactattaacttctattgtaatatttatctattttttactcaaaaattttatataaatgttatttattttcattaaagaaactctaatttaacttgcaactttatatatttctactaaatttctagttttaaattttaacttataattttatatatttatactaaattttgaacatttttaacaagataaaagttgaagagcgtcgcatataaaaaaaaaacccggagttattagtatatttaatatttcaatacgagatcccatcgcagtcggtgaaattaatttgctggcgtggagcaagggctgctgctgacatgcatggcatggctcgcaaagagctaaaatccacgtaatgcatgtttgaccttggcgcacgtgggctatatgcatacatgtacatgtaatagatcagtctattcgcaattcacgggaatagaaaggaaaggagataagaagaaatggaaaaaaagaagaagaagaaggagaaggaggagtgttttatttttattttttttatgtgtaacatatggatcccactaacacgtacgtgtgactgaggagtaccacatcaacgcgcggagtaggttggagtccatttagactagctatggtacctaagacaagtttaagagcttgaaaatgtgtataaaagtttcgg

SEQ ID NO: 95154 - DNA, 903 bp, Oryza sativa
aaaggatatagctaagagtatggaaattttggatgagattctgttattaggaaatcctgtcctgatgacacttattctgtcttcctgtttctctcactgcctcttgtcttctttgctttcctcatcacagctcctggtcagtgacgcttggggccaaaaccacctacccatgacagttacttgttacaagtcccgtataattcatgtcatgtccatacttaccatgtcaaccagttccatatacgatacaattagatatgtatatgttttggcatgtttgctttaatctcaggaagctagatcatttacgagtatattacaagtctagcctgtatcttgtatatgccaggacaaccgcctggcataactatgagttttaacacttgctagtgttgaatctaaccattactttatttttcacccctcataaatctttagaagcacctgtgatgttccttagttactataagctaattcttaatccttctgtattgtcatatcttcacttaataactagatctccttgctgccttctattcctgttcatcatatactattaccaaaaattaaataaataaacattttcaggctagattgcatgagatcatcattacaaatgctaaagcaaagaataccaatgaaccagtggagtttccatggatggttgatggtgcaggattgcctgcaaatgcttcgcagcttctccctaagatggtacagtactttgactggatataagcttggtctttttcataagcatcttttgaagtattcaaataatttacagcatttgtttcaataatgcatttctaaaccactctaggagaggttttaataataagagaagacagctatggaaaatattggactgtctaatgtagggcagtcttttcttcaaaagat

SEQ ID NO: 95155 - DNA, 716 bp, Oryza sativa
cggtttttgctaaaaaactgttgacagttcttgaatattagggggaggttgtcaatttgtagttgtaggcttgcagcttggcttcctgatggaatatctttggaaaccggcataatccgatggaaaatgaaatattttaaaatatttttcatattcttattatctgtggttgaaatggctgacgtatactttcgtaaattttacctattttaaggtttttatttattgtcattttatcatatggaggtataacaacgttgtcttctatagttagtgtaggaaaattttcaactacatattaccatactgcatttgttaggattagtagtaaccagaatttaaaatatagtttgtcttccgtcacaaatatatcaactactttcaaatgagacacatactaatattatgaatgtagatagatcttatcgaatggaatacgtcctacaattatgaaactagacagtgtgtcccattcgataagacttgtccagattcgtaataatagaatgtggcatattcaatattagttactacttaaatttagaaattgtatttgtagtcttattgccataactaaatttatcataacggggacatttttatcattatattgtatttctcggccttggcttctggactgtttagaatagaaatatagaaaatcttaggcttcatttggcagtaagctatcctaacttctactccctagtttttcg

SEQ ID NO: 95156 - DNA, 585 bp, Oryza sativa
taatctttttctactatcactaaattatattctatattttattgaataggtgtatgtataatggtaaccttctcatatatatgtttacatagggtgagtttgaggaggaggggattgagaagattgggaagatacgcaaaacgaggtgagccattagcgcataattaattacgtattaactattttaaatttcaaaaatggattaatatgaattttgaaagcaactttactatagaaagtttttgcaaaaaacacaccgtttagtagtttgggaagcgtacgcccagaatacgatgtcctttctcaccctatgtcaccagaatgaacgctcccatagtatcctaatcgacccctaaatcaacaagattagtcatgtaatgtcctttttacttccccgcatgcaccgcacaagtttgtgcaccaaaacgagtattttataagtttgtatccatctgacaagtttgtgtaccgacgatgcaatttacttttaaattaaatagaatatttatagctcactttttaaatcgaggtataaatattctattgcatggttcacgatttaggatttaaattctcaaaattaaa

SEQ ID NO: 95157 - DNA, 611 bp, Oryza sativa
actcctaattgcatctcatgattttctaaaataaaatatttaatagtgaatttctcctgagctgaactgtataacaataataaaataaaaattgcattcacccgttgcaacgcacgggcatcttttctagtaaagaaaaaaacaaatcatactatgaaaagagtagccacattttctgtttggatttgttacttgttattctatgaatgaagtttggtaagtgaaatgataggtggtaaaataatttatgttgtgaatttttcatgactatttgggttgcatgtataagacaagggcaaccctggatgacttaaaaatcaacttccccatgataccaaaatcctacatgtatatgcatctcattttgttcttttattctcatcacgtttaattatagcatgatggttcatatttcaaacatgctccacatagcatcttccatttttaagttcctgaacgccaaaaataaacaagaagggaattcccaatccatcgaggtcctcagcttccctcctccgcttttcttccagtctttctcctccgtctctcatcctctcgaattttctttccccccgtctctcatgcgccattgatcggatcgcttgatgccg

SEQ ID NO: 95158 - DNA, 1384 bp, Oryza sativa
ttcctgcagcccgtcctccaacggcggagaggaggcatggtaaaaccccataattaggattttgtgtagggctttaggaagtgagatggttgaccaatggcagttttatggtagagaggcggcagtagaataggttttaccttgacggcatatcagtggtaagcctagttaactttggtaaccgacaataagtgaaattctacggtaagagccaactgttttgttgataagagtatgtacaataatagactataagtcagttctaagaatatgtaaaaaagatagaagaggagagagaagagaagtaggctatagattttagccagcggtagcacggactccaagacgatttgtgtgtatgacatgtgtgaccaattataaatgatgtagtatatatttatagtaaactattgtgtgaattgactatcgattatttggagttagtagtcagttatactactaaatttgctctcacaggaatggaattgttgagatgacaaacaacgtaactgattaggatgttgtggatctggtgaaggtagcttctgaatatcgatcagggagaaggcaacgacacaatgtatggtacctcaccctatcataagaagaagccaacatgaatggagaagcgaatgggggcagaattccatgagattttataaatagcaaaaataacttggaaacaggagctatacaaatatgacttaaaacattaaaaacaggtgagggaaggacaagccctaatcaacattgggactctccacacgcacttctatattacccacttcatagcatactttgctcgttccccttggcgtcgtgggacatcaagcgagagtcagcttttcttaccaccttgcaaggtttcatcatccacaatttaccctctgtttctcggagatgcatcaaaagattagagaaactgcagcaatcgatcctgttggggattagacgttacacagtgctttggtatatatgaacggataggatattcagccctgcacatgcacagtgcatgcgaattccctgtagaagcctgtatatatacagtagctagaatcgctggatcgagtggcatcgaagtgcggctagctatagcttacgctagctactactacctccgttctaaaataagtgtagccgtggtatccgtatccaacatttaaatatctgtcttatttaaaaaaattataaaaaattaaaaaaatgtcacacataaagtaaaatttatgttttatcatctaataacaataaaaatactaatcataaaaacattcaacgaagacgaacaatcaaatgttggatacaaacagtgcaaaactacacttatttagggacgagggaggactgtactatttcctccatttcataatgtaagtctttc

SEQ ID NO: 95159 - DNA, 633 bp, Oryza sativa
gaataccggatatttgacaccctaaacttgcaaaaccggacaaattcccccctccccccgctccaaatcggaatggtttggtcctacgtggcatacatgtggcactagcatggcattccaatccgaaaaaaataaaaaaataaaatgggccccacatgtcatagggagtacacgtagtactaagctctctctcctttgatgtcgcgggcgcggcgtggcgcagagccagacgcagcgtggcggcggggacgacggggatggcaggaggagacgtgctcgccggcgaagtccaaggaggagctgcgcgccgcctgtggaatcacggaggactagtcgccacggagctcgtgatggcggccgagggcagcgccgacgcagttggggaaggcggctcagctcaccgggggctgcggcgccgtggaggtctgcgacgatagcgaccaccccatccccgtgggctccgtcaagcgccgcgcgccgacgccgctcgattgggccgacgacgctgcagacgtgggaggagatgggtatggaccaagcgacggcgaggccgacagtgacctcactgccggcgtccccacgcgctgccgtcccccatgcgctcccacacgccggcgtccccccgtcgcgctg

SEQ ID NO: 95160 - DNA, 939 bp, Oryza sativa
attcctgcagcccgtcgacggtggctgcagccccgctccgcgccaccgccgggtagctcgacctgccgacttgacttgcactgccaagctccatctccgccaccactgccccacgcctggccagatccggcggctgctgccgagctcgcggccgtgggaggggagaggacgtccgctgctccgcgttgcccccgcccacttgttgctcagctcggtgcttgccggagacaagctcgatgatttcgcgtcgggtcgctccacgcagcgtcgagctcgtcgctcgattcgcgtggccgccgcatagcttgtggcgacgggaggggaggggggaggaggaaatgcgagtatgtcgtcttcgtcctcaactcacgcgtctgccgacgccggcaggaggaggggagagccgacgccggcggaggaaggaggggagagctcgtcgtcgtctttgtcctcaactcgcacgtctgccggcgccggcgggaggaggggagaaccagccggcgccaatgggaggagagagggagcaaaaggggatttgaggaggattttgtgggtggtttgacgagggagaagggatgaaagatatttgtgggtcccactataaggttacttgcattgtggagaaaatatttttgaatctcttcatcctatgtgtcagctcgtggtctttcctagttggtgcttgcactgttagtgtcctaattacactctccgtgaaaaaaaaacgctcaatcgatattggaatttgacacaatctagaataatcttgtttagattctttgttctaggttttgtgacaaatttccatctagattgattttttagacagatagagtactaagatagaatataagcatactcacgaaggtaacccgtacttatctttggattgtaggtagggcagtacttaagattaatatcacttctctattgtatcgt

SEQ ID NO: 95161 - DNA, 763 bp, Oryza sativa
aaggctgaactgaatcgacgacgaccaaggatagcgacgacgctgacgacgaccaaaacaaaaaaacgatctttgcgtgaggaggaaagaacggcgacattttgatattctacttacaactaccagttccggtgagggcgtcggccgcgcgttttcgagggtcaatgccgacagctgcggacagccgttggatggtgatcgtggggcatcaccaaaactccaaaatgtgtcaaagaaacagcggccggtaaccgatccgaagccagagaccagggcgtgtggttaccggccagaaagctacgaatttatagatttaaaatttgaatttatttgtttggttactgatcaatttgtttgatttttttagtccagtaagtgattactggtttttacgaaaatcggtaattttggaccagaccaagataccataatctacttcaatgcaaatactactttttttttggataatagaaatcaatctagctgttcgtatctgattcgagattttagattttcgtttgtacatggctgtgttcggtgctctgcttcctaaccctcatcctcgttttccgtacgcacgcttttccaactactaaacggtgtctcaccctcgtttttcgcgcgcacgcttttccaactactaaacgatgtgtttttttacaaaaattttctatacgaaagttgcttaaaaaataattcattttttttaaaacaagataatacttaattaatcacgcgctaatggactgcttcattttccgtg

SEQ ID NO: 95162 - DNA, 1107 bp, Oryza sativa
atatgcgagtatcttatgggaactacgatgaaagtcaatctatctataatatactaaaagtccatcaaacttcctacaaacactcctaaaccgccttgtggcatcctataaacgctctcgagtcgccatgtgtcactctaataaaatagcaaaaatctgaccattgattttcatttaaattggtgggcacattaattttgatcgttagatttatcttcaatcaaaggaaaaaaatctctgtccggagtccggacgtcagccttggtgcgcacgtatgtatgatccctccaaccaccgttcctctcttttttttaatccccataacaattaaaattaaataccttttatgggcctaaaaagcccatcaacctattagatctagccaactctttatatattctctcctaataaatagtttattcaacatcatataaatatttttaaacatatgtccagatttgttgttcttagatatgtcacatcatattctaatttgagttttgatgggacggagggagtatatagcactcttaaattagagaaaatctaaaaaaataaaatctttttaaaaaacattccaaacctccctccgtgctcccatgcagcgttaaagcacattaaccatcttataaatgtttctaaaccacccaatgacacttctaaattagagaaaatcataaaaatttaaaaacaaaacatccaactattggtttcgacttaaatcgtggacatatcatttaggttgtttttagatttttattttaaaaaactcccaaacctcatttccttcctccctgcctctacaatgttaaagacttaaaactacactaaacagacatatcatttaggttgttattagatttttattttaaaaaactcccaaacctcattttcttcctccctgcccctacaatgttaaagacttaaaactacattgaacatcctataaatatttctaaaccactatgggtctcttttaagtttaaaaaaatcataaaaaattatgagaggaaaaacgaaacatccgaccattggtttcgacttaaacatcaacacattattttaggttgttagatcaatcattttttttatgaaaaaacaccccct

SEQ ID NO: 95163 - DNA, 730 bp, Oryza sativa
ctgcacccctatatatgtaaaaccaaagctagctagatagcaattccccgtgtgccgtgccggccgctaggcttgaaaatgacaaatcgttgccagggcatgcagggacacgtagccttttgtcaatcatctttttcacagtacttttccctggtgttcatcggcgctgctagctagctgctcgatccaaagcgacgactacacgcgagcgtggtaaccacggcgacgttttgcaagcctttcgcttttgaggatttcgatcgtatgctattttgctagtagcacactacgcaatgtcgttggatatgatgtaccaactgccaagaaatagacgacggtgtggatcagatggcttcgtcgatctacttttatcagagtgcgtacgtggtttcaggtttgacatcggtttcggctttccttggattcctaaactttactgtactttggtttggtcctcgcaccctttgctactttggtttgatcattgtcatccttggtatacggtcgtgtgtatgtgttgggactttctactttctagagagacagcttctggggttttcaatttggtgagcttaaactcggcaaatttgagttagtcaaagctaataatgtaatgaaatcatatcaaagaaggtgaaatcattcgataaatctcacaaattaagttgagccattcacatttcacaagaacatcatgaagggttagaaaaaattcactaatcggtactat

SEQ ID NO: 95164 - DNA, 1054 bp, Oryza sativa
tactgcttaattttataggaaaaataagcaggatgacaacctgatgaaagagtttttcttttctattaaatggctccttcgaaacacaggatgtcgaaagcacgtgagcatgaaaatcacaagaatatggtgtcatcccataacgaatcctataggaagtaatttgctaggattttgcaaaaagcattgtttggtagcaccatagaaaaagcaaagaaactttgagtcacaaggataagaacaaatgaggtctaatctcatgttagttttcctccaaaatttctacaaaatgagaaatttcaaaggattttggggaagacattcctatgttcaaaggaccatgtagagaaattttccaatggatttgagttctccaaaattcttccacttttcctttgttccaaaggagccctaagcataccaattcttgcatttttcatcttcatatatggttttcctatcatgtgttcaaagatagccttaaattttaaaactttattttagagttggtttggtgtttctttaccttatcagtctatttatgttcaagctagatagagtcagtgcgctgaaaacgaaacaagccatcaacgcataactagtcgagtattaactattgctagtttaaaaaataaatttatttgacaatttctaaaaaaaatcgtgtaaaatacgccattcagtcatttgaaaaacatgctaacgagaactaaggtataatatacatcttaaattaaaaacaaacgaggccttacttactagtagttctatcatttcaatcaccaacaacacatactccctcaggccttatatgtgcatgagagtatatgtacattagtgcatgtgtccatgtccacaaccattacacaacaacacataatgtcttggtttgttattagctagaaaatattagggatgatgtatgtattgagtttattatcagagtaaatatagtacgagagagttattgacttttcttgattgtgatatacccatgtaatatgtgattagttgggaatagatagagtaaaaagatagaagttgatttatttta

SEQ ID NO: 95165 - DNA, 850 bp, Oryza sativa
cctgcaccccagccttgtgtgtggctctatctacctctagtctccatgcatgtgattatatggaaatatggtagggatggctgttgcaccagtgttgctcaggaaagagattaaaaagattactgattttgggagtggccggtgtagctcaccactcatatgcttctggctatagcttcttctgaccaagatatgtagcatggtaagggagaagcaaattgttggagtggagtgaagcctctctaaccaattggttgcaaccttcactacttctgtaccttttcagttgcttgcctgtatttcattggtgaaattaatataattgagctgcaccatatgtatatacttatctagtgggaaacctgaaaacctgtaatggctgcaaattgatatgcaaattataacagattatggaaattaaggaaaaaaaaacaatatttgttgttggagacttggagttccctttcactttttgtactgaacttgaattttgtatttgatgtatttatgctggtgactgacagttctatgagaggggacaaatcaatatacccttctctgtatttatatgagactatatatgagagaatgagagatagagagagaaatatatttgggagagagagttagttggatcaaggtcgactgttcagagcgaaccagactagtttggtcaggccttggtcagctaagttaatctactacatcctgacctaatctagtacatgtgttcttatgcaattcagttaattaggcttgacttggtcacttctgagtcgtctcagtttagttaccataatacaccagatacagtaagaaaacagttaagctaatgacataaatatgaatt

SEQ ID NO: 95166 - DNA, 1293 bp, Oryza sativa
tgtccacaataagcatcctaaagccccaatggtctaaaagatcaattggtaagtcctgaatcaaataattcagaggtaaacagttaactgcttggtgcttgcctggacctacagatcagacaaatggtggtcagaattctgatatggcactgcattgttcatgaatctttacttgggtgtttacactaaattaggtaattgaccagacagactatgccctgactgtgagcttgtttgaacctgtgtttgaggcctagtttagttcccaactttttcttcaaactttcaacttttccatcacatcaaaactttcctacacacacaaactttcaacttttccgtcacatcgttccaatttcaatcaaacttccaattttagcgtgaactaaacacacctggagtagtctactgttaccatgaacattgaacttgacgaaaaaaaaagtctacgaatgtttcgataattcaatgaaacctatccttaaatctagcaaacatgtctctttctggatgatttgttggggaacacaattttggggatgattaaattccacagtggggtcttttcaatgagaacattcattaagttaaatatgacttaattgaaacttctttttttgttttggtctcaagtgtctttcaagtactacagcagatgaagactgcaactgctagtgaacaccatcaatttggttaataagattcagttgagcagaacagacaaacaagctaggatcctgaattagttgggcagttgggcctacatgcttttacgaatatttgtttgacgaaaattatcagattcagattgctgaataacagtcaatccctagtggattctccataaaacccaaagttattatacatcaatggcaataaaaggaaacgtagtaaggttaattgcatacgttatttgtagattctgaatttctgcaatgttatggaaacttagctataagaaaaacgatgtgtctcgtaagatttcaagtgtatccatatattgtctaatggggaacctgaaattcatctgatggagtctgaaatttccttagatatgggtgcacttaagaaacttccttagatatttcgttatggggattctgaaactctgaatgtgatgaaaacaatttcctaggtcaggttctgcagttctgaatatactgcagtttacttgcagttatgcagtttaggaggcaatgcataactatctctctgttttttttttctgaaagtaggaatgcgtaactgtcaaactatttttcttaccggcattggtaatgttaacaggttctt

SEQ ID NO: 95167 - DNA, 946 bp, Oryza sativa
agtttcaaatgacgcggtataatatataatttatcactaaatttgtagttttgtataaattcagtgttaatttttagttttgtgatacatccttttaatatatatagttttgtgatagtttgattgaagtatataatttttaaaaatatgatcagcttcaaataacgcagtatagtactacctctgtaacaaattaaaacatgtcgtttcaggtatgttttaatttaaacttataaaaatttaagcatcaatatcttgtaaatattcagattaaatgcatgctaaattgcaaatcatacatttagttccacttccaccaaaagtactttcttattgttataattttagtaggttagacaaatatctcataatacacatcagatatgtatttgtgaaatttggattaaaaaacatatcataacataaatttgtgatcaaatttcatttctaagactgcatccagtgcaggacaacatgtttttatgaccagaagtatctccgacgcgcgagatcgatcggctgctcaagccccacattaccattaaccacaacaactaataattaattaggccaccaacaccatgtgccagctaggccatgaaaatgaaaacccccaaaagtacaccaaaagggccccccacaccacacaaaaccggtactgggaactgggaaaaattctgtttaacagtccggattgacatccacccgctgcagtcatttgcatcttagctcttgtagtttgactcttctgtgttgctacttccattctaaaatatgctaatcttcgtcccaaatataaaaaaataatatcagatagaatgtattctaatattacgaatctagataaacactatgaccaaattcgtagtattaagatatgtctcatccagttctaaattcttatattttaggataaagggagtgataacttttaacttttgacata

SEQ ID NO: 95168 - DNA, 768 bp, Oryza sativa
gaacttcctagtgggaatttttgagagacagagattcccacccggaggtttctcccggtctgtccggatgttccgggtccctggcagttcacaagactagtcacctcactttcttgtggtgctttaccttctctcacaaacatcaagcattctttcccatttaccatcacgcgcttagacacaggacttccacccgaaaacccgagcccgtgtccatccttgttaggatgagcggtgatggtcttgtaaagggcatcttttgaatggtatgtcttcatgcatccatatttcaccaatgtgcccaacctttcattctctttcttaagagcttgcatagcatcaatattagtaccacaagagttcaaatcaatattgtaacacctagcataaccattgctagtagaagggttagaagaattagaaaccacatttggttgagaggtgctattccaaagagtgtcaaattgaacttcaagatctttatgacttttgtctaaattaacaaatttttcttgaagagtttcattgacatccctaaggctagctaaagaaccattagccaaattaagctcattagcaagttgttcatttttagcacattctttagctaagctctcctctaaggcaaggtttcttttcttctaaagaataagcaatttttcttgcctttcgagtgattgttctttactatccaaagctctcattaacttagccaaatgttgcatagcgggtttgctaaagctcttaagcacatcatctaattcatta

SEQ ID NO: 95169 - DNA, 529 bp, Oryza sativa
tttagaagcaaaggctaaaaaataaactataataaaagaaccctttaatcaactccaaaattaagttttcaaattcaaatttgtgttgctgcttataagctggaatgtaccttactctccttttggttttcccttttaacacaatatatatatatatatatatatatatatatatatatatatatatatatatatatattgtggtattgttggaagaaatgctatcttgacatggtactaagggaaggtatatatggaaactttgtggtattatttgatacctgtgaattttttataatatcaccgaagtttaatcttaaatgaggatggattgagaaaaggcgtaagattagttgaaaaataaatgagaggtgattgtatagtagcattgctaccgttgttccaaatagtttataaggcaacaaggtggcaaagagttccctccctacaagagagaaccgaagcttgaagacataggagaggagatgagtgggtgggacaggaaaagagggcaagttgagtcggctga

SEQ ID NO: 95170 - DNA, 656 bp, Oryza sativa
ccataccggatacatcccagctgtgctctgatggtctgctccttgcaccccaaaacactacccaacggattagccagattcccaacactatgaccccatcctctagcatgtactgctccaattttctggcctacagccgctatcaccgcctaacttacttggatttcacatgacttggatctggtccattaaattatcacccgactgcatacccttcacttgatcggggggctcggtaccacacatctcttattcataactatatgacacacgctcactggccgtagtattacttacatactgcccggacacctgtgtcgtctcacatcatattcctcatgctaagcatcacactcttaccagcgaggtatgtgaatagaacaggctaattccaaacactcgcttactagcatctttccaatcagaatgattatatggactcgccctcatgcacgtcataaatcactgctttcgtggtgtgaacattcagcctgacctgtacagtcaaaatgcctgaccagccaaattaattaacaatcctactgtgcttctggtgaaatacacatattactcccagaaagatctatgtacagggcttaatttaagacatcgatctattgctcatcaggaccattcatcactaataaataagaaag

SEQ ID NO: 95171 - DNA, 517 bp, Oryza sativa
gtatggtacagtagttcatcacctatacaaaatagcctgccagaaggaaagagatttgtatgtcaaatatgtcagatataagcgatgaggactatcaagcaagcataaatttcaatgggtaggacacaaaatgagctggcatggaacgcgagaaggaagaaataaattgtataatcaccttttccagccatagctcagattctgaaatcacattctaagagaaatatgatcaccctctgcaataatcttactgcaacctatcttctgctgatgagtttgaagatgctttgccgtagttgttcgccagttgcaatatttgaataataataacagcaagaaataaccatcttattatcagttcttttcttccatttacatacttctattgtgattgacagatgcaggaagaattcgattggccaaccttagtgttatcaacatcaccagaaacagaaaatgttacctccagctctgtgagaagcacaaccaagaatgacgtggttattcagcaaggttc

SEQ ID NO: 95172 - DNA, 1041 bp, Oryza sativa
gctttatttgcactgatctgatcgatcaagctagatgcacatgcatcgcttttgggtgatcaggattaatccctgtgttgacaatagttgccaaccaccttaatcttgagaaactcctacctaaaataggttcaaagattaaaaataacaaatgaagccgatttaactaaatatattaggggtaaacatccatcttataaacggaacgaaaggttttgagacaaacctacgaagtgattcacactctcatatcaaggacgaacggcttacggtgtaaaccaacaaagatggacgacctagcgtaaaaattaaaaatatagaaatatgaaaaaaaaagtagatgtggaattgaaagaacgatctaattggctaattgtattgttgcaattggctgttaattttattcaactgaaccgtcatagcccttataaagaggctagttttatttcaaggatggtcttcatgttctattaggcttatagattgactaaaaaaatatccgtgtgttgcaacaggtgaacactattttaatcttattattattgtacggtttagttaggaagaaattcattgtgggaatttgcttgtatattttttttaaaaaaatcataagctgcaaatagtagtccaattttcaactcaagttagcatgcgagtttttttaagagatttcttatacggcaccttttgcatttccaaaagcaaataaacttaaaatccgactcaaacacatatatgtatttccaagcgaaagaacttaaaaaccgacttaaatacggatgacgtattaaaataccggtaaaaatatctttaatatttatagtagtaaagatagagacaaagattatgactcaagaaaccttgtgcccaagtaaaaaaaaacagagaatcactgaaattagactcgatctcatatagggctctcctattagaccagccttaaatcaccgagtcggataaaccatgtgcaaaatgctcatatccttttcaaacttggccaaacctaactatatgctcatctagggttaaatttggacccta

SEQ ID NO: 95173 - DNA, 524 bp, Oryza sativa
caaacttttggcccctttcatcaacttcctgcacaaggacaggagagattagcaacaggacacccaaaagaaagagagaagatgtgtgcccctcaagggttagggattagaggagagcaactacacatgtacaaaaagatggcccattccaacaaggagaaaatatatttctcttaaaccagcagaggataaactgaatcgagccaaaagagaaggaaaaaaaaaggcagggtaaaaatgagaaaccagctccttctttattaatgaaaaagaggcagccctcctgccctcttattcgaaaaaaaaaagagaaaccagcaggtggtgaggcaagaagaggtggtggtgatctcataataaaacttgtgtaagaaaaagatgtgacgattaagctgaagcctctagaaattttggcatgaggggaggaaaggacgactcagctcacctgaagcagcagcagcaaagaaatgaagaggttgcaggaggtggaaagggagagagaagattaatggcaaaatgcagta

SEQ ID NO: 95174 - DNA, 626 bp, Oryza sativa
aattggctgctggggcatacatatataagtccttattctgggttggtgatgagctggccttgcatctcggaacaaaggtttttcctgttgcagacctctttctgtccattcacttgctcgcatatgtcatcagacctatctggttgctggcttgcaattcatgaaagaatgctggtatcctgttcagtttgggttgctttacctgattcagaaaatcttgggtattattactaccactgcctccggtttataatgtaagtaattttagccattcttacatttatattgatgttaatgaatccagacagacatatagatatatgtctagattcattaacatcaatatgaatgtggtaaatgctagaatgatttacattgtgaaacggagttcacagagggagtagttacttttctcaaggaagtccagtagactagagagatttgatactagtctgcactgctccagaatttgagcatatatgtataagcgatctatggagtgttgttgggctgatgtatactgaagattgtggcaagaaaagtaaaagcttgattagtgtgactgagtgcattgttattaatgcgtcgagtgtctaccccatttgtctcaaaataagttcactttt

SEQ ID NO: 95175 - DNA, 638 bp, Oryza sativa
ttttggccttatactgggcactgcactacgtagaaagaactagctgatgctacctaagtactacattgaacgcttgcaactgatgatgaaataaccgatgaatcttgtggtgtttgaatctcctaaagattaaagattaagtgtttcacgtaaaataagaggataataacgtgtgattaattaagttttaattattataaacttaaaaatggattaatctgatattttagaacaattttcatataaaaagttttcgcacgaatcacaccgtttagcagtttgaaaagcatgccactttaatccaaaatttaatccaccgttttcaggacattcgaacggggctgttgctagtgttgctgtgacttgacttgcaacaacacagcttaatctgggtttaataatactacaatttttaatcaggaaactgggctataataattactagtaaaaaaaataggggagtttatatccaatctttttcttatatgcaattcaagtgatgggactataggcagcaagtactagtgtagtatagtaaacattatggtgggtagatatatatatctccaccgcacattcctcatcgagtggaccttgtggtcagctgcatatccatatttgtatgtagagaagaatgt

SEQ ID NO: 95176 - DNA, 592 bp, Oryza sativa
atatatgtagcaaaatcaaaagtgcaccattcatagcatttcaagtaaattacaactagcaaatttcccacgcaaaattaggcgaagccaatttttttctttttctttttagtaagagctggatttggcatacacatatattttgtttccatagatatttgtattttgtatacaatagatctttgaaagtagaattacatttgatatacaaccactagcttctatgtctatacgtccaattgtattttgcgtacaatagatttttaagaatatgttttagatttcatacacaactcttaccttgtttttcaatagatacaattatattttgtataaaactgtgtcaattaatctacatcaacacaatataattgttaatgtggtagtttgtaaacctcaagagttatctcgtactataatagggagatactaataacatatagtcagcagaggcagtttaattaattgctgcaagtgcaaccaaaaccattgggagtgcagggcagcatcagtacagtagcagcagggtcccaaggaggaagaattttggtggcattttgcgtggcacaatggtaatggaaagcatgaagta

SEQ ID NO: 95177 - DNA, 875 bp, Oryza sativa
aatccaggcccccaccccagcaccagcaggcagcagcacaagaagaagaaagcgggggtgccgtacgagtgtgagagcgagaggccagtagtacagagagacagacagtaggagacgaggaagaagagactgctgcgctgcaatgccactcccttcaccactttcccctccttcacaattgggaaaactcgacatcataaacatggatggtgcttgtcagttgtcactgtataagcacttcttcggacctattcagttggtggaatgaaaatttttgaaatgtttgactggatgtcggaagggattttcgaacacaaataaaaaaactaatttcataactcgcctggaaaaccgtgagacaaatattttgagcctaattaatccgtcattagcacatgtgagttactgcagtacttatagttaatcatggattaattaggctcaaaagattcgtcttgcgatttacatgtaaaatgtacaattagtttttctttttatcttatatttaatatttcgtacatgtgtccaatgattggatagaatgtttttgaaaaaagtccatgaggaactaaacagcacttgaagaagggtcctcatcgctatacgatacggtcctactcctactactctgcaaatactcctaggtggtgactggtgagaatcctgaatattcacatgactcctttggagtactcttctgacctgctttcttttctttccccacttttgagatgagatgacataggcaaaaataggattacgcagccaaacgatgttagaattaccctagtcgcactagcagattagtatccataaaatcagatttagcaagatactaaaacgaagggccgattccgattagaagggggtgcagg

SEQ ID NO: 95178 - DNA, 598 bp, Oryza sativa
gaacagcacagcagcagatgaatgaatgaagcgaaacgcaggaggagcaacagtacatgtcctcgtcttggtactgtctgcatgcagtcttggtgacggtgaaggcagagatatcgatagtgtggattttggagcccaggaggagatggtacagctgagccagcaaccaaaggatccttgcgagatcttcaggaggttcaactctgtcggcttgccccactcttcttcttcagcttgctcacttcacttcacttgttgattcggcatctcctcctctatgtgatgctgcttcgtggccattcctagtttgtacaaatgttactagatagctgcattagtctggtaaatgcaacagttaacacatcatcagtcaccatttgcaaagaacataagctttgcttcttgctaatcaatcatgcttgtatctcaattaccagaatatgcatgggttctactactaatgaaagaagcagtggctgctcatctcgacctggtgaagagagccctgctgctggccttgctctccaacttgcatcaccaccatgttaatgtggctgctgccatcctgcaatgcaaaggtgaagcacagacagcgcat

SEQ ID NO: 95179 - DNA, 1661 bp, Oryza sativa
taaattataaatataatttttatatacgtattcttttaaataaatgatgcaaaataaattttgataaaaaaacttaaaattaaaaatttaaattttaagttgatgaagataagtatagacagaaaaacgagaagatgatgtccttgggattggtttgttccaatttgtacgtacgggtccattttatcctcatttcagtacagtactaggctattatagcagttgaaaaggtgggtgaatcaatcactcctactagttctcaaaaaaaattaaaaaaaaatcaatcctactttacctacccaacaaaattcaggcactttcttgtgtattctttttgggcacttttgcatggtaaaatgcatcttgtctcacctgtcagtcaaaaaagacaaggcaatttcaccgtgcaattctgactctcgtagcatgatgtttagtccattttcttattgtgtgcaattacttcaaaactgatcctaattttctgttctatgctctcttttttcacattctttctttcttatatagtagttcttgatataatttcatgctttttaccactttattttaatcttttgctttctttttctctttctcattcggaatttcggatgttggatgtgggttagttgatgagttgttttcaacggcgcccatttgatctccatctcgttatctcaggtcactatacgtagcctagtaccgctagaaaaggtaggtgaatctcaatcaatccttatttctaccaccgaaaaaaaaagttcaggaatctctctttttctttttttttcggcacttttacatgcaaaaatgcatttgtcacgtgtcagtcaaaaagaggaggcaagttctcctgtgggctatggcttctattataactctttcctttatattgtacacctagtgtttgttaggttttctattttctacgtattgctgcaggacaatattgtagaaattaaatacaataaataaaaaatataatataaggtgtaatgtagagtccatggggttgcattcctataaaaaaatgcatgtatgttattatagtgtaataaattatttacatgttgagttttaggtgtttcataagttgatgtggcattctttagaatgtaataataattgatatgcttacatattgagttttagatacttaggtttgtaactatatactatagaagatatcgattgagtggtaattgctcctcgtttgttacatccccgatgtaccctgcgaccaaatgccatacacacatatggggcaaaaaaatgaaaataaaaaaataagctggaaatgggagaaggggctaccatatcgatatctactaagaggtagtgaggctcgaagtaaagtcggctagcctaacaaactacgatgctagcatttaaaacttcatgtctttcacaaaattgaaaatattcctaagtcgacacttcttatacttgatttcttcccctatatattttaactttgcctatgtggtaaagtagttgaaccctctcctttttcttttcagattttagactatcaaaaagtcttctttgaatagatgacattgtcaacttctaatcaattatccatctctatgcctattatggcatccctgaataaatgttgcatctttcatgaataaaattaaacaatataatctgcacgg

SEQ ID NO: 95180 - DNA, 1124 bp, Oryza sativa
cttctttcacctcactcccctctacgcccatctcaacctaaacctccagggcattcgccaatgggtagggagaaggtgtcggtcggcgaggaaaagctcgacggcggaggccgccggctgacgtggctcccaacggccgggagcgctcacgtcatgaacgggttgcgcctcgatcgagccgaggatccctcacaccaaccccgcgttcttcctgctcttgggcggcacaaagccggcggctagacctcgatctgacgaatcagcaatggcgctagagcgagacagggtggcgcggcacgacggttggcgggggctcggtcaccgcgacgacaaacccgaggtgggggatcgttggcaatcgcgatgatgatggttgtgaggaaattcggcggcggtggttgaaagggaggagaggaagatcacgagcaatgcagaacgtggagcggactgtgggcgtgtgatgcgtatacagagatacaggagtggtaggtcgagacgagaaaattgatattataccatcttcgaaaaatgtggcttcgctaaaatacaactctcaaacgagtacaatttgctgctggaatgctattcattttctccattttacatgaattgaaaatgttttggcacatagacagacctttttgcccctggcgggcagcggtaggcacgctatctgcccgttgtctgttgttcttggttggttggtgagaggaggggaagaagccggcgcgacgacgagggaggcagcagcgtgggtgcgagggcggtggtgaggcggctggacaggatccggaagcggggcacactgtcgtcgtcggccggctgtgctgctgcgatggagtggaggagggggcggcgcagccatgtcggcgaggaggctcgtgggcgcgcgcgttctggcagatgaacaaggagaggctggctgttcggggaggatcgaggtggcgcgctggagcatcatctgcttcctcacagccgcgtgccgatcgatcgaggtgagtgaaggcgaggaagagcagctgcccgccgacggagaagagcagccgtgctgtccattctgattattcacacgaacgaagcctaccaaccctgaccaccttattgtctgaaacaagcccttgctc

SEQ ID NO: 95181 - DNA, 524 bp, Oryza sativa
  unsure (1)..(524): unsure at all n locations
tgattcgagttcgnnnnnnnnnnnnnnnnnnccccttccttcttaaaattgttcatttggtccctgttaacaccagggggaggttcacactctatagcatggcgctcttggctcaactcaacttggccactgcttggctgcccagatgtctcacctgctctccccagcccctgagttttagctgtacccaacacttgcaattcccaaaggacagacacttctttgggcctctgagccttgccaccactgttcccttagcctgcagtcctcttcccccttcacaagctacctcccttcctgatcatgatccccaggcagagcagggtgtgcctgttctgtggtcattatcaccctggggttacatttttaagaaaacttctcacagcaaaccagtagctggccagatcccttgaatgtttgctgagttgggtttccttttctgcctttgacaaacaaagaaacaaaaagatgttttgtaggaccctagcaaagctggcaaaaaataagaggagataaatataaat

SEQ ID NO: 95182 - DNA, 625 bp, Oryza sativa
ccacctgatacacaccactatttattacatactctttatttttcagattcgcaactaatatgcatcatatctaactaaaatttttttatattttaaaatgaatgaataggtaagtgattttgatatttccaatactcataccctactatgagagtatacattaatatggtttttcttagacaaaacgatattgtgtttgatttgtgttataataggtgtataatatggtcctcatcggatggccaaatgttttggctgatcagccaaaactgcctctaattcagctaaatttcaatgtatattggttagcttattttgcttaaatggctgatcagccaaagcatctggccatctgatgaggccatatatgttctaccaccatttagttacagtttacagtagacttaggtttttttaaatcactgcttgattaaaaccaataaaacaacttataataccttaaagatagtgacttactatctataattgacaataatacgcataactattattttcttctcaatgctttataagttgtatgtagtctttgtgtttttctcatattgaaaaatcagaatgtctaaaatcaactttgatcgttgcgtcgatcgaattccacacacat

SEQ ID NO: 95183 - DNA, 653 bp, Oryza sativa
aatatagataaaaagaaaaaactaattgcacagtttacatgtaaatcgcgagacgaatattatgagcctaattagtccatgattagccataagtgctacagtaacctacatgtgctaatgatggtttaattaggctcaaaagattcgtctcgtggtttccagacaagttatgaaattagttttttcattcgtgtccgaagacccctttcgacatctggtcaaacatccgacgtgacacccaaaaattttcatttcaccaactaaataagcccttaattttctaagagtagcatatattagtatgtatacaatctgagcgcttgtggtaaagcgatgcccaactttgaaatgcagtgcaaatggataatatagtagtagtagcgacaaacataaaaatacaccaatacggaaaattgccgtatgcgactgcgacatattttcccgtgtccatggtttacattaccggttgaccactaaattttgagctccatcggtatcacggtttttgatgaattttgactaaatctactgtttaaccttcgaaatcgaaacttgattccgagccgtgtcgaaacgtcaaaattttgcggaattcgatcggttttcgttggtactgtgaaccttgcccgtgtcttccaatttctgcatatact

SEQ ID NO: 95184 - DNA, 650 bp, Oryza sativa
actcctattgaatggaacatttactagtacctgttcagatttagagtactaggaaatatcttatccaatactatgttcttatattttggacgaaggtagcaataaagttataatcaatgatgtgtacgtgagggttatataagagatagaatttttttttaatttacagaccaatagcagataataatatagaagttggtttattttaggacaaagttcaatctttagaaattacttcatccgtttcacaatgtaagtcaatctagcattttccacattcatattgctaatatgaatgtggaaaatactagaatgacttacattgtgaaacggatggagtagtttatttaagacggagagagtatttcattatttacaacaatgttaatagacgtcagattaaggtattgttgcaattgattatagtacagttggttagttttttaagctggaaccaatctatcttggtcaagggtagattcagtgtgggtgcggcacaaagggagaatgatgaggaagaagacgtaaggtggtgttggagtaagaagcaaccccacaactgatttcagcttaagcttttaattcagatgcttaaatttatagctaactatttacttttaaacgctggatgatatattaaaaatgaacag

SEQ ID NO: 95185 - DNA, 1071 bp, Oryza sativa
  unsure (1)..(1071): unsure at all n locations
accatcaataactttaaaaatatttagtttaaagaaactagaaaaacatatatagatttgtctttcaaaacactataataaaaataaacatgcatttatttattgtatatattataatagaaaaataaggtcaaagttatatcttatagaacgtgtcattgtccaaagcgtcaattaaaataaaactggagggagtagatgcttactacactattaataactggtcacacctatcatacatgtattacgtcttggagtccgtgctacagctgattataaatctgtaacccactgctcttctctctattcatttatctctttaaaatatgtttatagctagcttataatctgctactatacctgctctaatataacacctaatggttaagatttattgtctccatttaaaaatataaacgcttttagctgtgcagtgagtactgagggagtaacatttccctattacctggaaaagaccctcatgcatacacataatcacgcgcctacatcacacacacattaaaccttatgatttgaatgcaaggcatcctataattctatccactagtagtattcaaacttctaaattagactaaagcgaaatctgttttactattcatctgtcagaaaatgtattttataggttgtttagtatatattaaggttaagggaaaatatttctttactcgtctcagtggttaaaatttaggtaaattttgtaacaagatattgtggctgcgcggttntagatccgcgcaaagtgatttttaaagaaaggtaatctttaaagttagatatttgctggtgaacaccgtatccattaaaacaataattttcaggtgaggaagagagagtaatcacgtgaaacgtcaaaaattctcatgggcccacatgtcagctctcctatcactcttcctaaagaacttaacggaaagccgctaacgaaatctgttaggtgatggcatttctatgacaaattaccttgtacgataatattttataaaattcacgcttatcgatgatattttgtgaaatcgggtgtttgtcaatgacattatttgtattttctca

SEQ ID NO: 95186 - DNA, 655 bp, Oryza sativa
tattttgggacggatggagtactattttggagaacctaaacagggcctaaatatactaatatacctagagaaaagaacatttttttttcagttttagctcatttatttgaacaaatagagtgggtcaacggtatattagtgacccatgctaatccccaacctcatatttgttggtaggaaaattctgttctagaaaattctgttctatcctttcttgatttcttggcaacatttggggtaagattctgggagtttgattggcttatcttagctttctttgtgcaaagaaccatctttcgatacccatatgcagaacctagaatagatggtactaagtctgtttgtcctgaaacctgatagactggatagtccgtgcctttgaaccaaattgcttatcaggacttgatttcagtgcacttgcactctagtatgggttaacttttgttgccaaaggtactttttacgtactagtatatgagttattccagcaagcaattctggaaaaaaagaaaaaaaaaacagactctaaatgctaaattggagtctggaaaagtagtgttatactatgtactatgatagtggaactgagccttagttttcaaacagtagttgtacgtacctctgaaaaccgtattggtttgcaatttggtttcaa

SEQ ID NO: 95187 - DNA, 1656 bp, Oryza sativa
  unsure (1)..(1656): unsure at all n locations
aaactcaatatgcagacatgccacctcatcatccattagcaataattaaatacaaaacttatgcaagtatacaacatcatttataattcattgaattctacaaatcaacatccaatcatcttccttcacattatttttcacaatatttaacacacacacatatatatccatcatttttgtaatatttaacatatatttatccatataatcaaagtgcgtgatatcatatttcatctataatcttatactgagcctactaaatttatctctcttaatattaatatagtttgacaaattagttttatttgttattaagaactaatataattttttacttttagctcgattattaatttttttaaaagtcacatagtaatttctacaacaaagcgcggagaatcacgtagtgaactaaatgtgccagtttgttctttaattattgacataaacaaatagctcttcttgtacaataaaatgtactgctaattattactacctatattttgtaagctaatcgatctcttgaacaccggtgacataattttgaatgtctcattttttataattaccctttctaactaactgttacgaaaatttaaaaccataagacaatgttttgacgatatatctaccaacatcatcttcacttcacagttcaaattatatatatatatatatatatatatatatatatatatatatagannnnctattctgtatatatgtgattatgataaaaatatatatgctcataaggatataattatattttataagtactcttttagccatgtttctaccataagtaatcttttagtcatggtaaaacatacatatcaaacatatatgttcacgaggatatatggtaaaaacatacatgtacagaggatataataatattataaaggtgtccatttctatcatgagtattcttttggccatggtaaaaaaatatataacaaggatataattatatttttaggaaacttctgaatttgaagatgccaactttactatatgatataatttagagatgccaactttactctttatgttatacattttaaaataattttatttatgtaagtacactgattattaggtgtttaatttttttattttctttttttgtaaaagtgtttaaaaaaacaaacaatgactacgacggttattgatttaaatcgctgcttttcctgttcgttaagcataaattaaaatatgctgaagatgaccattgttgtcttagatgttgagtcctgaatttaggtttgtgttatgtatagtgtttgacacgtattttttgttagaaatatttttttcatacatattctataaagaatcagcttagacattgacatttgttttgattatatttacataatcatgtatatatatgagaaatgttaggaattctatattttcttaacttgtgaattgagaaagacattatttatctaagctctctcgttgtgtttttagaagcatacacatagtgttgtgatgttaaaagcatacacatagtgtgtggatgaatgggtaaagcatacacatagtgtgtggatgcatgggtagaggaattctatattttcttaacttgtgaattgagaaagacattatttatctaagctctcttccgtggggtttagaagcatacac

SEQ ID NO: 95188 - DNA, 702 bp, Oryza sativa
ttattgcaaatgagcttcatggagccaaatagcaaatgcactcactagttgcagcacactgaaaatcaagtaaacaaaaactaatttttatcaaatctgattcttgtttatcagatagggcatgtttgatgaaacctccatcacaatcacaaaagaatatcaacgtttgaagcttgatgctttagtaagaaaaagcacagcaaacagaacatatgggttagatgaaagcaaatatccaaattcacactatacaatatatgtaggtataatgcaccttaatgatataataaacctatttgatcatgaaaggaatattatttcaaaattcattcgacctcatatttccacttattcttatacttctaagattaagttcgaattttaaaacttttgatttttgcggtttctttccaccaaggtttattttatagttttgcatttgaatcgctaaggccacatatataaaagtatgtcaaaaaatatttttttaattacaaataagcatatacataggcgagatgaaacaaattctagtacactttgaaaagtttgaccggaatttgatcaaagcatgatatatgaaagcatagtgcggaatctatacaaaccgccgtcataatagatataaatcgctatacatcctaatccaataagggactgggcctcgtatatatttgcattcgcatacacgattttagaatg

SEQ ID NO: 95189 - DNA, 622 bp, Oryza sativa
ctttataagtgatcgtatgaatgcaacaacttgcaagctaggtacgattttgatacaataaatttgcaacaactcaattatttggagcattttttaatataaaatcaagttttaagtacttattttgacaatatactagcgcggatttgtataagtgtattatatttttatcctaataaataataactgaaagtcaattaaactggatgtagaaattattatattttggttgatatttgagaaggtgaagaaaacaaaaaaattcttaaaggtaattggatgtaaattgtactactatgtgccagtataattcttaaagattgaattcaatattataagataatatccgtatgattattatgtaatggcatattgaaatcatgaaaaaactcacctagcatatgcttagccaagttgatacaccaaaatactaaattgttaagttcttgtactagaacgcacccatttgtcaagttattacactcggacatttaattctcaagtttttacactctatcgtacccacttgccaagatattgtaccgtgggtacaatttactcgacatataatattactatgaatctggatagaggatatgactcatctaactaaaatctctta

SEQ ID NO: 95190 - DNA, 645 bp, Oryza sativa
tgatgagtgggcaagagagattggggaagagatctccggatgccccgccggccctccgtgagaagacgagagaggagatgggcaggggaaaagtattttctacacctatatgctacggtgttcatatatatttatgtggtttaaatagttatttaaaatatttataaaatttaataagatatttgataatataagacactatataaacattaaatctaaattcaatctacacatgaagaaagaaaaataacgaattttatctacgttgtgtaggtactattcactccttgattttattattttttctctggttctaaattaaatttagtcttgtatttttgtttatggattcatatcatcctaattgatgttactattctttttccaattttttttagctattcgagttacatgtaaatagcgggtgatatgatgtcgagttgaaaaacctagcagggagtagacgataaggatgtcactgcaattttgtattttggtcctttagtaaattaaatttacaaggtaacctcagcgttaaacgtgatattcacctagttatggccttggtgcttcgtggctggtaacgatcaattacgattttacgctcccacataaataaacagttgacagaaaaataaaaataag

SEQ ID NO: 95191 - DNA, 711 bp, Oryza sativa
aatggcttatgcatttcggatatgattaaaagaactcttttgatttcaatctccatcgtacaaatatcaagtttggcaccatgatgttacaaccgtttttgtatttttgcaaatgtatagtgcttcagttgtcagttcgataaaaatagcccttttttaaaaaaaaaaatcggtggagcatttcgttttctctcgtgtttaatagtggtatagacgtatagctgtttaaagttaatataataaataatatgtccccacagccagcaatagcgccccacctgctggtcgagatcaattagtacttattctattaaactaaaccatatgttcagattctcttctcgagcattctctctttaatctatgctctttccaccgaatcaacttaagtcctgtttggttacatgggctaatgtttaaccctcatcttttagtctcaaattagtcctcaaggatttaaacaggtgggctaattttgagctaatgtaaattagcccctcctcgaaacattagcccctccaaggggtgctaatggggctaattttgtgtggggaacatcaaaaagcagctctctctctccttctctctcctctctttctactctctccaccttttagccttaaattataccatggatccaaacataccaccctaggctaatgtttagcctaccaattcataactaaacattagctctcaaaattagccctg

SEQ ID NO: 95192 - DNA, 571 bp, Oryza sativa
caattattttagaagaaaatacatttgaagaagacacaaaaatgtgcaaatgagatataaaaacttgcgtggacatgcatttatagccatgatataacatgcgtgtgcatggatagtagtgtatgggggaggcgaggtggacgcccgatttttagatcattcatcgagcacccggctcaaggcattgtccttttctatggttttttatggtggcaggtgggccttcatttcatctcatgcatgctccatatacatattatgcggcttgcactattcagatttaatcggatttgttaaagcacaagagagacaataatatgctgcttgcttaaaaaactaaaacttttgacacatatagaagaataaaagtataggcatgcttcccaaactattaaacgatacccttttttttaaaaaaaactatataaaagttgctttaaaagtcatattaatttatttctatatcatctaagctaattattaataattatatgctaatgagctacttattttttttataggtgcggagaaataagttcccaagtagtacaaccgaacacagtaatttttt

SEQ ID NO: 95193 - DNA, 546 bp, Oryza sativa
aggccttgatagactacgtcgattaagaagctgagtctgttaaggaaagaaaccaattaatatgatggattcatcatgctagcttgtctcttaatttgtgaaatgttcatggctaatgcctctgaatcagtattttatatacacctaatgtgaatttggttgatacacacagttcatgtatatctcatgtacaccatgtataccattctctcgccctccacctggcgttttttttttttgggaaattcattttgacctttgcttctaagaagttataaccaattattataaagtctacagccaaaacgattgcagaaatacaaaatgcatgttgatacaaaacaagaaaactaactacaacaccaacctaaagacaatgataacgacctctaatgctaaacctctctccgcggaaggcgaaaatccgcataatatgtatgtagttcttatcctcttaaacctttgtagcaagatcctaatgtcaataaagcggatacacatcgtccccacctaagttctgaattcaaactctaagcaacaaagact

SEQ ID NO: 95194 - DNA, 616 bp, Oryza sativa
aaaattttcacccccttgaaggacccaggcccttaatatatattccccgcatttctccctcacacccggaagtaggtgattcgaccctttttttcttggaaggggaatttgtcgctgcccatatatatcaagttagtcaggcttcttcaagtgtggctacgagctaagtccgacttgagtttattcttgggctattcctcgactctaggttgggtgagagacttgtttgtcacgagatgagatggaagtagcactaatctttggctaagaacaagtttgagttggacttatcacgcaatcacactagatgagcacgatctagcttggaatgagcaattttcaaagcgacagtgttggtttttgcaatataaataggtttcgaggtagaatatcaaaacaaggatgattaaagttgaggcagtttatgcaattttgtgataaaaaggaaatgggacggattaaaaaaacgtagtggcagtgttgtaaaaaataggattagaggggagcgtgggaaaaaagaaaacgggtaatatactgtctaacttcaacaggtgaccgtctcagattgagatctccccttggcctccctgccccgttaataattacagtattctat

SEQ ID NO: 95195 - DNA, 590 bp, Oryza sativa
gtgcattttttctttattctgttgcagactataccatactttctctttttgagaaatatatgatgtgttagcttttaaaatggcattgacaccaaaatttgatcatcaatattcattctcattatattattattgactataaaactaatactaatttaatgccacaaataattgtatatgagaccaatatggtttgatttatttttttccaagcctgtcatatatgctacaatactcacatgtatgggttcagctaacaggtcagtgatagctaactcggccagcacaggtgcacagcacgggccaatgtagctaggccagctgggatgattgatttttttttatagaacggggatgagagattaatgagagtgtttggcctaaatagcagggacgtgaggtgagacgacatccagaagctgctgttatttttgttttctgccgcacgaagacagcaatacatgcgcgagacactcgatcgtttgccgaatgcttcatggacacgtggcgtaaaactgaatgggggtaaacgaaccaatcagcttgctggagaactatttttatccatcttttatcaattgtatacatgt

SEQ ID NO: 95196 - DNA, 608 bp, Oryza sativa
accaaagaggtgattctgagattctctatcagcacaaagcagtgtgtaaatcatgggaataaaactaccaatatctaatcaccacaagggacaagaattctacttccaaagaatggcgctagtttaatttcaactaaaatatgcgattaaaagtcaccgaaacaaagcaactaaaggagggttaatctgaaatgatagggtcgacgtgtaaaagacaaaaggcatcaataaagcagagaaagatgaggcaagaaggaaaaatagaaaaaaaaaacataaatatttcaatactagccacatagatgagcatatcacatcgtgcacgctgcactactttcttgaatggaacactaaagtatggcagtatgcttaccgagaactaaattcagtctagcacatcaacactagttgctaaggggtgttcagtttggtgcccacgattaccacacacaactttagcactgctatggtttcttaagtagtgtcagacactgcacgtttaggtcagccgtcagcgtaagtttcttcataggacagcatgcttaagctcgaaattcaagcagtcagagactaactgcggccttacactttttcattctctaaaaaat

SEQ ID NO: 95197 - DNA, 688 bp, Oryza sativa
acatgtacttttgatagcattatacttatgtataaagttttaaccttgaattcattatattttagcctaagataaaagttctgacgattttaagggtataaatagtccaaaattttgtcttttttttctccatatatagaatgattttgaagacgagactttagacataattatgatacaactaaaagtatatgtatatatttttctagaaattttttttgaagtttgttagttggtgtgtatagtgtatacacgagaagatgtgtgtgcataggatacgttcccctcaactaaaaaatattcattttattttgtttcttcctaaatatccactctatccacaaatataggatatataagagactttatgttcaaaaattcatattatgtccacgaatgtagagattttgaagtatactttacctatatcatctaaccactatatttattgctcactagtcatagtctttcttaatcaagtaaactttcaagatatcaaagcaatttcacccgagccttaaactctataaaacctagaattcactatatatgtggaccgagggaatatacaacacaccaactgcaatcaatcgatggtgcgacgagtcaacaacgctataaaaccaatccgcaaaaggccatcaaattcaacaatcaaagtcccatcgggggcacaatcaagtcacat

SEQ ID NO: 95198 - DNA, 583 bp, Oryza sativa
  unsure (1)..(583): unsure at all n locations
ttcctgatgtgacacgtaaaactttacccctcagttgctctttgtacatcctctggttttggccttatactgggcactgcactaggtagaaagaactagctgatgctacctaagtactacattgcaggcttgcagctgatgaggaaataaccgatgaatttggtggtgtttgaatctcctaaagattaaagattaagtgtttcacgtaaaatgagaggataataacgtgtgattaattaagttttaattattataaacttaaaaatggattaatctgatattttagaacaattttcatataaaaagttttcgcacgaatcacaaccgtttaaggcaaggttttttggaaaaaaaaaaggccaattggccccaancccttttttttaaaaaaattttcccccccaaaaaaaaaaaaaaaaatttttttttttttaaaaaaaaaaatttttttccaccgttttcaggacattcgaacggggctgttgctagtgttgctgtgacttgacttgcaacaacacagcttaatctgggttaataatactacaatttgttcagtcaggaaactgggctataataattacta

SEQ ID NO: 95199 - DNA, 688 bp, Oryza sativa
gttttctctccgcgaggttcttgcgttccgctttgttcggattagttagtagccgcgccctgattatatctgcgtgtagttcgtttccgcccggttacttgaagatcctgaaaattttggcattcttggcgttgcctcgcgcattttagaccttcaggcttcagttactgaactcgattatggtaacagctcacaaatctttctgcacaacttcgtgtgatgctcttagattgccgctgtaatgcctttgtgttgatctttcagtctagtaggtcctatttctaactgaactcccagcgcgctactgtttggaagcagtgaagaccggaagagagtagaatccctcaggggaaaaaatacttttcttttttgcttaaaccctaaggacaggaagagcattaggcttgtatatgttaggtttgatctttttgttagcttctacatttctcgtttctgctgaaaatagtggatctagtattggtagattggtaccaccagtctactgccagtgccatggttttatactccatttgggtagaatagcgccatacgcacggtgacactggttttgatgagcttttaggtggatagaaagatgtgaaccgcgagctcttgcaaaatcatgacctaacattggttttggaagggcttgccagtaatcgattgttcgccggaattaaataatgtg

SEQ ID NO: 95200 - DNA, 698 bp, Oryza sativa
atatatatagtatatatatatatatatatataatctacatctataactaattaaaaaatacttaaggttttcggtagttattttcgtccatctctttttttcttttcttttttcccctatttttcctttttttcgttccgtccaattcttttctaactaactaataattaaaaaatacgtaaggttttctatagttgttttcgtccgtctcttttttcttgtttttctcttttttttccgctttttctttttttttctgttccgcacgctttttttcctttttttcaccgcttttttccttcacctttctttttaccttttctcatccgccctttttctgtccatgttatttttgccgttttccctttttttataatgctgatataggttttattatagctattttttaggttgcttttttagtagctattttttacgttgctttctttcatacgctcgtaagtattcatttttttctcggccgggttttttgtcgccggaccaaaccctagcacccaccgccaccactatgatctttctctccttgctttcccttctctaatttattgcaaaaatcgattccccactgctccttcattatttttcccatgatttttcctttcaattccactttaatgtactggatcgaatctccatttaaaaatcaccatttttatccctgagtttatggatttgct

SEQ ID NO: 95201 - DNA, 666 bp, Oryza sativa
tggtatcatcttatattacttgatacctacatatataaatttgatatctactccctcaataaaaaaatgtaagccggcacctggcagctcatatcactggattcttaaatattggtatctacttatattacctgatacctacatatataaatttgatatctactcctcatatcccaaaaacaaatctataactagctgtctagatactacacattttagtacaacgaatctggatagatatattttcagattcatagtgttagggtgtgtcacatccagtacaggttagttttttatagtaaagagagagtacatagtatctaagggcaatcacaatcagtagcgtaactaggatgtaaagtaaaggttgtccatctatatgtactgtgtcaattaaaaaggtggttcactgtataatttttattatattaactagtacatataggttgtgtttagttcacgtcaaaattggaacgatgtgatggaaaagttaaaaatttatgtgtgtagaaagttttgatgtgatggaaaagttggaagtttgaaaaaaaaattggagctaaacaagaccatactatagttttaaatttttagtccatggaccacagtgccacctagctagctacgccactgactacaatatggttcaaaagcaggtagtaagta

SEQ ID NO: 95202 - DNA, 675 bp, Oryza sativa
tggtcttgagttttcattttgataccctacatacccatttcgttatttggccatgaactgaccggtatatttttttccctgaaatggctatactggccttctctcataattatgtgctagcttattgagaaaaaacacaattcttgatggggaaaattcttatatttgataaaatcaaaagggatggaattatttgaccctaaatatgaaagattcaaatttttagcaaacttcaaaatactggtaaaattcatacaaaatttcatcaagaacttggaaccaaaactatttttgtttggcttacatttgaattgaaaatgatttaaaaatgataaatttcaagtttaaaatttggggtcaaagaattataccccatttggtttttttaaaaaaaataatgaacctttttcccattgagaattgtattttttttcttaataagctagcacacaagttcgaggggtaatattgtcgttttggaaaaaagaaatctagcggtcaactaatggaataggtatatatgggattaaaaatgaaactcgggagcatgtaggaaaataggaaaaattcagaggcatagaaatgattgagcgaaaactagtcagggcacagaggaattttctctgattttttccacgcaccatactaactgggtaggatttcgagttgtggaca

SEQ ID NO: 95203 - DNA, 2583 bp, Oryza sativa
tattagttaaaaactttcgagaaaagaaaaatcttatcttaattagcgtcattatctaaaactaatttagttagttaggtttaactaattgtgaagcacgcgctacgttagtttttcctaaaaataggaacatttttcgccgatcttgctttgttgcggagaaaaagaaaaacgtgctgagaaaaagaaaagaaaaacacacgtgagggtagaggccagaaaaatgcacgtgacttaacttccacgcgcgtacgcactaattaggatcgtttccgtcaagttaaaaagaataaattaaactgatgtttaattttttaataaattttggtcgaatttcactggtggtctaggttttaaatgatttttgcaaatactggggaaaccactcaagagtgggtttaagcggtttcggttatgtgaagcttgcacatttattacactggatacatggaaatgccatagcaacaaaaacaataacaacaccgacaagagagtaagtttttacagttttacactagaaattagaaattatggttacgagttctaggcattttggataaggtccatttagccatttaaaactttagttgccagtaacttttaaaatatttttttgaaaataaaattatttaagagaaatgagtgtcaacttttagtaggaggcaaataacacaaagcacatatggtacttaaaaaccgttttggaaatctaaaaatcaaatatgaagttctgaactacaccatacccgcgacaattttttatttaataaagatacattatcacttatggtatacataaatgaattttatatatgcagaaaataaagcatgaattaaatgactctttagtgtcgtaataacttgcattttgtttgatgttaaaatgacgaatcccgcgacaaggcgcagagtgccaactagtttacttaaatcctatttaccatctatttttttaaaaacacagtataaaacatgcgttcagaatacatgtacactcacctctataaacacacacatacaccatatccctatgatcatattcggaagactgagcccctatgttaaaaacaagttgtacggggttgcagttactattcggacttaatttgattatattcttttgaatgttcgtagtatatcccattgaagaaaaacatgaaaataataatatgtgcatatgggtcaaattgcataattttgcaatgttctagagatcgatatacacatttgttaaatttggaattaaggaaagaaaagttaggcagtcacaaattaatttccatgaataaaaacttgttgattttttttgaaaggaaaaaacttgttgattttttgactctattgaacggagaaaagttaggccgtcagtgggtagcaattaatttgcttgaaaaatgcatgcttctagaataattagtctccgtattcgtcttttccaagccagagcagtcacatttgagaaaacatgcatagatatatgcacaggtagactatgatcaaggctgtcagcatgggtaactaatttgttgcaccagctattattaatattgtaatttttaaaattttaagtatttactcccggtgcccgtcaccgctgcgctcgcatgctcgcccaccgtcgctccgcccgccacccgcggccggcctcccctcagcaaagaaaagaagagagaagagagaagagaaggagaagaaaagaagagagggcggctgacatgtgggctccacgtatttttttaattttttttctgactaggatgccacgtcagtgaaactacccatatatactgctatatgaccttaaatccacggtttgtgtgaatttaggggtatatatttctggttttgtggttaagagacgttaaaaaatctcgctcttaagttgaaggatccccggtgaacttattcctttgtaaaaagagaaaagaaaggagaaaagcgaggaggccaaaggggcagcccaaaaagcccaagctatgagcaggcggagatcggacggcccaggtaaggctaagaagaagggaagagaagggaagggaacccttgcctccgcctggttgtcttgttgatcaacaaaaacacaaaaaaggggaaggcaggcagggcaggcgaggcgatcgaaggaagaggtttcatcatttcactccatttcccctgtttcttcttcttcttctgttcgtctctcgagggctcttcttcttcttcaatatactactagttggccttcctccctaacaagcaaggaaggaaggaagggagaaaggcgatcgatcctctactctagccaggatactcgtataggagtagttaggaggaggatagaagttagggtttgcggtcgggcagatccaggcggccgtggccataagggaatccgtctgccttggtcggtggatgggtgggtgatgaaggcagcgcccacggcgtctcagcacctcaagcgtcctaacctcgcccgatccgatccgtcgtaagtgtcttcttcttcttcttcttcttcttcttcttcttcttcttcttcttgtttgcgagggagcgagcgcccggtgtatgccggccgatgcaacaatcctaacccttatc

SEQ ID NO: 95204 - DNA, 688 bp, Oryza sativa
acggttgggggtacatactagatagatttctactatcggaaaaaatacattcttatcaacacaaagggtcattaagtaggatctttgcatgaatgcttactaagtaagcaagttctacattttggttgcgtatatggttgatatgaagttacataaaagtgcaatgtgaaaaccctggatgaaataattatataacatatcctatgtaagtcattttcactcattaattatattatccttgtgagtctattttctacacattcacttttttttcttccatttctcataaaaatatcaacacactatttaccattagcactaggcgactttgttcctcttgctacttctcttataaggagagataggggatatttacatgattaaatgtgcttgttaatatgtcatcgtatgaaatagttgcgacattttttgttttgcttgcagtgatagacttggggcattacttctctgttgcatacttttcacaaacaataggaacatttcaaacttttagagaaagtatctcatgttttttagagcatcaaattgttcattgtgtcaaatttatatattactcgaatacacaagccaaaacaattggttttatgtacatggctagaaaattatactccatccatttccaaataactgacaattggcactattcattttaaaggggtgcaggaat

SEQ ID NO: 95205 - DNA, 1609 bp, Oryza sativa
ggtggcggtgccccctctctagccgatcttatctcccccttctttgtctagcaccagctgctaccgccacagcaggcgccgtctgtcgcagccgctcgacagcgccgttcgacagtgtcgatcgcctcctctcccgccgctgccgtcgcgccgtccgagagctcatcatcgcgccggtcgcctcctctccttttctcccgccgccgccgtcgcgccggccggctctctcgccgcccccgctccaccgctagccacctctctcccctctgccgctgcgtgcacttgagagaatcgggagaaaagagaagagaaaaagaaaagaatggataaatgtgggacccacaccattttctctcacttacatgtgggccccacatatttattttaacttttttgctaactaggatgccacttcagcgaaatcgggcagctatactacctcgggacctttttttggacggttttacatagtttaggggtacacatttctgattttgtgattaaggtacttatagaaatctcggtgttaagttgagggacctccggtgaacttattcctttcttggcaaaagcctgaaatagcagcggaaaaggtacactgaaggtccctcaacttgtcatcgagttacaaaatcgtcccccaaccacaaaaccggatacaacgcattccctaacttataaaaccagtgcaaactagatccctcggcggttttgactccggttttaaccgacatgacagttgactcagcatgggacccacgtgagccccacgtgtcagcgtggccacctcagcctcctctcttcaccctgttctctccctcctctgtccctctctctcacttcgccgaacaacagaccgatgctggcggcggtccagagcagcagccgtgcctccgcacccaccaccgcggtggcgcccgcttctaccttggcgcccaccgccgcggcggtcgagcggtccacgtggtggcgcgacgttgagcggcccgggacagcggcgtggcgctgtggcggtcgagcggcctgggctgccaccatcgtcgtccgtatgcaaccaatcgcaaatttggggatgaatctattgatgggagagggagacgacgaggcacgttgctgcatcaagacagagacaaggagcaccggtcaccaaggacatcgggctagcagtaggcggcggtgcatcgtgtgtgtcttttcatcactgaagtcttgtggagatgaagagttgaatacacagcagatcagcgtgcgctgtggggcagcaaggacggcgtgcagctgccaccgacttttgcccccacaacgcttgtcgcgctgcctcggccggcctctgccgccgctgaccgtgcgctgtagcctataggtggcctccatgccgtccgggtcgaggtgcaccgccgctcgccgctcgccggacccgtgttgtcttcgtcgctgtcgctgtccgcttccacccaccaaacgcgtccctctcctccgacggtgggcacgtcgtgcgcgcatgcgggatgggaggaacggcgtgacaagacggatggcaaagagtatatgggcacggcggacgcgggcggctgccgatgagggaggagatgccaccggcggcggcggc

SEQ ID NO: 95206 - DNA, 1729 bp, Oryza sativa
tcctgcagccccaactggcagcttttcttggacatagatgccctcacagaccaacacaaggtcttttcagcacaccttgtcctcattcgtgtgcacccgggaagaattttccggtcagtcacccatcctgaaattgctccaggcaaagttgcaacttgttggtatgagtattctattaatcctattaagccctgtgccaggatgtcacaacctatcatgacggctcgtagcagtgatgcgcacagagtgggacaaggcactagaggagaccacgcgattgaagcactccgttgctgacctagagctgaagctcgtgtttctcgagccctgcgtgcccccactcccacaaccgctgccttccttgccgagtccttcctccgggtgatcccatggtgtcccccgccctgtcgtatccctctccgtcatcttcgtcagcgtgctcccctctaccgctgttgtgtaagctcgagggaggggagacagcgagcgagacgggagtcagcgagtgcggccgtcgcaacattggggagatggtgagcgagctggtttcgaggcgagagagaagttgacgttgccgctgctgcttggaaatcttgaggctcctcgttgttgcctaccgccacccctggccttggcctcctcgtcgtcttcctcgtctgccaaaccaacgccggctggtccttcctgttgtcttcctctcccgcctccccgccgtggctagggcgagaccgacaacacctgtgtcggacctgagttccccaccgctgttctctcccgcctccccgcctagctgattctggccatgcatggccattgcctctcccaccgacgatgtagccgctgtctccggctcttcttccgcccgacgtcaccttggttttgtcggtttgcgccatcgtcctgaccagcgggagagagtggggtgaaagggaaggaaaaaggagaagtggtcactgacccatgggttccacatattatttttttattgtaatgccatgtcagatgacgaagactaagtcaatgcgatatgtagatgccattcaacgaaaatcaccttcaaaaccaccgggggagttattttgcatcggttttaataattgagatattatttttcagtaaaaaaaaggatatctgatattgcgttgagagataccaatcagactcgacctatattggagggagtcaacgtggacttattgcttacaagggtaggcttgcagcccatctttgagtccaaaatggactggactcaccccgtcctggcctgtgaacacgttcggccttgtcccgttgattttgttaatatttgggacactgagatcccattaatatgatcttagtcacgagctgtgaaatggttaaccgtgccttccagcgtgcgcgcgggttctctcgctctttttttttttcatttagaactcatgacttttattaatattaaccatttagaaacataggacatgagttattacactctcgtaaacgtaaggagagaggctttccaacaaactgacattagggcaactaggagtctaggatgatgacataaacgagaattactttaacagtaagcttaattaccttgtcgatatcttcttgcttctcctgccaatttatcctgtaatcatttgtcttccttggtatctactacttcctccgtttcacaatgtaagtcattctagcatttctcacattcatattgatgttaatgaatgtaaatggggtgcag

SEQ ID NO: 95207 - DNA, 1022 bp, Oryza sativa
aggagattggaagatgagggagagggtcagaattatcgagagaaaaaggataaaaataaaaaggaaaaagggaaagaaaaaaatacaccggttggaggaggggcgtgcgaggcgccgagtggaggcccacatgatagggtggcaggatgatgttgggaggttgggttgtgttgggctgatatatgtgtgtataatagttattctaaactcatatcgaattggatacaaacgatatatactaactgaaatacggatgatgtattgaaattccagtgaaaacatctttaatttttataatagtatagaagtaaacaggtccgtcgtaacaaaataaaagtgcattggggtgatgtaactctttttattttataaccggtacaatgtaattaaatagtgtcaccaccttactatattcataaatttgtaaccgacttaacaacgtccatatactccttttgtttttacaataacccaatcatcaatataattgctagtaatatcttaagcaacttattacatttattagcttacactgatatataataagcacccaacatgttatggaacgatatgtaaagaattttccggtttctctttatccaatggtcataaagaaacaacaaccagcataacaatatacttactttttggagcaaaacacaatgcccaactggctagagttaaaacttacaaccatttctcattcgtggaaaaaatattatattttccatcgcttagcaatctccttggagatgggcagatggcacacaaaacatgaatagaaaacccaaaaggaaggatgaaaaaaacacacacacacacacacacaaaacacagagagagagagagagagagagcgagaaaagaaaagaaaaaaccaattcttttggtctcttccctctccgtttgtcgtgtcgaagcctttgcccccaccacctcctcctctcctctcccttcctcccctcctccccatctcgctctcctccctcctctctcctctcctcgtctcctcttcctctcca

SEQ ID NO: 95208 - DNA, 562 bp, Oryza sativa
actggaggagaaaataacacaaattgttgcaagtcatgtgtaacttcaaagatagaggtaaagatactcaatatatatactaagataatgttacagagtattttggttctgcctctgataaccaacacaatggaaaaacagaaagacctaggaaattgagatcattaatagaatattcatgttacttcaaaatgtgagtacaaaatgcagagaatgaaataagcaatggatcacattagaattgcagagtaaatctttactttctattaaaagttttgcatttcagatatatgaccagtgacaatgcaacaggtccattttaactggggtagagaagaataaaaaaaatattttcttcattgatatatcaagcgttatctgaatattccaatagtttgtcagacagcaaactcctgtgctctcgacacaacaacacatcagtagcaaagcaacagcatgagtcccaaaaggcatttatgagtccaaggcgcacacatcgctaaatccatgtttggaattctccattagtcgcgtagcataacaacaatttgtcggctagcga

SEQ ID NO: 95209 - DNA, 2859 bp, Oryza sativa
gaatgatgaacttcagaacaattcagaaaacgatgaagttcagagctctttctcttactgagttactgtactgtgaacgatgtttcactagcagaaggttattcttgaatgctcttttgtattagctaatagcttcttaggtattattttacctatactattaatagttccgatagagctgtcaatttttatcagggtatactactctctattctctaggacagccatatatctttgagaatattgattttattccccctatttgtattagattatccatatagagactgctgttggccatgaatttatcccatagcatttgtgcgcatggaaatgtgctgaatttttttcacagtgattcacaaatataatctattgagttgatcatattattcaaaagcttcttttgatttctacctatgtcctttctattgatcactatacaggaccaccaccatcgtacctcgccaatcacgacaacagaggctgcagccttcatccttccatccatataaccttaggccattgcccagccatgacaatttgttactcttaactgcatttgagaactaattaatttgtttcttaacgcatgcattgcagcagggcatcgcatgcttattcttcccagttaccaggaaaaactaatccagtggaacaattatgaacaactcacatctgaataactctttgtagcatttacaagtggaagcaaataatttatggcgttgagttgaggtacctctcatgttctctgattaatattagcacgatgccttttcaaatactattcatgaaccaatatttatattctactgacaggtaaaatgaaaattcggaagggtatacttacaggactaccgtgaatttggactcaggtccacaaggggactgtaaagtcgtttgcttaatttatatttcctatttccaaatttcctggtaagtcagatgatatattttgcttagagatatccctgttacggattctttcacatcaacatgcatatccaaaactaactggagtgctccagcaattgatctgataggttttgctgtttactatgttagctctgttccattaattagcactggattgaaattaataccttgaccatactttgctcggagttgggatgaaatcaccactgggttaattttgtgatggcatatccatctagccatatggccaactacatagaggaataactatgtatttatttgcttacagaagtgaaatgctctgctgggtaaaaatgattaatatggtcaagggatttttgtttggcgtatattgttcgatgcaatagatatttggttgtattgctgacaaaaatgtttgatataaaattttattgattcatgtagattaacaattgattccacaagcaaacgaaagagtgtgttttttagacatttattatgggtacacttgctattatttactaaggaggtgtttcttaattttcaatcccattgttacttgaggtgctgttaaggagggaagatgttggaactgccaagaaggctgagctccaattggtctactgctccttcattggcgagatcagcctcaacctgcgtttgtggaagtttgacatgttaaatagcccggttgacttggtgttgtatcacattctgttggcgatagttttttattatttagcccaaaagacaatcgattaattttgtaaaactgaatcattattagcatttttttgtcagtgctatatatggtgatagattaatgtgattagttactttggtcacattgcaatgtaagatgacgtatgatcaatacgtaatgcatatataaaattagatctctgcttttctatcggctcaaaagctagctcctattattttagttattattttgtcctttcgcatatcaacgaattttcaatatataaatatttcatctttttgtgtatcataagctagctcctgtatgtttcagttattacaatgtttttagatattaataattatccagtttatcatcaaagtttaatttgtgtagcacgtatagttaaacgctacctggattttagttaagtgggtatgtcattttttgtttgcacgaacagagtaaggtgtataattatttaccccttgccacgtaaaatattcacttcttttattatctaagttgcgtttatatctgattttcatggaaaaatgctcgaggttactaaaatacaatccaccctaatgtacgaagctagctctagaaaataatttgtgcagcatagttaaaacactatccacctatagaatatggtgcgcaaattactttcttttccattatgctcatcatgcacgtcgaatattaagtttgatcatttcggatcctttcatagagattgtttgctatgttgtcactaatgactccatttgaacaaggataataactatgttatttaatttttataaatgtggcaatttaattaataacataataaatatatccatcaatcttaatttgtatttttagatgtcgtcgtagcgttagcataggctattactacttcacccctactcgcactgcgcggggttttctatctctctcgcgcgcgccaagaggccaagtcgcgcgcgtgggcccgccccgccctccactatctccacacggacgaccccgccgttcgctctctcccttatctctttcgatcgcgagtcggagcgagcgcagcggcgacgacaaggggcggtttcccttcggcggcggcggcggctccggctccggcgagcccgctcttcttacctccgacgagcccctcatcactccggcggccacgaggcgagagctgagtggcgacgccggcgagtccccttcctcctctcctcggccaggttagc

SEQ ID NO: 95210 - DNA, 681 bp, Oryza sativa
cgacgtccctcggtgagcatccccctcttccttcccctctgtcccgctgctcgccgccgccgcgtcattggattataaactactaataccacatagcagggattcgagcataatataatcagattatatactcaatagtttgaccaccaacaaagcccctcaatgaattaacataagacataagacatcctaccaaaaatgacactaaaactatcaggtccgaattttttagtccaggagggattagtgccggctaataagcctagcaagagagggacctagagtgtttgtggttgtgccggcacctctgccgatgtgccgggtggcggcgcgcggcgtaggtgtacgctggagttgtaggaaacaggattgccgggtaggtcgtggaggatgcaaagcgaactgtgaactcaccggcagcgaggaacacaacggggctgagttagggtttggggacatttaattatttgctgcttttaagatgtgtcaattaatgatttgtcactcgctgtttataacatgtgggccgctcatatatctatgacatatgggcccaatagcaaatcctttagggatgaaaacgataggaaaacagcctcaaccattaccataaccatatttttctcggaaacgaaatcgaaaacggtaaagtcggaaacgaaaacgatatcggaaatatcg

SEQ ID NO: 95211 - DNA, 1085 bp, Oryza sativa
cgcgtttctgacaaaactcagtgtacacagagttgatgcacaagatgtttttgcacctgttaaatcctttgtagttttttctctgaaaatctgacccaaggatgttactagaaagcaacaactatatgatgacacctacaatcagattgctgcaatccagcgttctgaattgactacctgaaatcatctcaaaagaaagttgttcagcacatctaaattgatttgtgccagatcacttttatcttattctacaaaacagatgccttgtatctgttattctcaaaacgatgaagcccatccccaaactagagtttacacatgcaaaacataacactggtggagaaaggatttgtagtcccgattggtaaccctctgtagtcccggtttttcaaccgggactacgaatctgggactaaagatgtccatctttagtcctggttgaaataaccggaactaaagatacatctttagtcccggttcgtaacaccaaccaggactaaagatttagtcccggttgatgtaaccaaccgggactaaagtttttttttttcttttttttcttttctcatgttcaatctctccaaatcattataaaaataacaaataacaaatcacaccacaaatcacaaataatatatagcacgaatcacagatacacgaatcatagatagttcacatatcacatatctcctaatatcattcacaaatcacagatcgcatcacaaatcacagatcgaacaaatcacacagatcccacatcacattaagaaggaaaaaaagaaaaaaaaagcaaaaaattccatgccgggcggccctccgcaactgccgcggggcggccctccacgactctgctgccagccgccgcggggcggccctccacgcctctgccgcctgccctctggacgggcagccgccgccgccaggccctccgcgcggggcaaccgccgccagcgcctccaccacctgcctcggcgccggccggcgcttgccgccgccggccctccgcgccggccgccgcccgctgccgctaggaagacaggggagagaggaaggggaggaggagaaggagaaagaggagaaggagt

SEQ ID NO: 95212 - DNA, 543 bp, Oryza sativa
agtaagtaaaagttttcttagccataataatagtgtggatcttccttagtatttgttgatatttttgcaaaatggacaaatgatcaaagtgtaaaagtgagtagtgccccgttgtcatctctactgccttaaaaatggtttaagtcgtccttcttctaccgcgcacagtacaccgactcataagggcctgttcactttgctgccaaaaaaaacctaaatgtacccacttttttggcaactatgtcaaaattttggtaatttgccaaaattttggcaggatttcttatatagttaccaaaatttggcagcaaactaaatgtacccacttttttttggtaactttaccaaaatttggtaaggttgaaaatggcacaaaagtaaacagcccctaagtttagtaataagcctaaagaaagatgacctaaagaaaagaggataaagaggataagaagtgggacaagacgctggacgtccggcttttgctaaaaaatggggcattgctccgatagatacagaaaattatgcatcatttgattagatgtt

SEQ ID NO: 95213 - DNA, 691 bp, Oryza sativa
atattatcttttttttgggtaaaataaaaaaaaaagtggctacatttagtttgttgccaaattttagtaagtacatatgaaatcttgccaaaatttggcaaccttgccaaaattttagtaagtacatatgaaattttgccaaaatttgacaatgccaaaacttggtaaggttgaaaattgtagcaaagtgaacaagcccgaatcttttgaggctaattagtccataattagctacaagtgctacgataccccgtatgtgctaatgatggcttaattagactcaaaagattcatctcgcggtttccaggcaagtcatgaaattagttttttcattcgtgtccaaaaatctctttcgatatttggtcaaatattcgatgtgagacccaaaaattttattttcgcaaactagcctaaggctgtattcggaggtgagtgttgggaacccatctcccatgcaagaaaaacggagcggtctattggtgcataattaattaagtattagctatttttttaaaaaaatacatcaatatgatttttttaaataacttttgtatataaacttttttaaaaaaacatcatttagcagtttaaaaagtatgtacgcggaaaataaaaggggagtgttaagaacgctcttacaaacacaccctaatttgggaatttccctcaccaccgtccagtcgttgcaagt

SEQ ID NO: 95214 - DNA, 1210 bp, Oryza sativa
aacatgtggttggacgtccaggggcaaaaccgtccaaaaaaattatttcggtgaaaaatcttttgcaaatgcaacagacactgaaaatggcattcgagcgaatctcattttaacgatggcattccagcgaagccgctttttaaggatggcagagatgcaattctctaaaacttaaggtgatatttggaatggtttatacaattttctctaaaaacaataaggtaacgagggagagtcggccacgtgaatgctctcatttccaggaggtagcaaaagtgcacatgaaacatgctaatggtattttggaccactattatttctaacattaagctactacatactcctactaaactggtaccaccaaatatatctaaggcggaaggccaaacttcactctaactccaaaacaagacatgccttgccctcatttctcatctgagagcatttcgactcaaaacaatttacaaacgcgtatcgttaatgcaaaacaaaaagttgcttatatagtatgaaaaaactaaaatgtgcggaaagcaaagcgaatcattacatagtaacaactcgtaggtttcgatttcctcttatttttgaattttttggctcctcaaaatagctgtcatgttttttttgcaacaagatttctcaattgggccagcagaatcagcgacacgcggttcgatggtcagctgctctatttctcattggtttgtgcaacgattcagtaaccgggcataagcagttgaggcatacatgtgtgcaatgcaacctcacacatggttttttttataaagaccttaatactctaaaaatctcgaagcaaccctttaaccgtttttaccctgttgtaaattttgtaaagccctatatatttttgagaaatataacacgaagaagacaaggtttcgtttttagaggtagcattgtaataccaagaagcataagggtttttttggcaaaaatatcatcccaatctgatgcagtcccctctcgtatcatctgaacttccgcctcctttgccgccgctttccgcttctgacgccgcactcgctccagccgcggagccgcctcttcttgctgttctccacctgtggtgaaggaggccaggtttgccgcccagccacccgcttcgccgctcgccctcccccacctcctgccaccaccctccccggtagcgcctcctgccgttgtccccacctcgcgcagatcgggg

SEQ ID NO: 95215 - DNA, 561 bp, Oryza sativa
atcagctttctctggtcgggaagtacatgaagaactttcagctgtataaactttttgccttccatacgattttgccgcaagatgcatgccaatgtttcgccaatgaagagtattggcaagaaagcaagattccaccgtagggtccttatcatgctgtaaggctatccacggcctctattgttgtgtgtggcgccactatacacatcgcattcgccggtgtgtgagtgtggtgttgcgtcgtagtgctgtgcatgcgtgcatatctaccttgtcatcaaattttaagtcaacttgtggttttagatgtcaaaatttcagttttgttttcgacaatgtcaggtagatccagtcgtacacatgtgcaacttgctttgtgagagcgggcaatgcaactaggctgagtgagaagagccgcaccctgattggattaaggtgaaataaatagctacatttggggtgcaatattgttttttattaaaaacaggttacacttttgacaatacgaattacatacatttacaaggtatttatgttataaaatttaagactgtatttttcaaa

SEQ ID NO: 95216 - DNA, 734 bp, Oryza sativa
  unsure (1)..(734): unsure at all n locations
ctgggtttgannctagaaacacatgctgcggcagacgncatcaacatgctcatgcacacatataacacgatggttaaagacgcgcgaacaagcgacattatattctagtaaaggtgaaggatgatcaggcctgaagccgaaacttgcctaccaaagtattggcattttatacggtcatcatggtaatgtttgacacggtaccaatccttgccaataccacataaatctcgtcaaaatattgtcctgggcaaaaacttacctataatatggcatcgccaatatgtttggcatatcctcaaaccaaacatgacctgaaacttttgttcattgtaccctacccatcttaaaactactatcaggaaaaattgaaatatatagcgaaaattgtgaattaccaacataacgctaccggagggagtatgtttcttttttttaaaaaaaaacagaactaaacgtatatttcggcagaacgccacccgtcatcagatggactctggatcctcctggatccatgctacacgcctagagccatacattactgcatgattgtgcatactttctacatggcagatgtccatatcgaatggctatcgcgtgttgataacacataagcgcgtaatgcgtcatgtcagttgtcaacgaatatagtttaaggattccatcaagctgaccgctaatcgcaatctatctattgatataagtgatactgatggggatacaggtaatacctattg

SEQ ID NO: 95217 - DNA, 540 bp, Oryza sativa
gttgactttgaagatcgtctgatttctaaccagcatcttttaaggtgttggagaggttgttgtaaaaccacagacattaaaaattacatgatttagtataagatattcaattgttaagcatccctgtcacgaaccagggggctgctgcaacaccagagtcagcttctgctcctaatctcataccatttgtcgtgatctatgaagtaaaaattgtcattcagataattaatacgaagagaggaaaccttataattccttctagtggcaggccacacagttctaatagccttcacctccacttttgcagcaatgtggaagtaattttacaaaattttaactaggttagtagagtgcagatgttcagtgcaaaattactcgtctattttaatgcgcaccagttgtcttcccataaaacaaaaaaagtagttgagccttacaaaataaaaacttagatgcagggtgttgagcattatcggtgattaggaaatagttccagttctaaactagagtgtttacaaactgatcaaaatcaaatctatg

SEQ ID NO: 95218 - DNA, 695 bp, Oryza sativa
aggaattgagctttgacatgtgttcaggaaaattaaagcactaaggaaatgtcataaaaatttgactctgtagtatttattaaattgactcaaattcgttcgagtataacggaaagttagtgaaatctgtgaaatctgcctttcttctgtctagacataatatattatttggtgatttataaatcagtcatttaaaaaatcgaagtagctcaattaactaaaaatagactatcttattgatcatactcgtcatataactacaaaagagatgatcggcgttgagctatcgtcgctacaaattacagaaagttgaagtgtgtcaactggattttacaatgtgcatatgctcatatactgtcgaaaaattatccaacttctcagctctagccatgtattgtagtgtcttacttgcccatgtttgaatcaatttcttttgaactttcatgtcaacattgctaaagaccaccagttagtgctgacaaagcctaatttgatcaagttcgtatctatatcaatacatcattatatattaagggaataaccctgaaacctgtacactataaccggttagtcttctctggattcgcaccactggatacacagcctaaaatggacaccggtggttgaagttgtaacagatcaaaatgtcataacactggttttgctaattctttctccgcttttcactaggagaa

SEQ ID NO: 95219 - DNA, 740 bp, Oryza sativa
  unsure (1)..(740): unsure at all n locations
ccggttattgaaggtanggtcgttttgtacngnncncncatatntagttgggacggngccggccaagcaccccacactctacattatgagtgcggactagaggtcacaacgtattctttacactacttagagcctagccttgcaccatcacgatacgtgttcctgcatcctatgcatacttagaaatatgtctagaaccgttaagtggtgggcccacgccttaaacccacccacgtggcacaataccgttgtattggacagacttagtcacctaaactaccacgtcggggcaaataggaagttgctctgaatcatcgactaattcctcagaattatcgactaacttatacacaccggcctaccagaatgcaatgctagttctaaatagattaatcagcttaggccatcccatactagtacatgtggatgtacgaataactttaagttggtgacacaagttcggtccttacggtccttacggacttgggcaaacactccccctatcggcatgtaactaacaccatatgcacaccacttgccgcccaagtctaaaatcacattttacacattttagttcgtaaatacccatcatattcattttattccagcaaaggttcacatatgaaaatcacattttaaatatagatggaatgagcatttgcatatttctaaatatggctaagcaagtagttgcacatagagcatatataaacccatttgagcacaaagagtgtgctcta

SEQ ID NO: 95220 - DNA, 648 bp, Oryza sativa
gattattatacatttttttttacaaatccagacaaatacatcgcaaatatattgcaaatatgttcaacgatgaaaatgcaatcaaaggaatgagaaaggcaaaggaaaaggaaagacaaagaaagcaaagaaggaaagaacaaagaaaatagctgtcaatggaataaattgaattattgtggtaaaatttttattttttggttctcgcaagattgactcccggctagggttccagcggttaccgctaaggatccaagattaacgttgcataaatgcaaaggtaagttattttggggtaacttatccttatctattgagagctacaaacataaataaatcatcatattctacaaaattctcacgctccataacttgcggaaagtttacaagataacccacaaaggcgccttcagaaaaacccttttactccaagattcttgccactcattatcatggcattttgtaaagagtccaggcatcgctgacaaaatgaaccgggaaaaacagggaagggaaaaaaagaaccaagctaccgttttcaaagcactactctacaattgaattagcgagggtcactattacttacacaatgtcaacagatctggcctgttccacctgttcactcaaaacaagacttaaacctaagcc

SEQ ID NO: 95221 - DNA, 743 bp, Oryza sativa
  unsure (1)..(743): unsure at all n locations
ccccttgaagtacgatctnctctgcagnagctcatcacattaacaaatgtttattgttgccccacattggcaaatcatggcgcagtttggctcaaaagattcttttctcagtttacacgcacactgcttaactagttgttctgcacatttaatattctatgcatgtgtctaaacacctaatgtgctgggtgaacagctttttttttcaactatacacggccttaaagcctatagattctgtgaactctctcacaagaatgcgtctgccggccgcaggatacataaactgtgtgacgtcaccacgtgacaacgaaataagccactgcgtcataaagtatacagtgtgactaaggctaacactctaagggtgcgtttgcggcgcactgatagcggctactgtctggttacacatgatctaaactatgtgcgccgttaacacaagatgattaatctactatcaagtgttccaaacttcaaaaaccggacaatatgattctctaaagcaactttcctacatgagatctgttaaaaacaacatagttttttcagaagcgtgcacgctgagaacgaaacagaactgcctcacgattgcccatatcaaccggcactgtacacaggctctgactggaccaggctactgaaacttacggcacaggagtccttatactcctatgaatgaaggcccagcgtatactatttgacacgcgatattcatacgagaggcaaacggtttatcatggaga

SEQ ID NO: 95222 - DNA, 748 bp, Oryza sativa
  unsure (1)..(748): unsure at all n locations
gtgcgnctttgatttgcttgactctcanctcngcaanagctcatcaagctatgtcaaatgaagccaaaaaaaaagatggagaaaaacagagagaacactctgctcctcggcttctcgcatggcggcagccggcagcggcagcaatggcgattattacatttattacatgggccagagcgcgacgccgtgtgggtaggcgacggcggcggcggcggaggtggtggtggtggtggaggaggcgactactgtatatccggcctactggttggacgaggccattttccccaaagacctcttttgatgaatcatattggggccgctttgagattttgatcgctagagaatggttaaaccctcttttatctctcaagttcccaaaattgttttgcaaattttcgctatataaagttgtcacattcagtaaatatatttggactaaagaacccaatttcatagatattcaacgcatgcactgtagtgggggaggggcgcgccactcctttatttttaaagacttgagacgcgcctaaagaggcctaccacgtttttaagtacggctaaagtccatgtgtctggggtgggaatggaaatggaaacccccaatttcgggttgcagtgttccgattaagggcattgtttcctgtttgttccccccctgcccgtacgggattcattgttagcgggtaacctcaaaggactaaaaaaaaatcacttttaggtacgaaaaaactcggatcagactattttc

SEQ ID NO: 95223 - DNA, 755 bp, Oryza sativa
  unsure (1)..(755): unsure at all n locations
agcggnattgatttcaagtgtnatcannccnnggcttgtagattcatcactccaacctctgcatccgtcctcacatagccttccgcctggatgtgtctcctccccttctcttctcttctaaggacgcttgtcatttggtttgggcccgtcctaatccaggttgatctcatcctgagatccttaacttaattacatctgcaaagacccctatccaaataagagcactgtcttagtccgcctgggctgctatcacacatgccgcagactgggtgtctaaaagaacaaagatttatttctcccagttctagaggctgcaagtcccacattaaggtggcagcatggtcagattctggagtgggcccttttccaggttgcaggctgctagctttacactgtattatcacagggtgaacagcaggatctccgatgagcagaatgaggctcagagagggtgggcgacttgcctatggtcacacagcaaacagctggaatttaagccctgctcaggagtagcccctgagctcaaactctctgtgactctgtgactccctggaagacccacccgttggagacccacttgtctccactcagtgcattagatttagcttagctctttggtttttggttttttctcttttagcctctatctcctggtcaggttaattaagctgttgttaccaacccttcttggtcagtgaggaagcaagtccagagcggctgaggtttgtgcacagccccactcaatctggaagaat

SEQ ID NO: 95224 - DNA, 591 bp, Oryza sativa
ttccttctagtggcaggccacacagttgtaatagccttcacctccacttttgcagcaatgtggaagtaattttacaaaattttaactaggttagtagagtgcagatgttcagtgcaaaattactcgtctattttaatgcgcaccagttgtcttcccataaaacaaaaaaagtagttgagccttacaaaataaaaacttagatgcagggtgttgagcattatcggtgattaggaaatagttccagttctaaactagagtgtttacaaactgatcaaaatcaaatctatggcgctttccccagaaaatttagaatggatatgttttacacactttttcaagaacacacgaatatactgcatgcccttcatacaaagaaggaagatagggttagacatcgtattactatatctgaataataagaggatgatatagttaaagcccttcatcatgctcagaagtaaaagagagctgaaactcactgattcagaagtttggatcactgaaggctgcaacatggactgttcacttcagaaaagagtcgatacttcaaatttatctacagtgatcacacaacctaatagattcactgga

SEQ ID NO: 95225 - DNA, 523 bp, Oryza sativa
tcctcaaatacaaagcacttccctagttagatgtaggttagacttgccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtatcccttggatgtgcccgtgcccaatgaagagaaagagcgcaacatgaaacgtaa

SEQ ID NO: 95226 - DNA, 761 bp, Oryza sativa
  unsure (1)..(761): unsure at all n locations
tgatggtnnnnntttggttgtcgtcatcattccttggcttgcagattcatcactccaacctatgcatccgctctgacatagccttacgcctggatgtgtctactccccttaccttctcttctaaggacgcttgacatttggtttgggcccggcctaatccaagttgatctaatcctgagatgcttaacttaattacatctgcaaagacccctatccaaataagagcactgtcttagtccgcctgggctgctatcacacatgccgcatactgggtgcttaaaagaacaaagatttatttcctccaggtctagaggctgcaagttccacattaaggtggcagcatggtcagattctggagtgggcccttttacaggatgcaggctgctagctttacactgtattatcacagggtgaacagcaagatctccgatgagcagaatgaggctcatagagggtgggcgacatgcctatggtcacacagcaaacagttggaatttaagccctgctcatgagtagcccctgagctcaaactgtctgtgactctgtgactccctggaagacgcaccctgtggagacccacttgtgttcactcaatgcattagatctagctcagctctttgttttttgctttttctcgtttagcctctatcttctgtcaggttaattaaagctgattgtaccaacccttcttggntaatggaagaagccagttcaaagcgcctgacgtttgggcacaagcccactccatctgcaagaaggct

SEQ ID NO: 95227 - DNA, 570 bp, Oryza sativa
atccaacggagttaaacacgcagagcagacaggcttggtccacggcaaataaaaaacggcccacatcttcgcgttgacgccaccacgagccgatgcagtgcagcccgtggtgcgccgcgcccttgccacaagtgagggaggggaggcctatgctgccgtggccacacggtcacaacccgtgcttgccgatgaagccccctctgccaccaccctcttccttgaccccgtgccacacctccgcgtcctccctagtgccgtcgtgcgcgcgggagcctcactgcactctggctacctggaggtccgactccagaatcccgtatctaacggcacgggaacattcgctccactgcagatcgtcctttgtcgattgttccaaaagcgcatcgcccagtcgttcaacccacgttgctagggagctccggccgccggaaccgccgctcaacctcctcaagttctctcgagctggtggagcgcgtcagccgtcgatgtttcccgtgcgtggggcacgcgatgtcaccttcggcgagggcagagtagaaccaatcgaagatgacgctttcttttcatttg

SEQ ID NO: 95228 - DNA, 621 bp, Oryza sativa
acagtagttcatgacagagctcctcgtcgccgtcctccaccacctccccgcatccatcctcgcatcgcgcgggacgtcgacggcggcggtgggcacgggacgtcgacgacggaggcatcgagtggcggctccggcggcgtgcgggcgagcacgagtgcgggaggaggcaccggcggcgacagcacgagctcagcggctccggcggcgtgcgggcgagcacgagtgcgggaggaggcaccggcggcgacagcacgagctcagcggctccgcttctcccctctcccttcctgccctcacgcgccgccgccgcctctcgtgtaacccaccacctccgttcctcccttacatcctctcctctcctctctccacttggcgaggctgatagcgaggctaccgccgcagccgccgctgctctggccccgccggccggcgctccagctccagccgctcgtgctccccgtggccagccgaaggggagagaagagaaaaagaaagaaagagagaagggaggaagaagaaagggagagagaggatgacatgtggggcccacatgtcagtgggccccacaatttttattttgtgtgtgaatgactaatgggtcccacgcatattttttatttc

SEQ ID NO: 95229 - DNA, 548 bp, Oryza sativa
gaacgtgacgggggtcgacacgcaaccactcgcgcgacgtgcgtggacggaaggtgccgagctgggcaccctctactgctgacaggaacgagcggtggttcctgtcaatcccacggttcaacagtgccggtgtgtcttacgccatacctgcatcaaataggttaatcagaaacatataaataattagttcaacatatgtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaagattgaattgaaattacacgatagaagtatttagtccgaacactcattacatcattttatttcctaaatcgaaagcattgttacaccatggaatcgcctgctgcgcgaccacgccttggccttgcgcgcctgcttgttgttccttcaccaggtggtcgactaccatcacttgcctgtacagatggacta

SEQ ID NO: 95230 - DNA, 584 bp, Oryza sativa
agtcccgaggtgttccaggtccccgtcaagttcgtgtttgataagctgacgccggtcgcgtcccatgggttctattctcaggattctatcgtgtccaggagtgtaatgtggtatttctctgtgggtggtcatccattctcgctgatacattcaatttatgtgttacgagcagtagttatctcgttgattgctcaatgtttttctccctatggtcctagcaattaccagattgatcgtggttcatatcattcgtcgcttggaggagacgataacaaaagccagtagaggggcagcataggagaaaggtgacaggcatcctcagatatgtgggcctcactactttgggcaggccacacatcctgctatcacagtctgatcccttgttcacagcggttttgtaagagtgagggatagagatttcaaataacgcgttttagctaacggagaatgagagcgtagagtagacgtattttggtgtacattttcacgggcccaagcatcccagtaagtgctcgttgtaaatgggctatggacctgttgtaaagacaagcgggccactcggaatggtacatgtaccttgtgcg

SEQ ID NO: 95231 - DNA, 820 bp, Oryza sativa
  unsure (1)..(820): unsure at all n locations
cacacacacacacacacacacacacacacacacacacacacacacaacacacacactacacaaacacaacaacaaaacaacacacactacacacacactacaaccccctatcacacacacacacacactcacacactaccaacaacatacactactacacacacaacacaccacacacatnacacatatcacacacacacacatcacacacaacacacacactacaacacacaaccacacacacacacacaacacacacacacacaacacaccaaccacacacacacacacacacacacacacacacacacacacacacacacacacacacacacacacacacacacacacaacacacacacacacacacacacacaaacacacacacacacacacacacacacacacacacacacacacacacacacacacacacaccaacacacacacacacacacacacacacacaaacaaccacacacacacacacacacacacacacacacacacacacaaccacacacaaacacacacacacacacacccacacacacacacacacacacacacacacacacacacacacacaaagacacacacacacacacgacacacaactcacacacacacaactacaaaacaacacacacacacacttcanantcacacacacacacacacacacagacataaacacacacacacaccacacacataacaacacacacacacacacacaccacacactaacacacacacacacacactcacacacatacacacacactcacacaactactacacacacacacancacaca

SEQ ID NO: 95232 - DNA, 660 bp, Oryza sativa
aaattagtaataattaaaacccaatcaatcatacgttaataccacctcattttacgtaaaaaaacttaatcttcatcttctttatcaacaagagaaaagaacacattatccaatacagcaaagtatcagacgcaacacacatggcatgagtagagtaggtttgcaagtcaagatgtgctagacaattcagttgctgattcggtcttaaataacaatgaagatttggcggggaggaccaaccagattgaggttagatgtgtgtaagaaaacaatccatctaattctatcgactcgctgataagatatccaaacccagcatcgcaatccacatcatagcacccttccgtagaacacaagggaggttagtttaattgcggaaatatgcatatccattttccatctttgtactcctgcaggctctagtgcagtgcaccccaggcaagtgactttatacgccactgaaattgctaggtccaccactcatttatgttggaccaactcttctcgccctaatccatttctgaactaaattagccataatcaattactgaagtaatccactctcaattgaactgaaaactgagaagatacgtattggaaatggcaagcactctcaattgtttttgcactcttgtaaacaaatcgacaaaaacctgatat

SEQ ID NO: 95233 - DNA, 740 bp, Oryza sativa
actatagggcgaattcgagctcggtaccctataaaattatttattgaaaattggtatatgtatacttttatgaaagtatttttcaagacaaatctattcatataatttttacattttgggactcatcaacttaagagatattcataatttatattcataagatttgacttaaacattatcctaaacgacttcctttacgagtatagagggagtactagattaatttttatgggatagagggaatactagtagtactatattaaacacatagttgtactcccttcatcctattttaagtgcagccataattttccgtgctcaactttgatcgtccgtcttatttaaaaagttttttaaaaaatttaaaaacataagtcaaatataaagtaatattcatgttctatcatgtcataacaataaaaaatactaattataatttttaaaataaaacaaacgattaaaattagccacggaaactcatagttgctcgtaagtgagaccgagggagtttggttcactcccttactttaacaaactttgccacactttttaagacatatgtttggttcacttccaaacttggggcatggcacaattttttaatttaaagggccacgtgtcatacaaccacttttctagtcaaaccatgtctaaggtgtgttcattaatttataagccatatatatgggtatggtttggcaaaaagtgttggaattgtttgggaagggaccaacaaaccc

SEQ ID NO: 95234 - DNA, 541 bp, Oryza sativa
catggtttgagcacaagttgtcaccacttacgtttccttcaggaatcaggagtagttgcagcttttttttgctctcaaggtacgtacttacagcatcagtgtgtaataatcaagttttgtctggcgacctttcggtaaccatctagagccaagtcatgggaaactggagttgggactgattcaactgagcttcgtgtggttcagaggctggcacgttactggcacttcctagttgcaatcgaatcaaatatcgacactcgtcctatactcctagttgctgcaatcaatcagagcttgacactcgtcctagttgcgatcgaataaaaagcttcacagtggcaggaactccaatcgacacgatgggcactacaaactgagctggaaacttttcgtttcatctagagaagtagagagagccaccacttgttcagtcctcctgttgtgcgtgtgcctgccgagcgccatcaaactgcaaattgctagtagtagtgcggaaaggctgattcgcgatcgatcgacaggaccaactggttgcgatcag

SEQ ID NO: 95235 - DNA, 587 bp, Oryza sativa
ctacatcgttatttttcagagcaatcgcgcaaactggggtagttgtcccagtacacctgcgcactcacgcgctaactctgcctcagcattcagcagccataagcgacagcacttcgccctaattcccctgtagactacgaatcctctcggtacaaaaggactcaaggagacactcttctactccaagtaagccacacggtagaatctcccttcaaggaagacgacgactcccggagccaatcggacctacaggctacagttccctcagcacgatcaccgacgggaagccccccccccccaccccccccaacaatgcggatggaaccgaattcaaatgcaaaaatgcgcgaaaggagaggtgcggagagatgctaccgattccgagaccgaggtggatggtggcgaccagcagctgcccgcgccgatgctcgccttcggttccaacgagtcccccgccgcggacgccatcctccgacgatcgggcggccgccggttcaccgtgaggggcgtgaatgcatgatcggttgggccttggatcgccaggaggttggacttcacttccccaccgttgatgggctggttgggct

SEQ ID NO: 95236 - DNA, 643 bp, Oryza sativa
tggcttgtaattgtagtaaatgggtagccgaataggccctgtatagaatgatagaataatttttgggagtagattacatgcacgtgaaaatttattaaacttcagtataactatcgttttgttattatatatgggtttagtttaattttgatttaagtttgaatgcttttttcacgtaattttgtatatttatgaactgtaagtttatttcatgtttagggtataataatctactgctcaacattttatgaagaaaaaaaaaggttctcttttaaatgagtaagtaatggagtaacggaaaccattgaatcctcatctactccctccgtcccaaagaaaaacaaaccctagtttccatgcccaacatttgaccgtccgtcttatttgaaaaaattatgaaaaaaattaaaaaaacaagtcacgtataaaacattaatcatgttttatcatctaacaacaatgaaaatatgaattataaaaaaattttatattagacggacaatcaaagttggacacggaaaaccagggtttgccttttttttttgggacggagggagtagatgagaacttttaaaaatttcaagcaccttgaatctgatactcccataattctttatttgcgccgtgggccctctcatttatt

SEQ ID NO: 95237 - DNA, 725 bp, Oryza sativa
ataccgcagttacttaactttttaggagttggtacaatgcatcttaaaaggtgtcaaacagtaaagctttatatagctgtcccgctgacttttttatatagtcaaggtgctgtttggatttatcaagcaattgattggatacaatatcattgctttttgccacgtaagtgtgcatttttattgaccaatattatgactaggctgattatatattatggtcatttttcaggcggttggtaaatcctttatgagtttacttactcggatgttataccacatatgccatatatttccaggtgtggtgaaaccatgtgtcttttagggacttaagcacatctgttgaagcagtgtgcgcatggcgtatgcccaatactttggagatttctttattcacagcattcaagcttctttatagttgttttgctatgtgaactttcaaagatgttgtcaactttaggttgtacgcatcatattttacaaagcagttggtatatcactcggatcatgttatttggagggttcacaccgcatatgctatatattgatatcaagtcacttggttgattacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggta

SEQ ID NO: 95238 - DNA, 740 bp, Oryza sativa
tgcagccccgttaatagaaaatggcctcttaaagaggagaagaaagataaacctgagacaactgaactgaaacggatggtagataggaaaaatatatggtagaaactagtgaaaccctaaaaactatcgttggattgagaattgataaatagatatttaagattcgtccacatttttcttaaacttaaacaaccattaatataaaacgatagagttcacgggaataaatctacattgccaaacagataaactgaaagcataaaaccatccgtttctaaagaatggggactgcactaaggccacaaacttcctaatgaaaccacacaacggagaaggtgcaaatcgacagggaggtgcggcaatgccgcgacgattgcgaccttgggcctcctttggcgtgcacaacgcttgacaaaccagcaatccccttcggttgcctccacgatgacggcacaaaatagaggtatgctactgagtcacaaattttggtgtaagcatccccatgctcagcaagagttgtccacggagttcgtcgttaaatctaaggagagtaagctcaacccgaacaacaaactctgcatggaacaagctgttaggaaacacatgggaagatggagcccaaatccaggttcccataaccactgaagaactcgaatggtggcaaacgaactgttgtcttcttggatcgacgtacgtggttggggaagcgtgtgaatcttgactaatggaaccttggcatt

SEQ ID NO: 95239 - DNA, 526 bp, Oryza sativa
atgtgccaggcactgtgctaaggctggaaatacatgagaacaagatatataagttatctccttatgtaaaacctacttgcatatatattagtgcatacattagaatgtgtattccacctttattcataccagaatcataccaggacacctagatagttcagtaatgctttggctggcaatcgtttggctgtcagtgaagaaacctgaaaaacattaacttaaacgttaaggatattatctcatttgcataagaaatttgaaagagagtcaaccagggctgatgctctgaatttatacttctatcgattactcaggatccttctggctttctattgtgccacttctaagcatggaaccattggttctaagcttgcaaaacagcttctccttcttaaggtatttctccaggttccagactggaaaagggggaaaagccaaaggaaaaaaaaaggcaggtgctccccgaatctgagctcataaaagagctttctccaaacttaagagttttctcaataacatccattta

SEQ ID NO: 95240 - DNA, 705 bp, Oryza sativa
ttgtagccaagattcatccacgttacaatgagtaaaaattttactacatttattacttatgagtaatggtgatgtgaacaaggagttaaatttttactcatggtgatgtggacgaatctcataggctcgtttttagatctaaccaatagtttttaagtttttgctgtataagtggtttgcagtatatattttcctaggtggatacttggtaatgcacacccgtgagttggctactttctcctctcctcaaacaggtcgtccgctgggtcaccaaccttcgctgccacatcgtctctcctcctcctcctctttgcctgcggcccccgcatccgctctctcccactgtaaacctctcccactgtaaacccccacccatttcctgccagtccccctctctctcctcttcgagagattaggttgttcgactgtgctgctgctcatgcagcaaaagggatcaagaacaggggcaggggtcatgtggtggaggtaatcaattaatcaattcaggtaatgcgggagatcatcatctatctggctaacctccgccgcgtgcatggccgaggcctacaagctgatactagttcttattgtggactagttttattgtgcatttaattggttaactacaacagtgtgccgattttttcgagaatttagagtatttactatcaaattcaggtgcctcagcttttttaccactcagtt

SEQ ID NO: 95241 - DNA, 710 bp, Oryza sativa
cgttttcagggcacccccctatccccggcgctaatgctaatgactctgcccttccctcactcgtgccgtgtccgccacgggaggctgacgtgtggggccaacgagggggcggggtggtgggggccatgtaggcgtgactcaggcgggtaggttcgtgggtgcgccatgacgcggctggcccccaccccgggtgattagagcagctacaatagcagactatcagcgctataaacatattttaataagataaaagataagagagaaaagctgcgggctacagatttgtagccagctacagcatggactctaaaacgcaatatgtatatgatatgtgagaccatatattagggcacccgtaatggttatctataggctctctaaaagagatctatgtcagcatatttttctacttggaataaattaaataaagagagagagtaaagctatctactaacatggagatagtctgtagagaaaaacgaggcaatagaagagagagctatagatacccatgtagacatactattgaggtggtttactattaatctagtctattactgagatgtacatgttttatagagagcaacttactttaccattgcgggtgctcttaataatatagtaagcaaatattatatgaactggctattagattagttataagtgaattggaactaagtattgggctatgctattgatgaacgacttgc

SEQ ID NO: 95242 - DNA, 1630 bp, Oryza sativa
caagttataaaataagtttagataaaggtagtagtattctttgtgcttctttcacatttatagtatagtggctaatcgaatattatatattttaaaacaaaaaaagtatacgggtttttttttcataaagaaatttttacataagatagctgttgtaccgataccaaagataggtaatctgcatgatatggaacgaaccgtatcctctgacattactcagtaatgtcacggtgtggcattacttcaatccacaccatccattctaaatcaacggccgtagattatttgacatgcaattaatcaaactaattagtaaattgtgcagctataattgtccctagatcagatattgcattttcaagaggcaaacatcgttgactggtggaagaatcggcacatgatgataattaggtttcacttagtacttgttagatgcagcgattagcacattatcctggaggaagtgaatcctgtgcatcaattttgtgctgccacatcctctgtcgtcggaacggggcaattcttaatctacaagccgatgggttaatgtttaatgaagatgaagagactgctttagtgttaaaaaaaaatccttcccacctattaagtacatacctacatagtacatactctgctagttagtttgattagttagatggagtaccaattaatctgtggccgttgatttagattggatggtgtggattgaagtaatgtcacgcggtgacattatacaatcagaggatacggttgggatatggaagggtttgtgttcggctgcaacacagctagcaagcacaataatttatgtctgtggcaacggatatactggctagttgtgttgtgtatactatatcaaacagtcgaatagaccctctaaaagaaaagagatgtagatatgtttatattttgatcttatcgatttatcattaccaattttttaagggcacaaaataaacaaaatccgaccattattttcgtgctaaaatatgatagttttggaagctttctttcttaaaagtatactaaaattttgtgaacttttaaaccaaacagagccccatactaccaaaattcgaaaaacttgaaattatgtcatcgtaaaaataggtttaacctaaatatcattatgtaaatgggctttactcttataccatttgcaaaaagagctgcacactagaaatgcccttggaccttcacttcttttctagttctggctgaacctcatcatccatgtcttctcctcggggggtgtaggctgttgtggccacctcatcccctcactgccatggttcctccttatgtcctccatgtgaagaccctcctctaccatgcttgttgtctggatccgtcctttagtccttgatgtttcactaccgtcctaggcactttctcgcactgccaccagctcaaggcccaatgctcaatcacaagtcccgccaacctcctttagcttccacgttgtcgtcctcatccagctctcgcgttgtgatctcttcaagcccatgcatcattgtcctcgtcaagctcctatgtagccacaacctcctcaagttcctggtctcacggaactccagtgttggctgtcctttctcatcatgctcatgtaccaactgtcctttgtggagct

SEQ ID NO: 95243 - DNA, 702 bp, Oryza sativa
cacgcagccttttgctgttgctttgctctctttccatgcagtaagtacattgatgagtgatgacctctttcttggtcctccctaaattgcactgtgacaaaggagtcctccaccaccatctcaccctggggattcagatttcaaaattcaaaaacagaagcaggagtatcaactggccacaagggacaaaagtcaaatcttaatcttagtgctttgacagctgatgatttgagagtcaatgaacaggaatttggaataaccaaagcaaaaaaatgaaacattgtccatgtgaaactgtggccgcaaagttttctataggtgcaggattaggtaaatggtgtttatatggggtattttcattggcaatattgtgccattatggtgtaattaaatttttccatagtagcctttcacacagttaagaaaggtttaatcttacgttttgacccgtctattaattattaattataaatatatataaaacatgtctattaggacatattttaaactttccgaccgttggacgttattttaaacttctcaaccgttagttataaatatatggtattatatcatggtactccctcaaatattaaaaacatgtcgtttttgacacattttgaactttcagactgttgtacacattttaaactcctcgaccgttagttataaatatccggcatgtatggagtaacagagtaa

SEQ ID NO: 95244 - DNA, 1389 bp, Oryza sativa
agctcgatgatggtggcgacggtagctcgatgatggcggcgatcaccacgcgccaccgagctcaccagatccagcatggggctcgccggatctggcctcgggaggtggcgacggcagtggctcgacgacggcaacgacaacgacagtgggacctccgtttacccacttccactacctcgttggatttggctaaagctcgataactgtggcgaggaagctcgacggtggcaacggttgaagatcaggaggggaccggctcattgggaccacctgacaatttctgacgaggttcgcgcatccaaatgaggcttcgcgttcttctttcaggcacgacccacgccaagctagctcagaatctccgagctggtgaggcgagtccaaacgccaagtcaccgcactgtgaatggccttactagcgccggtgttgctagcacactagtgccaattgcaatacaggggtgcgacgtacagggacaaaccacacaggacctgaaggaggaggaataaactaatttctgttagtagttttgtatgggatccacccttttgttctagggagttgattttacccaatctaatggaaagagaaccattttcacaccttaaattttgtttaggattcccataaacagatattgggggtaagatttagccattctcttaggctgcgttcgggaggaggggttagaaaccccttctccctggcacacaaaacaaagcacgcgttgttgcataattaattaaagtaccgtattagctatttttttaaaaaaagattaatttgatttttttaagcaactttcatatagaaacattttgtaaaaaaatacaccgtttagcagtttgaaaagcgtgcgcgcgaaaaacgagagagaggggttgggaacttggagataagaacacaaccttatagcaagtttaatagtatagccaactactaactccaattcatctatagccaatctaatagctcacttatacaatagttacatactacactattagagcacccgcaatggtaaagtaaggtgttatctataaaacatgtacacctcaacaatagactagattaatagtaaaccacttcaatggtatgtctacatgagtatctatagctctctaatccattgcctcgtttttctctatagactatctccatgttagtagatagctttgctctctctctgcatttaatctcttccaagtaggaaaatatgctgacatggatctcttgtagagagcttatagataaccattgtgggtgcccttaacacctggttacacctgtcatacacacagcgtcttggagtccgtgttacagctggctacaaatctgtagcccactactcttctctctccttatttatctccttaaaatatgtttataac

SEQ ID NO: 95245 - DNA, 631 bp, Oryza sativa
agaaactgtctacgtaacatagcacaagaaacagatataattgagtaatgctcctattaaatttaacgtctggaccatgtttttagaaagccattttgcacacttttattgatatgaaaacacagaacgttcagtaaaataaggggctcatcaatacaagaactcttcaaatcaaattagatgtatgtttagatagaacatgtgccaaaaaatttggcttcccggcgaagcgctcaacagagacttgcaaaatcacgtcaaaatattgcattcatataaatttgttgacgaaaagccgcattgtttccaccacttggaagtgtggctgcgttctttcaagggagagatagggaagattgtgactcgttttccacgcgcatgcttttcaaattactccctccgtcccagtatgtaacaagttttaagctcgtggacaagtattaaattttaaactggtaggcggcaaaagcacatacggcaatacaaactagtactctattcttttcttctctttcactgataactatgctgaggggtagaattggtagatttctggtaaaagttgtactaggttgtaacatttgggacaaattttgaatgccaaaacttgttacatattgggacggaggga

SEQ ID NO: 95246 - DNA, 701 bp, Oryza sativa
tgattcacatttggacggtgtttcctaaggctcatgattgacaccacaataataatggacaaaaactagaacatactagaataagttccaatgttcatcactaagacatatgtcaggcttggaggggttgttttatttttgcatcaccatatttctcaggaaaaaaagttcctatcaacaaattatggatgtacttctgcctgcaagtgacatgaagcataataactaaataatatttcacattatgtttcagactgccatttaattaaatcctaatggcaatttagtactatatttcccaacccatgtctgaacacatagcactcaattttcatacaaaattttgattattgaggcaactaaactaaacataaaaatttggatgcaaggcctaatgtcagtgcagtttaaaatgtgaagtaataatagaacgtttatggctttagttatgctccaagatgatacagaaaacttgataaagagttctttacaccctaaccaaaaagaattgttaagtgtgggcccaggtgtcctgtgtggaaggggtatgccagggataacaaactcatagtttaactcacaggaactcccacctacatagttgtcagttattgtgaattctgatactatctgggtatttaatccaatatgtgaccaattctactttgtgactcaaaaaaaaaaacactttggtgcaacat

SEQ ID NO: 95247 - DNA, 915 bp, Oryza sativa
atgaaacattcaaagcagccgcttctcctatcgcttgagcaagcaacacctcgtcttatccatccatcaataaaattagcatatgctaccacaaccaccaccagatgtactgagtggcatcacgatacttcatgtaatagccgggtttttccctatagtcttagtcatgctaatgacttggtcacactggctcgaagcggcgttgatcgagccatatggctagataagacctactgatatgttgaattttctcttttgctttgtatagcaatttatgaatggaatatttaatggccaatattaagtcatatgcatatgcatcattaagagttagactaaaccttgtgagagtgggttaagtcaaatgtggttcatgcatgccatgtgtttgtgcaaaaccacaccaaggtattgtatgattcctacccacgagtgggacttgtgatgaccgtaaagtgtttgtgcaaaaccacactcacaatcaaaacagaaggcatctctcaattagctgtcaatgtcactatcaggctgagacccctaaagagatgtcttgttcttcaaaagctaaagcaaattgtaaaatcaaatcagtaaacaaacattcagtgacacaaactcaaagcaaactcgcttgagtagagtgttgtaccatgtaccgcaggcacaggtgtcccagcactcagatagtgattttagtggagtatcacataagccaacatttatagtttttccatacttcgcggcatcagcgccggtagtatgaactttaagcaaatgcagtgtagtgtgctgatactgactttatcgtagcagactatgcagtgtccttttttttcaccagctgggtgcagtggcacgtagctgcccatcccatctatccatggtagactgtgcatcaacatgttacaatcagtc

SEQ ID NO: 95248 - DNA, 651 bp, Oryza sativa
aaaaattaaaatacaatgatctgatctctagatagcaattctcaaactagcttgaatgcttgatcatccataggggactcgatcatcatattgcatgttgcattatgatgttcaattctgttatctaggaagaatttgatctttgtgagagattcctgtagagacaaaatcatataggatcatgttttttactcataaattaggggaccgatacagtactacgaattctttggctgcatcagtgaagaactgaagaatcttccatgtaatgtaactcagagataaaaggtactatatgttgatttgctggagagctaattgatccattggattgtttcgtagccagtttcgtactagacctcacaaaacaccctaccatgttattagtcatattgatatttacaacctgcaagaattattgacggcatacgtcatttgtgcacatttgattgctatatatatccagttaattggttgctatccagtttgttaaaccaatccactaaaattcagttccatgtctacggaatttagttcttaaaaaaaaagaagtctatggaatttgcttgactagatcctacaagcacgaacccttgatgctgttcctcctgacagtaattcgttccagtgcctgagatgtcaggcgataat

SEQ ID NO: 95249 - DNA, 1379 bp, Oryza sativa
ccatcaaccattgtgtggggttcacatcatctgccattgaggctaacggcaaacattttgccgttgtattcatccgtgccacacattcttctatcaacagctgcatgaagtgatcccactattgtgattaattatgaactactaataagcagaattacttatttctcttttgaaaaaaaaatcagcaaatagaatacgcactcggcggcaaagcgtgcgagcaatcaagcatagaagcagagcagagcaaaatactgcagcaaagcaagcttctattatactgagagctatccaaatcctcgaacaatagtacatatcttataaaatactatttaagtattcatttgacaaaaatagcattgccgcactactactatgtccatacagagtattttttatccaaaaactagcagcgaaatgaagctactaacaaaatccttgagaatacaactcacaaccatttgaatcaccctacaaatgtatagactgatataagttaaaaaaatagaatttatcaaatcttaaaaaaacagtctactctacttttgttctcacacgctttgccgccaagtgcatattctgttttctgattttttttaaaaaagagaaattagtaattatgctgattagtaggccctaattaatcatggtgggatcactgcatacagccgttgatagaaggatgtgtggcacggataatgcaatggcaatgtttgccgtaagcctcaacagcagacgatgtgaaccccattgtgtggtgggagaagtgcttagggtcttttggctagctccacatggtggtgggttagccgaccaaagttcgaagcctcattcattctatttatttgatattagatcattctctaatattcacttttttttaaccatgtgtgtggtgggctggtgtcgttgctacgtaccttgaagatcacgagaccagagcctacatcagagattaattaggaggtggaaggggaagtgctgaaaagggtttccctcgcggctcattgcatcctgcgttatgtcggtgcgtgacggtagtatgcggtcgtgagaagagatcgtgagagctcatgctgataatagggtaactgataaattgggctattgaatgtgtcaactcataatatatagagtagatagtgtgattatgcatatattatttcataggatagtccgcatctattgaattttagggataccatattcgtattcatatcatattatttgaatccgtatccatattcgctaaaatttttataaacccatactataccgtcattttggacagactcaacgcagaactaacatacgatccgttattaccctaggaggagatgtgacgacgtgtgttctaagggcaaacgaatcctggccgt

SEQ ID NO: 95250 - DNA, 545 bp, Oryza sativa
aaagtattcaaggagtaagtaacatcatgatctatattgttttgatagtaaactgacctatccaatgctccatgaaagtagtaactacatctaaaactcagaaaatttgttgataatacagaatttgcatgcctataaacgatgagttttttttagcaagaggccaggcctcccatttccattagtagaaatggagatagacttacacagagttttttgactcattgactactacctggcaactacattcctccaaaagccaaccaagcagctggatcagatctggacatcaaataaatgacagcgagtatatatcaacaacaaagccgataacccctgccaagtaacaaggtcatggaataggcaaagaaaacatatcatgatcccaggaaatactggtcatggtataggcaaatataacatatcatgatcctaggagatactggtcatagtgtgcaggatctaacagttagaagagtcaaaaacagtatcaggtgtaccaaactatgccacatgctctttccggctttccaatttatgacgcc

SEQ ID NO: 95251 - DNA, 954 bp, Oryza sativa
aattttagggtgtgaataagtgttttcttggcaaatgccatttgcattcccattgccatggcaaatgcgctggcacaaagaggaaggaccttaatatttctcctcacgaaaaatccctgcaatttctcttttaattatgaggaaattgcaatttctgtcctcaagaaagcaacaaaaaaacttactatttggatggatggttggttatcctgaataataacttgatttgattgtagtgacacaaacagcatttgcaaggaaagttttattcagttggtattaaacaaactaaatattagctcatcagttgagtgttcagttatcacaagtaacttgacctggaaaatttgattcctggggctccctggttatctttttcaggaagccatttctgacctaattaatttgtgtgcaggaaacagagtagaagtacaccaccattgttgcttgtgtgctgcacacactcaagcatagcttgctgactagaactaaaaaatgcttaaaaaaataattttcgagctaagaattggtgtgttgattgaggtatatgcatcagttagctggtctcgttacctggctcataaacaggtgacagcaaatgagggctgtcatgtgacaagtggatacgaattttaaaattatttaggacaatagagaatggcctacgtttttgttttgttttctttcatttcttttcatggtagttatcagtattattagactaactcggcagtttgtcattcaaaatacaacaaacattggttttaaaaattttgagtcttgtgaattctgtataaaacattttattcgtgcttataaaattcataaaagaaattcttacatccccaaaagatcactctagacacgcatgcttcttctacttcttcttcttcttcttattgacgagtgtggaagttctcaccatttaccataatttgcgagaatcacttaaga

SEQ ID NO: 95252 - DNA, 775 bp, Oryza sativa
aggttgccccgttggtgccttttggctagccagcaaggctgggcagtggcgtggtgtcggtgtcggtggtggcgacgatggcgggaagagtcgagcgcattgtgctcttgcggtggctgggaagaagaaaagaaaagtcgaaggatattaaggtttaggggtttgcacgaatttcaaaacgatccaatggtccaaaatttacaagatgttataggatgtttttattaaatgtagagtagatagtctcaactattttggcacggaagtagtattgatttatggattggatggggagggtggccataccaatatcagaatgttgcgcttcttattatttcttctttcttttttttttactgtgtgcaacttttgtatgtcccgaaggtgaggtgtcggcattatattcacatctctttatatagtagtgcacatttatgcattacagatcgaatctatccatgggatgtaaaggttcaatcttatttccttttgaaaatgcatattggttttgactactctatatatactttatggattcatgaaaacatcaacaacactgagtgtaagcctagataagagctactccctcattttatatattataagtcatttttttatttgggagaattgcatattcgccactcctttcaccctctaactcgaaataaccattataaaatcatgaattgcaaatttgccacgaaaatagtgtgtgcagattctatatgccatcgtcgttccaatttgttcaagtaaaagggcaaaaataattcat

SEQ ID NO: 95253 - DNA, 1168 bp, Oryza sativa
ctgatctagtagccatttgaatcatttcaacattcaccatttgcctcctttcccaccaaatataccgtattcccctatcgaaacaatttcagcaaatttcaaatcattgaggtgtggttacctcctctcatgattgtcttctagtaaaacgattgtcttctagtaaaacaaaacccgattgatcaatattggcaatattctcaattttgtttcaaattcacatatttatccacacttctatatagctctatcacattgaaaataatatgtttaatatcctcacatatacggtccaatcgtttggtttattcatcatcatgaaataaaccaaacaacatatttgcaaagaaaaaataatttgtaaattttatgatcgttaatagaatattataaaataagttagcgagaatgtgtattatgagagacggagtaacaaattaagttaatatgcaaggacgagccgggggagtatgtaatactagtattatcaccatcagtcatcaaccattcttactctttcgttagatatgataaggttggaaggttcattttgcctctaatatagtctgtattaatgaaactaatcactagattaagtctactaagtgattattagactaaacaacatcttctggtggcttggtgcttacgccacacggaagcttattagtagctactccctccgtcccaatatgtaacaagttttggcattcaaaatttgtcccaaatgttacaacctagtacaacttttaccagaaatctatcgattctacccctcagcatagttatcagtgaaaaagaagaaaagaatagagtactagtttgtattgccgtatgtgcttttgccgcctaccagtttaaaatttaatttgcgtgtgagtgggtttttactgtgtttaaccagctttctggcgccaatgtgtttgaaatgcacgtgtgagtttgatggcagcaaacagaccgccaccactgagttttagtacaggaataatcattgagggtagtatggtctttttgcaccttttcttaatacttgtgaacaagcttaaacccccgcctcgtttctggaagattctctcctcccccgctctctcagaaacaactcaaatcacgattcgctcctgcaacgctgcacgcgcgcggcacgaggagtaggatgccggcggcg

SEQ ID NO: 95254 - DNA, 649 bp, Oryza sativa
tccgaccgagtcgtgcaaccaatcactgaacttgttgactatcatgtgggtccagacaaacaacatatatatgcttatacatacactagtcggatggatgggtcagacgtatagaccgagtcatgcaaccaatcactgaacttgtttactatcatgtgggcctagacaaatagcatatatatttatacatatgacagtcccatcgatagagtatacatataagcatatatgctatttgtctaggcccacatgatagtaaacaggttcagtgattggttgcatgactcggtagaacacaaatcatggctcggtcgtatatcaagataccagcagaaatactatagtactactccttccctagcctctactagtcctctgaatcctgcattgctgctgccatagtgtcaatcctctgataattctgaagggagttgtcaattctgggctcgtgccgctctcatgatctcatccgatccggtcgtatacccaccccccatctgctggcttttggtggtcgccactcagaacatgacacgcagtagtacaaacgctgaagctctggcacgagaaggaaaatacggggtggattggctgtgttcgacggccattctttcccacccacatctctcgtttttttccctaaacgata

SEQ ID NO: 95255 - DNA, 738 bp, Oryza sativa
aaacatgatgctactgggagatgatgtaaaggaaaatttgacatttccgtgcggtattccaaagttgtggttggtctggaaggcattataaaactgtagctatctgccagagctcgttctgacataaacagtataatcatagcaagtactgcgtcagtcccaaaatatagcaagtgtgtccagatgcatagctaaaacttgctatattttgggacggagggagtagcaaaggagtgcaccgtgtttattttctcttggtacaatattgttgagagaaaaattccatatgcctcctctgtcctttcccttgtagcatgcccaaaagttcccgttttctgggtataatatgttcaaaattccatttctgacgttttgagaatattctatattttttcagattttaaaaacgtttttcaatttccttaacgttagaagtagtgaccaataatatttaatcaacactctaaaatattctgtttaaattcaaggtattgtttggaaaatttatttttctccatttttttagttaaattcgtatctttaactattaaaaacagatgggattttttggatttttgggcatacgtgggatctgagatattctctgtgaaacataagatagtgttcttttgatgggtcgggtgtgttgtgacaactggccacccttttggtgtgtatccaaacaaatggtcaatagcaacactgtcttgtagccaattttgacatcaaatgattagt

SEQ ID NO: 95256 - DNA, 735 bp, Oryza sativa
tataataatccaatacgagattattaaaattcgtaataaaaaagtaaaaagattagaaattagaaaaaaaataaaataaaagacgagttcaagtaggaatacaatttaaaattaactgaaattcggaattaaatataagcaatattgaaataagagtacatataaaaacctaatagtagactaattaaaatttggaataaaaaattaacaaaaatctgaaattagaaaaattaaaaagagagttcaagtaggaatacaattttgaaacaaatgaaattaaaaataaaaaagaaaaatattaaaagaaaacaatacgatattagttaaaatttgaaacaaaaaataaaataaattctaaaattagaaaaagaaaaataagatttcaactaggaatacaatttctgaataactaaaattggtgataaaaaataaagactattgaaataaaagaccatctaaaacacataagaagattaattaagtaacatatctataaaggagtagagtggtagtggttgatgggacatctaagaactattaataaaacaccaaatagaatcctaatgacgattaagaggaagaacatggtaaaggtggttggcgggacttctagaaagtaaaaaaaaacccaatgataatcataattgatttttaaaatcttagtggcaataaaaatgagaggcagcgggcgggccgtacatgaatacaatggcagagccgccgatgattagtgag

SEQ ID NO: 95257 - DNA, 641 bp, Oryza sativa
tccatttctcacagtaatgaggatgtagaactattatggttttatggctgactatataggctcgttttgcaaacaatgatagggaaatgatatcccacccatcaaaatgtaaaattgcatcctagccatccattctctccacctcatttcagacaatggtgtttgcctaatgccctttcacccatttcactattccaatcctgcctctcataacccatgtgctaaacaggccctataagtttacccaatgaaagaagagagaagacagggtaatacttaaagagactccatctgaaacttgtgtgcattgttccaggctctctttttttgttgtgtccaaagtttcaaatttggaaattcctctacatatattcctgttttcctggtccttgtcatacaacctagacagtaaacatattatgtgattgtcatatgccaatattagcaacatcttgtgtcgggtggtaaaacctcttttgcaggtgaaattttggtaactaacaacaggagaatgatatgcatttgtatcagtgcacaggaggattaccagcaaaaagaagagatatgaaggatttaacttaatcctattattgcaccttgcaatctgggaacactctgggatttggtcaaaagttagaaca

SEQ ID NO: 95258 - DNA, 907 bp, Oryza sativa
cttttttgtgctgggaggaaaagtttctaacaccctggttttaacgcagccttaactctcgagcgaaagcttatgaaaaattaaattttagagacgatcgccttaagttgtatcagtctctgaaaaatggtgtcactcatatgtatattttcttcataacgttctatatgtactattaaaattgtaaagctcaacaagatatgtacgacactcatttaaaatcgtttacatatccgaaaatcaaacaagtaaagtgatctcgtaatattgtagttccaccaggtgtatcaaatacactactactaatactttttgtcgtacacatatctagctgacacaaaatttaatagttatttaatcaaaatgggcaatgatcgcttctgttacgtacacagtatgcaaatatgatccaataattctgtgttctctatctcctgctgtgcaatagtgataaaagatttagtttagagattgagccaatgtcaaagataacatggtctttgcaggagcgtgactacaaggttacaccggtagtcaaacgaacgagctagtgtgatgggatcttaagaaaaagtacacaacgaggggtatcgatttcctgtgaaattaattgtggaggtcctttgcaatactggttttatctgaagagtaagggcctgtttactttgatgtcaaaaaaaaccttaccaaatttccaaaattttggcatagttgccaaaattttggtaagttgccaaatttttttgcaggatttcttatatagttaccaaaattaggcagcaaactaaatgcagccatttttttggcaactttactaaaatttggtaatgttgaaaatggcatcaaagtgaacaagcctttaatgccattttcaaccttaccaaattttggtaaagttgccaaaaaa

SEQ ID NO: 95259 - DNA, 651 bp, Oryza sativa
aagaaagggattgcaattcacatagctgaggaattgtgctgcaaccaggactgtgaaacaataacagatatcgaaccaaacacttccatattctattcggtcaatctttctataagagaattgaaggaggtttgtaggggaataatttcacacctttaatccctcccttctcaggattaaatgggcaatttcaaaattcccaacaattttgcaatgcgtagtttggattactaacacccttcaatccctcccttctcaggattaaatggacaatttcaaaattcccaacaattttgcaatgcgtactttggattactagcacccttcaatccctcccttctcaggattaaatggacaatttcaaaattcccaacagttttacaatacgtagtttggattactaacactgggcatacgaataaacggtcaccaaggttagatcttttggagttaacacccggttcttttttaccagtcggctctctcaagtgagagatctgtatgtcatgacggccaattagacaaaagcggttgcatctcggttgtgcctgtccatgaagcattgcacaatcagaaccttgtgacaacaacaatctgataacttccataataacatgataccgtgtcctgtctgatgttctgcagtagttg

SEQ ID NO: 95260 - DNA, 626 bp, Oryza sativa
atcctccgttaactgctcgctgaattggatagcacactacggcgactgccacacagggtctctctctctctccagtctccagctcgggcgccggtggtgtcgttgccgccgcccgtgtagatgacggacgggacgaagatgacgccgctgcggagggcggcgacggcggtgctggtggtggtcctcgccgtcgtcgtggcggcggcggcggcggcgaagccgaggaggatactggtggacacggacatggacaccgacgacctcttcgcgctgctctacctcctcaagcagaaccgctccgagttcgagctcaaggttagtgtggtgatgctgcagccacgtacgtctcagcacgtagcgtgtatagcttcttaatttctcttgcatgcatggttgatgacttgattggtggtagtagtagtagtaatggttttgcttaccttcttgcatttctctgcaagtccgcattcctgcctaactataggagttatccggtcattggtgggggatccaaattaatataatttattccccccaaaagggcccaaaaaaagggaaaaaaatatggagatatacgttggttaggcattgcctttgatcgttccttgcagtgacaactaatatat

SEQ ID NO: 95261 - DNA, 1505 bp, Oryza sativa
tctataagcctgattaaacctatagaattttaactaagaaaagaatcaaacgacttgcaatatggaacggagagagtattatttttgctaggcgtgatgatataacccatatttgcacgtagactaagtatagcctctggccgacatgagaaagtgatgcactacatgttgtcacgagaatccttctacggaacgcatatcaaaagagtatgtaaaattcgtctcccaaacgggtcctggcgcaggtacgacgagcacctaagctctggcctaacaaaaattcgcgatcgatgacgctagcatcccaatgggattcttgcttaattgctctcagcactcattgatcaacaaaagatccccttttttttaataacacatccaatcaatccttacaaacgatagaccacccataagagaacaatttacaaatttaccgcactaggaaattctaaacttgataccgtctgtctcatcattattattcttttcgattatatactcacgtatacaaaccacgaacccacgagaccatctttcttacacatactcttttaatagatgataccatttacttttatacacatatttaatcattgttttattttaaaaaatatgtaaatatataaaatataaattatacttaaagtattttttatgtaataaaataacacataacaaaataaataatgattacacaaaatttttgataagtcatacggtcaaacttatatgtaaaaaatcaattgtatcatctaatattgaaaaacggaagtgatatagaagtagtaaatatgatacggaggccaagagtagatccatactcaatcatgtcacccagttaaaatgatcagtctgcatctacatgcatagatctctagccagatgcttttacaccactaacaatttaattaaactgttagcgtagaaccatagaccccagatggaatcaagatttttccatttccgacaccaatggcgattgccatttaggctttgttccgaccaattgcggcagttggagattccgcggtcactccctcgcactccaaagtggcctctaaagtggattacatgtctaattctattgagagtgtcactaaccaaattgatggttgtctttagtggtaatctagtccaaaccggccggcccccacgcgttaacggcaggtatgaaaacgggctcgatcgatttgacaccttagtgcgtagatgcatgcatccgagacccacacaaaattgatataaaccctaacttgctaattacttgaaggctaaaggaaactcttgctaattttatcaaactgaacatttttcctatattttattcattaagaaacaacttactgatcgaacaacaatatgcatgacagcatgatgtttttctcctcctcaaaagttgattttttttcttttgttactggcatgttacaatctggaattaattgtacttgatcatagcattgcgagtagcactttttttcctggtccatttataggtggcactg

SEQ ID NO: 95262 - DNA, 645 bp, Oryza sativa
ttttagggacgacgtgtggcatacaaatccaatcgtcgaggtagaaataaaaccgagaatgttcgaatcgacgcacgataaataaatacgtcgattgattgtaaatattcgagggaattatcgagttcgaaacgacaaagtggttttaaaataaccgtaggataacaatttgagagagcgatattattgcggtgagggcttcaggtctgtgattaatttcgcactgaagcgcttaatcaataaacggagacgatgaggaaaggaaaggatgtcacacaggggacaaccttttagggaaaagaatttaataaagatcttttggcacaatacctaaacacacacacaaatcacaaatcttattatacaaactgggctaggcctttccgggagaaaaaccagactttatctgagaatgccatttcttttaaaatagccttgttgggattcatttggcaaatagaattcttataaataatttactagtagatattatttgcaagttatttttcaaagtacttaaccctttacagtgattcttagaaaataatcaaaacaatatttcttttgtaaaatagtatttatttttatgaactatcccataggggtatccatccaaaatagtaacagataactttatatacagag

SEQ ID NO: 95263 - DNA, 513 bp, Oryza sativa
tacgatgctgtttcttgaagaaagatgctcaatattcctacctttcctagctttgccatatcactgcacattaaattccatcatatgtcatttgtacttctacgtactaaaatattgtacctataattctctctacatgaaatgcttacttctaagcaactgcgaaagaacatttgtttactgtattaccgttttccgataatggaaaacagcattgtttttctatatcctagaaaactcagtttagaaaaattatctaaattgcttgatattttcttcaacaattttattacctacagtcatgtatagatttgtataattgctccattatctaagaaaagatatatcgaattatagaacgcatggtagctgtatataaataaataaataaataaataaataaataaataaatatatatatatatatatatatatatatatatatatatatatatatatatatatatatatatatatatatctcagctcgtttttttaattagatacaaaaat

SEQ ID NO: 95264 - DNA, 534 bp, Oryza sativa
ttcctgcagcccacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtccc

SEQ ID NO: 95265 - DNA, 567 bp, Oryza sativa
cttcgctgcttatcaggtattcaggtcaccttaattgtatttgcaataataatgtagtatcaactgttcgctgcctctagcagcaataatataggtgtaaactgtttctttcccatggttaattttaattttgctgcatatgatccagcaattatctcgtgatttattgcattcaacaatgtggttaataagctacgacaggtagaggcaaccaaagataatttatgagtaaacttttgtattagtattattacagtttaaaagtaaggctggaaaatagatcacgatgaaaaaccataaaatcaactctgaaattcaaattttagttgtaggctgtagatgataagtcaacaagcagacgatgaaatgcatgaactttagctacttcagtgcatgtcttgacttcactgattatatcaatcgaaaaaaaaaagacttaactgattatattgagtaatagtgccgactctacgtttctatatcttcaggtcatacattccgggattccaatcacgatgattcctcttgatgcgaccaacacaatttcggtcaccgaggaattcgttt

SEQ ID NO: 95266 - DNA, 599 bp, Oryza sativa
ttggatccaaaatgtacatcccagatctccttgttacatttatgaaatgacccccgcaccagcctatgtacattttgcacatacaccatcttgtttttttcccaaccccacattggtacagctccttttgaatcatcagatccaatcgggagagggggaggggagagaggctaatcgatggagacaccggccaaccagtcgcgggattgagtgaggaggcgtggcggaggaggaggcagcgacgacggcgacgacaacaaatcgtttgctccgctagccagatggatattgtctgcaccagcgatcccgcggtgagcttctctaaaggcctccaaatccctttcctcgtcgatgccgaatgctgagcagcgatcatgagatgagtttctttcttctgtttgcggggttggggagtcgtttggagcgatttgttgcagaggctgctgttgtgctcttcgacggcaggaggaatgcacagattgctgctgcggcccttgctcttaattattaattatattcctatagaatgtcaggatgtaggatgtaattaataatcctccaagctgtgttcccttgctcttaattattcattatactag

SEQ ID NO: 95267 - DNA, 706 bp, Oryza sativa
ttcctgcagcccggttaatattgcgcaataaatgatttaaggtttttcttttatagtaataaacacagtgaatcttctaaaaatcataactaattcatccgagctccgtttaatcccattcaagtctcagtaaatcaagaaaaatgtgtagaatccattaaaaatggtgttgttccctgtttcagtagtcttatagcctgtttgcaatgtttgctttgtatgtcgctagattccgtttcctctgacgctccggtgtacttcgagatagtcgccgaggtccctccagcagcagagcaaggcaagtcatgcttgtcacttgatcatattgatccaatattgcaaatgccctaatgttttctttcaaataccgcatttgttttgcaatattactatgggatggttacctattgttacagccatactattttgataccatgctcctttgttagcttgggtcataacatgattagagttaggactagggtttgcttagccatgcttagttcaactagcacacaatggggagatctcatttaaaacctagattatagggttatatgataatgttggattagtaccaccgctctggtgttggttaattaaaatgaatcacatggtgggctgtgggtgcatggttttgctggtcgcacccatggcagttaaggaccggttcgcgggatgccctggaagaatttatcgtacttac

SEQ ID NO: 95268 - DNA, 726 bp, Oryza sativa
  unsure (1)..(726): unsure at all n locations
tattttttanatttattaatctggtgtttttgttctagatgtcttttttaatatttcttatttttattcctaattttagttattctaaattgtatttctatttgaactcttatttttaattttctagtttttgtaacttatttatttttatttgtaaattttaattaatctcttattctatatggaatgttattttagtattgctttttttattttgaatttctgttacttttgaattgcaatcctacttgtactcttatttttctaatgttgatttttaatgaagtgttttttcaatattctttattttttatttcgaatttattttatttataaattgtatttttatttgaactcttttttttatcagactaatatgaaaatttctagtttcacaacgaacgtgatgtcttcttttaaggctattgtaataatataatagatgttgaacaatattagagtaatttctatgctacttaatgaggattaaaagcagtattggtcataaaaactaacaaacatatttatataagagaacaaactaaacaaccggaacaacatttgtaattagataggaaagaaagatagagagattgacctgcttattttgtgcatgtcatctctgttgtagccaaaccacatcacataggcatcatgtggtaagtgtgcaacgaatcagtttattcacgggattattaaaacagattatttgctgggctgcaggaa

SEQ ID NO: 95269 - DNA, 711 bp, Oryza sativa
  unsure (1)..(711): unsure at all n locations
tgcagcccaatagtattacctgtttgagagtcatcatgtccagttaagcatgacaactgtggtacacgatagagggggggaaatgatcactagtgttatcaccggtcacttgatgcaccggtgaaaaagtattgtactactctatcaatgatcatgatgaatagtcggtagtctcaaaactactactccagtatgtatttaccggtgtctcaacgagattttgatgggtttcctgtctgcacggggcacagtgctggaacccaataccaacgttcttttcctgattcgcaacaaccacaataaaaccacgcattttacatgtcaattatgccaacaggctgcctactggatggccataatacacgccacttgtgnggcnccgctaatccttatctcacatcgatctctaccatctactactaactatctattgtgaagtctactaatcttattatcatatcgactgaagagtgccaaggaacaaaaacactgacaatattaagcatcggacaaaccggtgggatcggtaggtacaatatttttccgtttaatcgtgacacatgtccttgatcttggtatggctattaactaaacactgctagctaacatgtatacatatcatcgtctaaagaacttcacacatacacggatcgatagacgttatcgtccacgaacataagtaaggtggagcattactagcctgcaatggct

SEQ ID NO: 95270 - DNA, 520 bp, Oryza sativa
acgttttttaataagttggggtcggccgtccccacagatatggcataaatcctcctctgccacaggtgccacatagttaactcggcatatgggcatatgatcccatcgttcacttttcagtcatacaatggtctgtgtgattgatgcctattacgctggtgcatgtagttgaaatggatggtgtacgcgtatgtgattagagtttaattgattggtattttgtcatattgatttatttgattgtttttaggtaggttagatatagataggctcatgagtgttaaattggaatttgagttaagatctgtaagtgttaaatatatgattccccagattaaattaatagtagaagttttatatgcacgtcggataacgttgcactagtgagcacatcctgcgatccgcataggttgcgactagattcgatcaacagcttcgcctttccggccggacatcctcatcagcgcgcggtcgtacgtgtccgtaggcgctccgggctctgtcagctctgctcccctcc

SEQ ID NO: 95271 - DNA, 721 bp, Oryza sativa
cccagaatttcagttaaaaagatgtaataattttcctcaattaatgaaacatatgaaacattttcgttggaacagttttcatcgtggtgtgcaatatgtgaaacattctgtgataatatagtgcaacaccgtccagtatttgcaaaaatataggatgttcaacaacactttcctattttatactctaacatgatacgttgtatttctggaatagtgatggtacgttaagcaaacataaacggtgtggatttacatttttaaagatttttatgcaccaagatatcacatgacaaaaagtttactagccacaaatatatttgactttttaaaggaccttgcaacatgtctattatttccgacccataaaaactctatttctaatcatcggtttataaactaatggttagtgtaaacaaccaaagtgtccattgttaattaaaaatgtagttattagtactataatagataagttgtatgcaaagaataaacttcttgattttgtgaaccaataagtaggtatgaaggtagaaatgaaattttgtttaataaagtttgagggctagaaatgtttttttaaatagaatgaataattgtttattccatagtctaatttaaaatgatcttgactactcccttcgttctaaaatagacaaatatacaaatatagcacaagatgtgatgtattctactttacaaatagacaagagtttgtctaaattca

SEQ ID NO: 95272 - DNA, 656 bp, Oryza sativa
gtaattatttataattttcatattattggattcatggttaaaaaactttcatatacacatatagtttaacatatttaaaaaatttttttaataagaggaatggtgtcaaacattttaaaacgaagggagtataataagcgccacatgtcattgatggcaaatagttatttcaagtggcaaacagttaaaagcccccggtttcagagagagaacagttaaatgccccgggtttaagagagagaatagtgccacggaccaatcaggaatgcaacggcttccggattggtccttcccattcccattggtggtttcacttcaaaccaatggtttctttaatgtttccggcctggtggctttggaatcttcttccctggaatggggtggttggttgtggctaataaatcaaaagttccctttcaggcccattttcaattaattttggttcaaataagaagcaggaattcttggtttcctggggttattacctcctttggtttaaaatttttttttaggttccattccattattgttttggttgggaagggaacggttaaccggggttcactggagcagaggttggcctgggccaagggtggcccgcggggtacgtatacgaagtcatcaactactcctacaatgttcttcgtctttgcgtt

SEQ ID NO: 95273 - DNA, 1520 bp, Oryza sativa
cgtcgccggaggatacagctcgcctttctctctcccatgaagatctggcagcatagctgagagcctttgagaggaaaggagaaggcatattgagggtaataaatgtccatggcggctgtcacttcaactcctagctgtttcaggttttgatagcgcagcgaacggtttcagcctttcaggtgagggagactcaaaggcggacatggaagccgaatggctcagttctcttgcgtcgtgttgcgctgagagtggagatggaacgatagcaggtaggatgttctggggtacgtaggaacgtttggttgggttttctgcgtgagagacactacatgcaatctgatggaaattaaggggtgatgtggcaaagcgagatgaccaaaaaaatactattaattgcactaattggggatgaattgtattggtttataggatactatgctatgcaaaataagaaaaatactatatgacatgctgaacttcagccatttccccttaaattgataacatgttggtttcttttacaaactgttagtgttgttgtacaaaaggggacaaaaaaaaaataacggattgccatgtgtgcaatggtgtgcttgcttgaattttctgtttattcctcaaatggatgtaaaccatgcatcttgtgctgcagatggattgattgctttacgggctaaaagaaagggctcaccctgccaacaagacggcgattctcaggggctgctgacatagagataccaagccttccagaggtacaccataaataaaatgtgatgatgaaacatcttactagtagtgtagtacaagtaaattatgacgattactgcttgaatcgcacaaatcggtcgaccaacgttattaaagtttatgaacggagcactttgatgctataacctcctacagctgctgcatcggaactgtttttccagctgttgcacttactttcaatcacaaattgtctacacataatgctttcttctaagctggtggttcttaggctgggagtttctcaagtcaacatcaatgatgagcttttgccactagtctccatgctgtttctaacttccttaaattgtaccatctcaaaaacggttccgtgctaacaaatgttatctccgttagaccattgcagtcagtacatggtaattttgtgagccgcatgtccttgtaggatggcattcttgtttgattccccgcatctccccatcctgactccccgcatcttccccatcctgagttcctgacctagtgtatgaaaatccaagcaagtaaccaaacacaccttaatgtttctaacttcatatcaatttattttaacactgtagctgccaaaagttatttgattctgatacatatttaactgagctttctggttgtttatatattcagatattggtaccctatgcaaagtgcatgtccatttctgttccttttctgccattagacaattaaacatcattccatccattttatctggcacaattgcaaagaaacaaatagtgctgagcacttaatacatg

SEQ ID NO: 95274 - DNA, 683 bp, Oryza sativa
ctattatatattagtaaagtttattattttgtgctaaatagcttagtgatttacaagataagaatagattaattaaatattagtataaagttgtaaaatatagatttaaaaaatagttttcaaagaattcatatatagaaaaaattgcgaaaattacaccacctgaaagcttggggtccaaatgcatataattatccaacattatttttttcttataaaagaacgtgtaagatttctagtccagatgttggagcagagaatttcacacgaaacaactattttgacgtctaaaacatatcaatatcaatttagtgtataaacgtaacggaactctgtatgtatattttgttgtgaaagtagcgatcgatgtcaccgaggttgttagtacgcatgccattttgttggggttgcttgtagttggtgatgactatccacacaagatagtgtgttcatttttcgcataatggtcggtcgcatttccacagcttttgaagcattattcatctaatttccaacctttagcatgttatctctccaactctattagtactccaaccaaaactaacctcaccccaggttggaggaattattggctgggccatgcctgcctcccaactcaatggtggttcttgttcctccatcctctggattgtggggccatcaacttttgccctgatgcactc

SEQ ID NO: 95275 - DNA, 568 bp, Oryza sativa
aaaatatgaaaactcgacttgttgaaaattcataggaaacttaaaaatatgaaaactcaactttctgaaaattcattgataagcggtaccacctaagttgactacaactgtgtcgtgtttgttctcctgagctgattatatacaataatacaaatggtctgtctctagtatttctcaggaggtgtgccccagaatcagtttcattcatactccattcataagccatagtacaaagttcagacacgtacacacaaccagtcgttcatacattggagtacacggtacagacacagcatgcccgtgcacacacacactaccttcatctctaaacacacagacacaaccctctaataccctctaatctgagtaaactacagtagtgaataaatcatggtatacaaaggcacaacatactccagatatcacgtatgccgcatacacaaaaatcttggtcgccacgttgagacaagcgaaaacggataccttcacctcaatcagataataataagtgaaggcagcgagaacaaccgaaactagagacataccgacggcagcaaacatgaggata

SEQ ID NO: 95276 - DNA, 977 bp, Oryza sativa
aagcaacaaaaaaatggccgtctgctttttcttggacggcattcttatatgtaccaattcaccaaatctgctggttggtggattaacagcttgataattggtatattgattgtactactaccactaattgattgaattatgagaaaagttaatgaaatcttttctaattcttcagcaacaagagtattatctggagccatgtccattttgatcaaccaatcaatcaatcatttgtactactatgctcccccttttctgctgcaatgcttgcaggtgacctaacattttgcgacttctttaatcgcaaggaaatcttgtaaacagcgacacctgatgaaagttggtgatgttgatccacactatttcatcatagtactatttattcagttcctttcttggatggaaaaagagaaaaatggttgttgatctttaataaaaataaagataatctgcagagacaggtgacaggttaaagtcatggtcatcagatctttataggagatgatgatgtgattagattataattaatcctctcagtgattagttttttttttctcctgggccaagttgttttcaaccgacaattgtatctttacgcgattcgcagagatcaaagttaattgaaagtttgcttccagcttttcagctatgctcacacacaacaacaacttgcaaaatcaatcaatggaagagggagagctaacctaactcatcatggcaaagagataagatatagatagatagctgcataaaacagcagcaaacttattttgcttattgactttcctgtctaatgaaaaagcaatctgctttgcaaatgagcctgagcccagtgcttcatcattatgtcctatactttgcgctgcagattgatatattaagggggtgtttgggaactagggactaaactttagtccctctcgcaaaagcataagtccctaccctagggacttatgtttttgagagaggggctaaag

SEQ ID NO: 95277 - DNA, 841 bp, Oryza sativa
gcatgctgcgcgatgaatttgaagacaagctagcgacagcgggatgtttgtatacacgatacaccagggatggaaggtcgtttgatcatgtatatatgtgtttgaggggtttcacgaggaacgagtgtcaattaaggaaagtgaatgttgtggtggtctattttaatttacatttgtttcattgatttattattgggctctaattggtggagcaaatccgatcaaatcactcgctttcagaagaaagacaatggagtaagagcattaacgaggaaacgtcaaaagtatatatcacggtggagattatggatatgtatgaatctcttatccctttttcctccaattgatggagacattagccactgaatcacaagccaattatttggtactcctacctgatgatactctttccttttctaataaccctgtgacaccttcttcattagtacttttgttctgaataaaattctctcaaatagtatcaacaactaaaccatttcataatcaagagcacatccacatatatatttatctcattttaaaatcctcgaaatggtgctaatctttcttaatgatcacattccaattaggacataaacaaatgtgcactagtactcatcaagtagctactaccatatgccttgaaatgtgtagggtcagctctagtggccgttcatcactggctagctatagcttgtgcatgtagtgattaataatttgctcataaaatttaaaaaaatagtagaaaagaaatcaccacttggcccgacaacaacatctaggggacttgaacgccaccctaagtggacatcctataaccattattcaaacaccccatctg

SEQ ID NO: 95278 - DNA, 662 bp, Oryza sativa
tgagctatccaaattgaacaagaggatgaaatgaaagaaaattttgggagggaaaagatgaaaaagacgatttcacagtgttagaattaaggtctatgccatggaatattacttctgaatatgtacgttgactgattctttcaaaatcaaatgcattaatatccataagaaactacaccaaaattaaacagttggttccagtagcataatttgaacatgatatatatgatatatagttaaatgctagctgataagcaattaatatatttaattgaatacccaaatatcgtttgcattataggtgagtcactagtttcataaccatgagtccatgacatgaatatcaagttagggcagttgtctagttgtgaatgtaaaggcaggttacatgatatcaattaatatgacagtggtgacaagtcagaatgataccagtggccagtggggtgtgctagacatgcacaacagatgctaaagtagttaaaagtaagaactgcttgttatattcgcaattatctaattcacatacatgtattaaattgcttcaagacttaaaaccaactccaagtaacaagcgatttggaagcaacaaaacaaaaagggctcaaatcagtcttcttgctcattcattgctcaggaaatctggaaggaaagaaacacaa

SEQ ID NO: 95279 - DNA, 1231 bp, Oryza sativa
cccaaaaatgcaggattcatgcctgttgcagctgtactatttcgatcagtttaattaagctggagtgattaacaatttcgtcagtattattgccatccaaattaacgcgacatccatggattggaaggtaaaccagtgttgttttgccaggggacatcagcaacctaccgtcccaggaattcagacttaacagttaattaattaaaccaaatttatatgcatgcatgcacgatcagacattgacctcttcctagctccatccgtgttttggatgatatgatccatccatgtttccatgcagtcttgtcagctaatcccggtccatcgatcgatctgtttcctgctccgagatcgatccttcgttgtttgcaggttttgctccttggaatctgcgtcactgctcgatcgtcagaggagagagatgcagctgatgagctactacagtaagtaggtcgtctgaattagtctgaaccattcgtgtgtttcttttcttttttttcttctctgtcagatcgatgaactggtcagcagtaagatccaatattcttgtagacgataccaatgcaaaacatagcctgcctcctcaaacagttcctggccagcagcgccgatcggcggtctgaatttatttgtcccaggagtaccttcacagctgcactttcagattttattaaattcactggtggtaatatatcccagtacatgctggaatatctgaaaaacaagtgcatatatatgctacgattcaaaggtttcacctgcatgcagtgctgtggatttaagatataaagaagtacaacatatgtacaaagtacaagaccgtcaaatctttctgatgaaattgaactgtttcatgtgaaattcctacatttcaaacaaatcaccacgattttaagccagtcgtttttcacttgttactaaactcttatgcatgcattcaaataattcaccgtggaacatgaacggttaggctcccttggattgtaaggaaaacatatgaaatttaaagcattttaattctataaaaaacatactacgaaaaccttaaaacaagaaatgttgaatcctaccatttccttaaaaatttctatggaatgaacattcccacgaagattttaaagaaaagttagcaagagcttaaaccacttggaaatttttttttaagtctatctcatttgaagatgtgttttttctctggcctagttaaacaatcattcccatataattttag

SEQ ID NO: 95280 - DNA, 1377 bp, Oryza sativa
taataccctcataacatggtccgcgggtatgccccgtcgacaatcattattactaaaaatatctataaattactccaaaaacaaaatagaaaaatcaaatggcagaaataacgtaaatgattcaattaagcctcagaaatctttttcacattgtattttccactaatactaaaaattctaaggatttatttaataaactttgggttttatgaattttttacagttttaagaaaacaacacacccaacccaacaaaatcattcagaaatataaattagtatgctaccttgatccatttaaacattataataatatatttaaaattcattgaaaggtccttttgggaaaatatttttaatgaaaatgaaaataactcgtgtaaaaattaaacagttttctagtatcatgtacatgctactgtaatattatgtacagactataaattgattggcgggctaattttgtaatatgttataatagaaggatctatgtgcaaaatgcaccaccgttggaaccaacggccagattatgggtgggtccgtcggacgggacgggaaggggaaggggtgatcaggcggaaagctggatgatttgccaccgttggatcgtccgtatcccccccaaaacccggaaccctcaactttttgttcttttattttttattattatgagagtaaatttcacttaacttttgttaccattgtactctcttcgaattgataatacttgtctctttggacaaaaatacggtctcaaaaaaactttaatcattattttttattataatatatataaaagtgttaacaaatatatgattttattaaagtactttttttagaaattattagagtgcttttaagactaattatttcaaagagaaatattttaaaaatgattcataataaaaaattataaagtttaacctcaccattatctgaatccggaggaagtagcattttggataactctttaacaaatgtttctattatgaatccaataaatttacctttgtgatatttcggatcaccctcaactattttatacatctccatcaacttattatatatcagagcaacaataaaaatatagttgtgagacttcattaaagagtacaaaccgaaatcttatatatatatatatatatatatatatatatatatatatatatatatgtatgtatgtatgtatgtatgtatgtatgtatgtatgtatgtatgtatgtatgtatgtatgtatgtatgtatgtatgtatacacacacttaaaacgagagttggagtggtccaaaagtaagattgactacccggttgaaattaaaatgacgtaggttaaatggtggtctaaagtaaaatattgataataaaacacggggctgcagg

SEQ ID NO: 95281 - DNA, 773 bp, Oryza sativa
aataaaggggggaaaagagaaggaaaaaaaagaaaaaggaaaaaaaattaaataggtcccatttgtcagtcaaaataatgccacgttatatctgcgtggcatgccacattagcgccgcgtaggatcctaaaagggttatggcgatttgggacctagatgacacactataacaagttctgggatttggatatgcattttgagagtttatggacttagatgacacacccctacaagtttaaggaccgcatatacactttactctttacaatatgtgattaattaaaatacaaattttctaaaatatttggtatttttaagtaggtaggtatataattaaatcaatttacaagtaaaataagtgtgagaaataaaatgatatggttaaatttaattttattaaattcccatgattagttacgctctttgaattttattggaattttcagagcttaattgctaattttaataatacaaacatcatttaacaattatttaattagaaaaaggaatcaaaatcctcccttttagtttgggccgaatatggaaaagtttataattctcccttctctctattctatatgtctggtctgtttcctttctctgttgaagtccattttgtgtcctcctacaatcgggcctatgaaatgatgtcccagaaaaagtctaatttacgcccagtcgctacagtagcttcttcaagctccagccagtagcccggtctacacccgacgacacccgaatcccgcgtccgattcaactaaacacgtggagat

SEQ ID NO: 95282 - DNA, 1052 bp, Oryza sativa
tacgtttaatactcctaaatagtaagatttcggagggctatttaataggctgaagcatccaaacagggccgacgtcgcgaacttccacagactaacaggtcaaaaattagcagaacgtaaccctgcaatgaagctgcgaaacaaagaggacaagctgcacagaatgttgccctgcaaggaagtgtaaaatcacctgcaggaataattccgagttgattgtggtttcttgtgaactatgatttcttgtaaacttaacattgtgatttcttgtatgaagtactcctgtaaagttaacaacagtactcttgtaaagttaatacaactgtgaaattgtagtgcaataaaggaggctgatttttttttccaggtttctctcaggctgatttcttatgaatctgctgcatatgcagagcactgaacagtgaacacaagtggctactctgatctgaacatttactcgattaattctgattcttttaaatagtggtaaactggtaattgaaagaagtacaggtaggagtagtgcattgggactgtaaatctgtaatatgatgtttgctctgaggaatcaaaacattaatcatcaattttatctccagattgagtaacgcagttgcttgtggtttccaaaaaaaaatgatgtactccaattcaatccaattattcaggactcaaattcagaaaagtacattctgaaaaaatcagagtacaagcaatagcaagaaaagtacacctgatttttgctggtggtactgtggtagtactgaattcaatcataggtttacaatgcaatctgaattctgaattctgactgaaggagtagtagtgctaggatttctgaatttcgactgaactagatctaggagtgttccaagattaaattagttccatgtactccaagatttctaaattctgactaaattagtgctagaagttttttttttcttttttcagtgagaaaagattaaagtctgaatccttcccaaaaagagaatattgaagtctgaattctgaattctaccgttgctcagatgaaggccccgtttggcaca

SEQ ID NO: 95283 - DNA, 635 bp, Oryza sativa
aatttgtgtggaggtccaaaattggcaatcaacacccttgaatccaacaaagaatataatatccccctttcgccctctctcccttatcctcacgcccacttcctcttcccctcacccggtgcacccgccgcccgggcagcgcctcgatctgctcccctggctggtgccctggctagcgcccccggctggcgcctctcctcccctttctcggccgacacccctgggcggtgcctctcctccccactgccagccctcactccccacatcagcggcggcggaggaccccgaggcgagtctcggcgacggcgtctgtgtagtggcctcgcacgggcatgcggatcgagcctagcgcggctaggaagctctcagcagcgtggatctaggccggcctcactagcgggcgcggctgactaccccaaccggcggtagtcctcgcggagccaggcggagcagcggcagcgctgtttggagtgacaactcgccgaatctccctttctctctgagttcgccggagccaaatggatcttcaccaccgccgacgcttgccccattgagcctgtgagcttatccggcgaggacggcgtccggtcgccctcctccctgggcaacgcaacagtgtggagtatggggatgac

SEQ ID NO: 95284 - DNA, 606 bp, Oryza sativa
ggcattgttgctaagaagacaccaaaatataaccgtttagctctaagaaaatattgaagattaagaaagaccgcctctgtgatgatacagcatcaatgtattaatttcaacctgttaagattaataagcagaaaaatgtatatcatataattgcccaaaacggaatgcattgcaaactgttgttaaaaaatgaagtagagaaaacatgacaagcaagatggatctaaaaatgggcagcaaagctttagatccacagagggggatagcatgcaacaaaataaagtgtaattgttcctatctgcctgaagttagcagttgggtgagatataagctatatgctctcaatcatgaacaaacttactgcagacctgagttccactgactgacagatgaaaaatactccctaacagctagcaaccaattcaatgtggcagttaatatcacctagatataaatcccatcccacaaataaaaaagctcgatgaaacagtggcagaaatttttgacattcagaggacccattcggacaggggcaactgtctattaacaaatcacagactgaacaaaatcatagctgattgcagtagcatatatgcaacaaaagaa

SEQ ID NO: 95285 - DNA, 708 bp, Oryza sativa
  unsure (1)..(708): unsure at all n locations
gtggccccattgatagactgctagctcggnaccctcttaaatttcccctcgtgatcgcgcacaagatgtagacaagatgctccgtattcatgacatgcaaaatagatgattatagtactttgaaatcgcaaaataaacatgcggacaacctttgttataccacccgtctcacggacaccggcagatcggattattaactactccttgattagctacagtactttggaaaaaaaaacgttgactgatcaaaatttatacggcgacacataaaagtataatacacatttatactaaatctttaattaagacgaatgatcaaacgttaaaaaaaaagttaacggtgtcatccaatttaaaaatgatgtagtactgtttagcattagctttatatttttttaggaaatactactagttccctgacctcctggctactgcatactgtacgtactgaccgagtctgcagcagcagcaatcaactgccatgaatagagatgtttttcatatggacaccgaaatgcacgttatttagcgaccagttcgtcgtgcccttcaatttcatgccatgcaggcgatgagttggcaaaacaccacattaatcaagctaaacaaacacaacacatatcctctgatctttttcagccggattctggatatgagtcgctggcaactgggccccactctgataacgcaaagtcgaaatcccaaaag

SEQ ID NO: 95286 - DNA, 737 bp, Oryza sativa
  unsure (1)..(737): unsure at all n locations
cgtgctttatttgaatccttctcgtaccccttcactgaaacttgagggactaaattagctattcaccctataaaaaacgaaaagttgtgcttaaagtactataaataataaagtaagtcacaaataaaataaatactaattttaaaaaaatttgaataagacgagtggttaaacgttgcaaataaaaacttaaaatcccttatattatgggatattatgggatggaaggagtaatccatatacgtagagattttttgagctggtagtgaaaagtggcaaaataaaaataaatcagtgaacccgaatggcaaatcatccaagtcctgactttgggaagatggcaattggcaaatggagtagtccaaaatcccacactcgtcaggcccgctagggtttcaggcttccgaatccgagcagctccattccccaaatcgcctcttgtctcgcgccctcccgccccgttgccggcgacgagcgctgcagggcacagggtgctcaggctgcagcttcgcctgtccccgccatctgccggacaccaagcccccgcccaagtcctagcctgccattcgnccgccgnnccgccagnttttggccttttggcccccccttgggtgaaacccctttttgggttgtaactgttaccggcgtccctgcaggatttgttgtttcgttgtatacctttagtttttggcgcaaattgantctgcagaatcgaccttacttgtcaatttcagggc

SEQ ID NO: 95287 - DNA, 616 bp, Oryza sativa
aaggtttactcttttcttccttcttcaaatttcaattagtactagttggtcagatttgtgaagaaaaagatatcgtcagttgtttgccgaagctccggaagactgcaggatccgctagcgtagcaaaggaagcagtgaagccagctgtgaagcaggagtgaagatcttggaaaacccgtcgcagaacctaagccgccctatagggtaggttgttagtcgtgtgttccttgcttgtgtgtgtagtgcgtggtttgcatcggtgggttgtgatgtgaccatgctaggttgtttgtttaatcaacttgcagaataagcaaaacaaacaacacatcaataaaaagagttagttcctttaaggtcctgtccctagctctggtctattctttccttgtatgcttcctctctcaacccctaccttgtgacagatggataacactggtaacaaaggctatgggaatgatggatccgatgactcaagaacccaagccaatgggaatgagaaaagcatcaacgaaacctcaccagagctaatccaaattgtggttaaccaaaccaacatgttggcaaccgcctttcaactattacagaatcggaacaacccagcaggggcaaccaa

SEQ ID NO: 95288 - DNA, 558 bp, Oryza sativa
cccccccccccccattcatctatatcactgataatcacaaataccgcccatacaaacaaggtcaaggatcatagagaggacttatcatcgcaacccgcagcggcttggtttacaccaatgtatcttgattattcgtgagaggctatggaagttttaggtggaaatatagatctcgcccatttgttggagatgcagttaggtcgttttcgttttggttagtactggtgatcggatgttggttcagatcgtcaagcgctgtggagttcgtgcgaagtatttggtcatcgcacttgttggttacatgcaggtgttggttgggattagggccttgttatagttccgccgtattgaagctcctccctccccgtcacgcccccactagccggcctccgctgcgcctccgctctcaccaatccacgcatctggggaagaaggggaggagatagagtaagagaaagggagatgatgaagtggaggaagtggggtccattatttttaatcttataatttgagtgacatgtgggtctgactattttgtttttattttttcactgttaa

SEQ ID NO: 95289 - DNA, 551 bp, Oryza sativa
atgccgatgatacgaagtgaagccttggtagaatttctggaaataaaactgctctaaaactgcaactgtctatgtacatgatgctgatgatatggagtgaagccttggtagaatttctgggaatgaaactgctctaaaactgcaactactagacacttcaaattattttttagaggagccagagaaaaactctcaaatcccgcgggaattgcactgccttcttcagaaaaccccacagtatcttacaaaattcacgtacttcctctatgaaatgtcacatccggtcatcacttatattaggacggaaggagtatgaattttggagaacccctatagaatttggttcaattttctatataattcaactaaatttcctccattcgaaagcagagcaaagttggaggaaagaattccaacaagaatcacgaactagccatacggcccagggcccacaacaaaagtgggccccatccataactgacatcccagaaatggagtaggcttcgtctcctccaccccaccccaacccaacccaacccaacccttctctc

SEQ ID NO: 95290 - DNA, 732 bp, Oryza sativa
atatcgaggtgcaactgggtggttacaaggggacatggtataacaattaacaaatgaatgatcaaatgcaacaaattaggtaggtctgccaatctgccttgcagacgggacaacagattaagtgtgatcctatcaatgcataatatttcgcaagcaaaataattaaatttcaaatataggctcaagatgttcaaaggtggcttgccttgctcgagatctggagcttgatcctcgaaatccttgcactgtttcatattgacacgcgaggtagatggcgacctgcccgccttgacttgtgtagtactctctgttttcctgggtataacaccttttgattttggttaaagtcaaactactttaagtttgactaagtttatagataaatatagtaatgtttataataccaaattagtttcattaaatcaatagttgaatatattttcataatatttttttggtgaaaaagttattatttttttctacaaacataatcaaacttaaagcagtttgactttgacaaaagtcaaaacgtcttataatctgaaacagaggtaacttcaacagcaggtgccatttctttgagtaatggaaaccaacttgaataagacggtgcaaaattctattatagagcaggagaaaaattacaagattacaaccctatgtcatgtcgaaccaagaaaaaaatagcggcaacctaacatgcaaatatagtatcagaaaatggcatcattg

SEQ ID NO: 95291 - DNA, 514 bp, Oryza sativa
ggcaggagtgtgattttatggagcatttgaaaaagaacagagaatgtcatctttagaacaattgcccattatacaagacgtatcggacaggaggaaaaattcaagaatcagtacttgcttgattactacgtactagcctatgtcaaaaaaagatctgcttgatatccataaaaaaatgttgtgtagtatggccttttacaacaaatcttataattatctaggtcaacattttctatctgggctagtattaacagaacagtacaacaaatgtggagtagctttatctgagaaaactccacatttgatggactgttcgtctgttaatacaaatatgaggcctagcgtcaaaagacgggcacaaatacaacattgtagcggttaatattttccagcgaaaatctaagcatagaaacaaccatatgacgattttactgaacatcaatctgcggcaccatggacgtgtgcaacaatcaggagttgagctcacacaagcagtgagttgcctacctacctt

SEQ ID NO: 95292 - DNA, 721 bp, Oryza sativa
cctgataggagcgattagtagcagagattttgttattatgcaacctatatttttatgcgtaatgtaggtcaattctagtgttgttttgccttacgctttccccactgtaataggcgggacaattatattgcacaaacatttaattgatgttataatggtgcacacattcataatagaaataggaatgtgtgattgccacaaagatcatgtaatttactgcttttttgatcggtcaaactatatggattgaccaacttccatcaatgctgctagtatttttatgatccgctctgcattcagttagccataaaatagctcccatgttgccataatgatccatacaagcatcggtcttattatcactgctttgtgaatatgtttgtacaagctttacaaagctgtagcgttattccagagcagttcattagcttatgttagctacacttttgctgaataaagaaaatagcacatgtttgctagttaatatgatagacataacaacaaagtattcttgcataccagaaattatttaaacatgcttggttgtaatagaaacattgtcactgaggtattcgaatggaagagttttaagtatgttgcaccacttctcgaacatgctcttggttcagatatcagaaattcataatatagatataaatatttttcaagaaacttggcaaaaaccattctttggatgctcttgttttccatggttgaatat

SEQ ID NO: 95293 - DNA, 572 bp, Oryza sativa
actaaatatggcccaaaaaatcagatcagtatatcgtgataaattatctgaatattggagtacgtttcacaattatcattcagctttttagcttttacatctgcaaatgacagcaggaaggaagttatagtatatggcaaattaataatgtggcaaacaacgcgtaattggttgttaaatttgttcatgaatcataacgcattaattctcagtgtctctcaatacatattttcgttcattcagaaaacgcatgtcgatcgtcaggtgcacagattgctgatcattagagtcagtataggacaaattaaggatttgatatatcacaattgacagtaattaatttgcttgctgtgtgtttttatgaacttccttagctgatcatgttttcattccatcttcacctcgttttacagctgcgaacgaattcagaaagcattaattaagattcagacgctgcagaatgcaaatcaagcaacaataatgcatactaatatggattgcaaacactctggattacaactgagttatgatctacgtttttactcgtttcctgtttagtttctggtaatttc

SEQ ID NO: 95294 - DNA, 909 bp, Oryza sativa
  unsure (1)..(909): unsure at all n locations
tagcgacangctcgcaagnagcccancaagatttnttgtgacatttcttaaccactcatgacggtagcctagcggcaatctgaatggcagcctccgcgttaactctccattcatttctatttgtatcatgtatgtgcgtggcggggtcctcaaatatatatcttataaaaatcattaaataaatacaaatcatgaaatccgaacctaatactacttagaaatagatataggcacgaactataataccatcaaatccataggtgaattcgacctagactataaggctcaagcgctaagcctttgatccaaactccatgcaagttccatacaaaatttaaaatcatgcttgaatttacagagaactacaagataatatgataagtacccaaattaagttagaatcatggggttagaggcttagagctagcaatcgattatgtttggtttgaggggatgacaatctagcttttgagtgtgtttggttagtgggcaagagtagataggatggtccgacgagacaatattccacgaagatgttgcgccaaattgaccaaggatatccatcttttggaaattttaatcattagtaattgattagcaataattaatggcatttgtgattgagtagtaattaacttatcannaactaatgttnattagatataatcagtctattttattggtattaatatagagtatggctatattaataataattaacatgtgatggtgtcattcattcattctataatcaaaccaacaagaaatagatggtatatctataaaagtgttaaaaacgaatacctatcctatatgatagtttatttatccacttatcaaaacaatccactaagatatgaggcagacattttgtcatattagacaaatagatgaagaaatctcttttaa

SEQ ID NO: 95295 - DNA, 1425 bp, Oryza sativa
ccctctcaagggtcacacccacttcccccttcttaccaaggcccaaaacccacctcccaccttagtcaaaggcccctcccaccggtcaaacccgcctactaactccccccacaacccacctcttctcagctcttgtcccaggacggtgcagtaatacaacgaccactgtgtagtaacattgtgtcttacgtgcagtaacagcgttaaaatatagttgaaatatagtcatgacggatctacttttgataagctctttttttctagcatcatggtgcaaacggttttaaaaaaccttacatcacttgggatatattgtttttcaaagctcgacttttttgcaatttgtctcttcacaagtggtaatactatactattacttgttactatttgtctgttgtacgttactataatcacatcacgacgttactacactgcgttttactgtatttttttgcgtagtgttactgcattaaacacgtgataacgtgtatcttctgtgtagtaatacttttacttttgtgcagtaacaagtatatggttagcatctaagacttttaacctatatatttttgtttcaattcttgatttactgttgttcaccacaatattattgtcaaaagtgcagtaacgtcatatatatatatgcagtaacactatattggagggaggagatcggttttcttgaaaagagggaggaagaacagtttcttgaggaggggaatacatagatgcattttgaagtttaaacatccacatgcagtaacactatagaatcattgtgaaaacggttttaaaaaataatacataacttgtgacatattgcttttcaaatattggcattttgaactttaacactccatatgcagtaacatagtatgtaatttgcagtaacatacgtatatacatgcagtaacatggttttaccaaatgtataaaattgttcaaaacactcctacatcaatcagacctcgttcaaagccacctacagactttatctatagcccacctattcaatcttcatcttgtaaaaatgacatagtaaaactacaattattgtgcagtaacatagctacttgaaagtggtaacatgtacctattatgtagtaacacttctactttcatacaataataagtatatggttagcatgtgaggctttaacccatatatttttgttttgattcctggtctactacaattttactatgacattactaccagaagtgcagtaatgtcctatgtgttatacagtaacgtcacgtgttactgtatttttacaacaatgttactactagagcatagtaatatttatgagtttcgatagtgaaagatattagaattgataatcatattactttctcataaaattcttaaaacaaatagcattattagacgaattggttagatgattgtgctttgaactataa

SEQ ID NO: 95296 - DNA, 1503 bp, Oryza sativa
  unsure (1)..(1503): unsure at all n locations
gggagtgctcaatattaacaccaacttttggtatctacttgataggaagtagtagcatagagcatcctcagaaaaagagaggtttctataaacttttttttccttttaacttgaaatttcaaaaagagaaggctgggaagccttttatgttgtcttcttattgagcccgccaatatagatgttttgggcctgatcttcaacaatatagtcataagcccaactctattttccacacccaatagttccctcccaaaatatagttgttaatctatgtaactatatgtaagtacatgtgcatttcactatttatcaatctatttctttccataacccaagaaattactccctcaccgctaaggaacaattttgtttttgaacacaataaaatggtaatctgctcactaggtaaaagagataaaaatacggggatcgctagttggcgcgtctgccggcgcgtgtttctttgggataagggtanngttagaactanantccctttaaatttttaaaagcgctttcccccttttagataataaccgtttgagataatgacggtagtagataataagattttctttttcccgcgagatttttttaaataacaaattgaaaagaaaatctatatatgaagtcaaattttcaaaattttaaacccagattttaaaactttcaacttgaattttgaatttttaaagtcaaattttgaaaactttcaacttttcatctcaaatttgaaaaacttttaactcaactttgaaaatattcaacccagatttaaaaactttcaacttgagattcaaaaactttcaactcgagagttgaaaatttttaagttaagatttgaaaaattttcaagtcatgatttaaatacttttaacacaaactatttaaaaatacgtgtgctaaaaatgtttaaaaaataatcagaaaaaagagcaaaaacaaaagaaaaaaatcatgaaaaaagggaaaaaaaacgccgtgcgggggtgggaccgtgccgccagctagcgcgtgccaattagctttcttgtaaaaatacagtattattacgaagtccttctctacataatttaggccattgcttagtaaatacgattttgctatatatttatcgataaattttcttccaaaaatttgacagatgtaactacagtacaatcgtagtgtaattacactgtaatttgcatgtaattacattgtaactataatgtaactttcaaaaatctctctgtaacatgttatttcggtaaaatggaggtcgtgggaacaaatcttttcacatatgtgtgtgctgtgatttttttctttcctcacttattaaaaacccaaaaaaaaattttccctttttttgaatagatctaacgattcaaaattacgtgaaacttacatacaagttatactgtagttacatgcaaattacagtgtaattacatacaagttacagtgtaattacactacgattatactataattacatctatcaaatttttaggagaaaat

SEQ ID NO: 95297 - DNA, 675 bp, Oryza sativa
cccacacggcccgtacgcgcggtgctgccagcgctaatcgagattttttttcatagcgcacgtttaatgtaagtaactgtttaaggataatgataataattaatgaaagatttttttcttttttgagatttttttactaatagatagaaaatttttaagttacatttgaaaacttttgacttaagatttaaactttgaagtcaaattttgaaaactttcaactcatatttgaaaactttcaactccgatttaaaaacttacgactcaagatttgaaaacttttgactcagatttgaaaactttcgactcaggtttgaaactttcaactcaagatctaaaaactttcaactcaaattttaaaaattttcaactcaaaattgaaaacttttcatattaaaatcgaaaactttcaactcaaaattcaaaaactttttaactcatatttgaaaactttcaagttgatattttgaaaactttcaaatcgtattttcaaaattttcaagtcaatatttgaaaattttaactcaaaatttcaaaatcaattgtttttatttttttattgataaattactgtagcattttcgttaatcactagtcagacgttgttgttttctttcgagaaaaacgctaagcgctacttaaagcgaaggtccacgtgcacgcgacttaacgtcc

SEQ ID NO: 95298 - DNA, 1035 bp, Oryza sativa
attcaatctttctgtgaatggaagaaagaggagagtacgtttttgtccgctgtacaactgcccagctacagcaagacagcctacgatgtgcagtgagccagcgacgagcgtaccttcaaagggacatctggtcgtagccgttggtactggatctggtgtacttggtattatattggatggtacgtactagcttgattttgaatacttacattaatttttaagtaaatttcataaaacctaatttttttatggtcaaaattaaagaaaaattacatgtattatgaaatgtgacacctaatctaggtattatggttttaaaatttcacaaaaccccacctttatgcattttgagcgcgaatttacttaaaattttaaaacatagagtgcaaatgaaaattttaattattaatttcttgattaagatcgatagtttaattttttactacttccaaaattttgtttaagatatgttgaaatttatcaagatttcaaaaattgcggagttttatgaaacattcagaccataaaacctgtgatgtgccacacatcataatacctgtggttttccacaactttgacgacaaaatatggggttttctgaaatttactcataattttttacatgctgctaaaatgctagtaccaatttatctcattcttgcacaactttctttgggctatgctgtttctatatatttctaagtaagacaactcaaattagtagttggaatcttggaatacatggattgcttggagaaaatgactatatatattttattttcaaacactttgttatatttaaacataggagttaaactaatttcgtgtggtttgccagtcgaattaaactattattaatatgatttgtatcacatgtaattaatcgaatgaaagattggacctataccgtccaaagttcaccactttagagtagtatcattcgaagtacatcatttcacaataacaccaggggaaagatactactccgcctaaattaacaggtagtcattatccatggcaaaattgcccttcttt

SEQ ID NO: 95299 - DNA, 1124 bp, Oryza sativa
gttcagtgcactgaaccttgctatcctttccatcgtgctcatggtgcaacttgcctgatgtacttcatccaagttgcccaagtagctataggcctatagctgcagctcgatctccagcaaacaatgcaattaaggagcactgttatttttaagtaccccaaaaaaaacatacaatttttagggactagttcagtttcatcctcagaagttggttttttaggtaacagaggaatacgttatcactactgttgctatatttaaatatatttagttaactgatcaatcacaagaaagcttgagaattaagatggattattgtaaatatgcaagttcgatcaaggagtggttttttaatctctatctgagaaattgttttagaatataaatgatcaccctgcatgctaacttaaaggctgaaagtttagtttgctgactgagtgacgctctagatcgaaaatctgacccgcaatagttctgataaaaaaaaactatatgcacatatttatgagcaaatttgtcgaaaagatactacaatggttcttcacactttataactttattctgaacatgtcaagttaaatctagtggacaagtggacatgagagatgacattatgttgactttgaatagtaaaaaaaatgattctacctctgtattggactataattaaggttaccttctaatcagttcccagtgtataatcctagtataaaaaaaaccttttattagatgtaatactcccttttgctataggttagtggcgtaggacttaacaatcgacgtggccttacattgtgcttttccttaggacattgaataatttgagttatgcatgggtgaattattttattcattattacttgtcttttggaaatggggctggtagtaaacaaggtaaaataagcattaatgctatcttgatcgactagtgcaatataagttactttttttggggggttttgcaatattagttacttattactacatccatcccataataattgaattttagggaattagagatagattaacaacaaacataatttaccacaataaccctatttataactacattgcatgcacatattccatatgtatactttattaaaaggaaggttgaggca

SEQ ID NO: 95300 - DNA, 669 bp, Oryza sativa
ctactgcagaagatgtggacctgacactgggagcaggactactgagctgggaatttgtctatgttggtagccttaaggtatttttacttctgcagttaaatactaccaatatgatggcatgccaatccatgaacaaaaacattaacatgtaaatgattgaagcacctgtgtttggttgccctgcttgtttaattgtgcttctccctcagttttgtgcttgccctgggctacttgctgttcctaatgctactgcttttaggtactttactgctgctatattgctcatcttaaagatcacaaaagtaacaaaagcaagtactttttagttcttaacaatacagcactctgcatgtaaaatggcattggatttttcccgttcccctaatttttttgttcggaactgttgatgcatgcacttttcttccaattgctttcctgttctgacatagagaactggccttgcaagctgcggtgctggtttacaattcgttaatactacgttggacggttggagtaagaaactggtggttcacatcaatgtcaatgggggagaacactttatttgattttaggaatactttctttcctgtttttatttaagtgagtacaaatcaggcaacatgtatttattctgaaaacccaacaactaaacatatataaaacactatg

SEQ ID NO: 95301 - DNA, 615 bp, Oryza sativa
  unsure (1)..(615): unsure at all n locations
cgtggtttttctagtttttctagtgaataccgtattcctcgtttggtgcggtctgtaatacaaatagctttagaactttaattactacctcatagtgttttgtatatgtttagttgttggcttttcggactaacaattgatatgaaaccttacgatctattaggaacggccatttattatggctatgctgaacgacatggtatttgacaaaaaaaaaagttgggttgatgggatttggttgctatggcatgtcaacatttggagcggatggtcaaagaatgttttacatagagcataaatgtaacactccgggtatcttttacctataatgctacacactacggaacaaaaaccactaagttctaaattcattaaaattttgacagtctcccctgtaaatatggacatccacgacaggcagttacatattaaataattaataatatcattcccacagtacgatccatccttataatccacagaaagaaaccacaatagatattnctttggnnaaaanaaggggaaaaatttttttaaattataataccaaacgaggatatagtttaaatgtcattatagacctaagcaatatagtttgatagtgtgcagataaat

SEQ ID NO: 95302 - DNA, 812 bp, Oryza sativa
  unsure (1)..(812): unsure at all n locations
cacaagattttattcacataccaaacttattggtgtgtatatattagttattatgcaccctaggcttgtgcacacatatttcctttttaaaaaccaaaattattgatgagtcaatcaattgataatttatttttcaaaatatcaaataacaaatgcaagtaaatgtcacatcatgccaaacgtatatatgtgcactcaccgtacatactatgtgctgccctcggttacactcatttttaatttgtaatattaagggtacttgttttggtaacataaaaacatgagataacacatggaataagtgtccaattgcttggttttcataataagctgaataaaaatatacaaggtaacaaaaatatttgcctaaggaaaaaatggatttatcagcttttagcgaggctaaaaataggtataggtgattcagaaaagaattggcattgtgccacacaaaaacactatatttggattctaattggacaacattagtagtttcggctcaatttggagcacttaaaacgtaagagtttatagattatgtttgcacaacgccatatctcagacaaaagttaaatttgaagtttgtatgataaataatagtgatntnntaaaattaattnnaattnnannttntttnttnntttaaaattctaggatgggaacaaaataattcatcgaaagataatcttaaatctgaagtagtgccaaacaaaggccataatatacgtgggctaaaattagctagcgcgtcaaaggacgcgcctattttctagtgttgtactgaagaggatgcccaaattaatgagcatagg

SEQ ID NO: 95303 - DNA, 616 bp, Oryza sativa
tagcacgttttgaatatcaatgtagatattgaaatgagcttattcgccattagcaacaacctcagggtcgaaatctttcacctctcttagaagtgttgacatgttgtggcacacgtggaaaccatattggtctccgatctgtcgtgcgcatgcaaacttggtgtcatgataaagttcgttcttgccctccttgtgcctaccacccttttccacatatgggccccaagccatatttaaggccttggtgatttcactgaaatcataatctttggacttattggagttaaggtaggtaaccctactccacttaggtacgatgactaggagaatccaatgtcgcctgcgcagtggttatgtagcgttagtactaagaaccttaacttcaaaaacaatatacatgaagggtattgtcctcttactcttggttgtgtgtgcacatgatgtactccttgtcttcatgggcccataaacaccggttgacatagtcaaccacctcagtgaagctctgtcgtaaattaacctcattcaccatggatggatcaaggaacccaacctgattaccatggcgacgactctcgatccaacacaaccttaaaatatttacgtattagaacta

SEQ ID NO: 95304 - DNA, 1590 bp, Oryza sativa
attaataatgcgctaatgagtcactccgttttacgtgctggagggaaaagttcacaacagccactaccaacacacccttagtttgcacatcaatctgtcccggattaaaccagcttttgaccaattctgaatttattcagaaagatattgactgatttctagctttacgctgaactccacaaaccagttgttttctggcaaacaaaaaacagtgggggctagggacttttatgagttctgactggaaccaagtagaaaacatgaacttatatctgagcaatgtcctgttatgcaggccacaattccatttaatggataagaacctggttctgcacactgaatttgatattacagtgataatcagaacctcagaaggcattggacatttcaaatactgcctttagtattcaatatgcaaccaatattagttatttgcctatatttcagtgatgactgataagtgatcactcaactgtttttggtacagtgtaagaattgagcaacagtatgtgctattgttctaaataaagatcattgtggccttctgaaggcagtttacaaggtaagtctagcctctccgtatgttttgcgttttaaagaacaggttgataaaggggaatttatctattttagcaggcattatacaattattaagaccatttatagtagaaatctctccttctaaactcaaaaatatcatggaaattctagtatcaactatagcaactagacctagttaaatcttctccttttgctgctgccatggataaatgttgagattcttattctaggtacaggaaatatgtgttcaatgattgctttgtctactgcatgaacatgtaaacatttgtatgaaatttgtaaacagtgcccggggccaccgcgctgcagcgattgaggaggacaaaggaggacagcaggcggccggtgcttgtgtcaggtcgagtaaacctatacgcttgtggacttggccggggagcattgggctgcgccagctgatggacgcagtttgttacagcgtccacacctggatgctgtgaccagtagtgtccttactattttgctaaataataccactaatttactgattatttaattttaggattatagattattataaataaaaattttggctctatatctctatagttccatcaagggataagcatcctgtgtaggacaactgatgctagcagcgaaaaatgaatgcacaaaagttattcagatcaggagtaataattgctagagaatgtttaaacatatttgaaaacagaaaaaatgtgccagggcatcatgccatcaaaacataccaattcttctataaacatatgcattagctattatatgtcaaggaaaccacaagtgctcccagtaaaataagtattccctccatttcttttatttgacgttggttagttcaaaaacatcaaagaaaaacaaatgaagtaaaacaacagccgttttaggttacgcatggtatcattacaacacaggtgttagatatgtactaaaaataaacaaatctatacaaagacaaagaaagatgaatcgaactcggtatacaacatgtgtaaaataagtatctgcttt

SEQ ID NO: 95305 - DNA, 613 bp, Oryza sativa
cctcatatccattgccaaattttgctactgccttgagccatcaccggcttgattacctcccagctccagttctgttcaagatcttttggtagatggagcatctttcaaaatctcttaactcatttagattttctttcagatttgagaacggtaagagtatgaaaatatagaattcagaacataatttagaactcgaaagctaaaaacacagctattttagattttcactagttaattcctatcaactgtttcttagaattctaaactctattccatattccctccatcataaaataaaccaacatcgtgcgggatatgacacattcctagtcaagattcataatactaggatgtgtcatatccggtacgagattgatttattttaagatgaatgaaggagtggagtagaagtagcagtaccgtacagtacgaggcagtgttgtctgctgctacaactgcatgcagctagacaagcgacccggttcagatgggactaattttagtcctatcacatcggatgtttggacactaattataaatattaaatgtatattattaataaaacccaccttataaccctagactaattcgcgaaacaaatttattgagtcta

SEQ ID NO: 95306 - DNA, 634 bp, Oryza sativa
ggtatttcttaactttacaaataaaatccgcaagcgcacggaaaatactgatgtagcacttcagccaggagtattctcaggtattgatttccacagggaacgtgtgtgtcagctctttaccaggtttgtccaaggacacgaagctaatgataggcaaaggatagagaggattcaccggtgagaaacaatgtctacggaaagcttaacttaatcctaacgcgatacttcgggcactggccagcttgctgctcccagatatcgctctattacgtacccggacagggaggacttacacccacctctacacccaccttacacctactgtgggatacggagcaaacaccataaatcaactacttagacaccgcatctaagcaattaatagctactgtagtgtttataactcactaaagtaatctatattataatagactatagtgaacgatgatcccgcacgctaattaggaactaaccaagagataattctcacagagtaaattttaattacttataatgatattcaattaatgcagagtaattaacaagataaaaaaggtaagaagagaattaatttgcatcgacaacttcttctacattactctctctctattctaatatacaataaagtacacta

SEQ ID NO: 95307 - DNA, 530 bp, Oryza sativa
agtaccaacgtcagacctttactatgggataaacatgcttttgacatattccattggccaaaaaagaaaattgcccatcatcttttagtaattcacatctttctagttttgcacaagcctctgtttttgttaaattggagatgcccgaagaaatcagagtagtaaggtagctgcacaacattgttattgtcttctacatgaacaatatttacatgtctgatgcctcaactgaagtatatatatatatatatctatgatgctgcataatattgaaattattcattagtgattagtgtttattgagtgtaacagcagaatctgaagatcagtgtatgtcgaaaaaatatgactaactaatggtacaatgcagttactgtcacctatataaacgatatctactacatatcctaaatctctactgagtatggacgtctgatactttcagtacattgaaattgttcatcagagtttattctttattgaacatgaaaaatccacagttcagtacacgtagaagaaatatgacaagg

SEQ ID NO: 95308 - DNA, 553 bp, Oryza sativa
cacttacttcaacttgaatagaatattagacctaactaagaaattcaagtcgggcccttaattaacttgtatagatggaatcaactagatcccgggtagttacaggcttacagaagatcaaatccattctgaaaagattagaggaatgttattcttaaagatattttttattgaaaatgttggaggactacatttcatttcattaaggagaaagaaagaaagaaagttgatatatatatatatatataaaatagtcccccgcaaaaaaaaagatttataagatcacttaggggtttttaccctccatttcttattcctattaggaataactcactacaacaaagctaacaactcttaaagaaccagatttgtacataaactattttaccccttgttgaatggatgatactccatattagaaagacattgtgtaaagtagagtttgtttgctaataaagcgaagataaaagaattgatgctatgattgttatgtttatggtacctcacgtcactacctttcatgtgtagttggcatttaattttgttataaaaa

SEQ ID NO: 95309 - DNA, 3977 bp, Oryza sativa
tcgcttgtaagaattcgcctagatatatatttttctaaaaaatcatgagatgcaatcaggattatgatcacctcaagttagcattctagtatttttaaaagatttcttatacgactccttctgcaacccaatcaccaaatgacaacaacttcaccaatgaacactaattcaatcaatagtggtgttttggaggtggaagatgaagataacaatgacttgcaaattaaaagtatcgttgtaaacttgtaaacttagagtgggatataagaaattactacttcctccgttttagaatgtaacactttctaatattgcccacattcatatagattttaatgaatctagacatatatgtctagattcattaaaatctatatgaatgtggacaatgctagaaagtcttacattatgaaacggatggattatatgatatttttcttcaagcacgtgacagtcaagaaaacacaaattagattaagaaagtgataagagctgagtagattttagtgaaaactctcttaaacaccctaccgaagcttgtattggaggggatggttctttgataaatgtttaattacgttatcgtattaagaaccctatattagttctttacattggagatggcctaaggttaacatggctcttaactcttgaacttttacggagcatgatgtttatatattacattaaaatgtactaatacttttattttggtctaaaatagaaacataatgtctctgctccaagattcgtatcgtcccatataactggagctgtagcaaacactcccaagattttggataatatagctaggctggagctacctctatgctcctgaaaattatgttacaagggtggaccaacattccagctccactccaccctcagagtatgagtcgtaccaaatgggccttgttggtatttctcatgatcacagataaatctgaggcgcacggaataccgttgtagcactttcccttaaagtattccaagggtatcgaacacaagtaacatgtgtgtattatctacgatcaagattcaatccaaggacaacaacctaggataaattggctagagagaattcctacgtcttttagttagttaattaagttaaaggtcaaactctatcgaatgctttagacaccggccctcccctagtctgtcaggttgagtccgaccttgagatctatgatgtacccaaacatggagggatagaaaggacggacagggctgtctccacccgccgcctacctcactctctgtggagcacacaacaaacgaaagtaatttctaatctaaacaccacgtctaagttattaattactactctagccttgcacaggaacttccttctttatccagagtccaagtacagttgcacactaagcgacaaactcgcattgataagaatatacctcacttaaataaactaattgttgatggtcgttaagtgcaaactttaaccgtcaaccactgcataaaagatatcagatatattatcaaaacttagtggtaggagtttactactaaccacttccatagtgggatggcaatttttcccatgcgtctgggtatccgcggatacccgacccgatgggcacgggcgagggtgtaatctgcccgagaaccgaagatgccgtgggcaacagctgggtttcatttcattttttacccatgggtaacccatgcttgacccgatacatgtttggtagagagtgaggggaagctccggaaggagtgccccggaatatcggagttcctccgagaaatttatagaggagtgttggagtgttgacattcttccaacggaattcctgagaaagtcgggattgtcggctttcttttctcgcttgtacctcggcggatgcttcctttatcaaagtatgtgttcgagtttctttatgttctttaattagtttatttaagtgagatactccctccgggctgataatacttgtcgttttagatgagggtgaggtcaaactttagaatctttgattatgaatcatttttttaaatatttatctttcaaatatggtgactacatgtatagattagtcttaaaaaaatactttaataaaatcatataggcaaaatttgctacaggacaccgaaagattgcggccattactgtgagacacctgaagatcgtgtatttgctcgtggacactgtaaaaaagtggtaataagctgctggacactcctcccattattttattatttctgattgaaatggagagagaaagagttgtgtaagtaccaaaatgcccctggacactgttcttcctctctctctctcttcttttcttttccctttcttcttcctcgcagcggagcagaggcgcgaagaagtagttttggaacagatcaaagcgaggacatgaaatttgactgtacatgtcacacacgcagcccaacaagtcgatgggctccgtgagatccttgctccacgactcacgcgctagcacgtgcagcctcgccaggaagatcgccaacgccgtcaccatggacggcaggtagcggtggaagtggaacccgtaggtcagcagtgtcccatcggcgaaccgatgcgccgcctccttcaccagcttctcttccttcccctcgccatagtacctcgtgaagtgctcaccaaaatgctggatgaggtcggcaaagcttggtcatcgacaatggctcgtagaatgtctcggtggcggcgcttcacctcagatgaatggcgatggctcgatttcttcaaaggactgccatgcatgcatgtctttcgtgttagagaggtccatgcaattggattgggactcactagagagggagaaatcaaagatggagctcggcggccggttgtagaagatgatgctgatctccaagatcattgcgccattggatggggtacttgggggtatatggagagaggtcaacatgaagctgatggcgtggtggtttggcttgcaacagtccactgcagccaaaacgacaacgatgtcaaggcggcgacgcgcagagtgcgctccaaggccggcgatgacacgtggcgttcccgtcgatccgctacacgagaggatggaatcaaaaggaaaatcttcggcatgataaggtgagtatggaacggtggtgaggcagagatggagatagttctacggtgatggcgggtgttgtcttcttcatggcctgcgacagatttgagggcgacgaagaggttgagggcatcctctctcggttcacggtggggcggcggcgggggcgcatcgccggggttcacctccaacggcgacgacgcacgacggcttggccacggcggagctcggtggcggcgcaatgagaaagagatgaatgaagaagaagaacagagaaagaaagattgacaagtgggcccatgggcaaacttgtctttaaccaaactttctctctccgtttccaccggaaataataaaataatgcggctggtgtccactagctaattactactttttacagtgtccacgagaaaatacacgattttcgagtgcctcacagcaaatgctgcaatctttcggtgtcctgtagcaaattttaccaatcatatatttgttaacacttttatacgtattataatggaaaataatggtcaaagttgttttttggagaccgtgtccttgtccaaaatgacaagtattatcaacccagagggagtatattctcatcggtgtgggttcgtcgcttagtgtgcaactgagtgctctagtactaggtctttggatagaggaggaagtttttgtgcaaggctagagtagtaatggcgaggtgtataggttagaaattaccttcatttgttgtgtgctccacgaaaagtgagataggcgttaggtggtgacagccctgtccatccttcgtatctctccatgttcgggtacatcatagagcttaacggtggacttgtcctagcagaccatgggaggaccggtgcctgaagcatttgatagattcttacctttatctta

SEQ ID NO: 95310 - DNA, 948 bp, Oryza sativa
acccaccaccctaaacctagagaaaattaggattatgccataaaaaaatggtttcattggaataccatcagttcaatgggcttcgataaaatatcacattcatcttgggtttgtttgctacagtacaatctcggacagaaataccactagacttttttctcagcttcttcctcctcacccccaccgtctgtaacatcctgaaaattcactattttctaatattgcatcatgctgattcttatgttcttaataaccttttaaacctaggaaaatatatttagagagacttccaaatattaacttgcgtagaatctctctctattatttaaaatctttcgtggtttgtattctaaaattgattttattaaaccaaggtatttgctttgatttgattctgcaccttaaaccttcttttgcaaaattcctttttctcaatttaattaaaaacccttttatgaattatggtccaagaaaccttcccatattgcccttgaacctaaaccgtcgtaattccgattccgttggaattaattgttaacctatcctttgatcttaaacctatactttgatgttcgatctaaatatccaaattcctccttctgatctagccgccaatttaattcatgtggcttgatttcctcttcgtcacaagaacagtattattacaaatattgtgaataattgctcttgtgctaagaaaatagattttatcctcatgcaaatctcctattagccacaaaatatttctttaaacccataccacccatttgtggggataaaatcctatttattccctctctttatttttcctaccacatttccagaaatacagagccatattatttatggttcctatttaagtgcattaaacaaactcccactccaaaatattgcactcaaacaaattagaacatctttactttgaaattcatctccgcacataaatct

SEQ ID NO: 95311 - DNA, 519 bp, Oryza sativa
ccataataattacatcttcttgactgcagtacatatgagttacaaatataattcaactgctattgtacgataattacatttgtcagatttttagggggattttctatcgaatgttagataggcggtctctatttctttttaaatctaaatgacaatgatagaccgttagaaatatatgcaatgccttcctctcatttgaaatatacacaatgcctttcttccaactgtaccaccacccctctcctcacctcctcttacctcccctttactccttatttttatagtagttgagataataattttaatttatcataataaatctcaaaaaagtaacttttaggttacccaaacaattattattgttcacgccgttatatttattacaattaaatttctttggttatctctattttaatttataaagaaaataaatattattttggataggaccctatgcatcatatttaagggaaaaaagaaccacaacatatattgtaatatcatctatcgctgtacaaa

SEQ ID NO: 95312 - DNA, 593 bp, Oryza sativa
tcgtatgatggatcaagaaactagttgcaaaaacggaatgagaaggaggagaggaacaagaggagtggtgaattggcgttcccgtcatctttattcttgttctccataaaaccctaggttgtggtgctccggatcatgcttggtatcgtctctttattgttcgagtcttttcatgtatttgctgtgacatgtttgcatgaaaggatgggattagctacacagtcgcacaacatgatctcacttagtcatgagtattgtaatatgctgataagattacttgtgtttagaaataatgggctaattaattactagagttgttgaccattggttaactacttttttcaagcctatccctacatgtcagtcaattgttgtatcataaacttaatctatatgttgatgcttctgcgatgtttttttttctaggtagttgttaccgaaatttgcttgttttggcacttatgtgtggttgtttagtggcatctagacttatgtggttttctggggtgttacactgataatcggccttgagatagccttgaatatgcggctagacacactctatatatgatgattcacaactgataatcaac

SEQ ID NO: 95313 - DNA, 528 bp, Oryza sativa
taaattaactattcacccatttttaaataaaggaatttttaaaataaaccaaaattcaagggtgctacagagagtgctaattaatttatgatgggagaatttaaaatcaagtgtgttaccgccagagaagaagaattattacatagctttgtcttctccttgtggcggaaaatgtattggagaaaagatcaaaatctagactaggaatgagttctagggtcgctaaccaaatgtcaaatctaaaatttaacccacgtgggctacgcatactcgtgtacagtcaagccatccatccaccgttgatgacctgcttaattatcacgtgctcttccgtcttaaaataagttgattttgacagttaaaaatttggaatttttaaggctcttacctacccactctataaaaaaaaccattccttcaatactccttgggatgcaaagaatagatttattttttacaatatagggagtgtgtattacacatgtgtaatctttttcaaaggaattgaatggtgtataaatgtagggt

SEQ ID NO: 95314 - DNA, 587 bp, Oryza sativa
attcccctttctttccccccaaacgacgccaacactgccgccccctccctcctttgtacggtcttgggtgttctctcctctccacgacatttccactttcatagatctgttgtgtcgtatgatgaatcaagaaactagttgcaaaaacggaatgagaaggaggagaggaacaagaggagtggtgaattggcgttcccgtcatctttattcttgttctccataaaaccctaggttgtggtgctccggatcatgcttggtatcgtctctttattgttcgagtcttttcatgtatttgctgtgacatgtttgcatgaaaggatgggattagctacacagtcgcacaacatgatctcacttagtcatgagtattgtaatatgctgataagattacttgtgtttagaaataatgggctaattaattactagagttgttgaccattggttaactacttttttcaagcctatccctacatgtcagtcaattgttgtatcataaacttaatctatatgttgatgcttctgcgatgtttttttttctaaggtagttgttaccgaaatttgcttgttttggcacttatgtgtggttg

SEQ ID NO: 95315 - DNA, 554 bp, Oryza sativa
  unsure (1)..(554): unsure at all n locations
tcctgcagcccataaaaatcttcataccaatgaatattgtctaattgagcgtgttttaagagagtgtctttttttttgacgaatcgacgagcgccaatttcattgaacagagcaaagcaagagagtgtatttatgggtgtgtgcaattcattttcatatgtaataaaattaagaaatctagcatataaaacaccagattcgagacaagcaaaatgttaaactctgtatggttatagcctaaacccatgaatgaaccaatgtcagcaatgattttattaagataaacagcattatatgcagggtagattttgttccctccaatcgacgtgccacagcaaagacacataatttggtggtcccagaaatcaaggggcacaataaccttattgaattgggttntnacaaatggcagattaatttgagtatacttattatgttgtacacgcacacacttaattagattgttgtcatctagtactagctacaacaactcgatcgatctcttacgaggtggatgagacatactgaagataaaaaaagaaaaatactactgt

SEQ ID NO: 95316 - DNA, 526 bp, Oryza sativa
cacgttgtattctttgaaagaaaatgtcgcaaactgtcgtagcaagctgataagattttcagcgaagctgtcatagcaaacggcggagccatgaatttttgtcatgtggggccgactattaatacttcacattttaatgggatcatttatgcaaatcttaatggatttacacatgaaaattttaagactctcaagggtgtttgtgaaatagttgtggggccagccgaccatatagctaataggttggctcaaacactagttataaggggcttgagttaccatgcttgcttcaaaactctatgtaaatcttttagaaattatataaaaaaaataaaatatataatttctaacgtgttaaatcagccctaggcccgcaaatattttggttctgccgctgactgatcgtagcattgttgtagttagtaggtggtgagagagacataagacctgtttgtggagattaagattttgatatacagctggtgagaatctagagaagctatgaaacccaacctagattttgact

SEQ ID NO: 95317 - DNA, 609 bp, Oryza sativa
tttatatatggggcaccaggtatatatacactattttaagcaaatatatgtatgcagatgattttgaaattataattttcactccactggttttactactagcagggctcgaagccgtgaagcgtaaccgaagcgagggtgggttaattttatggccggccgtcatgactcggcgtagttcgtgatttatccaacattttgtagataaacagatggaatgagaaaatatatgcatgcgtacatctatttcctatctctaaccatggaaagaaaataaacaccattttattttaattcttgttagagaaatatggctgaacatatgtcaaaactagcatatgtgcatgctaattagtatgctcaattaattttgtttatcactatgcctgtatcactactagcacggctcgaagccatgaagcatgaccgaagcaagtgcttgtttaatttatggtgaattatgcaatttgtatccgtgatttgtatccgctcgtagaggaccgaacctgagagcgagaatctcgcctaggcttgtatccactaacgggaccaaatcagagggtatggtatgatgacatgaaaagagtatgcatggaagtcactgctagg

SEQ ID NO: 95318 - DNA, 698 bp, Oryza sativa
ttctataattatatatatatcatctataagtccaattgaaatctaataaccgtgactaaatgtgtgcctagagaaaaaagtagcaaaaaaacatgttttggttttaccaatattttttttatatgggcatggagataggctaagccaccaaaatttggtcagatattgccattcaaattttgtccccaaaagtttggtaagtctattgcctacctttgccaaatagagagagcacacaaattattgcctacctttgccaaatagagagggcacacaaattgtggtcaccagccaaatggaggacaaaaaagcatgtgcattgccaaactttggtttgtcagcttagggcttaaaatcaaacagcccctaactcattgcatatgtatatactacttccggtatctacataaaaatcatccatacgcatcggcacattgccacaaaaatggaagattgttatctataagcaaagaatagtgctgagcacgcaattaccaccttttagagcattactgttttacgataagcttttcacgcattaactatttcacaaaattgtacaggcgcgaataatatcatgcagaaccaatccactaagccattaatagcaatcagaatatctgctacatttgcatccttcatatttggggcctagcaggtttcttcatgctaattggctaccaccagggctgcaggaa

SEQ ID NO: 95319 - DNA, 636 bp, Oryza sativa
cgccactagtaccatatggctgtgatgcaatcatgtaaataggagcctacttttcttgacaacactaatcaattgacctacttgtacaatagcatgcccctaagggcatgttgcatatgtaccctttttggagttcccatgtaggggtgaacaaaacgctcaaagctcgtggaccagttcagcttgaactcatgttctaaacaagccaagccaaactggctgtttagctcgttagcttaatcagccaataccaagccagccagtttgcaagctactcattaagcatgtttgttaaaagaccattctatttgtattacttaatgtcagaattacttcatatccttttatatttaataaatattttactaatatatgataacttggtgctactattttgctaatatatgataaattgtaaatattaaattgtacatgacatgtttgaacatttctagcttgctaacgagccagctcaagttagcaaaataagccgagccagtcttttagctcgttaaggttaatgagctgatccaagttggctccttatcataatgaacctgaccagccaagtctaacgagccaaacttgctcattatccatccctatttgcatggctttttaaggagaacatcaagt

SEQ ID NO: 95320 - DNA, 578 bp, Oryza sativa
aactgtgaaaaaagaagtgaaaactaactgccataagaaacggagaaattctatcagatcaattaattcagcgtggctttatacggagtattgacttcaatctgcaagaaagtgatgttctttagcagtatctgaacctgttcaagctaccaatacatgatctatcttcactgaagaaaaaaagacgaggacaaagcaacaaaaatgtgcgagtagtcgagtagatcatcacggattcaggcatggggcctctcattcgggatggtggccacaaggcttattattatcctgaattccttgatgctatgcattcaattattagcctgaggtgatgttgcaacctcctgcagttaacatctctaatttcgtacaaattgtgcggaatactaatggtgattagagatgttaattaacatctcaattcggtgcgatgcacgcaagtctggccatcttaatggcttaaatttaatccaggatttttctttcatctttgaagcattcaagctacaaaatggtatagtgtttctcctgttcgatcagagaatcgatcgaccaatttgtttcatgttaacatcaga

SEQ ID NO: 95321 - DNA, 889 bp, Oryza sativa
aacacgtcggttacaggcacatggatggatggatcgatcgagcagtagcctagacaattgcagccatgcttgcatgctacctggtcgatggatggatcgctttagctccctttagcctttacgatcagatggcgcccacgaattcaatgcgttcacaagccatctccttcgctcccgcgaataattgcgatcgccctcgtcgccgtgatttggacgccggcgagcgatcgatcgatcgagcgaacgacttatttccgcccattcacacctgcaaaacgcagcagcaaacgcgcgtgcgttgtactcgtttcaaaatagtttaagtactccctcccaaaaaaaagaagaagaagaagaagaagaagaagaaaacttctgactgtatattagatacgaagttggtttttttacaaagataatattaattaaggttaatttttcgtcgaacgctaaattaatattagatcaaatgatttatcttaagtcgttcttaaattttaaattacttagatttcctttcaaaatatccgattagatcgagaatgatgattggagtgatgagaatcatgggaaccaattttcttctttttgtcatgtcccccaataatggtattctagctggttgcagtgtgtatttaaactctcctttttctaacctattgacgtgtattgtttttgcgtgtttacgaaaaataatcatagggaaaaaatgtttctattacagtataaaatttaaaattttatcattttaaaatggatggggtactgtactgtgttgtggatggctgcgatcgttggatcgatgggtctcgctctcctctcccaacccaacaaatcggcctcttcaatgctcggctttcgcttcacggacaagttgccaatctacgct

SEQ ID NO: 95322 - DNA, 688 bp, Oryza sativa
tatcaccatcttctatgggatcatcaatgtagccaggataagtatatgcatacacatatcattaggatttgaacaaatgatctgcatctaccacaatcatctgtgtacaaatgctattgctgatcgcacctttgacttgcaagtaattgaccgatgacgccaacacagaaaaaaaagtgaggtacctaacgaatggaactatatccgctatgaaatttataataaccaaatatatatgccacaacacactgagatggataacatggcgaaagcatcacacatatgtaatcattacaggattgcagcaatgtgtgaacaatgccataaggacatgatttattaatgccctcactaccaaagaatggagaatacaaagcattggctacagtaattgaactcaattctaccgaatcaatagcaaagcgcttgatttcagtgcagcttgtgtgaagaataatgggggaaaactactactctgtagcttgataaatttaaaacccaaactgatgaatcaaccaggacagtctatgtgtgcacggaagttcactgtaccgaatgtacaactgaagaatagagcatacattatgaggaaaaaatcaacgtaaccacaaattggtgtcgaaagtgaaacatagatttaaaactcatccaatgaaggttaataggaacataccatgcaggtaaaaaa

SEQ ID NO: 95323 - DNA, 780 bp, Oryza sativa
gcaccacttctacacccctcaagcgctcaccatctcaaattttgaaggcacacatgagtacatgacaaaccacgatgaattcacacttgtaaattaaggtaggaattgcagcaggaatgggaggactctggaagaaaaacagcaccgtatgccctccatgccttggctggctaacgcttacatgtataggcaacgcgtttgagggtaggcgctaatacgatgtaataaccgtgatcagtgagtcttgtgttgccaagtttgaccgtgccctagtgagtgggaccgagggagtatatcctagcaccacttctacacccctcaagcactcactgtctcaatttctgaaggcacccatgacgacaaacaatgaattcacacttgtaaatttaaggtaggaattgcagtagaaatgggagaactctggatgaaaaacagtaccatatgccctccatatcttggttggctaactcttacaattatttgtcatgcgtttgagggtaggcgctaatacgatgtaataaccgtgatcagtaagtcttgtgttgccaagtttgaccatgccctagcgagtgggaccgagggagtatatcctagcaccacttctacacccctcaagcgctcactgtctcaatttctgaaggcacccatgacgacaaacaatgaattcacacttgtaaatttaaggtaggaattgcagtaaaatgggagaactctggatgaaaaacagtaccatatgccctccatatcttggttggctaactcttacaattatatgtcatg

SEQ ID NO: 95324 - DNA, 1014 bp, Oryza sativa
agcaaggcaaggcccggccaagtaggattcggtcatattttaaacgatgtaaattttagaatgaccatacaaaaattcattcatatattttacacttcatgttttctttaaaaaaatataaatttgaaagaaccatgtaaatatgagaatgacataaaagtgtactgagaatgaagatggggaataattactggtaccgatgtacgtgcaactaataacaaaagacaatcctaccattgtttatctattagcaaattatctttttaccctttctatctaaatgcctttatcaatacttaaatatcttttgtagggtacctttcactatagagtgttggatatttaccatttttttatgcaaacaccataaacttctgtaatcaatctcatcctatagccatctatggttaatagcgcatcttaaacataaataagacggagaactgtgctaatttccttttgttctaaactacaagagttgattggctgagataggagattgagtgaacagctttgtgagttattattacttatattgcgagatgttcatagtaattactatctctacgggactacggcacaattgttttggttgatgaaggcactatatatatttttttttatttttaggagacatattagatattataaactagagaagtaagtacgcgatgattttttttaccgtattttggttgctattcaactatcacctaacagtagtttgtgctcaacggtgtgctaaagttaaacatttcttactattttaaataaaattaatcatgatattttttttctcgccctaagtactatgctagttagcgtagtagagaaacatgaaggagaattataaaaaaaaaagatatgtgcggagaggtataatcatcattcactggttgagaaaccgtttgtagtcccggttgtccaaccgggactacgaatccggttccgagactaaagatagctatctttattcccgggtgaaataaccgggaataaagatcagggccgcag

SEQ ID NO: 95325 - DNA, 579 bp, Oryza sativa
tccgttttgcccacgagacgggtagttatctagaaatctgctccgctagccggtttagttatcaaaacccatctaggtttagctcattgctaaatcgaggtggttggtgactctaggatcactacaaggcttaagatgctgcgatcgtgcttgtcaacttgtcaaataaattgccaacacgactccgccggtcagaccggatattaccccggcggtaagaccgggtctcaagccgatccaaccgcacatcttgatgccggtcagaccaggccctgggctggtcagaccggcgcaattgttccaatacaggaaatagatctgatgactaatgctagttatttgtatcactttaaaacatttgatcctcctgtatctactgctacaagtagtccctaagttcccccacatgttcctaatgcttataatgatgtttctagggggtatcctcccgatactagacaaggccaatataatcatattgcgccacaaacacaacctattaggccaccgaatccaccgccaaatcaataagggcctaataacatggaggatataattagtgatattattaggaataga

SEQ ID NO: 95326 - DNA, 904 bp, Oryza sativa
ggaaaaatgaaggagggacaccatcggtcatgtcttttcacacatccataaattgtgaccatgtcttttcaccatgtgaccattgtacattagaaagagagagaggtcattctattttaatctattcccttgcagtattcacattaatccacatggaggcctactatttgctatcaggttagacataagtacgttgatttctttaattaatctagttgtttgtgtcaagttttatttgtccattcaccacccaaatatgatgttcacaaaaatgacatttcagaaatatcgttttgcaactgtgatgtccaaaaaatgctattgcaaaatgatatatcatttttagtagaataaaaaaaccacatgattgttacttttacagatatatgccatattctaaaatataattttgttataatcgacatagatatatatcaagatgaatgtccactcagctccccaaacatgatatttgcaaaaaaaaaaagatgacactttgcaaagtaatgtccaaaaaatgatatagctaattggtataccacttagcatttattaaaataaaaaaatcatatgaatgatattctaccgatttatgctatatcgcaaaaatctaattttgttataaactacataataaatagtgtctgggagacataatatcatgtgggccatcaactaaagtatccaaattttggtgacttaatgacggttggtcaattgtagtatgatactagtatccattgccaaatcaatttgagcagtaagtgcatatgtcttgctagccgaacaaccatgtgtatgctaattgtaattaagagaattgataacaactctcgacatgcaaaatcaattagaacagctaactagcagtgttaagtcactcaaatatacaaatatatttgta

SEQ ID NO: 95327 - DNA, 1454 bp, Oryza sativa
gatggataaaagagttgagggtaatccaaagggtcaatctacatgcaaaaggaaaacatttattaaatgatgatacaaaacaaaacactgcaataaaaagtggccaaaaatgaaatcaactctttcttttataaaagctttctatatagatttttttaaatatattatatatatatatatatatatatatatatatatatatatttcaagtttatagtgattaatatttaattaattatatgctaatatttgtctcgtattacatgttagaaaagctaaatcccaatttatcttttgaacgcaacctaaatcaattaaccaacgaaaccatcagttaatcagagcgtggaaaaaccatcattcacaaatgaataataggtgtaaacgtagccatcaaagaagaggataacaaattgtgctactcctgaatgcaaactggtttaatccggatagtgaaccgtacgtacattggggtccgaggggatgaaccgtacggctcaacatccggtgataatgttgcagccgtatcattcaggttatcaactcaactgtcaccggctagctaggttacaactcatgtgtatgtctgccagttttgccggccgccggttgtggcttgccaggcaggcaaacctgcggcacagctcagagcacatgttttgtttaggcgaaatcacatttcacatggcaacaaattgataagtatctagaaaattaattacagtgtttaagctgtggcagtgtagtaccccggacaaataatttattaggatcgggatactacctatgataatctttttccttgataacactaatagagaagtgctttttagtcccggtttgtaaccctctgtagtcccggttttcactaccaatccgggactaaagagcgctatctttcgtctcggttaaaatacccaagactaaagagttccggttggtgttaccaaccgggaccaaagagagggtagcggtagtgagatggtctcttttttttttcttttttattttctcccgaatcaagtgggatacatatcccaaatcaaaccccaaatacccaaatcaaaccccaaatcaaagtaacatcacaaatcttatacatcacagatccatacaaatgtaaaataaatcacaaaattatccatacaaaagtacatcacagtgaatcacaaataaaaaaaacaacgttgactgccgctgccgccggccgcttgcttgctcccgccgagcgcggccccatcggccgccgccgcacgggcgcttgccacgcggtcgcctcgctccgccgccgccgcacagccacggccccgccgcacggacgcagccccaccagccgctgacacgcggccggctcgctccatcgccgccgaccggccgcagtagagaggggaaggaggaggaggaggcggcgaggggaagggggaccagagaggggaagccggaaggggagggcc

SEQ ID NO: 95328 - DNA, 540 bp, Oryza sativa
tgggggatttgagaataatagacttgggatagatagcaagaaggggagagatatagaatatacatggtttagatactaaattgatttgacgattattagttgttgtttcaattcagtcttggtccccttatatttataggagtggcaacttgtttttagggtctttcccatatccaattatgctcataatcagttatgaaatctcgatctaaaacaaggaaacacgagaagtatctaaattagactcggactctatgctgaaggtctgatcgtctggatacatgcggtctgatcgcagtgcattgttcgatctgatcggtcacgtaatgacggttagactggtcttcgctgaaaagttctgatattgtttcattttggttaaagcttgctataacttgtctccagtgtaaaatttggttatcaacacaacacgtggttgtttgtttacttgaaaagtgtgatgatctaggagaaggatcggaggattccgcgagagataacactggtttctgtgcgagtggtttcagagaagaaagatga

SEQ ID NO: 95329 - DNA, 520 bp, Oryza sativa
tagggcgaattcgagctcggtaccctggaagaataagttcatgttaggtcccttcttttttacgttaagttttaaatcacatccctaaaccgcaaaatggggatgaacacatcctttattattcaaaattcagtcctaaaacagtattaaaggctattttgagtgacatagaacaataagcaaaaaaacaaaaaaaaacacatgagacctatatgtaagtgaaacatatccgatgcctaaaacagcccaaggagttaatctcataaggctcacatatttgtcttgctgcctggccttctaggcctgttccaagtgcagcggcgaccgggggtccaacccaacccgtgagcccaccagaccgatggataaaaacggtatgaaaatttcacgacgagcgacagaaaaaataatataataataataatttttaccacggttacccgttctaaataaagtataggttttttcctatttctatcaatgtggagtcaaagttgacacttaataattaaatctataa

SEQ ID NO: 95330 - DNA, 705 bp, Oryza sativa
ttatatatcatcgttttgattgattactgcactttttttttattgttgttgagctagtgatggtggtggtgtgaggtttgtggatgcgcagtaccaggcgcgacgtgcggtggaggcggtgacggacgccgccggcgccatccacattccattcaaaattttcactgttatacctctcaaccacctttctatcatcaaccataaattattttataaagtttatagtaatttgttcttaaccataaattattttataagggtattatagtcatttgttttaaactttaggatatgccaaacaaccttaaaaaatactccctccatccacaatagttatacatattacttttaacaccaagaccaaggagaaattaaatcacctcggatgttgtaaaatcaaggagtgaatacaagcatgcaaccaatgagtatttagatgactccttgggttctaataaaacatttaatttatctcttcatttaagtcttgaatgcataaagactacaaataggaacaacttatttgaaaaaaatcaaatgtgaaataggtgtaacttttgtggatggagggagtaaataatttgagacggagatattacacttgcatacggcccattggtgactcgaatttcttggcagtgacagcctagggccgtgggccgtatgcaagtgctagttgtaaccatcaatcagggaagtgtatta

SEQ ID NO: 95331 - DNA, 612 bp, Oryza sativa
tcatgtgtgtgcgatatatgggtctgacgcataactatgtaaattttgtacgtgtacctactagcgaacccaaaattcggtttgcttttatatttatttttattgcaatgtacgagcattatgctactaaaataaagctcttcattatctaaaagatttatatggtaaaccgatagtaaaatgttttccatgctatgaattcaaccatggcacatcctaattcttacttgcactgcagcagcacaacaacggtacgcaccttctgtacagtagacttggatatatgcatataattaactagatgatacctcgcactttgttgtgagatttatagatgagtatatattaaatattatcgaaatgatgaaagttaaaatgttaaaaaaataatatgaggaagatggtttgacacatacttgttgatgatgtgtcatgcttgtatggggatttaaaataggctataatagtaattactcgtgagtgaagatgtgacatgcttttatgggattttaaatgagctagaatagtaattgttagtgggtgatgatgtggtatgtttgcatgttgagctttggcttctaataattaataattggtagtggataccaacta

SEQ ID NO: 95332 - DNA, 555 bp, Oryza sativa
cgggtttttgttatacgcatgcagtggaacaagcaaaccttgcatggcttaacatgttttcttgttttgaaaacatgcacatgacatgatactgaatcaggttatgctacagaaggttttgattgttgggttcttgtttatctgtttgttggcattcatctcccagacatcacaggagaacttcgaaaattcagcataacattctgcttcaaattttggcaaattttacgattaactactaactacagactacagtaaccagcaaggctagagctgctgtatgctggagtgctggtatatcgccagagacatgttagacagggttcggagaattaaactccgaccacgcccacgcgatggcccacatgttacctagtagcaaggccacgtggcctcctctttttgtgggccgtccggtccatttagtgcggcccattttcagtgggagcttgacctttcatgcgtgcgtcagaaaatggaataagttcaatttttctcccttaactagtgacagaatgttatctgtatccttcaaacgcaataccggatatctcg

SEQ ID NO: 95333 - DNA, 586 bp, Oryza sativa
ccacatgtcagctgcacatatctctctcttctcttttcttctccctcccttctcttttctctcttctctcttctcttctttggtcagggaggccgggggccggcgagcggagcgacgatgggcgggcagcgggcggagcggcgctgggccacgggcgggcggtgggctctgcggccacgaccacggcagttcctacagcggcggcaaccatggcctcgacgggaggagagaaatgtggagaggggaggcggccggcggaagatgggggaggggagaggcggtcccttcctccagacgggccgacgctgtccgtcgtcgtgcacgacgccgcagccgcgtcgaaactccaccttcacaattttactcggataccatgataagagcagaagttaatttcacatggacattcggcacaactctggatacagacacctcaattaacaaacccaaatgtacacatttagaatccgataccaattaacccgatcaaagagcaaacatatgaactaaaaaacatcgattaaccaatcaaagactgaaaattcagattttctgacaccaattaaccaatcaacgaggttacctt

SEQ ID NO: 95334 - DNA, 589 bp, Oryza sativa
aggcaccaacaccttggacctccattgtcctggaaatataataaatgcttgattttttgaatattccaaaacatgatgacatatactctccctgttctagattataagtcactttgattttgctcaaggttaaactgccccaagtttgattaagtttgtagaaaaaatagtaatactttcaaccaaacgtaaaaatatattatgaaaatatattcaattatagatttagtgaaactaatttggtgttgtaaatattattattatatttgtctctaaactaggacaaacttaaagtaatttgactttgaccaaaatcaaaacgacttataatctgaaactcaaacggatggagtactatggccctgtttgggggagcttctcccagctgcttctgctataagctgccctaaacagtccacagcttctgagaatttgtagttacagattctaaaaaatgaactaagaagccagaagctggagaagctgggtttcagagcttttccagattctcataagctggctaccaaacagctgcttctcaaaatttaaagctccctcaaacagggcctatatatatcaagtgaaaacc

SEQ ID NO: 95335 - DNA, 625 bp, Oryza sativa
acccggatgaactgaacttcatcaccctgatcaatccctcgtgtgcctggatctcctggcacatgtagacgccagtgaagtccatccacttcttgttctgctgatgaacttttgtcctgtacaatgtgcctgagttcaatcctcttggttggacatgtacatcatccatggaaagtactctatctgaaaccttcttcctcatgaagatttcccacaagctcttgaattcgtttctcttagggccgtgaccgaagcgaatgcgcagtagttttcgcattagtttagagaatccaggcacaatctcaggcgcatttggagtcaccatttcatcagatgatgttccagcctcctcaacaatctccgagaggacatcgtgctggccttgatcatgagatgttgtgcttctccttccactactgttataatccacatcccttgtgcagttatcagcactatcattagtattgtctgttgctgccaaaatactgtcagagaagcaagaacggaaggaagagcagatgctactgatcctctcctcgaaatcgtgaaatgagcagcaatccgttgttgcgatttctgccagccactgggggaaggccgtcccggtaggaccggggctgcagga

SEQ ID NO: 95336 - DNA, 577 bp, Oryza sativa
tcctgcagcccgctttacttagggcccgattgagatatattcattcgtgagggccgtttgcccgattgagatactctttacatcagtgacttctagcctgtgacggacgctgtgcccgattgagatggggcttaccgcccgattgagatgagggtatccgttctagtgttagaatcttatgcctctgcgtactagaataccacgtcaatcaaaacaaccatccatgctgccttaggattttatgtaaccaggtttttaatgttggggattcaacatttcatgtattgtggttgaaggatataatctaaacttgatgtaaaaataaaagacttaaagtgaagttattcccatgttacaaaatactccatccgtttcacaatgtaagtcattctagcattttccacattcatattgatgttaatgaatctagacatatatatttatctagatttattaacataaatatgaatgtgagaaaagctacagtgacttacatcgtgaaacggaggaagtaggaagcatctccactccctcactggaacagcctattgcactacgtactgattcactcaaccca

SEQ ID NO: 95337 - DNA, 693 bp, Oryza sativa
atattgatattttatattttaaattttattttataccagttcaaactatagaggttatgaacctttaaattgatgatttaattatgaatagagcaatagttagattagaaattagatgtacagctaaaaaattgcatgttttaatattattgattatttctcgctataaaaaggaggggtaaaggagagagtggagaactcaagctgagacaggagggggggggggaggggatgggtagtactgtgttgtgcacatctaatgatttaagtgaaaaccgatgatccactttttttgtcaaaatttttaatatcctttgcgtctaaattttaaggcgtaacacatggcagcttaagattttctctaatattatatctattggttaaaataatagatccacctattaagtggaaactgatggtcagatgtcttttcttataatttctaaggtcttacttttaattaagatgtaacacgtaagttacataccactgtaaatgtgctacagaggatgtacaatgatttgaggtgatgcaatacttattgtcactttttttataatgctctattttttttctatttggttaccatgcaaaggatatataggtgtgtgtgcttaaatggagtattttcatttttatggagtgaaatatgagtaatatgcatcttcaattatttatttaattataaaaaaa

SEQ ID NO: 95338 - DNA, 512 bp, Oryza sativa
caccggcgcgggaaggcagagaagacggccccgccaccgacatcccgactcgccgcctggctctcctggagacgcgcttcgacgacgggaatgtggaggagaggagggaaggagggcggcgacggcaggagctagggttttgctcccgagccgcccaccgctgccgcaggccgttgccgtcacccgacgctgccgcgagggacgggtgttgccgccggatccgggcgggggatggcctgacgagcccgtagcaggccgtcgtcgtccgcccgccgctgccgagggctgtcgccgtcacccgccgctgccccaccgcaccctgatgccgtcgtcaccgcctcctccacgccgcccgtcgcctggacgccgccactccttgaccatagggtacggccgccgccgctgttgaactgctgcatcgaccgcaaccatcgcctctcctcctcgcctccggtcgcgccgcagatccgtaaaaatggagagggtgggaaagtgggtgacgtttctaccat

SEQ ID NO: 95339 - DNA, 506 bp, Oryza sativa
tttcggacctttttcatcccaggtaagtggtcaaggcgcgcgattgtacgtccattacacgcactcggtaattccagatgcaaaattgatttaccgctagtttccaatttccaacgatgcaggtaagatccacagcaacgccatgaacacgcaagtcgacgtcgagaatgtggacgtggtcatcaagcctagaatggtacctggccatcagggttggcagactagcctctgcgactgcttccgagacggctgcgaatcatgtatgcaaagctacgactgactggatttttctggtttggtggtacaatgcaatgttttttccgtttcatggcttaatttctcgacctgttggcagtttgtttgagtgcttggttcccttggttgtcgatttcctgcatcggtgaaatcgtcgatcaaggcttcacaggtaggggtcatctcctctcccatagccccatccaaagtgctttgctttggaccggttaccgataaaacagaagagcgtt

SEQ ID NO: 95340 - DNA, 607 bp, Oryza sativa
aagggatccaaactaaaattcagagatatgtaagggattgagcaaaattcaggggtatagaagggattaggtgaactttcacattatgcccgttatgcccattttctaggttctgcattttcaagttctggaggagcagaacgtatccatgctggtattcaattacacaagcagaacttgatatggggaccaaaacgaaaatgttctgctcttgtttctgctggagccttttgctctaatagtagattgaatcgtttttgaaggaacagaaactattccgtcacatattcataattataggaacagggagattagcttctgttgcatgcgtatacatatttctgttatgcagattagctgctgccatattattagcctgttttttcgtttgccggctagtatatatcttctgtcggccaggagcagaaaatcaattccaaaaagagcagaacatcagttagttagttaggagcagaaaatcaatttgaaaagagcagaacatcaacaattgcatgtgctgcccgtttatatacaacatatcaccaaacagtgctcactttcaaacgaaattaataataaaaatattggtttgagagcagaacatatt

SEQ ID NO: 95341 - DNA, 507 bp, Oryza sativa
cataggcatggctagataaaacagtgataacgcgggaatttaaataaagcgataatgcagtaatttaaatcaaaataactttataaactgggattcaatatgttcaaggatgatgtgacttgccttgctccctttcccaaacgtcggcttcaacttccacgaagagcggatcttccgaagctgcagcgtctacacgaccaacggaaaagaaaaggcttttactctaataaactccatataacaagcaggaacaaagcccaaaaatgggttcttgacttcttaaggaaaaattagagacttgaacggtccaattccgagttcaaatggccaagttatggtcatttgaagtttatatgctctttaaatgaatatttgcgaatttcttcatttaaattttaattttaaaagggtttattgcgtcagccgaggggagggggcgagcggaccgggtccaccccacgcggcagcctcacggtccacggtggaccgggtgcacccgggctcaca

SEQ ID NO: 95342 - DNA, 630 bp, Oryza sativa
aacatgtctgcaatgtttctgtatttatcatgataacaatgagcagcatgcataggttgcaaaataatccaaggcgatcagccatgacatgttgtaattaaaatctgacctgttagtgccatgtgttgaggattactgataattgaacttgcacatgtttgaattattctgtattaagcaagagatttaggagctgaagttattgtttgcaaagttggcatgtgttacatatctaaaacaatatttccagcaacaacgtgatcaaaccacataactgaattgtgtgttgtatttgcagcaaaactttaatttatcttagatgtaatgacaacaataaataaaacttatcttttaagtaccaacttgctgcatctacaatttatgaacgcatatttgtgcacttattttaactactcagttgtattgtggtagaaggtgatatgcttccgttttttttttcttaacttcaacacatggttgctgccatgtgtacactaactgcactacatgtattttcacttgctactgttatatactttgttataacaaatgtgtgcctatgtgtatttaattccagaatctactgttttgaacatgcttacatgtttacatgtgctgccatttctatat

SEQ ID NO: 95343 - DNA, 666 bp, Oryza sativa
aaatttaaaaattttaagaccaaattcaattattttggattttcctacctaaaatcctggggtcctttttatcctcttaagggagctttatttggttctattacccaagggtaggggggtttaaaaaatccatgtgattttcccttggaaatttcttggccaaaccattccctaccaaaaaacaattttcctattccgttaacattaaatttggggttaagtttcagccgtaaaatcttttaaatgtgtaatggcaaaccgaacttatggttaacctcatttagtccaaaccaccaaaattaaagtttaactactaatttttttttttttccttttcccctttttaaatctttaagacattttaaatggttaatatttttaatattttatttaaaataaactatgtttatttattaaaattggggtaaaaattgaacttcaaacctttccacagtttaaaagaaatatatatcccaagctgtttgttttcagtcgaattaaatcaccaaccgcattcatgcctaacctaaccacctggcaaaaccctgttctactctacgtggcccacgcacacccccgacgcgcaaaatcttcccccaaacccacgttcggactcattcttattcaagtggaaaacaaaaacggtttcatgccggttcaaccccc

SEQ ID NO: 95344 - DNA, 527 bp, Oryza sativa
tatagggcgaattcgagctcggtacccgtgaatgcatgatgccagtggtggtgtcgacctcgagtacagtgttggcagcacgggagaatgatgccatcggattgttgattatctattccgtggagtaatcatttgcctcgctgtagaggtacggatttgtgtaattgtgcatcaaccaacacattggcactcaaggtagtatcgccctgttggtctccacaagtactggctaacgatcatcgtggtacgagatggagtcggccttctcatcattacaacaaactcttaggattaggtggttttagggaatgttaggacgtagcataacctacgagcgacggggtaacactccaggtaaacgtggccatattttatatgcacgatatgataggggttcaaaccaattctgatgagagtgcctcgattctattgggaatgcccccgaacatagcgggcatgaattggttcgtgagtcgcacatcattggatagcttcattgggcgtctctcccattactaccctcagtt

SEQ ID NO: 95345 - DNA, 1089 bp, Oryza sativa
tgtttaagcacacataaagttcggaaaatcatagtgtgatttcaagaagaactatgtgcataaaaccagtcttttatgtcctaacatgaagctagacagcagggtagctgcatccgccaattgcagatcaaaatgcatcaaaaataaattatatagaagggataaactggagttgcgatgaattatgtggcactacatgatccaacaaaattctaagcagaaagcataaaatattgaagggaattcttcaaaaaggcaaaaaaaaacaaggaacttatacctttttctccaaatcaagtgcttcagaagcaagacaggccaaaacagaatccacggacataattgtgtcacaatgatctttgcaactaaatggcaatcctcttgattggaagttgacggtgcctatcaacaaagatgattcagactttaggtgaatttacatatatgacttccgaggacaaagtgtgcagataaatgaacttaatgcattagaagctataaatgtataaatttccattaaaatcgtataaggtgggttgatggttccttagcgtgcagtcagcactactctacaaaacaaagagatcagtatgcttgtcacattttgacaaataacagattagcagtgaatttcctgcttgctaaccaaccaaccttcatttatctgaaattctgaactgataatcgtggagcacaacaaaacaaaccaaataaaggcaaaccgcattgccactgccacattttggaatcgctagatgaacaggtgaaagtacagaaacctgttgtcttcagaagtaagggtcttcacatatagagaaaagctgtgcattgaggagctgtgttcttggattagagctaacgaaccttttttgtctgccctcctgattgttggaccaacgcttctcctgctgctgttgttggtgagtggtgacaagaggcgtcagttccctccatgctttgtgactgcacacatcattttgacacaagcatcggatataaaaaaaacactaattcgtgcacaaaatcaccagagcaatcagaatcaacagctggtggtaatcgatgtagtgattatcaaggaatttggga

SEQ ID NO: 95346 - DNA, 700 bp, Oryza sativa
aattgatgcatgatgaatgtgatgaaaattgatggatgatgaatgtgatgtgagatgaattgatggctgaattgggatgaatttttgatgaatgttaattggtggtgaaaatttgggcggatgtagtttttttttgtgttgatagaggcatgtatgagtttgtgcagcctctgaattttttgtgcaccaactaaaatagatgtgcagccactgaattttatcgatgatagaggcatgtatgagtactgtcctttgttttcttgttgcaaatgtgatttaaattgtacaatcaaaattgatcttgtgctcaacatattaagaaaaggaattgttttgctgctgcactttttttccaaaatgaaatgcactttcttttgttcaggcctatgctgttgctagccattgctgatctgaaagcatgcatagtttctgcaatttatatatatatatatatatatatatatgtatatatatatgatgcattgcgatgactgttgggtgaatatttagatgcacaaatttgttagtttgactgaactcgagtaatttgttagtttgatactatggcgatcaaaatgtgttgtttgaaatattaattcaaatggaataatacatagattggccgcagattcaatgtatgatcctaggttatcaaactcatcacagaatacaaaatgcatggggaattttggtggattgg

SEQ ID NO: 95347 - DNA, 563 bp, Oryza sativa
tgggacacttgcgcatgggcattgtcacgaccggaattaacccaacgggcgttccttacgtgcgtgcattattccttgtcccaggaggcaaggtacaccaaaagttgacacttcagagtttaacaagtcgaagcgtaaatagttaatttattacatgggcggcgaaggcccagcatacacaaagacaaacgggaaacagcggaagactcgggcgacgaccacaggcgcttgacggcaggcacgagctagacaccaaagccttcctcatccaggggctcctcttctgggtttgggaaaaattgagcaagactgagtacaaccaccgtactcaacaagacacacccacaagtgcaggataaatgcaagggactacaagggggttataatataatgggttagagtttgcagcaaacaacattaaaagacatttagttgctcaaagctattttgtaaatacgatcctagagctatacattattattaaacaaggccatgaacccacacgaacctgccttaacccaaggcctacgatgattcagaccgaactggcaacccgaccctgg

SEQ ID NO: 95348 - DNA, 604 bp, Oryza sativa
agttaattaaaatacactgaatggtgggctgtgggtgcatggttttgctagtcgcacccatggcaattaaggaccggtttgctggaaaccctgggagacttaccgtgcttaccacaagcgggagtgggtaactgcttgatctgaagtatagctcgaccctttcctaggcaccggtggtgagggtgggcgtgatggagttgggttggacggggtatccggttgtccagctgccggattcaccgcggcgcacgaggggactgcccaactccggattcaccactgccttttgaggggtgggggtgaaaccttagcgtagtgtggatggttagggagggttatgcgaagggtcttttcacgatttccccctttgtagtatcatggtgatacttcggggcatggcgacgtgtcttgtgggtacagttgtacacctctggccagagtaaaactattcgaatagccgtgcccgcggttatgggcgatcaatcatattcaccgtgattagtctcacccctagtttagcttaatgaactggtgtagttcagattgttggttgggcctgttgcaacgtggtatagcgttggacagggattggttaatactgatt

SEQ ID NO: 95349 - DNA, 624 bp, Oryza sativa
ctgatgagaccacaacaacgtctttgaggaaccgcggattgacaaaacggccgaaatctacgcgacaaacaaagcacacaagcgtgggtggcggctaggcacggctcggctcggcacaaagccggccggccggccatggggagcggcggcgcacggccgatgcggcggcgcagccaaaggcggcggtgcacgcgggaaggggaagaaaaggaggggggagtcctcaccggcgacacagcggccggagcgggaggcgaaggcggtgacgacgacccgacgagcagagggggcggacaggcggcgacgacacctagaggaggggaggagagaagttagggcagagaggacaaccacggtagcttacatcgccggccgaaaaggggcaaaaatggtgggctcaccggcgaggcgagggaatcagagctccggcgtcgttcggcggcaagcaagtggtggccaaggtgcgggcggactcggtgagcgcgacggcggctctagcggcggtggcgcgcggccggagatgggcggtggcggcgaagctcgggtgtggcgtggggagagcggcggagtgcacgggcgaacgtggcgagagcggaaaaaggttgagggggctcgggggagcga

SEQ ID NO: 95350 - DNA, 597 bp, Oryza sativa
tcccaactacggggcccaccctagaaccggcatctttgtgggcaaaagaaatagatgccgatctcattcaaaaccggcactttcccaaccggcactgattacgttttctatagtagtgatagactccttattatctgtggacacatcatctgacacactgagaaaagtaattatacaccatgctaagtcagatactccaatccgaatagacaggtatcctctatatttattgagtcactgtaactacggttgaaaataatgtactgcttaacatattatatctgtgttaaaacacactgaattggttgaattctgaacatttcttgataatatgtacttcgcaacactggacatgcatgcatggggtaagatggagtttgcaaaacaaaaaatgctgctaaattttttaataaattaggcatgtgctatgcaggcaaaagttaatagaaagatatgctgcgcaaatatacagattgtgtctaaaatatgtttgctttaactatggtgtgcctttgagcgtgtcattatataccactagtccaccacaacatctcagcccttcatacccccacccaacacacactgagagagtttaat

SEQ ID NO: 95351 - DNA, 643 bp, Oryza sativa
tttttttgcgggaattcatatacttttctggtttgaagagtgtgatcatagtcgagccaagccattctctttttttctccttcggtaattaattaccctccattcaaaaaacttcatttctaccagtacaagtatttgtgggaccgaggtattagtatattggccgatgctaagttgctaactcaaacaaccatataaatttagtaggcgatgacacttgtcttagggtgtgtttagttcacgtcaaaattgaaagtttgattgaaattagaacgatgtgatgaaaaagttgaaagtttgtgtgtaggaaagttttgatgtgatgaaaaaaattgaaagtttgaaaaaaaattgggaactaaaccaagccttagacttcattgcaaaggaagcataggctgacaaatctcttccaatcctattgatatcaccatctatgttgacaaatctctttcttttctacatgatatatgagggtagaatggtcatttcattcaaaccgctgcatgcaaggatgacttgacatactcatgtggtatttttttgggtctaaggactatattaacccaaataattaatttggaggacttgcttggacgatatgaaatatcgagggctaaattaggcccgaagcgaaacttca

SEQ ID NO: 95352 - DNA, 649 bp, Oryza sativa
tcagcaaatagtaaaagtatgtttcagttcactgcaacattagatctatacatagtgaaacattatgagtgcactaggtaaaacattttttgtggaacaaattataaaacaaattctcttaatagagggttcccaaaatatgtgggtgatttgttgcaatggagtattttagttcactgcaacattagatctatacatagtgaaacattgtgagtgcactatatgaaacatttttggtggaacaaaaaataaaccaaattcccttaatagagggtttccaaaatatgtggatgatttgttgcaatggaatatatggtggagatacatggtggggccaggaggagacattgcgcgtgaggagggggaagcgcccgatccggctccccccgcgccggtcgcccggcgttgagcatttacgcaataaccatataatatctttgtttttaatatatgacaccgtgacttttttgacaaacgtttgaccatttgtcttattcaaacttttttgtgcaaatataaaataatttaagttaggctttagaatatttaacgataaatcaaatcataaaaaataaatgataattttatattttttaatacaataaatggtcaaacgtatcttaaaaagttaacgacatcggggtgcagg

SEQ ID NO: 95353 - DNA, 620 bp, Oryza sativa
tattatttcaacaatataatttttagaacataccgtaacatgtacgctagtatatgatgaaatgggataaatcttctttgcagtactgccctccgacttggtcaaacagtagtgtagtgtgtagaggatttgtttatgatggaaccatcttatactaaaaaaattaggatgagccttaaccaatctcacctcatctccaaatcacagccaattgatattgcctaaacgaagaaaacgattaaacccgataaccttacgagcgaaacattttgactttatcatatatatctatctacctattatattattaaaacaactttgaaaggagacaccacgttcgctgcgggaactataaattctcacattaatcagaaaaaagaaaaaatattaaccgttagatcctaataagtctagattttaatggttgagattcaatatgagtccgtacaaaagttctgaaaaattgcagtccgtttagctaaagcacaaggaaaaagttgcagtccttcaaccatcggtgcattacagctggactatgcatcacgatatggattgaagtatgtatggcatcaaacaacaccatgaatgagatcctatttgcaaacttacacaaatcaaaa

SEQ ID NO: 95354 - DNA, 550 bp, Oryza sativa
ccatcagccaataaaacttagggcatatttgggagggggtggttctcgtttttgcattttttttccaaaatactcaaaacgatctaaggtgaaaaaggttataataaactagaagccaggagttatgtatcaaccaactatttattaaaatcttaactttcctaaacaagaccttaaattgttatctttcatcgtagaactgaaaacaatttaggattagaaaaaaaaaagatgagagagaaataaataggtcgaagtgatatattattatgatgattgggtatgaacggtttcaatcaggtttgacccccccccaaatatttgtatgaaggatgatcttgtttctatatatttttggtgggtctaaggataaagcaaactactggttgcatgagccttggcgcccgtgcattaccatcaattatttacgtagtactcaacaacttccttctctctcctccaccttagacttttctaccgtctataggttaatagatggctttggtaactttattggcacttgccctaactgaaaccaaatttagttttt

SEQ ID NO: 95355 - DNA, 1228 bp, Oryza sativa
acgatatggaattaatcagcttgaaattaaaatttactgtcatgaagtctctaattgcccaaagtgctggtcctctgccttcgttttgattccgactgatttctactggtagcaaagtgcaggttactacgctgcaatttttatagagctcccattggtttctacactgcaaaagacattcttaattacacatattttggaaattgctaccattatttacttaagctaaacacaacttaatgtgcaaagaagagcattcaatattcacagcataatagtgcgaagaatctagaaatccatcaccaaattttaccataaaggcatttcatcggatatctggtgtacctagcagagaggaagagaccaagccattcttgcgtcatggtattagctcaaggagagggaagtactcatttatgatgctagttaatccatgaggactgcctttatctcgaaaaaaacagggagagggaagttagctgagtttacactgataaacattggcatcatgttgacacacaaaataatagtaacacattaacatgcagaattgcagataagtctgatactgattcttgtctggagaggacagaagtgcatctgccaacaatagtgcccagaggactatggagcatgaacatcagcagacagcagctacgtcattggagtccagtaacatactctgagagaatgtttaagcacacataaagttcggaaaatcatagtgtgatttcaagaagaactatgtgcataaaaccagtcttttatgtcctaacatgaagctagacagcagggtagctgcatccgccaattgcagatcaaaatgcatcaaaaataaattatatagaagggataaactggagttgcgatgaattatgtggcactacatgatccaacaaaattctaagcagaaagcataaaatattgaagggaattcttcaaaaaggcaaaaaaaaacaaggaacttatacctttttctccaaatcaagtgcttcagaagcaagacaggccaaaacagaatccacggacataattgtgtcacaatgatctttgcaactaaatggcaatcctctcgattgcaagttgacggtgcctatcatcaaagatgattcagactttaggtgaatttacatatatgacttcctgaggtcatagtgtgcatataaatgaacttaatgcattagaagctataaaagtataaatttccattaaactcgtataaggtggg

SEQ ID NO: 95356 - DNA, 714 bp, Oryza sativa
  unsure (1)..(714): unsure at all n locations
tttaaattggcagagttcttatcaatcatgaaaattatctttatctgttgaacgcacaaatatttttgctagtccttaaaaaggtacaagggtatcatattttctattgcctttgtacttccagatactaagtatctcaaaaaaaatatatcttgatgtaccaaaatttgtttttagtgtattccaagtttccgcatcctaaagcaaaaccatacattatacatggaactccagaaccaccactaaagtatataaaaaaagtcgcatatatatatatatatatatatatatatatatatatgtgcaacctctttaaaccaccatgtatagagcaaaactgaaatttactaggggtcattgtacaaaagcactaacaggtgtcattgtggaacaaataataataacatgaaagaacattgcaagaggattcaccattattatgatatttccttcctcacagggaatatgggaggccatatcatcataaagggcatgattgaaaacaagatttcatccttttctgtcacctcgtaaaccttgtgaagttgcctactcttaacatccaagtagagtgcacattcatctgttttcaagaacacaaactcaggatcgtcccctacataatccatgtaaacaacacgactattcccgcccacacaatttatgtgcanattagcgcacatcgaccgcacacaatggtatcaaccagagtct

SEQ ID NO: 95357 - DNA, 675 bp, Oryza sativa
  unsure (1)..(675): unsure at all n locations
aagaaaaattgaaggggaaaaaaaagaacgcatctggcatactggatgctcaaaatcggtggaaggctgcacaacgtttgtactgcccaaattagcagcgagcagagccaatgaaaatctgtaaatcccccacagtaataaaggacatggaaatccccaaatcagctgcagcgagaggctctggcgccgtcctcgtcatcttcacactactcctcgagtagtccatctgcacatgaacagcttggtggataggcagatcggacggtcgtccacgggtgatgaacgaacagtgtaacaagtttactaatttgttgacaattagtaaaaatctattcgattttcaacttttttgggttcaaattttctgaaaacttaaaatttcaatctggcgattcttttaagactctgacatcttcatcctttctcaaagttaacaacaggcatgggattgcaacaattattaaaatagctttctttactgttcttcggaaaaaaaaagaaaatgaaaaaaaggtagtctggacgagaagagagcccaccattagttttattttattaagatagcagcgagagatgcattaagcattaatcatgaaagggtgagtagctaccagtacgtgttngtatgaaatactctcaattgggtggcacaagagataaacctgccgcatggag

SEQ ID NO: 95358 - DNA, 664 bp, Oryza sativa
tttccatttttcatatgaaatgtttatatttgtaagttgactatagcaaaataatttagtgcagtataataattcattttataagtcagaataactttacgggtagtaaatgatttcaaatgaaaaaaatgtcaacaacaaagttgtataacttatcaagatttacaacttttagtttggtcatttttcaatataacatttttttttgaatagtttgaatttgaatttaaaaatatgacaacttttttcagattatgtggggtgcgtcgacaatgctttttggatgtgacaattacatgttgcgcgtatagttaggggagtttcttctggccaaatgatgccactttaaaactgaattagttttttctgtttttagaaaaacatgtgatggatgttgaatctttttaaaaaaaaaatctctcgggttacaaatcgttgtcacaaccttaatagtgtcaccttttttgaaactttccttgttcttcccggcgtatttgttatgaatttacacaagcgccggaggatgttagtaaggaacaatattccctcccctttcgtcagaagtgaccacttaagtggtttgggaaggaacaaaagtaccaccgtttgtttaaacccccaccttgtaacatcttttttggagcaaccacccggtccttataat

SEQ ID NO: 95359 - DNA, 649 bp, Oryza sativa
ttttttggtgtgtggcaatgcatctaacttttttgttttcatcggtctggttgttttagcatattgtattactgtatcaattttcctttcatgtgcatatcagatatgaaccatattggtagtcttaggggctctttggttgcctggatctaccctggctcgcatgggagatgcagacgcgtccgcttgtttggttaactgcatgccctttggagcctggctgagttcatgcaaaagtaggttagccaggcccgaaagaaacggccgatttcttcttcgctcctcaacctggctcactcgatgcaaggtggatgcaccgcgggtgcaagcgttgcatcagtgcgtgcacgtgcgtgggaggggtctagcatccgctcaactcctccctatcattttcatcttcccatttctaattggtctcctcctcccctttctacccttggcgttgccgcaccaaattccctgcggtcaccgttcgtttggcgtcttctccggtgggggactgggagctgacctccagcttcctccgccgaccccaagggagaagctactggcgctattacaatccttggcatctccatcgcgtcgatgcgctgcctttctttttttgtggcacaactgccttttccacccgcaggccaccaaatcc

SEQ ID NO: 95360 - DNA, 663 bp, Oryza sativa
tctcgaaccagaatttctaagctgaatgtgcattaaattcctgtctaggaccagccagggtacacaaacgacaatgttgacatacagacccacgtcttacaaaaatataaaagattacaaatgcagcgggaaagattaaagcgagctaaaccgggaagcttgacttcagcagcgggcgactccactccacaggcaaaccttgacggcagcaacgaagccaacctctctgagacggctccactgagaagaacttcaactctggtgtgggggaaaagagagcaagactgagtactacccactgtactcaacaagtcataccggaagaggaggtatgatgcaggatataaccaaaggaagctagggattcttttgcataaagcaggcatttcaaagcagtagttgaaagcagtaaaacagctgtagtaattaatcaatattaaccaatcactgtccaacgctacaccacgttgcaacaggcccaaccaaccacctgaactacactagttcattaagctaaactaggggtgggactaatcacggtgaatctggttgatcgcccataaccgcgggcacggctattcgaatagttttactctggccagaggtgtacaactgtacccacaagatacgattccagggtaccgagctcgaattcgccctata

SEQ ID NO: 95361 - DNA, 557 bp, Oryza sativa
cgaattcgagctcggtacccagcctgattcgagacgcatgatctgtgacgaacggattttcatcacatgagagtcacaggtttcaaaacatgacataactctttgttattatgacataaataaaatgtcacctatcataagatctcttgtagtgcctgacgactatccccactgttcaacatgccatgtggacagtcatagtgctggaatatgttggtggcacacattgataccagcaaaatctttcgtggtaaaatgtgatttgcagtatatgtattgcaagattcctatttggcacagctgcaccacaggtgcatgtttagagcccatctagcccatcggggtggggggcagaggagtatgatccctcttcttattccttcgttcgctgctttccttctctcttcaatgtttccaatcgacagcatcagtagagctgctcgtcgttgcccttcaatctgcgcttgtgtcaggccatgatccttgtccacgttcccagccgcgcttcatccctgggtcaactcctttggccatatcgtacccccattgatgaggga

SEQ ID NO: 95362 - DNA, 573 bp, Oryza sativa
ccaatatataaagcccaactagtcaagttataataacccaaggtatcaaggaataaagtagtcaagaacaaaagggctataacaaacaataggttaattccacccaatgacattcgaaaataaatgcaatagttgaatagaaacaatagctttaaacgggatcaacatgctcaaagggttgtttgggatctgtgtgacttgccttgctggccttagaattcttcaaattcttctcctgcgaaaacggactctccggaaacgtcggaatctaagcagaaaagagcaaaatcaccaaaacagcacataaacaagcatgaacagtacatgtggatatttttaacagtagatctcaattttagaaaaatttagagacttgaaccaactaaatccgagctaagatgaattagttatgaatttttgaagattaaatcggattaaaacacttatatggattttaattgaattatgacgcaataatgaattatttttgaaaaggaaaaagggatttattgcgtcagcggctagggttttcggtggaccgggcgcacggcgacggttcacggaaacgaacgg

SEQ ID NO: 95363 - DNA, 606 bp, Oryza sativa
cccctactatactctactcaccgtgaatagtcattttttggggatggttttcctttgcagaactgagttataatgctttttttttaccacaactgatatatgcaatgtttactggtagtttgtccatatgaatcttgtgctgcaaaaggcagcatagtttattttcaagttctttgtagttttgtttgttaattgtagcttaggttgatataaatagcttaatgtttgaagttatgctttatatttttcaaagtaaattattgtgtgatgtccattgctctagtgaatttagggtttctcttgaagaattttgttggctgctccaactgctcccaataatgccactaaaagaacagttgcatttttacaagccacctgctagtactgacatggtattggatgtgacatttcctagtacaacaaatctgtcaggagcttatccagatttgttgtattagggaatgtctcgtccaatactaggttggttttttgtgggacggagggaactaccttgtcttgtatagatgacctgattttgttgactgacctcatcaactccactaaagaacaacagttgcattctgttcaagctacctgctagtactg

SEQ ID NO: 95364 - DNA, 550 bp, Oryza sativa
tgaggacgacgggatgggagggaggaggaagaagggaatcaaggagaagatcaaggagaagctccccggcggcaacaagggcggccagcagcagccgacggccactgcggcgaccggcggatatggtgccggcacgggacacaccgccgccgctggtacaaccaccgacgccggcgggacggcgtatacaccgacgacgcagccgacgcacgagaagaagggtatgatggagaagatcaaggagaagctccccggtggtggccatcactgagccctttttgaggttcagtttagctccagctttggagtggccgtacactgttcagaataaccaatactccgatgtatggatgaataaaaacgagtggttgcatgcttcaatgtgttgctaatattaatatcggtcatagcttcttgtatttctgaagtttgtacttgcctgtcttttaaaatgtttccttgtatttatgaagtttgtacctgcctgccttttaaaatgtttccataatgttgctagtaatgttgttatccagtatctcctccgtccttg

SEQ ID NO: 95365 - DNA, 753 bp, Oryza sativa
agtcgagctcggtacccattcctatacaacatcgtagaatctatagtctcactttctttgattacatacttattcaacacaatgatgattctatttaactgaatccataacctttggtccgactggcattccttaaaacaactttgaatctcgtatatctttgacaaactggaatacatgaataaattgattgcttggttccacatcttatcctctgtctaattattattgcacctgccggagccatatttttttttctcatgaaaacacgaaccatttaactctcttgaactattatagatcatttgcaatatagacattggctggcctttcattcatttggataatagtaacgtagttaactcgtccttttagttataatctgaccaagatgtaatagagaatattgttgtgactgacatcttgcatcaattattattacacttcaaacatgctccagttctcatggcatttactgtagacatccagggtagaatcatatgtgcaaccatctactgcgaatatccatcttacttgattgactattaatgctagaacttcaactatcgacctttagaaattgtctcacattgaatagaccgtcgtgaacacattttccatatatctctctctagaactgttgattcttaacggcaattagcatagtctctccaaaaatgtcttgactcaaaacaattaactcataccaatccccaacatgaaaggggtgcattcctcttcattaacaatctt

SEQ ID NO: 95366 - DNA, 5027 bp, Oryza sativa
ccattcccctataaaccatagaagaatctcgtgtaggtggaccatacagggagacatgcaacatggcaagaatggaacgcgaaggttcaacatcctcaacacccgtgcagatgtatgtggccggttgggagccatctggggatgcgcccagatggacccaagctccaggccattgcattggaggctcgggctgggaaagtgccagtgagagccgacggcgggcgtatcatgacatacaatggggtgggttgaacactcaatcccccggatcaagcagtatgcctccatctcccgctgaatggcgctcaagttcctctcgttggaacttgggtgaatcaccaggagaatggatacccttgatatgcaaatgggagagatcaaatacaacctcgaggaacacatagcacagacgcaagaatagcagcaaaatactaatgctcagttcaccaacatcaacaacctgatgcagcaacagcacgatgatcttcaagcttgggggagacgtctctcgccccactgaggtaacttgtatcattacatatttccctttccatatgcatgtttatttttccaattgcatcctataaactaaaaacatcataaaattttgaaaatagaaaaataccgaaatgataagttagattttattatcctaggtaagacaacttagttctctttgttgaaataacgaatagttgctctgttttttatctctcatatatgggttcatggttaagtactctctcaaaaattgaataagagtagccaacaattatccgggaacctgagggaagtgagctgcacttgctaatctgagtttaagttgctgtgagatatgagatagtaataagttgctataatcctagtctgagtttgacttgacttacggatgttttattttcaaaaatgataaactttggaagttcctcacttgatataaattcctaccaaagccaaaaatattcatattgattatgccatatacattttggttatttgcaatttcattgaactttgtcaagtccttgtgacttgtgttgatactttccatgctctataatcaagatcaaacatccacatatatgcacatgctaaacttctgcactggaacctagcagatgtccattccatctccataccaccatcaaaataaattctccatgcttatatgtgctttcttctcctagaaaagaaaatcatttatgaaaaaaaagagagaaaaggagggaaagtcatggttataaaaataataaagttatgctctatcaattttgaacatgatgttgaaaaaaaaagaaaataatgtgtagccaaaccctctccttatttataaaggaaggattttggagaaggaagtaagcacaaaggagaagcacaaagtcatggttataaggaagtatgtttagttatctattttagtctaagtttttgacttagtaataaatgtgaatgcaagtatgccatgtttgattgctaccaagctccatatatcaaccgtagaataggaataaaaaaggcaaattgctgaggaatttatattcatatacttggagagatcgagtgaatcatttgaggaacttggatttcttttgcaaaatcatttgaaaaactttcggaataattgttgaatgtagattgggtaattagtgctctaattgatgttctgtttctcaaccgctctttacaaagaaaggcagtgtcttgtgggaatcaggggtaaggataagccaccgtgccaaatttattaatttgagagagagagtacacataccttgcacctgtacatttgagatatacagcatggtagcaactcctgatcaacaatcaagtttttttttgtgagtccttcactcgggacgagcaaaggttcaagcttagggggttttgttgacggttgttagcgatcagtttcgcccgtcaatattacctttaaataaaagagaactagttatgcttgcaatgcatatttgtgtttaaataataaatattcaactagtactaggattattaaccccttgcagagaatgagcacaaaatggaggagaatcgacaacaaaacaggcgatcgatcaatcaggacaatgtcaagaattagacttatcaatgaatgggccaagaactcagaaatgacaggaccaattgggccaaaattcacaagtctgcaaaatatatcaagagacaaggccgctagccgaaggtgggctggattgggccagcccatggttcgaccaaaccctcgctggtaccattggatgcaggttttgtttttggacggcgtggatcactacccaatgacggttggagggcaattccgaccattccaacttcacaaccatcattggcagcctttttaaggagctcctctcatcacttcttccacacacctcaagcaagaagcttcatacatctctcaagcttagtatagtctctagagtatagtggaatagaaatagaatagaatctttagtccttggagtcttcggaagaattcaggtatggctctagtagcttttccttcttttgtaagaattgtactttatttagaatattcttctttatactactttggtattgtactactttccgagtatatgagtaccaactttattatatatccaagttatattcattatgatgctagcttatctaggagatgcaatgatgtgggtataatgatcgtatttacgatgactctatatcatgactctatatctaaaagtatattaataggatttttctattttcctttccactttgcttagataattatgaatgagagtataaatgcttctgcttagtgtcactctaccctttgaaatatattaaccccttcctagactttggttattacaagtaatattaaattattagtatggttttctctattataatcttcccacgagattaaacaaatatgatacccttggaatactctcagttgaaatgctacaatggtatatctgtgcgcttgttggtgaataaccataatatgccagaagtatttctgcgccattgctaggaattatatttctagtaatgtcgttaagaaatagtaacacttgcccgctgtgttgggctgctaagggggtggtgatatgccccttgccggcctaggtcctaggcggtcgcacaaccagcctaggcccagggccagccctgatgatggattttcttttgtgggtacaattgtataccttgaccagagtaaaactattcaaatagtcatgcacgcagctatgggtaatcgaccagcttcaccacgattagtcctactctattgcttaacttgacatagtgaacttgtgtagttcaggtggtatggttgggcctattcaacatggtatagcattgtttagaggatatttaatcttgccttaattaattagtagttttattgttttcaactataaatgtttacaaccgcctttatgcaaccgccttgtctccccttgcatgtatgcatcgttggtgtggcttgctgagtatggtggttgtactcagtcttgctatattccccattttcagaagtgtagtgcttatgtgttgaagatgaatgtagaggacgaaggcttatacctcagttgtgtttttgcctgtggggtggagctgaagtcccgctaggatcgcccgaatttttgttgttattgctttcttttcggtttgaggactaaatgcgtcctttgtaagcatttacaggttatttacgtttggatctatatattaatttgtcattttgtgtaccttggcttaattatggacagggatttatacacaaaatagtctagaaattggccaaatttcatagcataacatcgttgcaaccttcaatgaggggtaaaatgagagaagggagccggttggtatttcttaacgacattactagaaatataattcccagcaatggtgcataaatactctgggtatattatggctacagagttcatccgcaagggcacggatattccattgtagcatttcatccgagagtattccaaggttatcatatttgtttaatcccatggaaaaattatagtagagagaaccgtactaataatttatatattacttgtaataattataatctaagcatgtgttaatgtaattcatagggtaggaagacacacaagcataaaactactcattctcatattattctaagctaagtggaaagtaaatagaaaagaatctattcctatacttcttctagtatacgtattatacgtacatcctagttataatattaactagctaatatcctcttttcgatgtcctcctggtacttcgagaagccacccctgactgtcgagttccatacgacagcccatcatgaccatacaaccggggctaaatacggaggagtaccgtccccaggaaattaacttaggaatatatacacgagcgaaggaatacccatactgagctgtcaccatcagcggcccacctctcttccgcagcatatatccctaaataatgatacccagtaatctagacaccacgccaaaactactatatactactctaatatcatcgtcatgacatagagtaaatgcataagcaaacattatacccgtacctatccatctcccagataagctagcagtttaatcaatataacttggatataaagtaaagttggtattctaaataaaattggaaagaattacaacaccagaattgtataaagaagaatattctaaataaagtacaagtcttacaaaagaagataggagagctgctagagccctacccgaactcttccgaagactttcggactccgatttctattatattcctactccactagcttgagaatactaaactaagcttgagagaatatgagagagttttgcttgaggtgtgtgttgaaatggaggatgagagggctttatatagcttgagaatgacaggtatgaaggttggaaagattggtaatgccctccaccatcactggggagccatctcagccgtccatccaagcctcgaatcaaatggccgtgagaaaggttcggccgaacccgagccagggg

SEQ ID NO: 95367 - DNA, 693 bp, Oryza sativa
cgagtaagtttgcttggcccctccaaacggatttgcaaatgcaaccttcccgtgattgcaatcaacagaggatgtcgcagtttttgcgcaggtcattttatcacttgaataagggcatattttgctgttaaagtaccttgcagcctgcatgagaaggttcagagatcagaacatgaattcggtataatattatatatatatatatatatatatatatatatatatatattataccgaattcaaatgttcaatataaacttgtagaagagaaaatattgttggtccctagtccaatgtaaaactctgataataaaagatatcctagtgtagaattcacaagaagaaatattattttcccataaatgtatacgaggtattgtttgacatgccactgttccatataaaacatactccctccatccgtgattgcagtggcgaaactaggatttgaatactgtcacgccctgaagttcttctccctagcaaaaatttaattaataaattgtcgcaagaaattatttgtttaaaggcaagagagaatttttcttggaatcggcatgtggaatttttcttggattctacatgtcaaaatatgctaacaggaattttagtggaattttcagagccttggaaataattttagtggaatcccaagaagttggaggatatacctatagtacaagagtatcctga

SEQ ID NO: 95368 - DNA, 671 bp, Oryza sativa
tacaccccctcctctgctcctcctccccattctgtaaaattgaaatgatgaattgatgcatgatgaatgtgatgtgagatgaattgatgcatgatgaatgtgatgaaaattgatggatgatgaatgtgatgtgagatgaattgatggctgaattgggatgaatttttgatgaatgttaattggtggtgaaaatttgggcggatgtagtttttttttgtgttgatagaggcatgtatgagtttgtgcagcctctgaattttttgtgcaccaactaaaatagatgtgcagccactgaattttatcgatgatagaggcatgtatgagtactgtcctttgttttcttgttgcaaatgtgatttaaattgtacaatcaaaattgatcttgtgctcaacatattaagaaaaggaattgttttgctgctgcactttttttccaaaatgaaatgcactttcttttgttcaggcctatgctgttgctagccattgctgatctgaaagcatgcatagtttctgcaatttatatatatatatatatatatatatatgtatatatatatatatatgtatatatatatatatatgtatatatatatatatatgtatatatatatatatatgtatatatatatatatatgtatatatatatatatatgtatatatatatatatat

SEQ ID NO: 95369 - DNA, 583 bp, Oryza sativa
gccggaatgttttattctattattaaaaaaaaaatgaagatgcttgtcctctgttttctctgttactcgctgttggccctgttgcccttcagagattttgcaacttgcacggttgttttgttctcctgtatttatccatttccttcattgaaaattcggcagtgtgtagtaggaattttttttccatcactttgtctttttttaccattcaaaagtttattggttgggtacctacgacagagacagggacgtaacccattttttttctttataaaagagcctatagggtgaagttttatctcaaatattgtggattccgcccccattccttttagcttgtttatcatatcattgttgcgatttatttactccatatttctaaaagtatgatttctcaaaaaaaaattcttatatggtgttagcagatcacttgttgttacgagctatctattaattttattttttattaaagtacttaattatcctgatagatatctgtgatactaattccgggaataatttgttccaagcatttgaactactcataccatttaattattcagatgaattcgatgttctatgg

SEQ ID NO: 95370 - DNA, 1083 bp, Oryza sativa
cacatacggaagtatatcgtatggatgatggtataccatactcgtatgtttcgtcagtcataggataagaggtatgttttatccgtaaccatgatagattcggtatcacaacagcatgctggacggcaaaaaagctcatcattcaaaccttgcagtagcacgaggcataaggtaatagatgataatactggatcaaaatttctgcttattacttgagctacgaacatgctttctaaactgctaaacgatataattttttaaagaaactttttatatattttttctttaagcaatgactttatatttcaaatttataatgattaatacttaattaaatacacgttaattgctcgtcttattttccttgctaactagccaagcacaacagccatatcaaacgcagccgtcatcgatgacgaacaacggaacagccgaacaagcaagcgtcactgatcagatattacagtagttgtgccacgtgtgtagcacagaccaggcaagtaacgaggaacaagagacagaccagcaccatataagactatctctaacaataatacccttaacaggagacccattggacggtatgtgtcacctgtggcaaaagggtcacgcacctatttcttgccttctccaacagcgaacgcaaaaggaaaccctgcaacacggacagtttccttcgtgggcccgcgatgaaatttttacgcgggaaacggagggtgtcgtgcgagatataccgggcgcggggcgcgggactgcggtgttggctcgatggcgggattgttttgccgccccggctgcatgtgagaagggagtctcagtggcagcgaggtagccgccggcgagcgaccgttcggacaaggccgaacgttggcgcagcagagtcaatcagaacacaggtaatatgatttctagcatttgcttgttcgatgtcacattcccttttaatttgtggctaattccgttcgaacatttgcttgttcggacaaggccggctgcatgtttgcttgttcgatgtcacattccctttcaaaagaatgcaaagcggcagaaaaaccaaaagcccactgatctgtccaaaagatt

SEQ ID NO: 95371 - DNA, 762 bp, Oryza sativa
gcactttattcagggggttagaatatacaccaacagaccaaatttggtttgctgcacaccgggatacagctgccttgtttgaggcttagagcctatttatgaggcccaattcaagacgagaacttgggggccaatggccttaattttcatgaaattgatttaactagcaattttggagaataaccccaaaaaagattgcgctccctagagattgaaaaactattcgcaggatctgctattgataatgcattaatatctctttcttgatgtgttaatagcctttaattaggcaaaactccaaatccctttttttaaggacacggtgaccattgtgaaactcgtaacgctaagaaatcatctagatactatcacatatcagctcaccacatctagcttcgcccatttcgagctgtgtccacttcagatacatggacatggttatttgaatctaccctacgggatcatctctagatgatcaccctagtaaagtattactactctttgatcagtgcttgctgaaaacctagaaacatgcccatctcgaactaacgagtgctacagaagagcaaaaaatcgtatcactacaactcctgagtcctcccaagccaaaaccgtaaggctatggatatatgcactgcaggacacaccggcctaaaaaactatataaaaaagttcatctatcagttgtgtctcctagcatgaatggacaaaacagcagctttgattgctattttatgctatagcaacgacatttgttatgat

SEQ ID NO: 95372 - DNA, 681 bp, Oryza sativa
attttatcaagcgaagtcattcgtcttacaaattctataacaaattaacaattagctatagtttctttgaaactaagaccggtatatatttcattataaagaaaagtacaaacacaaatgcatgaaaagtattaataaagagctaaaagaaggtgacatgtgactcagattgtgggcctggctaaccaaagtaccttgcagcaatgcaactaattactccagtagttagctttcatgtcgtcatgagttcgtcgggacaacatatcagaaattcgacttattacgggcctccacttatttgccttctcgggcctctcggcctcttgggctaccactgtgggttaattctgcagataatgggaaatatgaaagaagcactggttgggggtttaacaagtaaggttattgattctttaaataggatcgaaggtacacatgccaacaccgaattcaacaaccggggctatcagttcacgatcgacgtgatcgagtacattcctaacctaacattggattttcttttccattgggaggattacaaatatagattttagcgtagattcaaaaacagatccgcactcaaaatccttatctaaaattttcgaaacaaatatatccgcttttggcttgcgcattgcaaccacatctagcagcacgccgcaggcgcgagcttttcctctt

SEQ ID NO: 95373 - DNA, 550 bp, Oryza sativa
caccactatgaacaagtacgctgcattcaaaacaagttgttaagactagtgtaagggtccaaagcacttgtcgataacaacagaaactccaatgtatgctcagccaggacaagctaaactgagaaatgcttcctatacacaatccaaaaacttcacaagtaaagggtgtagaagaaattgtctaagttctctgcctgaaaatagcatgtgacatgactgaccactgacatttgtaacagctatgtaacacaaattgcgtgtcaatgcacaaacaagacatacaagggaccatatcagtatatacacactggccacaacttcaaactggaacgagtgagaccaaagtaattactaaagaaaacaaggtggtcattcctaacattggttgcagagtttaagcgcagcaggctggctgtgggccataggatacaggagaaaaacagcagtgcagctgaagcctcagctagctgatgcatgcactgcaacagtcttgaacacatgtctttgatagtcttttttttttcctaataatatgttggtgtaaaaatat

SEQ ID NO: 95374 - DNA, 515 bp, Oryza sativa
aattgatggtcgggtggtgacagaacaatcatcaccggtagctactcccttttataaggagtatagatagactagcaaacatacaacaagggaaaaaaatcataaggttaaaagagtaaagataaagtcacacaatttgctattgaaaacagggatagaaatgcaaatgccatgtttcttgggtcggtttagtcctaaaatttcatttgtgcaaactcgtccctctcaatgttgatttgcaccaagccaactcaatgtgaatctagcgtaaatagtaaaatccccgattaaagttcaaattgatatctcacatgggtaaatgtataatttgtacttcctctgtcggtgacatggggccgggggtatcgtgactagagacttgggtagccgcggtcacccacgtggcctgaccccctcgggggggtcgggcccgagggtgacgtggccacccctccctctgtctccccgaggggtcgggccgctcccgtttcggccccgagggctggggcgccccc

SEQ ID NO: 95375 - DNA, 562 bp, Oryza sativa
atccatgatgtcatcgatgaatgcagactgagattattcagaaacgaatagattctgctgttttgggaattaagttgactaggttccattttactacctcaggttctaaacaaatgataatgttgttgattttcttttacagatgtttcaccatttatcttattaaaaaccttacataattattatttattttattataacttgctttaccattaagtgtactttactcattacttacattttcacatatttgtgcataagttttcaataagactaaccgtcaaacatatgtcaaaaagtaaacgacatcatatattaaaatttagaggaagtgtcatttatgtggattccccaaagttattaatatatagttggccacataatcaaaagatgaaattgtcaataggtttggatcatttatactgtgatgcaatactacaatagagatgactgtaaactgtaaaggaacaatcggttgattcacttttccccaaattctcccatccgtgtggtatggtttagccgaattgggctgtttaaaatgcatttgcatggggtacct

SEQ ID NO: 95376 - DNA, 656 bp, Oryza sativa
aatgttagatacctgttatcggttgtatctgtttgatgatttaaataagctctcctggtcaggttgggaccagattcatggttcagtcttgtacaggtacatataaatgagtcatgctaatttcctttttaactgtatctgggaaaccaaacttccttaaaaaataatggttttgtcatggtttctacccaagagtagtgtatcgactagagataatttgaaaaaataggctagcagaatcccggcacttgtgtcttctgtggttctgaagacagagtatggatcattcattctccaggtgccctgtatatgttggaagatatcccctccatcctaaaaaaaatccaatcctatctacaaatttggacatatatgtttctagattcgtagctaagatttggtttttttctgggacagagtagtagcttgcaatgctttcgatttttgctcactttctaaagtgtggtaaacttgtcaggatcctctttctccaaaacaacataaaaaaacctaagttatcgttggctttacaccaatttgctttggtcaatcggaacaaagaaacggttatttttttcgtcctaactttttttagggagattaatctgatcatcaggttgtatctcccctctgcacgtaatatttttgtcatgcta

SEQ ID NO: 95377 - DNA, 1971 bp, Oryza sativa
acgaagcgagagagcattgcgtttttccttgggcccacctatttatagggctattgtgggctcacccgtgtatatgggccgagaaaatcggtccaatggacggacggcccatgcttgctatggcgaattgtcgatcaacgttatgccagctttaccacatacgtgatgatgatgcggttaaattacaactgatctgcgcagttattcttgctgcagcaaaaggtgagtagtttccatatgcctcaattttcaggagaaaaggcctcgactggagaataaaaggttgcatatttacttggctagcatatagtataggcttaaaaaataaaaaatgagttaatatgatatcccataataattgtatttctaatatttgattttgttccaaaataattgtcacaatagaatactaaggatagcattaatcacctctcatccaaatttatctctattttaccctcaacaaccctccactcttaatataaaccattgctacgggtattatagttttttttttcaaaccttaatatatgataacaacgtaaaactacaattaatttagaacagaggtagtatttcaaagcaactttcgtataaatttgttttaaaaaagaaaaccctatgtaacactgcctcaaaactttttcggactgtggtttataattttaatcatgggtttgctactgtaagcctgtaacgctgatattgtcaatgctcaatcaaccaaactaacctattaatcgcattcgcgcgactctaattactctttctatttaaatgtcattacatgttatttatgtttaatactccctccatctacatgttatttatagtaattagcttgatgtgaaagttgaattgaacttaaatgtttgtggagtgatatatcatatgttaatacatcttcataatttttttcataactatttaagtgacgtgcaaataacgaagggacatcccctcgaggattaaaatctactcccaggatactagcaagtgtaggaaaaaattttagaaatatacgcattttctgtagaatttgcaagaaaatactgaacgcgtgaagatttgcaaaaatataccgccgtcgcggtttcattgagcgagaccacggtctcacaagatcgaggcgcgagaacgagagcggtatcgctcgttcggtctgcgaggacggagcgcacacgatggcctaggcggtcatataatatcgctttgctaattagggagagcgcacggtgtcgcactctaagggtgagtttgaggagaagaagattaagaagattaggaagatacgcaaaacgaggtgagccattagcgcatgattaattgagtattaattatttaaaattttaaaaatagattaatataattttttaaagcaactttctaatagaatttttttaaaaaaatgcaccgttgagtagtttgggaagcatgcgcgcggaatacgatgggctttctcacccaatcccccaggaacgaacgcaccctaaaagtgcgagagcaagtcggtgggtcccggaactgctgcgatgcgcgatctcgcacgagaggaaagcgagagcgctggtctcacgcaagagagatgcgagagccctggggccggcgactgcaacccaagcagtctcacgctacaggaacacgagagcggtaattagtgattaattaccataattagtgattatttaatgattattaatgatcaattagttgctaatcaaggtgattaacacattaatcactggccctgtggcagccatgccgtgcggtctcgcacattgtttgtgcgacaccgtaggctctagcaccgatacgtcacattgccttcggtctcacaaaaccaacgtgcgagactgcgggcccccatgcgcaacatcgcactcccactttgcgataccacagctgcctgatctcccagcaaaaaaattccgtggggcccactccacaaccgcctttgcgataccacggctg

SEQ ID NO: 95378 - DNA, 659 bp, Oryza sativa
gacaaattaagcagtaacaatcgctaactcctgctcagtatagggcaacaacaatgtatatagcaaaagtagtccatatagatgggacccacacatatagactataactattgttatcttcacaatgtatatggatagcaactagtattaggaggagagaggaaatagagataaataacatattttatcctctatgggcagcccatatgcttatgggtggcttttgctattttcttgctatgtactagttccacaatgttgttaggtggttgaatagaatattttattgcttatggactggttttatactacattgtggatggccaatgtcatgtaccttatagcaaaatcagttggagagagtagctatatttatggcgctatatttttttttcactaaaaaataatcggtatatatttatattgtaagttcttaaattacatatacaatttcattgtatttacaatgtaactctaaatattacatatgtaagtcctaaaattacatatgtaaatcctaaaattacatactaattacatatgtaagtgacgtgcaagtgggttttactacgtaagtggtgtgtaagtatgatgtgtataaattcgtatgaatatataaataactgtctacctagctagctttaattagctagccagct

SEQ ID NO: 95379 - DNA, 602 bp, Oryza sativa
ccgtccttgtatagatgaacagggttttacatttcgggaagcaagataatttcagcggccatcaaaattccgaaatttcggatactttgaacggttttttttaaaaaaaattaacatatttttactgaatttgaacaaattatgaccaaattcataaatatttgaaaaaaaatctagaaaattcgctcgaaatatttgcttgccggtggggaggggggaggggggatttcggcaatttccaaaatttccatccctgtagatgattggaattggattaccgatccacattccagggctcccatcagttgccattttacctaaaatggcttatttggcttattagaaaattaaaattaatttataagtaaaacttttgtagatttgttcgtagcgacttaaaagccaaaattaacaaaaattacgttaaaagcatttcaaaatcaacttcaaaattaagttcaaaaattcaaattttggcttattctttggctgtttaggccaaacgatggggctgcaggtcatgtacgctgggctataaacccaaattcgactactattaatttcggatttttctttacatgttctttttcatcgatcttttg

SEQ ID NO: 95380 - DNA, 646 bp, Oryza sativa
acttaatctgcatctttatcttcaggagaaaagaacaccaaaagaagtgtgtgtgtatatatatatagagagaggctctattatacacccttctcttagaataactattctacacccccctcccaccttccatccgtccccacctccctcccgcgctccctctccctctccctctcgcgcctccccccaatctctccttttcttcttttttttcttctctccctccttctatcttttttagaaaaaataaatttgcgtaaaaaacttaatctgcatctttatcttcaggagaaaagaacaccaaaagaagtgtgtgtgtatatatatagagagagagagaggctctattatacactcttctcttagaataactattctacacccccctcccaccttccatacggccccacctacctcccgcgctccctatccctctcgcgcctccacccaatctctccttgtattcttttttgcttatctccctccttatatcttttttagaaaaaaaaaaagacaattggtggaatcaagacttgatcccatgatcttctggttgatggtgagcacttctaaccaaatcaccatatgatgatttgtgaacaaatcagttatgtacctataacaatcataccttgttactatgatt

SEQ ID NO: 95381 - DNA, 655 bp, Oryza sativa
caaagatttaagggtaaacaataatcaaggcatggcataatcacaagtaggatgttcatcattgcatgcaattttatttgtaaacaaaacaatttcgcaattaggatcagcatgttcgaggaatagtgatgacttgccttgctcagtctagtccttattcttgatataattcttgatcaaccttcacctcctggaagttgctgacgttgcctcacgactaaccgatacataaattctataatacgcaagaaaaaccaatattcaaataacaaccaaatatgcacaacaaaatatactattcatgtctgctaatggattccaatctcgctaggggctaaggtttcttaatctttctattgtcaacgtggcctattcaggagctagccaatgtagtataaatgagatacgtatctggctaatatgtggtgtagtctagctaatggctatggaaggattatggctacacatgcatctatctaaataaaatggtcgtatactagaggttctgttgtcggatggatttaggatcaatcaaataatgaatcatttgtattattatttaattgatggaggctttactttaattatgaacatatttcacttgtcgcaataaattataaaaggttaataattatccatgctttctatgttagag

SEQ ID NO: 95382 - DNA, 611 bp, Oryza sativa
atgatgcaaaagttttaaagagtttgaaattttagtgattttttttattttagggaattttcagggtgttacaattactcagcaattctcaatatatttttttcgacaatcaagttaggagtaaaaaagaaaaaaaagaaccaacagggtttatcaacttatcatgaaacaaacaaatgaaatccacgcttttatgggaaacatattgaaaagtttatgttaaatattataaaaattatagatagatttgttaaaatattgtgcaaatatgtgaggggtgatgattggatatgcttttatggaagtaaatatgtaattatggctagtcagtgacgatgtggcatggttacatgcatgttgagctttacacttagtggggtatagtatagatacctcacgagtcacgaggtaggcacgaggtaggcagctattctggatcaaggtctgcaatttcgttttgcatattttagagttttttttaaaaaaaatttgaacaaatcaaactaaaatttgactaaactcacaaaatattgaaaaaaattgaaaattttgggcgaaatagtgtcttgcacaggagagggggcatagcctcatagggcgtccaaaattgc

SEQ ID NO: 95383 - DNA, 1454 bp, Oryza sativa
tttaatcatcattaggattttattttgtcggttgctgattgtattgtttcttaatagttatatattgtgttgacaattttattgatgcctggtatttatatgagaatatttaaatcaccatagtccatagaaattagggtgacataatgtgcaacgaatacaaattgactgttttttactcctactgtcaacttttatctttacgaattgtatcagtgtcatgctgttgtgctgtagccatgtctaaacataatctgacatggaaaagtgagtctacctttgtaaataatggactaacgtacttgtccgtttctaatacgtgtgtccgtttcttatatgtcaaacttattacaagtttccaaaacttttcaagtactattaaatcttaaccgtttaaatctagatcaaacacaatctaatggttaatattttttgttttccttcgattaacgtgagaatttctagcctcaacagtgaatgtggtgcctcctttcaagttgtcttaataatataatagatagataaatagattcctgttcagtagaagtattaagaaattctctgttttcttttcatggcatatctacaactatcccaattaatcgagaataatgacttgtttttgtcaaaaataaatcaggaataatgactttattgttactcataatatagctatattagttagcggctggcttttgtgtattctcatagatatactgccaacatatttgcgtaaataatttataatcctacaataatacaatcaaacgattactatgatagcagttggacacaaagctctattccctgcgctttgctgcagaaattactgtagacccccgattttgaaaatcggaaatcttctgtgtttatccgtaccaatccctggatcagtagttggtacacacatacatagttggatcacaacatatcacgaatgaatttaggctaaaagagttaaacacttacattagggccaggtaggccaacaactatcagagaacaatagcggaagacaaaataatataagggcccggttaacatgccacaggcagtcgactggggaacgagacctagaacaagaccgcactccgatcatcttgtgggatacgcaagcgtaccgacaagggcttctcttcaacactctcctaaaagatatataagtaacaagggtgagtaccaaccgtactcagcaaccacaacaacaatgcatatgatagagggtattcaaggaatggtttcaggttcttttgcataaagctaatttttacaattcttttcacaagcctaaaacctagcatagactgatcaaattttagtaccagtgttcactttaaacaacgacagttctgtccaccatccattgtgatcccaaggatagcttcccgccattgaatcgtcatggttttctgaggatgtccaccttccctcctctcgggatgtggctccatcag

SEQ ID NO: 95384 - DNA, 761 bp, Oryza sativa
caaaggcggtggcgggaatcggcgacggggagagaggaagcagagagagcgagagagagagagggcggcgctctctctcggctcgggcacgacgctcgtgctctgcacgtgcgaaggggagggggatcaggctgagaggagggatgggccgagggaaaggaattcagcccacaaaacagagggaggaaaaaatagacttttatagggaatttgagttggagagatttggggcttgggtttaaatttcaaatttgagattcgatctcgggggtttagggaggaatcaagggagactcaaggaaaggattcgagatgggaatttgatatttttcggaaatggggacaggtatttggcggggattcaaagggaggcgattgaatttcggagtttgatagccggaattggaatcttgaggtggacgatttgatggcgacgagagggaacaacgggaaattgaattgagatccagggcacgacttagactcgcacacaaagaacgaaattttcgcaattaggattttgccgaattagtttttaacgtctcacgagaagcggagcgttacagcgcacgtgcttaattaaatcaccctagagctaccacatgatgctaagctacccgagtaaattttattcaattgcttgcattagatttatccttcatgtttcattgaactttctttatatagcaaaacacagtgtaagaacatctaagctctcatcagcatttctatttgtggaatcttcaaaaattattttatca

SEQ ID NO: 95385 - DNA, 2220 bp, Oryza sativa
taagtgatgaagagatcgaaacatcttctttctaacgtggaacacggatggagtatatatatttttaaaagtgtgagaaaagctatgttatatgaaagaataccgacgcgaggaagatcgatttgcataaatgcccacatagattgaatgttagctctaaatggtttcatatgcattcaagttgtaaaacaaattcaactcggtaatactcatgtctggaccgttttgatgtagtactactcatgagctctgttgggatataacatttggtctttgcttcaagaagctataagaaactgcaaccgattattacatcatcaacgtacaacggcaattaacaatttacaatccattatgtaaattatctttattcttgcctgtgtagttgtagaaaaagaattactccgtaaaacatttagtcgagtgatgcgtgagtagatcacggttgactatttatttattttttgttgtgtaaaatactatgcaagtgtcacataagccaaaactagtcgagctttggtgaattaaatttaaaaatatactgttcatttggtttttttaaaaaatattcgggatgcaattgttttgacagaaatataccatcggtcccgcagaaacattgcacaaaaattaggtggcgatgacgtcaagaacggtcttgcgcgaggatggcgcgacactgcgctgcgagaccgcagtctcgctccttgcttgtggacggcgaatgttttgcccactgagctgtttgtttaactaggaaggaagcccgcgcagttgcgcgggcaatttattttttatttattaaagaactactgaaaaaaagtcatatatcatcataactaaccatagattacctcatatccttaccgtaaaagaaggaagtatttgtaccgtgaaatattcaaaggtgggtgtgcacacgtttatatgctcgcttaggattgccttttacattattagttaaaacaatattttcaagaaaattggcgagggtgtcatgaagcagcgctatggcagtgtggcttcttcgtcaacctcgtaaagagtggtcgctacatacatgtataatttgaggaacaccttagggtacgaagaaagaaacagaaaactaccagatgggatgaaccatatatgcactcttcttttttgtttttggcatctcttgtgtatgtacgtgcatagagagggattagctggttttaggagcgagggcttacctgaataaatctaattgaatggttgaaaataatggattcaccggtttaagtgcaaatcgatagctagatattttgttttttcttacaatttttttttacattttctccaatttattagagcatcacatggcatcttccaagtattagagcctaatttgaatacaactcgaaattgcacatatttttacaacttaaagcatatttaattaataaagggtttaaattattattttggttttccatctaatctaaatgagaagaaaaaagaaaaaataaggatgtgagacccggtgtgtgtacgttcatagtacgatacataggtacatattttttcttaaggaggaatacctgcgtacgtactgtacgtacgtaggtacgtacttttcttaaggaggaatacctaggtagctatgtgcatgtatattggctggtagtggcagtatgacgtgagcctttttacaaataaatttaattattaatttttaagatagatctaatggttgaacataatgggtccaccagaataaatgaaaatcgatggtcggatgttttattttttcttacaatttctatgatttattggagcgccacgtggcggtctaggaacgcttatagggtaatatgtggtggattagaagcgtttgtaggaagtttatcctcttgattactttttctctttatgaaaatatttgcaacaataattttggaatagttcgtaggaagattatcctcttgattatttttctctcttttctcttcatgaaaatatttgcaataacaatttttgaataaccacaaccttctaaattaaatatttgtaacaatattttttagatcgtcataacttttaactttaaatcgcacgttcactctttatctatttggaccattgtgttatttatgataaaaatcataattagaatttatgacatatgttgtctacttcgctcgtaaaatgtatattcttctaagttctattcattcaatcatatataaaaatata

SEQ ID NO: 95386 - DNA, 775 bp, Oryza sativa
tacccttatagaacaggaacacatttattaataatctagcgaatgtagaactaatgcgatgttcagcagttcagctaaccatgaatcttccctgaaagaaagttgaactactattaccaagaattatttctagagaatttcgtgacgcttccttgttccaaacagaagcccccctctgacggcaacaaactgttttgcaccgtcatactacgagttcatgaaaacaatgttatataacgttagactctagttccatctatcatatataaattttgattattgacacatagagtgaaggaaagtaggaaagaaagtaacaatttgcaggtctagtggaaatatgagctaacatcaaagtggagatgcaattaactagcatgaaaaacataaaactattctgacatttccttagtaagcattctatacaaatttgcaggttcattagtggggaaaaaaataccttaattgataacagaacagataaaaacggaaactatcgctgcatctccacatacatataactatctcataataaaacctactccctccgtcccatcaaaaaccaacctagtactaaatttgacatatcctaatattacgaatctaaacatatatagaatatatcacatctaatactaaattcgttttttttttacggagggagtaagccagtcagggagaatattgcgaaaacaggatagctaccttaagacaacatcagtcaagaaaccacatgaaccaccattgaaataagacactgagtaccactcaacta

SEQ ID NO: 95387 - DNA, 954 bp, Oryza sativa
atagggtcaaaattgaagtaggtcgttatgattcaagctcttttgtgctaggtatatccgtatatgatgttcgtaattccataaaatttatatgagttactccctccgtcccatgaaaggatttcgactttttacttacactatttgaccattcattttatttaaaaaatttgtgcaaatataaaaaataaaaagttgtgcttaaagtaatttggaaataaagtaagtaaaaaaataaaaaaaatttcaaatttttttaataagacgaatgatcaaacagtgtaaacaaaaaatcaaaatctcttatattagggacggaaccggctcctgtgacatagagaattctacgtcagagggatgttggacttccgatcgccgtcgcttgcgcatccaatggctcctgtccgcgtgtgatgatagccttctcgttcggcccataagcccattcgtcgccatcagattgctctagcatcgtctgccggagccgcgatagcgtgacggtgagcttgggcacacagctgagcaactggacgcagccctcccatgcgctgtccttgatgggctccgtcttggccaacaggtcccctgacgacgcggacgatgagcacctgcggttcggcagcgccgagagaagcgccaggtgtaagtgtcgcccgatgaacacgatgatgtgttagagtttgtgtcgaatatgtgtacgtatcggttacagtttagaacttggagttgtaataggtattaggattagagtatgagtcggactctatcctaggatctctcataaatagaggggcgtgcctgttgtaaccgcatggtgacttagcatagcgagagggagcggctgccgggtctaccggccgtgagtcgttgtaattctgatacgctgtatatggtggatcggggaggagcccccataatcagtgccccggagatgtaggctacggctgaactccg

SEQ ID NO: 95388 - DNA, 663 bp, Oryza sativa
tacccatgaattgaagtgggcccgcccctgaatgggaacgcgtcatcactcatcaccccctccctttttcttcttctctcccttcctcgtctctctcccatgggggtcgcataaaaggtaggcaatctcgaatagtctaatcccaaaccgaagaaccataaaaaaatcatctgtaagtccgaccgagcgacgacctgcgtccccgcacgcgtgatgtgttcgtcacatacgccgcccaaagggaaaaaaaattagagatcaaatcaaaatcctaatcacgtacagcggacaaatcccaaaatcaaatatcgattaaaaacccaattgtggcaaataacatccagagtcatcaaataacacaaaaaaaaaccaaaccaaaattaagaagtttaatgtatagtgatccagacattttttttctggttggtataaaaaaaggtatatatataggacatttagatggatgtagagaatttattccaagtgagaccgctcattagagcaagtttaatagtgtagccaactatgggctgcaaatcattcataatctattatatactaaaagtccattaaacttcttacaaatgctcctaaactgccacgtggcgctcctacaaacgctcctaaaccgacacgtggcaatttcaatctaaccgtcggttt

SEQ ID NO: 95389 - DNA, 662 bp, Oryza sativa
tctctaattgacaataaataccgagtacttggagaagtgcgtatgtgccaatgaaactaaacaaaacaatttgaacatgatatgtactgaagtgggatcatgaggaagttaatcattacttttgattcgtattatgtttggtagcaggagtaaatgttgatgggcgatatatatatattcaaaaaacagtgattgtttccaccacacctctttagaaagattcttgttagaattttaaaattttgaccaaatattgtcataaatatcaaatatttatgattgaaggtaatattaatagaaactgctcagcgggctaggtaaccagtaatgaaataatcacttaatgaatgtcaagctaagttaccaacatgatgccttgggtatatgtgttttcaattcaaataggaaaggataagaaaaatccaaagttgagaaaggacgcatttggaattcagatgcaatgaatataaattttggattttacactctatataatatacctgtgaatttgcggccctagattaaagtaatctgccaaatttgccatctgcagaaatcagccatattcattcaaatgacaagaaggatcatgtatatccatgagaacattcaacgaaggtctggattctttagcatgcaaatcttggttttctttagggaaa

SEQ ID NO: 95390 - DNA, 617 bp, Oryza sativa
taaaaaatactttaatgagatcatatatttgttaacacttttatacgaattataatagaaaataatagtcaaagttattttttttggagaccgtgcccttatccaaaacgacgttatcaacctgagggagtagcatcggggcgtcactcatcaccatccgcgagcactttgactaatcagaatatcagttcccgctggaatttcttctctacgaagttccttaccttcgtctcccgagatattcactttcttataatgttttaccactcattttatttaaaatatttatataaatataataaaaggaaaagttacgtttaaaataagtaagttgcaaataaaataaataataattttaaaattttttaataagataaatggtcaaatagtgcaattaaaatgtccctataaagagggagggagtactacctaccaatgctagcaactcggatcggcttgaacagatcaacacaagtgactaatgcaaccaagtagcacctctatttaacacaaattttgacaatttaaccctttggaaaaactaattttataaatgaaccgccgctaaaacttactttaaaaataattttttttccacgccaaatcatctagcgctg

SEQ ID NO: 95391 - DNA, 697 bp, Oryza sativa
tctatgttgaacctttccgctggcccgtgaactgggaagtagataggcctactagactgtttcaccttaggtatgtattttagcccgacccatctctctgtttcacttactaattccagttcactgaggcattgcgtttgcatagcatagcatcagggagaacctgtatagtagaaaaaaaattgtcactgtagtatagattcacggcgatttgcaatttgatttgcattttatataaacataactgtgtttttatgcttacagttattatagtatgcttgttggggtatattggtaaataatcgcataaaaaactaaacttttaattctaagtcataagatccattgttttacccacgcatgaaataaacaaacaagtatatctttttttctctaatggagggacgaacagtatgtactagttacacatgttaatatagtggttacaaaaatgtttgacagataaaaataatcactcattcataaggcacgtacgtagatggtccgaagtcccaacttaacctctaattgtttttttcccagaggaaaacctttcctaattctattaccagaaatgacgtttataacaaagtcaacatatcccaacttacctttcaaaaaaaaaaatttatcccaactcatgatagttacatttaaagtgggcgagccccagacatattctgagctcacacaaaca

SEQ ID NO: 95392 - DNA, 549 bp, Oryza sativa
taggcttccaggcatgcagcgaggaaacccttcccataatcaggaaagaggtcccttatttgagtaatcttggactcagtgatggcagtatcctcattcttatgttgtagttcaccaccataggaagagacaggcaaatcaggcacactattccaagatgtcagagtagatccacacaagcgtgcaatgaactggaactgctcatcatccatgtgtatccatcctgtttacgattggaggaacatattgaatacatcaaccaaaggttttggcatcaatataaaactatgacacaatcaataaacttgagataacaagaaaatacagcatatatgtcaacagaataatgctgacagtttagcaaactctttcagtcttcacaacaaaatctagccaaaacagaaaaagtgatgtcttatgaacacaactcataagtgccagaatgatcaaacgcgagcagaaataaaatcaaatgtagggtaatacgggaatattatgggtgaactttatgagaacaaaacaacagaagctagagcatctttttctttt

SEQ ID NO: 95393 - DNA, 618 bp, Oryza sativa
ctaccggtgctttccccttgacaagctaatttctgaaacaatgagataagggtttcgggatctcgtgaaatttggtcatatgattcaggaaaaaaaaagttgtttcccacaagaaactttaacatgaattttgatttttgagttctacagtccaaaagctattcgcatgtaaattttctataggaacttgttggagaatatgtgacacaacccagccttagcaaaagttggtacgtgattccattttaatcacgcctaaagtacttgtacataaagtttgataataagaataatcactaccttggaacccttatatcctcttaatgagatttttaaaaatcacacctacgtcgaaattatttgattaataccaatataatggttcattgcaaattaaacaatcgatttacctattaactattaagggttaaatcgatggacaagattcacgcatttattcttaagctttgtctctttgtcatataaacgtgtattaaagagtgtgtatttgtggacatgtgggcaccatgatatgcacatatatggtgtttgttccgattgaccaaataggtaaaaaacttttatgtatgtagtttgcatgaccttggtcatgtatat

SEQ ID NO: 95394 - DNA, 654 bp, Oryza sativa
cctaaggctgagttcttttcccagactttccaaactcacctcccttattttccgcacgcacgctttttaaacgattaaacggtgtgttttctgcaaaaattttatgtgtgaaagttgttttaaaaaaaataatattaatctattttttaaaaaatattaataaatacttaattaatcataaaaaatgtgtcgctctgttttacgtgcgcagaaggtgagttcccaacctcacctcctgaagacaacccaagtttggtttaacaaattgaactacaatttagcacgtgcatttatgttacatgataaggcttgacttttgctcctacccgctcaattagctgccatcatgataaatgatcacttctcttttgaaaagatcgatgataatatctagtatatgcaacggtaataaacattaacaatgaaattatgtggcttgagatctaagctataacagtattgttctgtgcatgcaaaatcatgatcctagctgctgagcatctcaaacaccaagagaatatactggatatattctacaaaacattatgcatgtttttcatttctcaaatctgcaccttaattataggacaggcatataaattaatttaatgtccactcatgggacgattcgaacattatcgagactggacgtga

SEQ ID NO: 95395 - DNA, 1022 bp, Oryza sativa
  unsure (1)..(1022): unsure at all n locations
gacagtgttgttcctgaaaccgaatttgggccttgggctttgtaatagactaggcctatctcggaaatgtctccctccacctccacgaattaacactaaaccctagatctattttcctctttaaatgtctatgtacaccctctagaacaattgggttttgtttagttgaattttgccaagtgtcattcaccttgtctctaatcctcgctcgattagtcggtgactatagattcagagcccccaatagatggtgtgttgatttgccaggttgattagatctaccacttcaatcggaactattcatttgtacttaattacctattcgcattatttagattgcatcttatcttgttcttgcagtgttctctcgtttgcattgcagggatcatcaaccgcatgtcacggttggtacgacatcatttgtgctgtagcgattacacgacgtcctgggcttgttccggtaggtagccacatcgtaaacgtcgcactctatctaagcgagagttatcatctcaccagaagatcgagccacaagagagagtgtcatcatgtttaggtcctctttgaaataaacaaaaacatagtaattccaaaggatctataccctatgggaaataatcctatgaagccctttgaaatgatggatgatttctattaatttttctgaaattcctatggaatagagtattctataggaattatagagaaaaaaataagcatgggtcttacctcatgttttcttcttctcgtgtttacgtagggatggcaatttcccacatggggccggggacccgcaggggacctgcccctacgggggcgggggcgggggcgggtgtggattttaacccgcggggagtcaggtccggggccccggtcatgagcggnggcggngacgggtgaggacatccacccgcgggtccccggaggatgtatattggactatgaaatagtagcatattacgagcccaaaagacccatcaagtctaaccctaattcctcatctattcccttccctaacctta

SEQ ID NO: 95396 - DNA, 1162 bp, Oryza sativa
cgcacatgcctttgacacctcagcgaaattgtcacgatctttggacaagcatatagcagagcagcagtctagcagacaaaataattgagcattagtttaatttgtcttgtcataaaaaactggagctattgtcgcatatacccgtctttgtctacgtgtggttcgcctttcatcggcactatatgatgatatgaatagggggtgttattagtggactaattgtttattgatatttcattaaattggtgggccagttcctacttaattaatcgattgtgctgttcagatgctgtagcctgtagccctgtagccaatatccagtccagtggccgtatatgtatccaggccaggacccaactagcctccaacgtaggatggaaatgattttgcagagatgagagggggcgagatggaggagtgcggggttaaacaacaaaaagctgtttcggataatatattaaatgaaaaaacttgaattatagctaagactattgtggccgtacaaattacctctctcaataaaaaaaccaaatatcctttaccctcaactttttatatcggacaaattaccacctgacaaactccggagcggttttaatcgtacgtgacgacacgtgctgtctaaccaacaacaaaaaaaaaaggtaggactcacatgtcgtgaccgagagaagtgatggaactgacaataggccctcactattttttttattttcttatgatgactgggctgctacgtatgcgccacgtatgaccaaaaccgctccggagtcggacatgggagtaattcatctggtataaaaagttgagggtgaaaaacgtctggttttttaattgacgagggtagttcgtattgccacaataggtggggggaggtaatttggactttttcctatattaaaaaatctattttcagcctaaattttttttcatgttttgatgaggacatcacttcgtcggatacacacataattcacacgttctaatgataattccaagtccaagtccagttcagccttaagagacatcactgacttcaaacggacctagcgtcttcatgccaactctgatttgggtgatcttggactcatggaaagattatctcgccacctttcaaatacatttggtctcatatccaaattcattccgagtcaacaggaat

SEQ ID NO: 95397 - DNA, 1029 bp, Oryza sativa
tttcctatccctacccatgtcctacagtctacagatagactcttttggccaccgtattcttattggtaagtgacttaccgctagttgtttccaagatatcgtgtggctgtatttgacatgagagaaaagagaagattgagaaaatatgcaaaataaggtgactcattagcgtatgattaaatgggtatatattaactattttaaatttaaaaaataggttaatatgatttttaagcaactttcctatataattttcttttttgcaaaacacaccatttagtacttcgggaagcatgtgtgcggagaataagagaaatcttttctcaatcaccagctaccgaacacagagtgctgtctcattccttcttacgctataatatcctcttgaactatttaatgtacgttgatcagacatcgtcttatgtgcaagctagttattctcgcaagttattctcttagacttttttttgttccttttattaattttctatttttgagactccactcaatcctaatttcttatcctgtggactcatcattttctttttatgagttctccgaatctgattcatcatatattagctttttttccaccatttttttctcctctttcaattttgatgactgcaaggaatgtaaacgagagcttgtcgggggcgtgtgatctcagcatcgacatcagcatggtagagacccctcgcgggcaataaccggtcggccgacggtttgaccatggtcgagaaaactgaggagaaccgtatgaaaccgtcacggcacacgacacggtcgcgcggaccattgaacggtaggagacgagacccgtagcaagtgggtgtgcaaccgtgctgtgcctatccaacgcgaccccatgccgattcgtctctccaagttcctctctccgaaagcgaccgcgatctgttgaggaggaggaggatcacgggattttcaccggcctcacgggagatttgccgtgttgaacgtacggcagctgtggaatatcaatcggtcgaagagaagatacgcggtagt

SEQ ID NO: 95398 - DNA, 809 bp, Oryza sativa
cccatggtacaacaacttggcaggtgtgtgcgatatagtgaaaaacttgagaattgaacgtccgagtacaacaacttgacaagtaggtgcattctagtaaaaaaaacatgaaaaatactgataatttagtattttggtgcatcaacttggctaagcatatgctaggtgggttttgttcacgatgtcaatatgccattatagtattcctacggatattacctatagtattgaatttaatctttaagaattatactacacttacaatttacatctaattacctttaatttttttttgttttcttcaccttctcaaatatcaaccgaaatataataatttctacatctagttttattgactttcagttattaattattaggatacaaatataaatatgcttatacaaatccacgctagtatattttcaaaataaatacttaaaaaatgaaattatataaaaaaaatgctccaaataattaagttgtcacataaatttttaatttagtgtatgaaaattgtgcctatcttgcaagttgttgtatttatacgatcactcttatactaaattacacattcttaccaagttgttctattataacgctcatttctgaagttattgtaccaaattgcactcacctaccaagttgttgcaccgtgggtgcaatttactcaattattatattcctacttgaactcttataattatttttatatttctaaaacttattttatgtgttatttaaaactttaattaatctcgttatgtgttctacattgtcccatatttcaatagtctttattttttattaca

SEQ ID NO: 95399 - DNA, 678 bp, Oryza sativa
aggcttatcgtatggttctcatcactgtcccaacatctttagtttcagtccccgttttcttttttcaactcatctgttggattatacttcctccgtttcatattactacataagactttctagcattgcccacattcatatagatgttaatgctagaaagccttataacctgaaagaagtagtaatttataactggattatttgtttcacacttctaaaaatgctcttaataaactttcttttactgcattgttgacaccacttattctaagttatttgttagttttataatatataatatgtagtttatctttacaaacgagtggatcatccatcaacttttacctgcatagtatatatttaaaacactacctaaagttcagagtgctcctaatctttctttgttttgtttttgttttgccgaatttatcaatatcaagagaaaattaagtacatacaggacaacataatagttgtgagaaaaacatggatggaccaccaaagaccaaaaagtgctccttacatttgccattatttgtgtccaactttcattgtttcgggaatatatccaacttttatgtagagaaaaaaactaaattcattttgtatccacttattcgtttcatccatagatgatagaactaacataatactctccctccagtcttttaccgacag

SEQ ID NO: 95400 - DNA, 1039 bp, Oryza sativa
gtacatgtttatttttaggcgtgcttactggtcgttgaccagttcatcttaccatttgaagtgtactgatttatatttccattatacagtttgagaaaaatctcagcactcctggattctattaaccattcatataatccttgttggtgatatgatcgttgtcaattaccttttattcattggtaattcatttactttccatagtcttttttaggtagtgaagtttagatatatacaatgatgaccaccaggcaacaaaattgtttttttttttctgaataagagaaattggggggtttctttgttgcagttgctgcgagtggataaccgtattaattagttattgttagcatttactaatatcaacttatgatgaagctgaaactttaaggtttttagcatactttatgtgctgttattaattgctgtgagtagatagaaatagtaaagtaaacaagaagatagcctactaatcaggaaatagctcattcctgcagtaaatgatcacatataaacagaagaaaagaaaaagttatttaagctctcttgactagcctgaccagtgtttcttaattgggttagaccagcccaattgtctttgcataggatgggaacatgttttcacaaaaataagctgcttaatagttataaaagtgataggctgatgcaatttgggctggctgggctaagcctcttttgggcttgctccacagagcctgatcattcccaggttgtcagactacattttttggcgttgattgtttatatatgcatggtatttagtctttacagagtttacagcatttattttattctaaagtggaataaacatcttgctgtttttttgatgtattaagaactaacctaatctataccaaattctgatgatggatcttaaaatcagttttacgtatacatattttttccagcataccgtccctgatgggggtttgccaattttatctgctttgttagtactcaaaccttttcagatctgtagaactgcttgctctgttcatgaacaagatgaagtgacacg

SEQ ID NO: 95401 - DNA, 657 bp, Oryza sativa
ggctgcttctcatgatataaagttctataatgaattactccatttgatttctttagttcaggcaggaagtactactgaactaggatgattcagagtttcagacaaacaacagaataacagaaaaggtatacctcaagacacatacaacctggcattggatattatagcactgaaacattgagcctattgtagttttgtagttgttaattaggtaattggtgatcagttgcttgcatgagaacagtatttatgttctgctctgcatattcagtgatgacaaaaaaaaaggttaatggaatattcagtgatgacaatgattatgccctcctgacaatggaacattcagtgtgccagtttcatgcaaatgggttcttaataaagccacagttcttgctttatgcaattaaccctcaaaaactcagaaaaatgaggctttcaggtcgttttcagagatgagcagaaacagggcatccaaaaacacataaataaggtatcaaccataaaagatacatcgcaactaactgaaaactattccctccctttattttttgtctagaaagtatgtaccaagtaccaaaacatacctatggaacacttttaatatgtccaaaacgtccagtttgccagaattttcttagtgaaaagacagcgacaacg

SEQ ID NO: 95402 - DNA, 591 bp, Oryza sativa
tactgctctgtttcctgcgttcccgggaaatactgctctggtaatctgtttccagcgtaaattaaaacaaacggccaatgataatcgtttttaattttttggccgagtcatcacagactcacagtatgtcaacaactgatgtcagtacacccgttctttgttattatgacacatcactgtcatgaaaaccacctgataggttaacaatcagaaccaagcagtttctgattctgagacccattcttcagaatctggaaattctaccgatatctatctgcctgactatctctatctcgatctcgtccaggattgttcttgcgaactaatggttgtacgcaaattcgtctccctactgcagtctcagtccaagtttcctctttgatgattcttcgaacttatcgcgtagattgggactcgcgcatttagccgaggaaacacgcttagcagcaagactcgatcagctccgatcctcacgttgaagcgatgaaaaaaaatcacctcgaattcgatccaggcggcgagacgtgaccaaatcacgtacaagtcgtcgtcgaacagacctggttgtttaaactactaattctaaactgc

SEQ ID NO: 95403 - DNA, 561 bp, Oryza sativa
tctaaagaatataaagtggtctaagaataattatcatccacaccactaaaatccatcacctcctccattaattcaccacacaaatgttgaagtagagaattatcatccacctgatcatccaatatctcgctatcaacatttgaagtatgtacctgattaacagaagaactaacatattcacttaacatcttttcctctatactctttaaatcatttataacatcatctaatatgtctacaacgtttgctgcaaaaattcccttaacgctgataatcaaacgctacattacagacactaacagcgacgttcttagcttgtcaaaactctcaactacgagtaatattaattgcagtggcatctctggttgggattgtgaagtcaaaaaaaaataaaacaaaacgataagagaaaaaaaaacttctcctgagaaaaaaaaatccagagaattataggtgcctcactgcctctcctttttatctgctgtggattggataattggacatggagacaaaacccaaacacccccctaaataactaagaaactcacacgggctgcagga

SEQ ID NO: 95404 - DNA, 527 bp, Oryza sativa
ttcatggcagtggaggagttcgtcgacagattggaggagctcatccaaggctattggttcggtggcaaaggtccttgtcagggttacggataaggcataccctctatcctacgacttatggaaaataccgataaggtataccttcacgtgtacggttggtttccgtatacgttgttaggaattcgcctcaaattacggaaaaatatctctacgagttaagaaattgccgaaatcctactcggttataagcgaggtggaggggatcgatggcaatggtgactgcaagcaatgtgaaggggctcgacgaaggtggcgacaaaaccagaggttcagatggtatctgagttataatatacttgttggtactaggcgaggcctatgtggtaccgtacttggcacttatggatattaggtgataccggttaggtaccaaatttgatacctatgagtatcaggtgataccagggaggtattaagatatgatatatacgtgagagtatactatttggataggattccgtgctata

SEQ ID NO: 95405 - DNA, 543 bp, Oryza sativa
  unsure (1)..(543): unsure at all n locations
tctaaatattgcaaataggggattaaacacaaaggaatagttacgattgaagtggtagatctaatcgacccggcaaatcaacacaccaattattaggggctctaaatttatagtcgccgactaatcaagcgaggacaagagacaagtgaatgacacttggcaaaattcaattaaacaaaactcaattgttctagagggtgtacatagacatttatagaagaaaatagatcaaaggtttagtgctaattcgtggaggtgggcctagtgtattacaaggtccaagtaccaagttnnnnnnnnnnnnnnnnnnnnnnntgttttgacaatttccgtttactcggaatgaatttgtatatgaaaccggatgcgtttgaaaggtgacgagataagctttccatcaagtctaacatcacccgaatcggagttggcatgaagacactacgtccatttgaagtcaatgctgtctccggaggtcgaactggattccaaaactcattggagatgtatattgtagatcctccattcatccgatgtattctttgg

SEQ ID NO: 95406 - DNA, 631 bp, Oryza sativa
tcatttttctgccgtttatataattctggacctgcataaattgaagtcctttcaacattatactccctccgttttaaaatattgcacaccgttaattttttaatacgtgtttgaccattcatcttatttaaaaaatttaagcaattatttattcttttcatatcatttaattcattgttaaatatactttcatgtacacatatagttttacatatttcataattttttttaatataagacgaacagtcaaacatatattaaaaagtcaacagtgtcaaatattttgaaacagagggagtatattgctaattttttattgagaaatacaatacaaacacagactcacccatataaacacatacacatatcctacctgggacccctataagcaccttcgaaaaactgagccgccagtatatcttggttccaccacgaggaaactaaccagttgagttacgttcacttcgcaactatattgctattgatattgaaaaaaatacattatttcatttgtttacattataaatcgttttgaattttttagagttaaacttcaaaaagtttaaccaaatttatagaaaaatatagtaatatttataacactaaattgattccattaaatctaacatat

SEQ ID NO: 95407 - DNA, 1119 bp, Oryza sativa
agggtgtttggttgggtttatacgtggctggagatgatcatccccccttggttttgcgatgaacgaacgaatggatgcgtggctaatttgccgtgtcggcggcgactcggcgtttcggcgaaaacgtgcgcccagtggaacatgggtgtgttttcacgccaaaattgaaagtttgattgaaattggaacgatgcgacgaaaaagttagaagtttgtgtgtgtaggaaagttttgatgtgatgtaaaagttgaaagtttgatgaaaaattttagaactaaactcggcccatgtttgaaatcatgggtgtgttgttcacgctaaaattggatgtttggttaaaattggaacgatgtgacgaaaaaattgaaagtttatgtgtgcagaaaagttttgatgtgatagaaaagttggaagtttgaaaaaaaatgtttggaactgaactcggccaatttcttactctaaaaccttactccctttatcccataaaaaattatcagaacacatcctaatactataaatctggacatacctatgtttagatttattgtattagaatatgtcacatgcagttttagattcgtttttttagacggaaagagtaggcattattactaggttcgaaggatttctcgattcttttgaaacaaacactatttatgtacttgattcatagaattcagaggaaagtttttcatagaaatactaagccaatcctccaaaactccttcgaaatgcactgattccatatgaatgaaaaatctgcttcattctcttttattcagctcgttggaggaaaaattcatgtgttccaatcttttatattgtgcgtatgttcctatattatttatgtattttttcttttctgtgatttggaaatcatgtgaaccgaagaggcccttaaaacctaataccattacgtagtaccaggtgccactcatttagtattagattactatattatgagattggagaagtattgttgtgtactcggaacatgtttgaaaccatttcttttttctaaaactagttattttgtttgaatattgttgctacagatacgatttacttgtataactcatatataactaaagatatgtgatcatagaccaatcaaaata

SEQ ID NO: 95408 - DNA, 876 bp, Oryza sativa
ttgggggaggagtggagatgaaatctgaaatggttggaattgatggcgactagacttttttttttttttgaacttgatggcgacttgacttgtcaacgcgagttccttctctcttttttttttcttttctccaccatttgttgggccgtgggctatgagcccgttatgggatccgttctagcccatgggctttttagagtagagccttcgcttatgagttgagagttgagacacgagttcgtttgccgggatggggcttcaactactcttctcttttcagttttcttctttgcatttgcaaaaattgcatcaggttcagaaatgattctatttaacacccaaatttgtcacatagtatgaaatatagcgaagtttgtcagattataaaaaaaacatgggcctattgtatagggtcggtccaatcggtggtatgaggccaatctgaccgtcggtataggggtggtcggatgtgccattcagaccgggtggagaaagccttgtggaggctatggccagttcagtttaaatcaatcaacaaccaacaacgcaattatccaatcgaatcgttctttcaatttcacatgtaccttcgtcctaggtttaatcctaatttatccattttgtcggtttgctctataagccatccttcatcgtgggagtgcaaattcttgtatttttttccccaaaccttttgttcctcccataagatgggtgtttatcctaatctatctaaatcggccctgttaaccatatttgatctctaaactcatcttgatcacgagcttcttaaggtcaaggtggttggcgacttaagtcaacaccacgaggctttagatgatttgtcgtggtgactgaaaaaagcgtcaacagattcca

SEQ ID NO: 95409 - DNA, 893 bp, Oryza sativa
aacaaatctgaagtatgtggttggcacatgtaccttttttttacacagaatcaatatgggttgtggttgagcttgcttatatcttgagcagctgagaattctacagttgtgaattatggtaaacatatcttatttgacttgtaccatgagtccagtgaacctgtaaccaatatgtttgtttttaacttcatatgttcataatttaaattttccagtgattttaaaggttatgtccaaaatttaaatgttccactgatttaaaggttagtggacttttagtgctacagtcttacaaacttttggattgaaaaggatacatgtttctattgttaacttaagcttgctgctagcacatcttaattcaacattcctacgtaatttgtcaccctttctcagatcctccgtatgtttcaactaaatagaacatatgtactccatctgcctcaaattacaagtacctatgctattttctaaaaaagagattaaggttggggcgtgagatggttgttattcgttgatatgagaaaataggtacaagtagttgtattttgagacaaatttgaatcttagaggtacctatattttgagacggagtgaggagtaagttattactacatatacaactgaagaattttcttcctattggtaagagctatgtttcatatggcttctctcagcatttcatttccattggctcaccagtactagcatgtggcacatttgcactgcacgggtgatgaattgcggacttgtgaggagtccagctcctccaagaaaaatgtggtgatggattgcggacttgtgaagagtccagctcctgtaaggaaaatgggttgatggttatgtaagatgccttggatcttatgatagtatattaacgtataagcgttgac

SEQ ID NO: 95410 - DNA, 746 bp, Oryza sativa
ttcctgcagcccatattttatcacagtaaaaaacaattaacttagacgatggattaaatgaactcatgaattttgaatataaatttagaatttatatgttagtacatgaaagaaaaagggagtagctatatttatggcatcatatttttcaccaaaaaatagtcagcatgtatttacatggtaagttcttaaattacatatgtaattttagtgtatttacggtgtaagttctaaaattgcacacgtaagttccaaaattacatatgtaagtagagtgtaagtaggatgtaatttcattttaaatcaatgaatataaacataaacatactacaagtctatgagacgtaaattaattcattatattaactaaattaagtaggtggtcccacagctaatgaccgtacatattgatcagatgaggtgtacgtgcacaaacacgaactcactgaaatctagtggccaaaaatattcgactgtgatgagcaacaaaatgtgacgccataaatttaggaaatccgaagaaaaaaaataaatatatgtatatagcagtatagttttgtgaaacaatatgaccataataactgtggttaagtgtaacacgtagaaactcctattgttttgtgcaacttgaacaaaaatatgtgtttttcttaaaaaaatactaaaaaaaagggaaaagcaaattcattttttgcttggttatgctactactatatatcccaggcagagctgcttaataatcactg

SEQ ID NO: 95411 - DNA, 691 bp, Oryza sativa
  unsure (1)..(691): unsure at all n locations
attgagaatcgtggttcgatcgtccgggtcaccggtcagaccggcggaccgctgaaccgagaggtcggccgggtcacccgccggtccggttttttatactatggttctgagttctaaaagctcctttggttgtctcgtacccatccacacatgctactgacgctacaagacttattatagtggagtacatcccatgccaagggaaaacaaaacccatactgacaccactcctacatctcacacactgccactagagctgtcactacccccacccccacgctgtagaacagtaatggtttcactcaggtagcggacgcggtggtacaggcgatgggtgaggcgctccagaaacataacttcattctcactagagcgaacaatagtcagcagttctgcacagagcttctcagcctccaccaccctaccacgcaagcgcgccacctgatggcgcagatgctgcacctgagggtaattgacatcccttatctcaatttggcgctctgctgctaaggcgtgtatagccatgagtgaagcagtttgctcagcttcagctactgtggtcttagctgcctcataataaaggtagggaacacgatcagcccgaccaaagttaacctgcacccctacaacatgcagtccagtggaactatatatatgcctnccagtaatagtcagtggaccaaagtcaaag

SEQ ID NO: 95412 - DNA, 675 bp, Oryza sativa
cacattaaaaatatccacatgtactgttcatgcttgtttatgtgctgttttggtgattttattcttttctgcttagattccgtcgtttccggagagtccgttttcgccggagaagagtttgaagaattccaaggccagcaaggcaagtcacacagatcccaaacaaccctttgagcatgttgatcctatttaaagctattgtttctattcaactattgcatttattttcgaatgtcattgggtggaattaacctattcattgttatagccccttttgttcttgtttaccttattccttgataccttgggttataataatttgactagttgagctttatatattggttcaactagatattagatataattgcttagccctgcttagaaacattagtacacttttgggataactaatgattcattattatttcatgatggcttaatgatagttcacgatggtcaatcgtgattagttaattaattaatgtgccaactaaaacctgataatggtgggttgtgggcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtgg

SEQ ID NO: 95413 - DNA, 732 bp, Oryza sativa
  unsure (1)..(732): unsure at all n locations
agagttanccatcgataccgatctcgtatatggcgaatcactgctcggatcccgaggatcctcttgagctccaccgcgtggcatgctcgcgagcatgttatcgctggagtgatgatagaggctgaacaagtaatgactctttccacttctgtgcttattacggaatgggggtcaaaaactaataaaatgtttacgacactcttatttgcttcggatgcgaccactgctactaaggcctagctaggggtgcttactcggctctggttgagagcatcatctgcatgtttatacaacattggcgcgtttcttatagttcttgacaagccggcatcctgatgctaccaccatccaaattcttaaatgtgtctttactaagagaacgaggtggcacgcctaatgacttacctgtgatgagtagtcctggtgtgcgaaatgttctaatgctttagctgcgtgaaataatagactgctaccacttgaccggttgctattacttgcatcattattaggctgggagcgctgatctgctcatactagaagtctgatatttggtctggtaccgcgcatctgcattattctcgaagctgatgctaaactggtaccacggtgccgctcagatcaaccgtgtgcttatttgtgtgggacccttgctccgccttattagaatggtcattctttgaccatggaccaacttccgccctctgtaataaaattatcatgttgacgggccac

SEQ ID NO: 95414 - DNA, 604 bp, Oryza sativa
aacttgctttccagcctctcttctatcttccttctgacgcctttcgatcttcttcactttcttggcagtcttagcacatattcagaaaattgcctgaagagccttcttgatgggagaagaactcgaggaactcggtggggcactagtagaaggaccagctgaagtacaaggaacagatcgagggaccactggggagaagaagaaggtggagcatgagggcgaaaaggattatggcgcccatctttgatgtagaacaccccagtgattgtctcaatcatcttctaatgaaaggagcatagatgcaactccgcttaggctcaagaatggtgttggcgatctcataccaaatcaacttcatcacactaaaaggaggtgattgtagcgcatgtgactgagaagatgagcatgcttggatggcaaagcagtagcatctccaacctttggaagcaaagaccaacaaaaatggagtacaacacctttttgttattggatgcaatccatgagtagatcccatgcaagtcctaagtgcatcctttgcatacatgaacttggttttgatcatggggaggggtgcttcactatgaatgttgggcctattgagatc

SEQ ID NO: 95415 - DNA, 537 bp, Oryza sativa
ccagcgcaaagccggcggtaacgaccagcaccgccgccaccagtggcgccagcgcgcgcagtgtgcgctgcgcagaacgcagtgcgacccacagcagcaacgcaatcgccacgaaccccgccaatgcgaggcgaatgtcctcacgcacgtagttgacgtagaggcggtcggcttccgccttcaggtcgacgaataatgcgccgggcaggttggcgtgctcgacagcagtgcgaatggctgcggcattcaagctgggtgggtttgcggtctgggtgcttgctttgtcgattgacggtgcgcgcagcggcagcatggcgctccactggccgtcgcgctccgtgagcagggcatcaacagccagtgccatcgatgtgccttgcaggtctgcgcggcgcagcagcggttgtgcgcgcgcggcgtccacgtcgccgatgaacggagtgaagagctctggcttcaagcgaatggactgatcttcaacggcggcgcgcatgcgctcggtcagtacatcggcggggggggtaccgagctcgaatt

SEQ ID NO: 95416 - DNA, 509 bp, Oryza sativa
cactcattctataacagcaacagcagcagcaaattcattctataacaatcatcaaaatcaggcaatcaggggcagcaggggcagcaattcatcaaaaaaaaaaaagaacaagtgtatataacaatcattctataacaggagttcattctataacatagggttatataacagcagcagcagcagcaattcatccagtgcatcaaaattcattcaaaatcatataatacaaagaagctaattcatctagtcctgcattcatccgaatcatacacatggatccaaaatcatccatcactgactcaaatcaatccattcatcaggaggaggaggggtggcggcgtacctggtcagggagaactggccgaggagaagaggtctgagaggcgatggcggcgctggtcgccggtcgtcctggatcccggcgttgtggatcccggtgttgtggatcccgatcgtcctggatcccggcgttgtggatcccggcgtcgtggcggccgacgtccgatgtc

SEQ ID NO: 95417 - DNA, 1665 bp, Oryza sativa
  unsure (1)..(1665): unsure at all n locations
tggcccctttgttgacctatcagttggnacagnacctcatcagcctttttctaagaagccaattgcttttagaaaggtatgttctgtacgtaaagacttccaaaataccgcgtgatagttttgtcacctccagtgattatgaatatatatataatggtcttgcacatgttcctggaattgcaatggaaataaagtagtttaggccctggtttagttcgcaagagtttttccaaaaatatcgtatcaattctttgacatatgcatagagcattaaatatagattaaaaaattaattacacagctaggaggaaactcacaagataaatcttttgagcctaattaggctgtgttcgggagcactccctagcacgcaaaacggagcaacgtttaacgcgtgattaaataagtattagctatttcctttttaaaaaatggatcaatatgattttttaagcaatttttgtatagaaactttttacaaaaaacacaccgtttagtagtttgaaaagcgtgcgcgcggaaaacgagaaaatagggttgggaacttcctctaccgaacaaagcattagtccataattagctataagtgctacagtacctcacatgtgctaatggcggattaaataggctcaaaagattcgtctcgcggttttcaggcgagttataaaaatagttttttcatccgtataaaaaaaacccttccgatatccgatcaaacatataatttttcttttcgcgaactaaacttaccctgatcgtgtgtctctgagcgtgtttgtttatgccgcatgttgctttcagaaatgtattagtcaaagtcaagagccaagacttttgcatcgtgtccttcatccctctacacggtgtcacctgcttgatggcaactctccgtgtcattgtttttatattgacatgcttgcaaagtcttctctttcgacaccgcgtggcaagatatatagcactgcgtggattgaataaataacagtaaatccattagtcctatatgccatatatatataagaaatgttttactcactccattttattttataagtttttactagtcacactttctaaattgatcaaatttacagataaatttattagcaacgtctataacactaaattattctaatcatattaacattaaatatatttaaataatatatatgtttactttatgttgaaaatattacgaatgttctaatttgccaacatcatataagtacaattcaacgtttggtagtttaataatccaacacacgtagcaagagcttgtggcgctacatactgaaaattttatagaaaattcgtcactgctcactgaaattgactagctctcattctgttataaatagagggccaactgtaagagcagaggcaaaggctagaaggcatagctctagacacacttaggccctgtttggcacagcttcagcttcagctccacccctactagagctggagctcagtcaaacagtttcagctccaccaaaactgggagtggagttgggtggagctctcttacaaaatgtactagagttgtggagcttggtttaggcaggtacacaactccacttcaaattaacctcctagaggttattaaggaagcggagttatcccaaaccaggcccttatatttagacttctgcggagttagcagcc

SEQ ID NO: 95418 - DNA, 1384 bp, Oryza sativa
ccggtccggctagtcgaggctagctggcaggtcgaggaggagttgacgcacaaagccgccgtccatccccaggccccgaagctcgtcgcgggcatcagagagaagaaccctaaccctaactagggttagggttatggcgatgcagcgaagaattgctcaaggtagcgaggacatgtcccaaggtagttcctttcgtgctcccgggcgccaactctctcgttttcttcttggtcccagtggacttcctcttgtgaagtgcccaagatgtgggaatgcagtagtggagtgcaaatcctggaggcaaggtggtcgagtgtttttcaaatgcgagaagaatgaacaatatgtaagtgaactctcttagtttgatttcagatgagatggttggaatttcagaatgcatagttaattttatttggtattgttgttttcataggttccagatgcttgcacgtttttcaagtggtatgatagttaccaaagaatggtggaaggaatggaattagatttcaatgaagaagttgcaaccccagttgcaatagcagcagcaggtgaggctgacaaggttgatgaagggaagatggataaactaactaagtggatgcaacttcttgtgttgatcaacatagggcaaggcatattagttctgatgggagtgtttgttttgcttatgaaatgatggatgtaataggaacgcagtgaagcaaacttgatgtgtttgttttgattttggtaataggaacgcagtgaagcaaactggaccggtttaatatatgtcaagtctttatggctatttgagaatgtggaaaaaatatgtggggttgcattgttatataatttgtgcagtgttttggctgtgtgttcaaaatatgggttactgcctatatagttaattcagtgtgtggcaaatgtgaatcaaacagcacaatgtcaggcaggcagtattttggcagcacaagcagcacaatcaggcagtatatagccagtggtacattcatgcagtaaatgatgcattgtaacaattccaggcattaaaacaattccaggctgtgtaaatgggcacaatgacataatatctccaacaacatagtcactgcaaatgcataggctgtcacatattgtcagataagtcttaaccaaaagccaagctaagctattacagattgtcattgcaaatgcataggctgctgttacatattagcagtggagacataagcagataagctgctaccaaaaggtaccaaacagtattagtactgaatacatagtgaagctgctaccaaaatacatccaaatgcccacatattacagaccaactaattcagttctttggtgtaagctttttccttggagatcttcttggtggttctggaaccattgtggg

SEQ ID NO: 95419 - DNA, 751 bp, Oryza sativa
catacattaaaatacggagagagtatatgattctgaatattgcaaaacaggacatgaagtatttagggatactactgtactcgaggaagaactaaaagttgatgaaaactaagttgtcattactgaggagtcaaaaaaaaaaaaactaacacttctctctttttcgttaaacaaaagctccagatatgataaatgacagtgtatgaagtcttttactctattttttcagacaaaaactcattctggcaaatgagtctattgtctgaaacaacctaaactcagattctctcttctgtgtttcctttttgagatacttcattttcttggtatatgcttagaatcaaggacagaatcctcaaattacaaaactattcccttttcctgtgacacgattttgcagtccacacgaacaggcccatctggatattggccgtttacaggccgtgtccttgaagaggccgtgctggcgcggcccggcccgttttggcacgaagcaatgaagcacgatgggccgtacggcccaagtcacttctgacagcagctggctatatatacaaaggtagccggaaacgcgtcttcccttttccgtttgagcggtcgagtcgcaaattccccatccaaaacaccactctcctcctccagtccagtaagcccctcttctcctcccttcccccaattccatccactgctctcaaatctcaatactactactgttctatcgaatcgattcgaaatccacaccgctactacg

SEQ ID NO: 95420 - DNA, 669 bp, Oryza sativa
gcagttaaatgtacttttggatgaaatatggttttaaccgattaaatttaatttgatttcttttagttgtctgcctcgaccgattaatttgagatatcaacttgagtgttaacatgttaccaaattacagaggataagtttgtgctaatcactgtccacataaatttttctatgattttatcttgcacaaaatattttagagaattaggatgacctttgtttgtatatgtgttcccacttcataattgcatctaatattattatagggattacattaaacttcttttagactgagaagatgatatttgagtttaatattaagtccacatgttatcacccaagattaactataagtttgtttagagaaataattcttttagattatgctcatgggacctattatggaatgcaagaccaaaactccaaatgcacaaagaactcgagcctaggcatgcattatgtacatgtatgcttggtgacatttctagtctaatgttgggaatgaaaagattttattctgttctcaaattataatcatgcaatggtttaagttggtcatcacctaaattaaaacggaaattttttgctctcaaaattggagaagttaacctctaactattttgacaagaaattttaagttctaaaatttcaggtacgttataggcaatt

SEQ ID NO: 95421 - DNA, 646 bp, Oryza sativa
aaaggaaggaggagaagaagagagcggccagtgaaggggaaagaagacttgggcctagcccaagggagggagggaagaagatttaattcgttttctttttatataaatgagtttaatgaactttgtgactttaaaattattttttgagctccaaaaattcatggaaattattttttgagctccaaaaattcatggaaaaatccggagggtattttagggcacaaagaatattacaaaatatcctcagccaatgatttttaaggaaaaattttaattctcccattatttcacttaattaaattgctttaactttaatttaatttctagaaaatgcattattaatgatttttaatcccgaacgaaaatcgggacgttacaccacgcaagccaggacacgactacacagttaccggtcgctagtttggttaaagcaacgaccactctatctcacatatgaatcctctttagctaaaaaaaacaatagtgcacatttttctaaacctctttgataacttttatcttttaaactgtatattattttaaaaatatatttgcaccattgtactccactcaaaatatatgacaaaacgagaccaacggttaatatattcaaacattttattaatttgcaagtaatttatattta

SEQ ID NO: 95422 - DNA, 587 bp, Oryza sativa
ttttgaatgaggaaagcacagggaatgttctttttacttgtcctttggctcattttgcttggaatgtaattgccatggtgttgaatttatttttggaatgtaactgtccctatctatctttctgggatggtatgagagctatcaaaacaaaaatgaaatctcaagtggggatggtagtgtttgctgggatgttgtggggtctatggataacaaggaatgagtgggtgtttgaaaacaaactaatcaaaactcctttgcatgttgtctgtcatgtctttgtccctgatgcaaagatggaggctgctactaaaagaaaaaactgcgctgatttccatgagaaagcatgctcattctggatggtttgccggcgcgcggttgacaatctgccagaagactttgggtagcttatgagagtttgggatggtttagttcccaaacaaaatttttcacatagtcacatcgaatatttgaacacatacataaagtattaaatgtaaaaaaaaatacaattacacagttcaccaggaaattgcgatatgaatctttaaagcctaattgcgtcattatttgataatgtggtgctaaag

SEQ ID NO: 95423 - DNA, 549 bp, Oryza sativa
taagcgaacataacaaatccatatatgagttgcagtattatttttttaacagaaatatgaatgaaggatcattttatttgataaatattattatgaataactaatgttatattaatattggcatgttcaatatatcctgtaactaatcttttttatttatacttagcagggacttgaagttaaataaggatgtttgaattggccgagatgagtaagttggtaaagaaaataaataagggatggttatgattactttaaaccacttagtttatattgctccaatggtttaccaacaatattgtcgctttctacaatatgccactggatttatcaattgtttctacaatatatgaacatttaaaaaaaaatcaaaatacccttgtagacaagcatccaaaggttgacaattgatttatctcattatacgtttaaaaaattatgaaatttttggtgtagtttccttacacaacatagaattttctctttatgtttcaaaatttcttgcatgtattttttgaaaagtctttttattggggcattagagagaaa

SEQ ID NO: 95424 - DNA, 1106 bp, Oryza sativa
attgtatatcgtgtcctttatctagataattgcataatcggtgaaggagtggattaggtgctaacatttctctgatcaaggcaagttttctcctcccatcctttgaacacattgaatcccatgatttgaggaatgaaaatatttgtttgcaaagttgcatgtgaacttagactatatcggtatttgaaactgggttaaggtagttatgacctatttgctgcataccccaccttgaataattgatcctcttgctgtttgaacacctagaaatggttagagtacactctttgtgctcaaatgggtttatatatgctctatgtgtaactacttgcttagccatgcttagaaatatgcaaatgctcattccatctataattaaaatgtgaattttgatacatgaacccttgctggaataaaatgaatatgatgggtatttgtgaactaaaatgtgtaaaatgtgattttatacttgggcggcaagtggtgtgcatatggtgttagttgcataccaatagggggagtgtttgcccaaatccataaggaccgaacttgtgtcacccatttaaagttatccgtacatccacatgtgctagtatgggatggcctaagctgattaatctatttaggactagccttgcattctggtaggccggtgtgtatgagttagtcgataattctgaggaattagttgatgattcagaggaacttcctatttgccccgatgtggtagtttaggtgactaagtctgtccaatacaacagtattgtgccacgtggtgggttcccgtcgtgtccgccaccacggcgttaagtttaaggcgtgggcccgccacttaacggttctaggtatattccaagtatgcctaggatggaggaacacgtatcgtgctggtgcaaggctaggctctaagtagtgtaaaggcttcgttatgacctctagatcacattcaacatgaagagtgtggtggagtcttgcaaactcaaaacaaactagagagttcatatcatgtgggtaaagctgtacaaactctgcagagttctttaaactaatcgattacccgtgctcacggtcatgagcgctttggtgatgtgtcatgagtatagact

SEQ ID NO: 95425 - DNA, 1086 bp, Oryza sativa
aaggtcgttttgggacgtgacaccgggggccggtctgaccgaggcttcaccgccggtctgaccggtggtcgatctgaccgaggctgttcagccggtccgaccggtcgccgatctgaccgcgggacccactgcggtctgaccggtttcctcgagggaaaaccagatttttgccactttgattttgcaaaagcaatctctctctcctttttctgtttatgagctaatctgaaacaaaaatcaacaatatgtccatctttaccacaaaaagaacaagtatatttttcacgttgtttagacacattgttagcattagaagatttagcaacacaagcagcaacaggaggttttgcatgcacaacattggattttgaagaagatgcattcatggtagacatgataccagcagatttaaacacaattttattagtatcatgtttaatcaaaatctcaccacttctagcaccaacacctaacacaacaggaggatgtctagaattatgagcataaggatcaaaacctaaaccaaggttatgtgtgctaaccttagattgatccaaaatcatgttgaggttctttttaccatcacaaaatctttgcaaagaatttttccaaataagaaacctatttttccaaattagcacaattttcacaatctaccatgacacctttgcttctacgacatttggggcaagaaaaccacttcattgtttttcacaacatcttttatgtactcaacacgacctaaagcatcttttagtttcatcttattcaaattacatgctgagcaatccaaaacatcatgaggttgtttcaactttttagcagaaatcatgttaaacatcaaactagcatgaaaagcaatttgatatttttgcaacaactttttagttaaaatcaactcatccaatgtgcgtgtacgcaaggcaaaactcaagcaagagaagatctatttttcaaatcatgtgcagcattaatatctctaatttttgaaatctcattcattaaaacctcacaatttgagcaatcatcatcattacgaataagagattttaatctagcaacttcagatttaacagattcaatgat

SEQ ID NO: 95426 - DNA, 1544 bp, Oryza sativa
caactatggtgcaccttggaaggaatttcttcttttacgttttgtcattcctggtggaggccattctgtactggttatgatcatcttacggacttcatcttcggttcgcattggtgcttttcttttctgctgaagacagttccttgcatagtgcccttgttcatcacacataaaaccaatgatacttgcttcttttgagtcaacatgtgacatggcatgaagggccttctgggatgttggcggtgcgctgactttgggtgtgagtgcttggattgcctccaactgcgcctgaggttgcatcttgactcggttcagaattggcatccgatgctgctgtagtatctctataagcaatttgttctggttaatcaagtgttggaccactgccacacaattggtgtctggtgctttattcactcgggagcttgaggtacccatttcctgacttctgacctaattgcctttctcattatccgccatctgttgcaggttttggagagggagagaggaaaaacaaaggggagagacagatcagaaactaaggataggaccttaacagagcaacactttttctgttgtgatgtatgttaggcttattctgccagttgattacgccaacaacctagcatggttacatcacaccccactgatgcaaaccacgcgctaccccccagagcaagggaacacccgactaacgaaaccctagaagtggcttaagttttgcgacgggtttttcaagattttcactcctggttcacatttgggttcaatgcttcccttggtttggtaacagatccaacagtcttgcggagcttcggcagacaattgacgacatcttctttttcgcaaagctgaccacctagtactagttgaaattcgaaggaggaagaagggagtaaaccttttgcaaatagcattaggcaaaggagaaaaaaaaggaactttcgcaaatagttttatttataaaatatgtccttaggttttatccacttggcttaacctacagtcaaccaggctctgataccagcttgtcgcgcccggaaaaatacctttttccagaacgctagtgtattaatccccgtcccaggaaaagccggggtacaccacacaaacatgatataaaagacacatctttattatatcgctaatatttacattattacaaaggcacttcaggcctgacaatcaaaaataaatagcagcggactagcgggcctacggctccatcttcacaggcgctcaactgaggtataagctaggactccacaaaagacttctcccaagcttctcttactgaagggggaaagatagagcaagaatgagtacaaccacagtactcagcaagtcacaccggtagatgcatgattaatgcaagagggtacaaggggtaataataatagggttgggtcttgcagtaaagagcgtttaaaaaccacttagttgctcaaagctattttgtaaacatgatcctagagctacacaatattattaatcaagcccgtggaccctcacgaacctgccttaacccaaggcatacgatgatt

SEQ ID NO: 95427 - DNA, 539 bp, Oryza sativa
gggcgaattcgagctcggtacccctatcccataatataagagattttggattgatgtgacacatcctagtagttcagattcattatattatgatgtgtcacatccacctaaaatctcttatattatgggacagagagagtatttctttcgagccataatttgctaatggaactggcaaatgatcaaagaaacatgaaatattttgtattttttattaatcatgtctcattcacattaaagtttttattatccagaactactgattaccattgttgaaccaaaataaccatcattttattgatgtatttccaggatccagctgcatcatgattttagtttctacatggcacgttagggaatgtataccagactacactttgttgtgtggaagttagtctactgattcaataccactgtccactggctcaccctgtgcaaggttgtttctgctatggatggattgtcctattcggacaaggcacccttcgcttgttgattttttataatattcatagagataattagctttgaaatttcat

SEQ ID NO: 95428 - DNA, 1456 bp, Oryza sativa
cagagtgtgggtaaagtgtacatccactgcagtgtgagtaaaccaaatctattcgaatagccgtgcttgcggttattgagcatcgggacatgtattacacttggctagactttaaattcttaacttgtgtgggatgggttattgcatgatgaatttttatggtggacgtcctcagaaaaccatgacgactcaatggcgggaagctatccttgggatcacaatggatggtggacagaaccgtcgttgtttaaatacaaacactggtactaaaatttgatcagtcaatgctaggtcttaggcttgtgaaaagaattacaaaatttgctttgcgcaaaagaaccatagccatcctttgaaatacccctatcatatgcattgttgatgtggtggcttgctgagtacggttggtactcacccttgcaaatataaacttaatcagaggcgggacttgaagcttcggaggatccctatgcctattaccaggagggtgatgaagacgatggcgctcagtaggacttagtacggtcgttgcctgtggcattggcgtgccgctgtcttatttccgctgctttatctatttctgcttttgggatgtattccggaccgcccggtccgatgatttaagataatgcctgcgggcttatgttgtaataattcgcactagactctcgtgtatgtgcatttggtatttcagctatgaactcgtgtgtaccagactacttgatccagggaaatggtactgtttacacgattgattcctgttataaaaatgggggtccacatcactggagttggagctgttgcaacgcgggctataggaatgcttcgggatgcatggatgacaattcgctgaggagcaagcttctgattgtggggagttgcgtggactgacgtgctggtagctatgtttctcggttttgggcacttgtcagtgaaatgacacatttcttgacaattgaagcaacagatatctttccggactcagtattttcttttctcattttgattcctctgtcctggcactggagttaggctgaaactgtaatcttggcgaggattggtgttgccttgatgcttctctccattagaacgggcatgttggttggccatcttcttcgtcagcagaaaactgagttgacaatcttttggtacatgatcagttccttcacacaagaaacaagtgatcctgctcatggggcactcgccgggtggatggtcttccttacaatgaaagcaggtagtggcacatgagctggcaacatgacgatttctccacaatgagagcatgccttatgttccattttattctggttgaacccttggggagacttctcatttcatcatctgaggagacttgatctgaatcttcactatcagacactctacctccattagctaaaagatgctctgtcaactatggtgcacctcggaaggaatttcttctctgacgttttgt

SEQ ID NO: 95429 - DNA, 1205 bp, Oryza sativa
ctcgggagcatgttacatgcgtcatcctttaagggtgtccaaggcatattttttggcctaggcctaatatgtctacagcccatattttcaggtgtggcctgtcatgttcttttagggacttaggcattttttgcttaggccaaagtgcgtgtgatcaagtgcccaataccttaaaatccttttataccgcagttactcaactttttaggagttggtacaatgcatcttaaaaggtgtcaaacagtaaagctttatatagctgccctgctgatttttttatatagtcaaggtgttgtttgggattatcaagcaattgattggatacaatatcattgctttttgccacataagtgtgcacttttattgaccaatattatggtttaggctgattatatattatggtcattttttaggcggttggtaaatcctttatgagtttacttactcggatgttataccacatatgccatatatttccaggtgtggtgaaaccatgtgtcttttagggacttaagcacatctgttaaagcagtgtgcgcatggcgtatgcccaatactttggaaatttcattattcacagcattcaagcttctttatagttgttttgctatgtgaattttcagagatgttgtcaaccttaggttgtacgcatcatatttttcaagcagtcggtatatcacttggatcgtattatttggggattcacaccgcatatgctatatattagtatcaagtcacttggttgactataattatcaaaaaccattcggttaattggataatttattccttgactatatgtttagtttgttcagctaatcacatagtcgggggctacacctattaggtgcatctatttgatgcacctgactttacttttttcagccctccacagtcttctgatttggaaaaagtactcgggagatcatggcgaagatgattgaagcactcggctttggagtaatctagttcgagagaagattttcttttcgactgtgaaggtctcaggggctactatggagattatgggtaccccatacccacacggcatggttatccgactagtcataggggatagcttatatctatggaatatgtaacagattatgacttgggtattacggttccttttatattatggagcggcctaaaatcctgatttgataatattggaaaatagaattaggaaaccgatatcgtattgg

SEQ ID NO: 95430 - DNA, 1028 bp, Oryza sativa
attgcatacatttggtcaaggtttcaaaggagatgttattacataaaataataggggaatttacaagattgtggctaactagtccagcagaggctatagaaggatttaaacactaatgttttattatagacttaaaccatttatctaatctatacttgagaactaagttagaatgagactaacttatatgattgaactcccagcttcggtaagaacatcaattggactctgaaaaaggggttgaagcaagggtgagtacaacgtactcagcaaactattatattcaataatgaatgcatgaaatggtaatatctgagtagatctaggtttactggcagaaagcaaagaatatagaggaagaaagcctagaatgttttaaatgcaacagtatttaataaagtttggaattaagtttctaaccaaataccatatgagtcccaatgctcaaatctgtgagcacggctattcgaatagattcatttatactttactgtagtaaatgtacgctttacccgcaatccatgacatgctaatattcatcagcttagtcatggcaaagcttttcagttactaacattagtggtacctgttccatgaactgtagtcatcatacgctctaaacgtaacgttatcagcagcgaaaggagttctggcgttcccgaggtttttggagagaactagttgagagacccccgtcatctcaacaaggttttcacaatacacacagtttgtgatatcacaatttatctcaaatatttacctgcgcctcggtaaatattacaatcgccctgctcggcgtaagtttgcctcctgcacgaggacttaagaagaacccaatacagaggtaccacctttgctagataacttaatcagctaggtctatgcccatacgagaattgcggtcgtactcgtatgttcttcacatgtacttggcaattttatgtcggttggaacagtactagccacccggaaatcaaccatttcttccgtattgttccaatctaagtttattatattttatgcaatat

SEQ ID NO: 95431 - DNA, 528 bp, Oryza sativa
ttctaaaattcataactcccaaatggaataaaataaaatagggaattatttcacctaaattcattttagatcagtaccaacccactgtgcacaaatcatgcattttagagcattttggattttcagctcttcggtgtttaattgtatatcgtgtcctttatctagataattgcataatcggtgaaggagtggattaggtgctaacatttctctgatcaaggcaagttttctcctcccatcctttgaacacattgaatcccatgatttgaggaatgaaaatatttgtttgcaaagttgcatgtgaacttagactatatcggtatttgaaactgggttaaggtagttatgacctatttgctgcataccccaccttgaataattgatcctcttgctgtttgaacacctagaaatggttagagtacactctttgtgctcaaatgggtttatatatgctctatgtgtaactacttgcttagccatgcttagaaatatgcaaatgctcattccatctataattaaaatgtgaat

SEQ ID NO: 95432 - DNA, 713 bp, Oryza sativa
ctataggcgaattcgagctcggtacccatgctttagactatgatatcccgcttactaagaataccatgattgacaacttgccacaaactgtctcatattagctttcctggtctccggtgctagatatttcctctattcaatgcgagggtcgataattttgcctttgaattatgtttccaagggaaccaacttatcccacttgacatgctttgacgtcttcccaaatgactttactgctgaacttattattgtctgatcgttatcctgccaaatctgaagcttcgttgttggatgtgattttaatctgacctctgtagattttccttgaacatatcacttgtttcataactgggaatggctctcatgaacaagcaactcagattcactttctttacattcggtttactttccagtattctcttcgtgttgtcatcatttagcattcaacgtattcctttacaccttcagccttgatgtgttctttcccgatggatcgattgctaagaaagtgcgttgaacgacacttctaacggtatgttgctacggatcttacaaataatatgcagtctaaaacatataagttatcaaagattttgtaccaaaaataaaatgtattagtgtaatggtattaacctcatagcatgcatgccaatcgacatgacatgtagcaaatagcatatggcctttttttcttgcaagtgggcttggttttc

SEQ ID NO: 95433 - DNA, 501 bp, Oryza sativa
ataattaaaactcaattaatcacaagttattaccacattgttttacgtaaaacacttaatcttcatttttatcttcatcttcatcttcaggagactcaaacagagcctaagtcttactagaacgatcttggagaactttagttaacctcaataggacttaaaatgaattttctatgagttcctaaaaatttgatttcttaaagaaccacttatacaaaaatagatactagagcttataaaaatatttactagtacaaagttgtagatctagttatgctctacaattttaatatagaatgtcttcatccaagatcatttgaaatactcaaaagttcattttcaaaaataggtctgaagagtttgtaacgaatatttagacatctaaatgtactatttaaaatggaaagaaaactttcaatgtagatttcatgaagagctaccattttataggcggttttttaagaatttgcccattaaaaaatagggtttcaaaaaagggtt

SEQ ID NO: 95434 - DNA, 617 bp, Oryza sativa
attaacttttaatcgctgtttgacttcctggtgtttggttgtttttcacatgctggttgagatcaagacgtgttcattatcatcgtcatccactcctgcctaaccgttaccgagagcttttccccttcctcccacgcggatggccctgccattagttgggcagaggaaagcccgggcatcaggagcaaacacacgcatgtgctgattcagttgacatgccaccgactagaaccttgcatggacgaccaacgtgcacacaggagcatgcaggccatgcatggagggagcaaataaattaacttgcttacttgctctcataaccaactacatatatgcattaatttctctgctaatcagattgatttgtttacatacatgtgttatcggagctgtcgtattgcgttgtggtatcggacttttctgagttaagaccacgcgcgaagcctccgactgggatttgatccagactcgggtccgcgatctgtacacacgcatggcaggaggatggatccaatgacatgcacgcatccaggaagaccaataatcttgccgagttcaacaatttaatctccgacttcgctgggtttttttcccttacgacttattgtttttttcat

SEQ ID NO: 95435 - DNA, 683 bp, Oryza sativa
ctatagggcgaattcgagctcggtaccccggttatgggcaagcctagcaatgtacccaagttagtgttttaaattcttaaagcctgcttaacaactaaaatgtggaatggttggcgtgggttggcttgggacgagctgggacccagggtcgggttgccagttcggtctgaatcatcgtaggccttgggttaaggcaggttcgtgtgggtccatggccttgattaataatattgtatagctctaggatcgtgtttacaaagtagctttgagcaacaaagtgacttttaatgctgtttactgcaaaccctaatcccctatattataactcccttgtactcctttgcatttattctgcactcgtgggtgtgtcttgttgagtacggtggttgtactcagtcttgctcaatttttcccaaacccagaagaggtgttcctggatgatgaaggctttggtgtctagctcgtgcctggcatcaagcgcatgtggtcgtcgccctagtctttcgctgtttctcgtttggcttcatgtgtgctgggccttcgcctgccatgtaataaattaactatttacgctttcgcttgtaaactctgaaatgatcaacttttggtgtaccttgcttctgggacaaggattaatacacgcatgtaagggaacgcccgttgggttaatttcggtcgtgaca

SEQ ID NO: 95436 - DNA, 706 bp, Oryza sativa
atggttggcctgggttggcttgggacgagctgggacccagggtcgggttgccagtttggtctgaatcatcgtaggccttgggttaaggcaggttcgtgtgggttcacggccttgataaataatattgtatagttctagaatcgtgtttacaaaatagctttgggcaactaaatatctttaaatgctgtttactgcaaccctaaccctttatattataactcctttgtactcccttgcatttattctgcacttgtgggtgtgtcttgttgagtacggtggtggtactcagtcttgctcaatttttcccaaacctagaagaggagttcctggaggatgaaggctttggtgtctagctcgtgcatgccatcaagtgcctgtggtcgtcgccctagtcttccgctgtttctcgtttgtctttgcgtgtgctgggccttcgctgcccatgtaataaattaactatttacgcttccgcttgttaaactctgaattgtatcaacttttggtgtaccttgcctcctgggacaaggattaatgcacgcacgtaaggaacgcccgttgggttatttccggtcgtgacactgggattcaatatgctcaaagatgatgtgacttgccttgctcgctttcccaaacgtcggcttcaacttccacgaagagcggatcttccgaagctatagcgtctacacgaccaacggaaaagaaaagg

SEQ ID NO: 95437 - DNA, 593 bp, Oryza sativa
aatgattagttttagataagctaacctttagaaattcatgtagaacccaatttagcttcaatttgaataaacttaagttctgtaggatcactaaaacatgtatttccaagttatgaaataagattatatacttgctgtgtagtaaaagtctctaaatattcatataaggatttactaacatagagtagcctttaatttgtaaaacttgtagaaaatttatttttagtccaaatgaaatgaagtttctatagaaccagcaaatagttatcttgaacatagtaaaataaaatttggcaccttttgtagagaacatagatcaaaaccttaacttagtgaaataagaatttaaacacatagtgttgtttaagtaatacataaacatgtataagaataaaaacatgaatgaccagtgaagccatagttccattcccatccactaaaattagaagaacttagctcatataacaatttctaggttaatataatatatttctagtttagattagagcatctctagtttataaaatatgaaccatactagtaaagaccataaacatgtgaactaaaaatgttttagataaccaaattattcc

SEQ ID NO: 95438 - DNA, 562 bp, Oryza sativa
  unsure (1)..(562): unsure at all n locations
tgaaacttctctgttcttcactctgctctgaatttctcctctcagttccttgtcactgttgctgtgttgtgccgtgccggacgcgtgcagtctgcgcgcaaggtgttcgatcagggaaatcttcgccaacacnnnnnnnnnnnnnnnnnnnncaatcctagcaattagcaaactctattgcccctcctccttactatgtgtggatgagtgaagaagaagcagaggccatgcatggtttatataggcgccagcatgcatagcatcatgtagatcgataaaggctacctgggagtgagctgagatcagctaattatattacatcatgattagaaatttgcgccgaatttgcaggttcaaaattaatgccgtaagtttgattttatcaggcagtaccgatcgattaagagtagtgcactgtgaacgtgcacactgcatgcagtgttcacccttgatgctcttgcttccaattggtggtgttaaacaagcaaaagttatgctttaatcgagtagtactcctacagtacacagtgctactagtccgttttattaaaaaggaggatag

SEQ ID NO: 95439 - DNA, 528 bp, Oryza sativa
atagacagagagcttttctcctcgtcttcccttccgactccggcagggcagacgccgcgcctgcaccggcaaggcaaaacccccccccatccctgcatgcaaaccagcataaatatgtgtcatttttctattagtatctgcatccaaaaatatactgcctctgtttttgttttcctatacatgacgtgattgattttttaagatatatttgactattcatctcattaaaaaattatataattatcattctgtattttttgtgacttgatttatcgtcaaatgttttttaagcatgaattaaatatttttatatttacatacaaattttaaataagaataatggtcaaacgcttatcaaaaagttaatggttcatatattaaaaactggaggtaataatataatactcttaatttatagtatagcatgaaacgtattctaatatccaaaaattgatatacaacttatttagattcgtaataataagttatacttcctccgtttcataatgtaagtcattttagcatttc

SEQ ID NO: 95440 - DNA, 702 bp, Oryza sativa
tacaacacatttaatttgtttcggctcataatatggtctggttgtcatattttagtaaaaaagaaaaggaaacccatatgcacaatggtacaatgcttatatttgccaattatagtgatattcatctctaaatatttataacagaaccaacaaaaattaacattcatagatgagaaatggccataggcctcaaaagtatagaagttattttttaaaatcaattagctgatgagggaatataagcctacgggcatttctcatctatgaatgttaatttctattggatctgtaataagtaattacatattgtttttttacaatctcatacttcgtatacccaatcaatatatataagttgtaatctagattctgatcgaccgcacaatcaaagaagaattttctctgtcctcttttttttttccatgtctccttctgccaaaaaccccttaattatgtttcctgctttgtcaattaatctcaaatgttcaaaatctttatctgtcagtactttgtgctgcacatatgtactaagtgcatatatacatgcagacaataaattacctttaaatttgcatgtgttaagcgatcatatattcaaaggatccaatccaataacaatccaatgcatttgcaaagtatatactgcagatacgatgtacggctcattgtagtactcctgatcaattaatcatctctcagact

SEQ ID NO: 95441 - DNA, 1700 bp, Oryza sativa
ttcatattgatgttgatgaatttagatagatatatatgtgtagattcattaatatcaatatggatacgggaaatgctagaatgatttgcgttgtgaaacggagggagtatttcgtattgtggattgagatattttagaatgcagggagtacaatcttgcgacgaccgaatgtgtgccagcttgttaataattgcgtgattaaactagtaaacatataatccggtcaggggtcgcgcatctgctagcttgtctgtgcatgatgcttaattgccgtttgctttagttcgatcgtctccacatcgtgctgagagagaattatatcaatccaaagaaaattaagagattgtttaattatatgcatgttgttgtttgttgttgggtgttgttttgctgtcttaatctgattgcacgtgaaagcccaaacggtcggtttaggtggatattccattcccttacttttatattattccaagtcgtaattatttatagggttcgatccggcttttcttctttgttgtttcatgttactcgcttaaaaaagacatccgtgccataagtaagctttaagatacaacatgactataaatagtggatcgagtggacgagggagatgtcggcccttgacaaccaactttttctagctagctaccttttttagtaacttaatattttattttaaaaaaatggtaaaagtttaacctcgtatatattgatagagattaacttccgaggcatcaagacaacacctatgttggtatttgatacggtcacagataaattcgcaagcataagaatattgttgtagcatttcaccttagagtattataggtttatttaatcacaaggaatgtgtgtgtatattatttaagaacataatccaatcaagaacaacatctaatgctaaacttatgttagataggattcttatggtttaattaattagacttaagttaaaggtaaaaccttatcgattacttcgggcaccgattctcctctggtctacgaagctgagacggccctgtagctctatggtgtacccggacgtggaaagatacaaaaggcgcatatggctgtcaccgtctgctgtctacctcaatttccgtggagcacacaacaaatgaagataaccgctaacctagacatcacgtctaagttattgattactactctagcttcgcgcaggaacttccttctttatccagagtcctagtactggagtacttaatataaatactaagcgatgaactcgcaacggtgagaatatatctcactcaagtaagtaatttaaataccaaaaggaaatctcaaacacttactttattaaagaagcattcgctgagctacaagagaggaagagagtaccgatagcttcggaattcctccaggccttcccctcactctctacctattttctccacactactaagggatgcctaaagtatgagaagtgacttgtactccactttgttgtgtattgtgaaatggcttgagctcctccttttttgggccatataacggttggaattacggttgtggaggtcggtgcatccacaaccatcattgggaggtgatcttgcccgttcacgtggaaggtggagatgaggtggggctatggtggttcggccaaacccctggttcagcagacctgtgggccccaactctctccaccaccttcttcaggagctaacatgtgggcctct

SEQ ID NO: 95442 - DNA, 519 bp, Oryza sativa
tcaattatgatgcaggagcttgttggcttggtaatcttacggtggctatgatgggaaggatgcatgagacgtacagataaaagaagtttttgcatggtgtgcagggctacggactaatctacaggcgacagagcggcactagtgcattagcactcggattagtgcatgtcgcgggcgtggtgggcagacgtggtggtgcaaggtgctaagatcaggagtgggccaagagaagaggctgatggtgcggatagatgttggagcgagatgaacacggagactggtaggagggactccgaacccgagtccatgatttttgccagccgagtcagtgtctgtgatggatgccgaggccgtggaaaagcaacaacacctagacattagcacttcggggagcccttcgatcaattgtggccaagctatcagtgcaaaaggtgcagctcgggtgtaggtgtgtgacaacaagcgtgcgtgaagaacgtcccgggcaacagcgggtgaaaatcgtttggcagtacagaa

SEQ ID NO: 95443 - DNA, 518 bp, Oryza sativa
aaaacgtactagccttaattaattagacaatgtcgtctcaaatgaaaccacagttcaaattaaagaatgaccaatcttcatacagtgataataatcaaggctcaaagcccactcggcctttagaaaagagaaaactccttttttgcaatttaaagaacttccaaataaacttttgtgaggcaaggaagtttatattaagaatcatatcaaaaatgtttcctttgattattgctagatcataaagtttaggaaatcacaacattagtatgtcccgaccttgcacattccataaagcgtcccaacaacaaaaaaaaccccaccaattcaaccatcatccagcaaatcattgtttaaaaacattctggaattttaaatgtatgtaaactacaacgagcaaagagtttccttaaaacattccaacaataaaaacccaccagttcaaccatcatccaggaaatcattgtttaaaatattctcacattttaaatgtatgtaagctcaaacgagcaaaggatttc

SEQ ID NO: 95444 - DNA, 2160 bp, Oryza sativa
ggggagagactgaggcggccgggcgaggcagggcgccagctcggttgattttttagtcccggttggtgtaaacaaccgggactaaagataccaaccggaactaaaaaagaattggggtctaactcggtccgataactttttgaaccgggactaaaaatgatctttagtcccggttggtgttaccaaccggggctaaagatcaaaaagtttttaaccaggactaaaaataatctttagtcccggttcctattcgaatcgggactattgtggattttgggcgaccgagcaaagatgatttctccaccagtgtgtttgcattcaaaattaataaaagtatgagactaaattcagtgcacccggaattttggccttcctgaaattcaaaaccctagtgacatataatagtactacaaagcaatgactcgcttcacaaagagcttacaaattcatgggatcaaatctcttaaatgcaagagagaagtgaatactcaataatactgaatgtaacatccatattatcgatcaaataacaagcgcgacggtaggggataaatcagatgatactacagttgcctactgatttaattgcactaatttgatttaattgcattacttaccactaataataaattagtggagtagtagatattgcaaagctctaagggaattttgcacaatatagaaaatcaaacaactaacaaaggttaacccacgacaatgtctaaaagggaagaaaacaaacttgcatgataatatattgtagaacctgtgtctctcatcaatggcggcaaaccatagaattttctcttaattaattatatatgtacaatgttgaacaaaataatattgaaggtccattaactaacttgttagagtttcataattctagacaaagtatggtgttgcatgctatttttttaaaaaaataatccaatttcagggatgataatagtctttaacacggcaaattgcaacattaattgtaggcaaattcctgagaaaaggcacatcatattcaagagttgtcaatgcatatatctcttaaatgagggaaatttttagataagagaaaaatgaaatatatgtcatcttcggtctctatacaaacacacccactaaaagttcaggaaagaaaatgtgtgtcagctagctagtagatatagacggttatgatcgagtgcatgaaatgatttcttaattaattaatataatttcaatttccctttgaaataaaccctctgattaatttccagcttcttcaggattacactcattatattgtataataagttcttctcccattcggaaaattgcattcaagcaggttggccaaatatatattctgcagaatataaaaggagtaggccggctcggcgtacaaacaaattgtatcagtcaccccggccgttgttgtaacatttgcatggaaagccccaaaagagaacagcaaaaggggaaacactgtgccaaaaccaagggaaggaatgtcccccaggccaagctgcaagagctactagcatgcatgaacataattatattattatatattcggattaattgcacactcccccaactcggtcactcactgccacctggggcccacaccaccatagtctcccttatgggcccactgccatagtctccaaaggctctctggtcactggtctcctctccatctgtgcaaagtgcctttggagtttggagtgctcacatacattcataggacattgttcttgctacattctctctctctctgatattctctctgtgagatattctcatgtgcagagaggatgcagctgctagctgtgatggatagctagggaggcagtgcaaactcgggagaacggaaagaaagataaacaaggtgatcgaggtagctagcaagctagagagagaggatatatagaatgcattgcgatgctcaaaagccataacacgctcgccacaaaacgcaatgatgcggttctctgctctccatgctccctctgatggtgtagattaatgtatataaacctctaatctttatttatctagttaaatcctttcttgatcaatgcatgcatagtgtaaagcccaatgcatgtatgggacatgcagatcaaatgtcgaatgtttaaattgatcttcatatatatcttatcaagattttagctgtaa

SEQ ID NO: 95445 - DNA, 617 bp, Oryza sativa
ttgtattaatctacatttatgaagattgattttacatttaagaaaaaaatgatctataccatcaaaatttaccttcagatttataacactaaaagtttgtggtacattttaataccaccaaaattttacttccatctccccgcccaattttccttttcttttggtgcgatgttcaatactttgtctccaatcacttcaaggtgatggatttgtaccagtatagggaaatgggcatggctagcgaggaataatgcatgctttctccagtcacttgttttgatcatacgaatgatgataccttatcactaagtcatacagatcactatgatagtttgtcttagggtgatcttgcagagcaccttgtgtcttcacatagtgattctgcatatcacagcttttgtacgatcactatatttatctgaatagtgatcatcaacgacttgtcccagtattataatttacattgttaatcaatacttcctccgtcccaaaatatagctacctagcacaggatgggacattatctagtactatgaatctggagagcctgtccagattcatagtactaggtaatgtcccattctatactaggtagctacattttggatcggaggaag

SEQ ID NO: 95446 - DNA, 648 bp, Oryza sativa
actgatcgccctgagtgattaaggtcgatcgctcgcccagtagcattcgtggccacggacgattgaaacaccaagcaaccaatcgtcaaaatcaatttattaatccaaaccctctatattctacatatatctccctccttcttgctacctatctcaaattttattatcctcaaatcctcaattgcttggcatctgtcgtttccacggtattagaagatgccctagcttgcctgccgagcttaggataaaccaacgttcgttcaccctggcaggtgggtgttcgttgggcgcaagttgcacataacgtgctaagatgtggtgttgtgattctacgtcaacatgaacaatcttaaaaatacataaagagattacattacgtagaacacataccgcattacatatgcgaataaatagagacaacgacacacaggagcactctgaaacgcgcattatttttcacctgaaaggcaatgcttatgcactgactccaagtctccaacacatatatcgaccgatcgatctcacacacagtcacactcctctcacatctcacaacttttatttattcttcacgaacaagctgacctgcgtgtgccgccgctggcgcggcgtcgagcgcgcgtcccgccgcgccgccagggggctgca

SEQ ID NO: 95447 - DNA, 647 bp, Oryza sativa
aaatttttttgctgggctcaaaacccatcttaaatagaaatattcaaacattttgataggactaataaaatgaatatatctaaaatttcaaacagaatctaacaaaaaaaaatggacatttcatagtaaacacatctattgtttcgacacaaaattttattattaattaaaaactacacggtttaaagtaattttagttcagaatttatatgttgcaagggtaattagaagaaaaatcataaccatcattcaaagtacattaagtaagttcaattttagtttaggataaagtaaaagaatatttttgatagaaagccacccacacatggacatccgtaataaagtttcatgcatattaaataagatgcccgcgcatatgcgcgggctacctttctagttttgtaaaaaaatatcgtaacagtttgcattacatttgagaaagaaaatacacatatcattcccttgagggatcgattaatggctagaactcatcttccttcggcagacacgcatggattgcgtaaaaaaaacttcaaaaccatttgctaggagtagatccatacatgtgggtgatagtactgaggaccttgtggcgttgtgcgtctgccagctcattgatttaggctagggagatgtgaacaccacaa

SEQ ID NO: 95448 - DNA, 537 bp, Oryza sativa
tcattgggctgtcagccattgattgatatgcgaatcggttccaatttgtgtgaggctcaagccacaccaattcactaatatgtagataaatgctactaatttagcaagccatgttgggcttatgatcatctaccttctacaaccattattttccttttttttctcttcaaccattgtacctaggtatgtgatctgtaatcagatgttaatcgttaagtatcagttgttagagctagggacttcatgttgtctccacgtagctagtagtactagattatgcttgtgtatttgaatttgctggtgcattcatcatgcatgtatatatataagctctggaattccttgtagttaactggatgttaagctgagaatgtataagctctagattatcagtttaccactccatgcgtgatgaaacgtgctactgcttactctgttcccaaatataaataacttgaaattgtttaccaaagatcaaggtttgaaaagaaaatgataaagtgtatcttattaaggccgagtttagttacaaacttt

SEQ ID NO: 95449 - DNA, 645 bp, Oryza sativa
attttgtacaagggagaaatcgaacttgaggggtctaattaaccaaccgagctactccctccgtttaatatacgtatatacatatacacgtatatacacatatacgtatatacacgtatatgtatatatacgtatatacacacacacacacatatatatatatatatatatatatatatatatatatatatatatatatatatatatatatatatgtgtgtgtgtgtatatacgtatatatacatatatatatatatatatatatatatatatatgtatgtatatgcgtgtgtggacaatgctaaaaagttttataatatgaaacggatgaagcccctatagttttctagcattgtgtagtatacgaatgcacaattatatccataaaaatgatattagatattcgtcgcgacaaaaataaagacataatatcggtttaccatttatcacgatatatctaaattccacttgatcccttttatggataaaatgtggataacaattactaccagcagtatatcctactatagggcactggacaccaaaataccctcacccaatagttacaaacgcatattttgccgttagttaattattatccgggaaaaaagattagtagtaatccaaaatttcccaaccccaacc

SEQ ID NO: 95450 - DNA, 578 bp, Oryza sativa
gctataacatcatgatctaaatataattagcatactatgacaccgataagcacgttctgacaccaacaaatcgattttctggatccgccactgcttcagcctatacgttttccttgaacatttgatcagctcctccaccactgggctctcgtttccacatgtgcttgaccagccgaaaggcgagactgtctttggcagtttcagcgttgcaaaaacacaaatgtttcagtttcagaaacgaacccaatcgatcccccctactactgcagttgctcacacacccacaccccgactgcacacgtcgcctcgcctcgtctgcgtctgcgtctgcgtctgcgtctccgtctccaacccaggcggcgtaggggaaggagaaggaaggagagatcgcgcggcgcgctggctgtcgctgtcgccgtcgcgcaggctcgtccacctcgcgaaatcgtgagctcgcgcgccgctccgggcatgcagggcgccacgccgggcgatgccgcttgagaggaggtgggaggccgccgggacctggtgattgtgaggcgggccaacgttgccgcatgcctgacctgcccgct

SEQ ID NO: 95451 - DNA, 515 bp, Oryza sativa
gctaacaatcaacaaaggcgcgaaacaaactccttaacaacaaaaaccatatacacaagacaacacatgtaaagcacatataccccgagttgagctggctcttctcgacgtggagacacgaggtcactcgtcataacatgacattgtaaatgctctaagtaatatcctatatatatctactatcttaaaagcatagtagtcctcttctcagtccaattccgcataaaaaaagcgctaaaagaaagagagaacccactctcataaatttctatttatcttaaaagcacagttatcctcctcctcttcccactccaattccgtgtaaaaaaaagctaaaaggctagagataaaatcaatcaggatttaagtcctgatttctataaatattacacccatatagttaggctttcaagaggaatttaagtcctggtttccattttttaaatcatgtgttaggggacgcgtttgtggatgtgtgagtatggatggtgttgggtatctaattgtgtgtgctc

SEQ ID NO: 95452 - DNA, 577 bp, Oryza sativa
tccttcaaagaaattccagtctcagtcctgcagtgtaaaagagagatgatttggctacagcaacaatgtttgaggcacttcttttgcaaaatattctgagatcaaccagtcgttttcgcccaaaaagcatctccaacatttcagacaaatatttgaaatgaatggacatcagtgagtatgctctaatgtcatttcaaggggaatttaaacatagattcagaatcattacagattttgagaagagaattactttgttatctctccctcagtgaaaaaggattgtgacacatcacctgaaagtagagtttatttcttcaggatgctgctcactttggacctggcttttggacctcactttgccagggcaaatctctcatgtgtcattcttcccctctcttcctcctcctagagttactcaaagatgaaaaaaaatttccccacatacatctttcttatatgtgacctgaatcatcttccaatacgaatgtacttgatggagaacagtggcagccttaaggatcagatacagatagcaatgcctccttcctactaaaacttttcttttcttttctcactg

SEQ ID NO: 95453 - DNA, 634 bp, Oryza sativa
gttctgataatagtgcatgcgcgtgtgcacgcatgcatgtctagcttcatggacacatgttagttttattaaggcaatccacatccaggttgtaaatgtagccgatagatttactgaatttagtttgccattaacttgttggtactttagtgtttgcttggcaaatactttctttttgctgcggcttataagctactcctccatcccaaaatatagcatcttccagcgttcaaaatttgtcccaaaatataacaacttctccacctactccctcctttcaactaatcacaattgttcgccatttaagttctcgacctacttcctcatctcaaccaatcaaaaccatcccccatttagttccacctactttcttaatagctgtgcgatcctctaaaacttcttatattttgggatggagggagtagctaggcaacaaaaaataattttagggcaagccttttatactcctactctcagcgttccaaaagcgaaagctaaaaattagaaaacactgaaaaataccccaaatcaactcaaaaattaagttctaaaattcaaatttgtctgtggcttataagccaacgagcagccaaagaagcattttgtcctgtttttgaagccacaaatgggcatt

SEQ ID NO: 95454 - DNA, 569 bp, Oryza sativa
  unsure (1)..(569): unsure at all n locations
ggcatcggacgcctttggtgtaggccccaccggctggattggcgagagcgagcagaagccaaaaggcagtggaagaactaggatctgcaacgcgccgccggaagtcaatgcaagtggagcaccattcaagcaatgaagaaaaaacctggaagtgacatgtattttgtaattttttagttgttacgtctgatcctttgcccgtgtctttctgtctttcatcaaaatgctagggtgctggttggtttttctatagtttaaccagattagttcattagcctttgctaaaagtgatgcgatttatcgctcacactgagtaggctgttggtaagaatattacaaactgagtcacaggcttccatagcagcagtgctaaattagggatattcagatggtttactgcattctgacaaaaattattatgcaaagcatctgctgctcatgcagctggnnnnnnnnnnnnnnnnnnnncaaaggcttacgactgggtataccaaaatctagaatgtgatggatcaatgtgtaaacaagattgtggtttgtctgtctggttcctttcaaaaatgaaaact

SEQ ID NO: 95455 - DNA, 659 bp, Oryza sativa
cactacccatgcccgctttgcccgtttatccgcgaaatctaacttacatgtaggctaggagcaaaatccactagaatacataagccacgttctttcttttctacggtttcccttttatttcccttattatttctctcctcttactctatcgctgccagaggagagacacgacaccgaggcggagaatatttgatgttttaagttcgattcgaacttagtagcttgtagactttttgttccactgcttttgttgtggcgggtaaacgggcacgtccgtgggcataaggcgcccgcgggcaatgggcatgggcaaccatccttacccgtcatgtagtaatgggtatacccacgggcacaaataatctcacaggcatgggtatggataggcacttcccgtgcccgtcgcgcccgattgccatccctaaccgtggagaatggcaagactagttgttggctcttgtagcaatcagagccaactcgcagaggactcagcgcgggtgacggtgaactcactgtggaggtagcatgggcggcttcaagctcacagtggaggccgcacgaccgatgacaagctccatgaccttacaccactagcctccgctagctccgtcgccacgcatcacctcttgtaccttggtgtcgcgctcctccactagctc

SEQ ID NO: 95456 - DNA, 515 bp, Oryza sativa
ttttaaaattttttaggttataaaatgaattaaaattaaataataattctatttttaaataagacggcaaacagtgataaaaaagtttaaatcttttatattagggaacggaaaaagtactaagtcaaatagcccatcactagcttttagctgatgtgctgtactagtactactgtttacgtcagcgtgttgaataaacagcggagctcccaaacacatcttttgttcggattagtagttaatcctgctacgaattactgctccatccgttcaaaaacaaataatttatcacacatatcaatacaaaactagcaaactagaatacatatattttatcaaatcggaatacaactatttcataatttatctacttccagtatagttattcattgcttttacaaactccggtccaatgattatttacaataaacttacctagaataaatgatagaagttagaaataaaatttattgctccatccgtctcataaaaaaataacatagtactgaatgtga

SEQ ID NO: 95457 - DNA, 1290 bp, Oryza sativa
gtctccgcgacgccgcgctttccggcgcccacgacgccgcgaccgctatcttccatctccatgagcggcaacctccctggctccctgtccctggccgacaggcccagccccgccccgccttcgccgcggaaacgaagcagagcagcccacgcggaggagagagacgccgccgcggcggcgacggcaacggcgacggcgacgaaatggaggcggcggagcgggtggcctcgcgatgagcacgtgcgcgtgacagcgtgtagacctcggctcggctcggcttcgctgcgctatatgggccggaaaggtgcagaagcccatgtgaggcccgttatatatgggccggaacaaactggattggagtaataagtctacttttgctccctcctgtgtaggtaaatcttattcaaatccttcaaccataatatcaaatattttgaccccccactattaaaaacagtgcaatttgatttcctcgatggttctttgagagtggcttttgctgacatggctcgttgacttggtccaaataacccagttagtgggttgggtccacatgtcagtgtctcctcttattccaagattggcagtaactcggcccatttatttatgggctggaaagggatcacggcgaacgtgcaggccattttaataggaaaaagtgcaccggaggtccctcaacttgtcagtgagataaaaaacgtcctcaaaccgtaaaaccaggtatgtgggggtcccttaactatgcaaaaccggtcacccgagatccttcggcggttttgatcccggttttggtctacgtggcagctgagtcagcatgggacccacgtgggccccacgtgtcagcctgtccaggtcagctactcttttctctcccttctctctctcacttctctcctctcgggcaagccggggcgggtaggtgttggtagaaacacacatgatcgatatctctctctcacttgacaaaaacttgaagatgaacagtaagctaaagagcaatgaacacagaaagttttgtggtgcttaaatcttgccgcaccgttttcacgttttcttcttccttttattgaagggaaaatgcacactacggcctaacaaattgaccggattactcgctctaccatccggattacgagcgctatcccactcgtcagatcgtgcagcgagagactcgcatactaccgcctcgacgtgaactcgcacgcctcaggtctacagacgcgctcaactctgactagagcgagcccagaaaaacagggaataaaaaacaaacacataacgtgcatgaaa

SEQ ID NO: 95458 - DNA, 698 bp, Oryza sativa
tgctatattctagtacggatggagtatcattatcctgatctggtgatcgacaatactccatttccaaatgtagtactttatcatcaaagactattcgtttttaaattttgaccatttgtcatttttgccaaaaaaaatgtaaatatttaaaaagacttagtattattgaagtgggataccccataaacattagcattaagctttattcatcgtaatttgaaaaaatattagtggtgaaagttgaaacggtggcggccaacggtgctaagtattattcggggaacttaagttaagcaacagtttcaacaataatatataccacttgtttggacgattcaagaagagacataagatgatacatgcatgcaagctctcacaaattcaagatgcattgagacggtgagacgtgagacctgaggcgtacacgcgcgcgcggagctcctaacgattgtccggtgaagaaattaactatcttctgccattccgtattttccgttgcttctcgttgcacgcacgcgtcacacgagcacggctacctagcctgccacgaccgtacattggcacatggattacgtgccgcttcatccactggcctccagacctccacgtcgtctcgctcgatcgatctcctctcttcaccgctctccttgaaccttctttcttccatgatgagtacgagtacggcgcccagtgtgaaa

SEQ ID NO: 95459 - DNA, 561 bp, Oryza sativa
ttttttgaggaaggatttgaaattgaatgaaagtttgcttttcaggtgaccttactttaaaaaaggttagactttaaggtgaattttgtttgattacctgcattactacatttgcatgaaatgcaatcacttaaagtatgattggggtatttaaatatggtgcccaagtagggagactaggatttattctggtttgcttttgttaaaaatatttgattattaataataggggaaatgttgagtgcaatgaaaaaagaaaaggcatgggaaatatatttagaaattatattgtctttattcttcaaaccttttgaagccaaaacataatttgggcacaaaatcccttattcctctttttccccagctaattttacaagttgttttttttttgttttgttaaatttttgtttggagtgttatgaagttgtagtttgataacaaatttgaaaaagacagatgttttgttaggtaccagcacatcgctcacatcacagttgagtcagaactcagaaacatacaccttaatcacaagttggtaagaaagaaaccaaaaaagaagaa

SEQ ID NO: 95460 - DNA, 702 bp, Oryza sativa
gcagatgatatttttttttcattggaagatgagcaggaagatatcaatcaacaccatgtatgttatctctaatgttttttttaaaaaaactttttgggaatatcagcattgtgtgactctttctagaaaacccctttctctttcttgatctgttgagtgatatgctattctatgcaacaatgccagctaccatgtatgaagtaagattcaagttgtacgttacagttggatttcacgcactatctctttccagttgagcaccattgtcgcagttttgtcttttatgtattatgtactattgtataatcattgttatgtgaagcatccttttaggtattgctagtgttctctttctagatcggggacttgttcaccgtctgaaaacttcacacatacagctgttagggtttacggtatacttttaatgataaccacatgattagttcctttttaagagatgtgttgactgttgacctcaattttgtgttaattgtcattctgtagtctgcttaaagaccagcatatgctactcattggtccaaaaataaatctaacttctttggaccgttcacataggtgataggtcaagctatgtaactgctggccatgccatgcatcattggataatctttctagttcactgtattaaatgtgcactaattatgtatagcattcagctgcagttggtgcatactaactaat

SEQ ID NO: 95461 - DNA, 677 bp, Oryza sativa
tttcagtgtagggtcacctgaaatgcaaacttgcatgcagtttcaaatccttcctcaaaaaaaatgatcatgtttcacttcttgcattctgcaggggaaccggcaagtcaggaagatctcccggccgagcgtatcggcacgcatccccaggcatggaaggttcccattcaaggaaggcaggcatatctgtggagcaaaaagatggttgcattgcaaggaggaacaaaacaagaacaacattatgatggggtctggctgtggatgttggtgtaactagggggagggggcctatatcttctgtaaacactgctatttaaaacagttttaaacataaaaactttaactttttgcaaacaaaagctaatctaatggtggggaaagtttttttgtaaaaaaagcaatgagtattaaacttccctctcacaacaaaacaagcatcaaaaattcttggcaaaaggatgtgggcaagaactcccttcttttttggcactaataactttagacatctaactagaactttggttcttttctttttttttttttttagcccaaacattcattcttttcccttgtcactgtgtatcacttacaacatcatatcataaatttgccccagagaaaaaacatgtcaagaaaggacccaccttttttttaagctctggctcttaccttctgat

SEQ ID NO: 95462 - DNA, 619 bp, Oryza sativa
tgattatgcaattcctggtttattcattttttagataataattcctggtttattcatagctggaataggctagtgattatgcaattcctggtttattcataaaggttggtaactgaagatgatatacccgtttattcaaatgccccagttgtatcctatcaatgggagactgttgcatgcaactttattgaatttgaattagcagcagtaagttttgagtgaaccattaccatatgtatttctttattatgcaatctatgattgaagttcttgaatagttatagttcttctgttctccattgactcacacattataaggcacagtgttgattaggtcatacaaatgagaatttctttggatatccttagttacccgtggtacatggtattaccatgccatctctgtaaatatatccagcagactgtaaaatatatccaacctccatacctctgtaccataactaaacagtactccctcggtttcatattattaagccgttgacttttttcttagtcaaagttctttaaatttgacccagtttatagaaaaaaatagcaacatttacgacacaattaatttctattaaatttaaacattgaatataatttaatacaatgt

SEQ ID NO: 95463 - DNA, 603 bp, Oryza sativa
tatcgaatgcccatcacggtcaccatctcgctccccacaaaattgagagaccgaccatggccagatgagagaagaccaatgttgtctacgaacgagtcaagatgacaagaaaacaagaaacgtactagtagcacacagttgtcccgttcgattctccaacgaggaggaatatcaagtgcgcaccaaaagtagacaaataattagcacataattaattaaattttaattatcaaaaaaaatttaaaataaatttatttaatttctatagcaatttttattgtaaaaaatttttgcatgaaaatcgtgctaaccaaatgcaaggaaaaatctgtatcactggcgttttttacggagctcaaaggcgaacttgcaggagacaaatgctgtctactacgaaccagtcaagatgacaaggaacaagtggcgcaaactgtcattgtttcacaaccatgggaaaaagggataatctgggttgctactctgtattagtattactggcattttgacagtagtactagctcaaaaggtgaatttgcagatggatcttgcggtttggaaacagaatcgctgtagcttttgcttctattctttggggtaccgagc

SEQ ID NO: 95464 - DNA, 934 bp, Oryza sativa
ggggggatagatcgatccgaccgtacgtcttgctttgagatccgtgctgacgagtgacgaccgtgcaccacaaccgccggcaaggccaggacgacccaggtgttggagggctttcctttccaggctgggggctctttaaatgtgaccaagcagagattattattgattgtttgtttagttgcctgtctcatcttatatttaatcgatgctggaagcttagcttggcgtcgaccgtcgagtttgtactgtcagtttcatttttttaaaagaacttttgtcagtttgtcgtgggttatgttcaagagattggaagggtgtgtaatagaagttgatcgtgtgtcctttttgagaacttctctttgatggtaacatgttaagcgtttgaagaaattctagtagcgtttgaagcagaccattcgttaagggcttgttcactttgttaccattttcaatcttatcattttttttgtaaagttaaaaaaattgctacatttagtttgttgctaaattttagtaagtacatatgaaatcttgctaaaatttgataatcttaccaaattttgataaccttaccaaaatttgacaatgccaaaacttggtaaggttgaaaatgatagcaaagtgaacaagcgctaaattattatcatagattgactacttaattatataaatgaattaaacattttagaaacaaacttaacaaatactacctttaaacaaatgagcctaagtaattcaatgaaagaaatgtttttgttaaagaagccacattttcagaggcgtgtggagcaaataattcacatcaacaatacgattaaaaagagagaaaaaaaatagatgctggagggataaactcttcagcatatgtgagaaactgagaaaccatgagttggtgtgctcaggcgagcatggagcgaagaacagtcgttttttc

SEQ ID NO: 95465 - DNA, 698 bp, Oryza sativa
tgtaaaaacacaagtcatggtattagggatgtatagttctattggtaaaacacaagtcaaggtattaggtgttccagtgttcaccgaggtgctaacttgatggcagactggctgcctttggttattattaagtggtgtctaggtgctacttttttcactttaaacatggtgatttgttcaaattattatttcttgccactaaaaattggtcataaattaatatcagtttttactgagaggtgtttacaatcatttctgaaaaagttcttgaacttttaaaaggaatggaacaaactttaatattgatgcataattattgataatttatagagtggtgttccacatcagatattaaaatttttaacttttgtaccatctacactaaatttatatatatcttaacaatcttatattaatttcttgctaacctgaatgttgctaaatttaaggctctaaaaaaaattaacttgatattttaatttactaaacataaaccgcaattttcttacaaaacattttattaaattatactacaattctatatttctgaaataacaatatatcttagctttttaacttttggcatatacaagcccaaaatttcatggcagcaagaacaccagtaacgagaaaaatgtggcttcaaaacataaaaataaaactgattattctttgcataataattagcactcatcctt

SEQ ID NO: 95466 - DNA, 684 bp, Oryza sativa
atgctgggagcttagcttggcgtcgaccgtttagtttgtactgtcagtttcatttttttaaaagaacttttgtcagtttgtcgtgggttatgttcaagagattggaagggtgtgtaatagaagttgatcgtgtgtcctttttgagaacttctcttttatggtcacatgttaagcgtttgaagaaattctattagcgtttgaagcataccattccttaagggcttgttcactttgttaccattttcaatcttatcattttttttgtaaagttaaaaaaattgctacatttactttgttgctaaattttagtaagtacatatgaaatcttgctaaaatttgataatcttaccaaattttgattaccttaccaaaatttgacaatgccaaaacttggtaaggttgaaaatgatatcaaagtgaacaaccgctaaattattatcatagattgactacttaattatataaatgaattaaacattttataaacaaacttaacaaatactacctttaaacaaatgagcctaaataattcaatgaaagaaatgtttttgttaaagaaaccacattttcagaggcgtgtggagcaaatattcacatcaaccatctatttaaaagagagaaacacaatagatgctggagggataaactcttcagcatttgtgagaaactgagaaaccattagtt

SEQ ID NO: 95467 - DNA, 579 bp, Oryza sativa
ttggctaagcctttactcaataggaagggaggttgtggggattttgccactgcacctttactccaataggtacaatctgacatacgctatatcagttttgtttggctccatatttaccaacatagggttttccatagaaagctcattctatgctttctggatatactacttgtcgcgaaggatctcggccatgtcataggacatcacctcgtctaacttgtaattttagctgatgtaactattcatccaactttgtggcctcggttttcaattcgaggttcttgatacaagaacgtgcctgatcataaagaaaagtcccattgcaattgtacaaatatctcaattttaaataccaagagttatttactttccagaaatacattaccaaaatcctccaatttcacatatacaaaaaggtgtgtgccaattccatactggagtactcctatatttttaagacacatactaaaggtgtgtttagattccaaaaaaaaatttggtcaaaaaagtcgcatcaaatatttggacatatgcatggagcattaaacatgggaaaaaaaatcaaatgcacaatttgca

SEQ ID NO: 95468 - DNA, 513 bp, Oryza sativa
actatagggcgaattcgagctcggtacccatgcgaccaagtaagtagatctgacagcattggagccttaagcaaacatttaattgcttcttgtgaggagactgttacagaacaagattgttgaatatcattcattagcccatcaacggtatcatggttacctggaacaataccagaccaccgtttctccaacaaagacatagaaaacatgatattatttatttctatgtttttcctttgtctctcaatagaatcaagaagtccttctccagatttatcttgcacaatatcaaagctaatagttggaaattgccttttgagaagcttagagaaactatcctccgaaaactcaccatcttcaagccaattacccccagcttggcagagtaaaacctcaatctgttgctgcagtacagaaacttccactgaagaatgtgttaactttccgactttcaagaaactgctcaacttagggggtaaatgttgctcatgtttccccaagaactcgaggaaa

SEQ ID NO: 95469 - DNA, 620 bp, Oryza sativa
cagataggaactgtagacttttttccattggtatatgattcagacttccaaatgggcgcaggctatattctgacttgcacaccaatttcggaattttcgttgcggcccatttaggggaacagcgtactattgaactttctggcaaaagtaggcccagcccgatttgttactgtcatatgcttctccttccgccggcgtcgatggctgcttcgccgcgcgctgatgggcggcctcctcatccccgccgggatacgcctccgtttcctcctcctcgaatctctccgccgtgcaagtttgcgactctaaggcagtttatgattcctcgccgcctcctcgaatctctccgccgtgcaagtttgcgactctaaggcagtttatgattctcgccgccgcccgcggcaggggaaggattccgatcaccggcggagaaccaagcatggcgccgccgcggccgcgtcatggtggaggaagatgggaagatgcgtgaagggttgggtgcaaaattagccgtggctgccgtgctgtcgtcaaattcatttggtaaattcttctctaaatttgtgagaatttgatgtctttaagtgattttttccgatatttgctgcatgtataggacaatt

SEQ ID NO: 95470 - DNA, 507 bp, Oryza sativa
cgggactaatgatcatccatttccgttgcactttttaaccgggacaacaaatgatctttagtctcggttcctatttgaacccggggctattgtggttttcggacccccgagcagagcaaagatcatttctccaatagtgtacatttaatccaaaatatataaaatatatagtaactcttaatcataaagttaaatatatattcaaattcatatataaagacagtactactccgtctcataaaaaacctaatcctagctacgaatctggatacatgcgtgtccagattcattcgtagagttggtctttttttttttttgacggagagggtacgttttttgggtggttggtacccgtccttatctgtgccaatgcattttagataaataccattggctatgaacatggctctattatgtaactgttatagttgtagttgaacacgttattgccactgatctaaatctaggttcgtacatcctttccaacgtgaagacttcaaagtctgc

SEQ ID NO: 95471 - DNA, 641 bp, Oryza sativa
gtactgtgcggggggccgctgcaaaaggcggcgaggaccctgtttttttgcaggcggccccattgccgcccttacggagggcggtttggtactgtgctggttgccgccagctttaagagcagcccccaggtgtttagttcggtgcatttagaaaatttagtaaatcatcacttctaaaattgtgaaacaagaaaaaacattattagaattgaattgtacgttgtttcggcggtttggagcccaacaaggggtgtttttacaccgaaatatttaattgttactgtaaaaactacataaatcattgtttcaaagtcaaaggaggaatagtttcaaactacataaatctaactattttgcaattaaaattttaagaaataggtattttacataaacctgatttttagcacttaaaattaggtaaagtatcgttttgaaacgaacaaagtacgtgcattttgacaaaattttaataatttaatttttcatataaattggagggctatgagggggtttgttacctataaattgtaagttacgcataattctcgtgtatgttgaaccatgcacacaattgaaggtggaagttataaaaatataagcaggtacatataaattataaggatacaatgatgagctactgt

SEQ ID NO: 95472 - DNA, 542 bp, Oryza sativa
tactacaacactttacctcagagtattctaagggtatcgaatcacagaaaacatgcgtgaataatctaagaatagacttcaaccaagaacaacaacgaattgtaggcttatgctagagaggattcccatggattaattaactaaacttaagttaaggtaaaactctatcgattgctttgagcactgactctcccctggtctgccaagctgagttcagtctatagctctatgatgtacccgaacgtgaagggacacaaaagacggacatggctatcaccatgtgttgcctacctcattttctgtggagcacacaacaaacaaagctaactgctaatctagacaccactacgcctaacttattgaatactactctagcttcgcgtaggaactttttctttatccaaattctaggtccagagtacttaatactccctctgtcccaaattataagccctttttttacacggtcttaaataatatactttgaccagtattttattctattttatgatctcaacaaatatgaaattagcatcacatga

SEQ ID NO: 95473 - DNA, 554 bp, Oryza sativa
  unsure (1)..(554): unsure at all n locations
gaacggatgccgttccccttcctgcgggagactgagctgtctaaggttgaaaaacgaacatttccactgtctctataaggatgaagctatgaacacaaatacctatcttaaacaatgaaacttaaaaaataacctgtcttggattgaacaatgatgctatgaacacaacatagaaaccaacctatcttgaactgaacgatgtagctatgagcacaaaatagaagaaaaaaaaagagagagaaattgctttcgttgagagtcgaactcaagacctcccgcttactaaacgnnnnnnnnnnnnnnnnnnnnnnnnnnagctctttgttgcttgtctttcgtagctcaaaatctctgagtttctttcgagtttatttacttctcttgattgtatagacgtcaattgcttaatgtgtgctacgcacaagcatcttggttgctcatttgcttcagagctcaattgcttcatgcttgtcaacaacaggttgaagcttgaggcatgaagcagttgagttctatcccatttccataagagaatgatagagaagatgcttatg

SEQ ID NO: 95474 - DNA, 528 bp, Oryza sativa
tcttagacttgtttagcgatgttggtttaagaattctgaaaaatgacaaagacaaaattttatttggtaagaagtctaagttatgcctttttggtaatatagagtattaaatttcggaatcgataagtaactagtatctatttactattttttcctgatataataattttgaaattataaattaataactatttataagctatctaacatggaccttagtttaatgtgtcctgtgataactttggtcttgcctatatgcatgactagatttattcactactctcctatccgaaaagctaatacatcttaaaatttagaattaatggagagtctttgttttgtgtgggcgattattaattagcttgtgttaatttccttcagcttaatttggtggtgtttttttttaaaaaaaacttgtatatgtgcgctagtttgcataaatttgtgtaataattggttgtatctcgttgagtaaaggtggggattctattccattatctaaataatttatttgatattaacatacct

SEQ ID NO: 95475 - DNA, 662 bp, Oryza sativa
agtagtccatcatataattaggttttgcaactataaaacatgtgcaagcgctagcttggaaaagacaggaaggctgcgctgttgacatgcggaccccacatgtcaacctaagggaccacagtagaccgagtacacagagacggcccacgggtcgacggaagcggaccccgtgtgccaaccgaggcgagtggccgacaaacggactccactagacaccacgcgggctgcacacgtggaaaccacgcggctaccgagcgggcacacaaacacggtcaccacacgcacccacgaacgattaccgacaccggtacacgggcaccggggtcgacaaccgcacaacgggcacgggcgacaccgaaaggacgaggacggggcagcgaaaggagagagatccttaccaccacgcgatgaggcgtgggaacgacaacaacgaacgggcgcggtggagacagctcggggacgacggaggcgaacggcgagggaacgacttcggcggcgatccttggacgaaggcgagacgcggctggcacaaggcttgatgacgcggagccgaggacgaagacgacgacggggctgctgcacacttgacgaaacgcgggcggcgaacgcgatcggcttgacggagggacgaaccctcgacgaggaggaaggaggaagacgac

SEQ ID NO: 95476 - DNA, 600 bp, Oryza sativa
  unsure (1)..(600): unsure at all n locations
actaacagatgtacagtagttcatcaacccgcaccaaagcatctcctagataagctagccgtgtattcagtataacaagaacataatataaagtaggtactcatatactcggaaagtatttcaataccataaatgtatttagaagagtattctaataaaagtacaaggcttacaaaagagaagagaaagctgctagagtcatacccgaactcttccgaagacctnnttcggactcctgatttctactctattcctattccactagctagatactactaaactaagcttgagagaaatgagagagctattgcttgaggtgtgtgttgaagtgaagagagtgagctccttatatagaggtagttatgacggttgtggaaggggaattgtcctaagtgccatccaactgtcattgggatgcaatcctggacgtccacgccaaaacctggatccaacggcgcaaggattggttcngccgaaccaccangttgggccgaacctggggctggcccaatctagcccaatttcggctggtggcctcctctattgctccactttgcagacttgtgaattttgtcccaattcatcctgtcaattctgagt

SEQ ID NO: 95477 - DNA, 602 bp, Oryza sativa
actatcagatgtacagtagtctatcacctgtagtggaacagatttctaatttccctttatcgcaagctaaaaatttagattgtgttgatattgataattcttgtaatgagaaagagttgtgcaatgcttcacttatatacatgccacaacttgtgaaagaacatgttacttctatttctaaatatttggtttccactcaaaataaatgtgtctttgctattgctgaagaccaagaagagctgaaattattgttttctttatgtactttaggttatatcgtatttgatgtcctttcttggaacaattatcatgtcattggtaaatataataatagaggagattatatggtgcatcgtgtgtatatatgttcagatatgagtactcttttaaatatgtgaaaatgtgagaaattaaatggatcatacaacattgatgctattgggataaattcacctaaccttgttttgaagatcgacaacaatattcaagaaggggagtgttgtgcaccattagattcaatggtcaagtctcgctatcattttaggacttgttcattaagtgaggtgagttggttttccctttatataaattggatttatgag

SEQ ID NO: 95478 - DNA, 585 bp, Oryza sativa
aatgactaacacatggacagtagtctatcagaccgtatcgatgtataaaaatacctatattttgggacagagggagtagcaatttaggaaatgcgcagacaaaaccaataagtagaagatgggaacttgtatatccaaacacaacctgggatgtcaaataatcaaagcacagtttgtattgtaaaaaataaaaatcaaatcttagtaccatgtaagtatcagcgtaatggatataattttcttcatatcatgtcaggttaaaaaaagttgtcaagtcttaatgtgcaaaaatggccgagtaaattggacgaggaaccgaatattcatgaacgaaaatgggtttactttttcagcagtgactaccaggtgttcagttaaagagtaaaatacaccagcgatccttaaacttgttatgagatttcacttagttccacgaacttgcaaagcatacatcacgacccctaaatttggtttattgtatcattccgatctaaatccccgtttgaccgtggtcttatctacgtgacacgccacgtagacgatgatatggatttttttttctcccttctgtttttttcccgtgct

SEQ ID NO: 95479 - DNA, 531 bp, Oryza sativa
ccccttaggagcacacataaaccaaccatgtaaaaagtaaactcaaatggatgaaatatgtgacaggtagaattttctaaagttctacagaaaagcttctcgcctcgaaaacacaatcttgcaagtggaatttggagattctaatttcgcttaatctggtaaggcgggtgagaatcgaatgtgactttttctatacatatccatatatatatatatatatatataatttgcttaattccgagtccatatgagaaaattatgtctgtttgaaggaaggacactcgaatgtaaaaaacaaactcaaggaaccctaattttttaataagagaaaaaatgtactatttttttactacaggaaaaacaaaaaacaacagaaacaaaaacaaaaacacacaacaagtgaatttaaggagagtggatggagcccccgaggggcgcgggagcgggggataggggggtgggcatgttagtatctccgtggtggcagggggcagcatcagagagaccacgccagcgactctggcgctaaaa

SEQ ID NO: 95480 - DNA, 548 bp, Oryza sativa
ttgcgaaaattaatccgtcaccatccatacgttgtcgttctcgaagggagtttgctcagcatgtggcgtcactgcttagccgtgatgaacatcaagtgcattccggaccaggcttcggccggctatgtgttattagtagatgctgtcacgggaacaacaaaccagtttaagctggtacaaaagccacctacttttctctaactttccttaattatttcaaactaaatgggcttgaagaaaacgatgatgtggtagctttgtctctcaaatttttcagcgctcatccaattgaagcggtagttaaattaatatcgtaatttccgattacattctttctaacttggctagctttatgtaattaattttcatagtggtggttgaacacacgttattgcaaactgatttagattcgttagtacatcttttccaacgaattgacttcaaagtctgcacatatgcatgcatcctgatctttacatatacatgtgttatatagacttgtttagtccaaaagtgtagtccatgctaacgttacattgggtccaaga

SEQ ID NO: 95481 - DNA, 537 bp, Oryza sativa
tgattatgaaattaattgacaaaaatcaaaaaatgatatatcacaagtagaaaaaaaagttagagatgttaatggtcaagtaaaaaatgctaaagcttttgttttaaaatgaaatttagttgttgatgttaaattaaatggtaaaactattaaaagttttaataatttaaaaacagctgataatcgtaatcaacacgattattttggtggtaattatttatatacttatttacttaatgatgattttaatgtcacatataaacccagtcaatattatttaaccaatgctaaatttaataataataaaacggatgaagctttattaacttatattaataatactgctgaagaaattaaaaaaactaacgaaaaatataaagatattactacaacaggcagatatcctactttaaatcaaaattatgcattaagcagagaattattcaaagagattgttctaaagagctttgattttaatcttaatggttgacaaattgaagaagttgtaagttatttaaataatgatactgataaatt

SEQ ID NO: 95482 - DNA, 551 bp, Oryza sativa
cagtgacacaatgtcacgagaatgtcatgggggaatgtcactgaatctgcgttcgatagaggcaagttcatgtccacacttcaaagatctaattgttttagataatagaaatgtcttacatcctgaactataccataaaacactttcttatccaaataaaaaggataactttaaaagaaaaccagctgataggctaaaagaccacattgattacatcaccatagtgaaatactcttaaactttatagatctaataacagtgggaatactgtaatagaacatcgtcatcattggggttaagttattaatccccggtgattaaggggtgtacacttttgatcagcaaacgagctctgcaggtcctagcctttcctaatttcttttcttttgagctgtgaagctcagcctttgtggttacttggtcaatttctttatgcagtgcccagttgcccacgtatcaactgtttagcatctatgcttagagcaagtctaacagtatagcccactactagctccaattcatatatagccgatatatagataattcataca

SEQ ID NO: 95483 - DNA, 630 bp, Oryza sativa
tgcaattaaatctttcaacaagatatcacatgattatattatgtcaaaaaaaaacggtatgtttcaaaccgttaaaacaaaatatttcatatgtgatagtgatatgtttcaatatgtgtcttaagtgtgtttcacaaaattcctgaaactacctactactactctctctccacctcatgcatgcatacatgcatgtattttagcaagcttcaaaatgatttttctcttaaattacctattcaatctaagatccgatcacaccattgtattcgttttaattaaatctttacaacaagatatcgcttgattatattttgataaaagaaaaacatgtgtttcaatcagttaatacttgttgtttcatgtgtgacagcaacatgtttcaacgtgtatcttcaccatgtttcataaaatatttaaatgttccagttgctgatttttttcaccatatatataacatgatgttttacttgttggtcaactgcaacatttgaccatccatttttttttaatttaaaaatgtttcacctaatgtactcatgatgtttcactatgtatgaatcaaatgttgcagtgagttaaaacatcctttcgctattcgctgaaacattattttcatataaggcgaaa

SEQ ID NO: 95484 - DNA, 634 bp, Oryza sativa
aggatcacctaggttagatctagtcgggtggttctatttgggtttgatgaacgacattgtagatgaaagggagagggtttagataccgaccggttgaggagatcgtggaggaagaggcgccggacatcgtcgttgtcgtcgcggcttgacgtggatgcggcggtggcgtttcccgtcactggctgcgccccctctcgatcggattagggttttgtggggtggagttggcggcggcggtgaatctcgtaccatgtgccgtgccggcctccaccccccttttatatggcgcagtgtgacgggggcccaccagccattgggctgggcgcccccgatcagggcgcggtcaaggcccccttgagccgttgggctcaaggggagagagatctatctaacagaacgatcaaagcttgttcagctttatcattgacctgttgtgcaacttcatcatgcatgatcatggtcatcccctcgaagttctgtgtaatctataacatatatatggtcacagatcaaccagtatgaagaaatatgactatcaaggggcaaggcgagcatacatatgttttcttgcttctcatccggtctacaatcccccgcgactacgtcgttccgatgcacaggtgagaacaaacgg

SEQ ID NO: 95485 - DNA, 574 bp, Oryza sativa
  unsure (1)..(574): unsure at all n locations
acaaaagcctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaactccgatccgtgaaactttgttccattaatgaagaactcatgtcactcatatgcatgtttgggaagtgcttaggccgactcccagtgcttggtggctatgactagttgggcagagcgtttaaacgtaatgagtcatctgctcggggaaatcaaaattgacaagaggagaaatacatatttataaatattttaaaatacttgattttttctcgagtattatatttatatcagatactactcatcctatatgtttgntctgcaggatccagatccagatatgcataaaagggattcatggctttaagcttatctcttacgctctaggaatggatcaagtagaacatcaccaccgggcg

SEQ ID NO: 95486 - DNA, 672 bp, Oryza sativa
gtgggcattttgggttttttgatttttttggtgaaatttttgtttttgcatggggtcgggttaaggacccgcggccggccaaatgcaaaaatcagttttagtagcatttagaaaccgaatctgtagttatattttatattctgagaaaccgaatctgtagttatagaacaaaaagctccctcatttttttaagctatttttttctagattctattgattctcttgattttaatcagctgcttttaagaatttaaagccagacataccatgtttcccatgtcgtatatctcacgtacgtataagtttattttgtcacgtttggattcctttgatcctatggcaccttaattaattagcatcaactgttgatgcttagcattggaagtaccttgacaatatattacacccattgcagtggagggtgctaatttaatttcttgtagctacaggaatgtctcctcaaactgcttatttcatatgacttcaatatatgctccttgttagacaataagaacatagcaaatgttgtgcaattttgttacatattatgatatggaatggattcacaagaggcattattttttcttcataaagacggaattgtttaaagtcagataaataaaacggttctggcacatattttcgtaggtagcacaaagttccaacacttgt

SEQ ID NO: 95487 - DNA, 612 bp, Oryza sativa
tgttaagaaataccaacaacgggcagcgacatgcaaccaccggcgatgggtgctggcgatgcacgagcaatggcgggaggtgcggggcatggtggcgcacgcgggatgctgcggctcatgtagaaacaaaaggggagagggaaagaggaagtcctgtccagggaaacagcggtgaccagcgcagagcgcgggacgatggcaacgttatgccaaggagcagacgggctacggcgagccgtagaggaggagatgagaagggtcaagaagaagatcacttgcaattgaagaagagtgggttccggcgacggggagcgatgaccgaacggtggccgaggggcagacaggctcgacggtggtggcgacgcagctaggtgggtgaccctagcgctgtctagtggacaactggaggagagcgatgagtagtggagctctctcgatccggagtttgaatctcttcattctcgacggacggctgctcaggaaccttttcatcaatcgagctagcagaagtggatggttgagcgagtggcttcatcgttagaggttcctctatcttggacactgatgccttcgactggttttcattggtttgcgtcatgaaggaagtatttt

SEQ ID NO: 95488 - DNA, 1490 bp, Oryza sativa
ttattttacacatagaatagggagagtatggtagaagaaatcggacgagttctggagttgtcggtaatctcctcttactttttgtacattgttaattactctggtttaatagaattatcttcctgagtaattaagatttacttcatgtgaataattcttggttattttctaattagcatgcgggatcattgttcactaaagtccattaatttattgtgatcgctttagaatttagctagcactaaagtagttattaattgaatagacgcagtatctgggtaattaatttccggtgattccttcgtatcccacagtaggtttgagatcggtgtagaggtggtgatagccctcaagtacactaaagtcctccatgtacgggtatgtagtagagtgacatttgggagtagcgagctggccagtgcctgaagtatcgcattaggattaaactgagctttctgtagacaccgtttctcactaggaaatcatctctaccctttgcatacattttctttgtgtccttggatgaacctgaagaggaactgaacacacacgttccctatggaaatagataccttggaatactgccagttgaagtgctgcatcggtatcttccgtgcacttgcagattttatctgtgacattaagaaataccaacactggcttaatgtgttcttttaaaagtaaatctcacttaaccctaggtactgtgatctaagttgcacaaaaccaaactattgatcattttactttgatctatccttttgagttctacaattacatcttaaattgataaatttatgagtttttttaatccatcatagaaattttacatggatgtaactaaatcattttaaaattttgaggagtatgtaaaattggttaatgatgtggtttcgtgaaaattggttaatgatgtggatttgtgtcgtgcaccaaaatccctatgattttgtgtaactgttgacagtcgttacagacaaattttgaccgtcaatataactaaaataatggagaattagctatgcttacaatgcatatttgttttcaaataatatagttccacttatacttggagaacaatatgttgcaggaatttatcaaataaaataaagagaaagtggagaaaacctcactcctaagcaagcttatggatgagagggctcagaagccaggtgtaaccgtcctggaaaccgccttaactacaaaaccgtcaataggacccacctgtcaaagactgtaccgaagctggaggcctgttgggctagcccaggtttcggccgaactggcggtgcccaatcagcctggccctccacgtgtacgatccggatgcactcttaatgacggttgtgagggtaaaatgcacaattcgcattggtacaaccgtcataccggccctataaaaggaggagctcattcactctctcaacacactcaagttagctcaaattcctcttcatactttagtattagtattttagtgctaagtggag

SEQ ID NO: 95489 - DNA, 680 bp, Oryza sativa
agtactgtggttgtactcattcttgctctatctttctcccctcttcagtaagagaagctttggagaagatgtcttaggtggagtcctggcttataccccagttgagcgcctgtgaagatggagccgtaggcccgctagtccgctgctgtttatttttgattgtcaggcctgaagtgcctttgtaataatgtaaatattatcgatataataaagatgtgtcctttatatcatgtttgtgtggtgtaccccggcttttcctgggacggggattaatacactggcgttcgggaaaaggcaattttcccggtcgcgacaagatggtatcagagccatctcgactgtaggataagccaagtggataaaacctaaggacatattttataaataaaactatttgcgaaagttccttttttctccttcccttaatgctatttgcaaaaggtttactcccttcttccttcttcggatttcaactagtactagttggtcaggtcagtgaagaagaagacatcgtcagttgtttgtcgaaactccagaaggctgttggatccgtcagcgcagcaaaggaagcagtgaagccagatgtgaagcaagagtgaagatcttggaaaacccgtcgcaaaacctaagccaccctctagggtagagtcactagttgtgagtttcctttcttgtgtgtg

SEQ ID NO: 95490 - DNA, 598 bp, Oryza sativa
atgttgtgcaattttgttacatattatgatatggaatggattcacaaaaggcattattttttcttcataaagacggaatattttaaattcagataaataaaacttttgtggcacatatttaaggaggtatcacaaagtaccaacacttctaaaagaattgtagtcactatatatgcaaaaagaaaattgcagaagaatcaaaatttcagttaattcaatactaaatatgtctcatttgcttaatgtatattgaaaagaaaattaaagcgctttatatcactgcaacaacttgggaaaaaagtcactagtgtcactatcctatgattttgaagcatgccccaagcgccgtccaattatcctagtcagctaatatattctagccacataacgcaaaacgttgttcgagctagctgtctttgtcaatctcaatgggcgttttggttagtgtctaaagcgaaaattgagtcctttctgttttctttttcccaaaacagttcatttcgaaattctcatcaacaagctctagtatatgtacagtacaatttgctaggtagtagttttttatttgtttcgatctcccgtacacttttctataggt

SEQ ID NO: 95491 - DNA, 1063 bp, Oryza sativa
cgtgacaaaaaaatgaggtaccttgttaacgtatgattaatgaagtatgagctacaaaagacttaaaatattaattaatatgattttctaaagcaactttctaaatgtatttttaaaaataagttcaggaagcgtgcgtatggaaaacgaaagggtggaagtgggaaaagaggagaaatgaatgcagcctaagtttacctttctcgccaaaaaaatatctacattatttactgatgttaaagaagatataattgctaatagggatgatttagatattatatagtataaatctaagaaatagcataaatgtttatcaaagcaacatagtataaatctaacaaatagcataaatgtttatcaaagcaacaccattcaagaaattttatggagaactcgtactttagatgtcatttatatgtcttgtcaagcgtagcctacgatgcatggccgtgcttcacatgggctacctttgtagttaaagaaaaatgcttgtatttgatatggtccgagtagtacttcataagtctcagaatgaataaatttttcatttcccccctccatttatcctcggataagttcattttttcagccattattactttggagattataaaaatagatgataaatatattaagaatagataaactactgaataataaaaatagttacattagggatttgataaagggatagtattttagtttttttatttatatatactacatccgtcccaaaatataacaacctatgattgaatgggatatatcctagtccaataaatctggacaacactttgtattcaacgtgcaatcctaaatagtcatattttgtgacggagggagtactagtagataagtaaaataataaatttattttgtgaaagatggagtatagttcttacacccaaaaatgaatttcgtttgtttgacaaacggaccaacgatcagaccacgctgtgactgtgagccggacaacactttgtattcaacgtgcaattgtgactgagggagtactagtagatagataagtaaaataataaatttatggctgaatagctaattt

SEQ ID NO: 95492 - DNA, 522 bp, Oryza sativa
cactgcaacaacttgggaaaaaagtcactagtgtcactatcctatgattttgaagcatgccccaagcgccgtccaattatcctagtcagctaatatattctagccacataacgcaaaacgttgttcgagctagctgtctttgtcaatctcaatgggcgttttggttagtgtctaaagcgaaaattgagtcctttctgttttctttttcccaaaacagttcatttcgaaattctcatcaacaagctctagtatatgtacagtacaatttgctaggtagtagttttttatttgtttcgatctcccgtacacttttctataggtaatggatctactggtttacatgttcccttgccacaacactaaataaaatgtttacaagcgtactcaatattactgtacattctgatcacaatcgtcaaatgagttgacttcagaattcccagaaaaaaatgtgtgacttcagaatttagtagatttgaggaaaaacattcacgcccggtcactctgtcccggggcgacgcg

SEQ ID NO: 95493 - DNA, 592 bp, Oryza sativa
  unsure (1)..(592): unsure at all n locations
gatttatttaattcactcttctcctctcccatttaattcgctattctattttctaactaacaacttaatataaaaaatcttagaaatcatgagaaaaaaaacacctaacgtttattcctaaaatggtgggcatgttattttaaccattaggatctgtttggcatagctctatatctttgatccattgtagatttgaaatttacatgttaaattatagttgtttaaaaaatttaagtttcatctaaaataggaacaaaatgatttattcgaatgctatcaatgtaatcgcggatataaataaatggatttgtgaaactagaaatacacggttttaataaatcttgtatccgaacctatggcaaaaacaaccaagatctatttttaaaaatagacaactcanatggatgaccaattggatctatgtaaagaaaacaaactatcctcccctcccctgctgtttacatttatatgtttctnctttcgcacccactcttcccctctttctncctccatttaattcacccctcctaaatttgaactaatgacataataataaaataatctaatagttacatagctaaaatatagtata

SEQ ID NO: 95494 - DNA, 594 bp, Oryza sativa
tgcattaggggaatgagcaagctagttctcttttgcctagacttgaaatgctgaacttaattaagtttgtatgtataatggttgtcacttgaatttggtagatcatctcattcaatcaggcttgcccccctgacattgatatgcgctgtttggcctttaaccccccccttagtgttggccaatcaagcagctgtaattttctttgtattctcttggttgtaacccctgtactccgttttttttttctactctaatgttaaattctagcagatctcctgccgatgttctccttaaaaaaaaaaaacaggcttgccccatcttcaatgctagctctgttcactgatgtatgtgaaccaatgcattattaggggagtgaggcagctagctctatttgcctagacttgaaatgtcgaacttaattaagtttgtatgtataaatggttgccacttgaatttggtagatcgtttcactcttgccccatcttcaatgtgagcaaggtctccaacgtctagaatcacctgacctggttaatagttttctgctggaaaaatatgatgctcctcacagtcctctggttgttggggaaaagtgaa

SEQ ID NO: 95495 - DNA, 605 bp, Oryza sativa
caccggtggttggaactcgttgttaaagctatgatcttggtggtcgcttaaaatcgagggaaacctaggtggttgcttggaggctaaatacttcttcctagttgtttgtcaagtgaggcaaggagttaattgagacctagctctctggagctgctcaatgagagtagatccctgtaatctgaatttcggaaaaaaaaatcattgtctccccatgtttttggtccatcttgtatgtgtgttgatttaaatgagctaaccgtggcctgcttctattcggtaactatcacaccatgaagtttccctttcctagccttaatgcatttaataaatcaccaaacgaaattgtttaagttaacctagaatgaatccctaattaaaaactctatctaataagtggaaatggcttggtgtgatttttcttgagtttcccttgccaaaatatattaactggttcttgccaataaccgaaaatattttttaatagtattgtataaacaaagaaaaccagatacatgccctaagttttataaacacatttagagaccttttaagattggaggaaatttgaaatatttgaaataaattatgctaaataagtttttaaa

SEQ ID NO: 95496 - DNA, 574 bp, Oryza sativa
tgatctaaaagttatttttggtgtaatggtacaaatgggagatgcagatcactattggtgtgcaactgacaacttacatctctaaatgttttctctaaacaactcccatatcagaatgcctgctaagacatttctaggttttactttacaactgtgcaaatgataagtgttaattccttgggtgctgatcatctcaagtctcaacataatgatatttgttttaccgagatatgacttctggtgataaggtatggcccattgtccagtgattttctgcttaatttatatgttactaagaatgaggtccggtgcaattagaattcatgttgcgttgtgtcacgactatgctaaattatatatttttcatagatggtgcctcttatgagcataaattatactgtcattttctcaagagatccaattaaccatcatttttccttttttttttcaggattttcatataatgaattcagtattaattgttcagtggaacagccaagaagatatgattatggatccttggggtcatattcttgcatgtgttctgcagctacactatgtataacgaaaacac

SEQ ID NO: 95497 - DNA, 653 bp, Oryza sativa
caaacataaaaagtaagctggtatgactttatggaagaagaaaagtagggagatagtttggactgtagattaatcatctaaaggctaaaaacaggtgatgtgatatgaattaattagatgaaaaaaaggagaaagataatttggaccatagattaatcatttaagtactaactaagtgaggatgaactataaaagtatataggatatcataaaacataataaagatgtacattgaaacattatgtgaattatgttggatgataatttaacatgtttgtatttgaaaagctcttaaattataaaaactctaaagatatagcatgtttgcataatgtttaaatgtgatgattgttagtggatgatgatgtgacatcttgttaattagtggatgatgatgtggcatcttgttagtggatgatgatgtggcatctttgcatgtcaagctcaaggagttagtgggggataactttatagtaagataggattttactggggccaaggccctacttgtcatacattaaatttacctttggcgatatgctattgctgttatataaagcctaaaccccataatcacaaagttggagaagaaactcgaacaaaaatgtcgcgaccggaaaaaatgctttttcccgaacgctagtgtataaatc

SEQ ID NO: 95498 - DNA, 586 bp, Oryza sativa
cccaaacttccaactttctatcacatcatatcacatccaaaattttcctatatacataaactttcaactttttttccaaacctccaactttccccaaacttccaacttttttttaagaaataaacacacagccctactctttggccggcccggcaaaaaactgagcagcagccgccatgaactccccaccctcatttctcattactgcaagagaaattatttattttttagaccttttaatttttagattttaaaaatagtccttttcaaaaataaatttttttggccacgccagtcgaatgggccaacgtcgactgttgataggaattccttcaaccctatctcaaaaccaaccttgtccttgtcgtcaaatgtctcctgataaagctattaaaagctaatttgttagtctgctgtactagtagcagtgacaatcattcgaagtactgattttgtatatctatggcgtgccacacaaatactgcggacaaaattttttgtcatcggattcttttaggctcgtgctgattttaacgagagattgggaatttaaagagatgggattgctaacttctttgtttgatat

SEQ ID NO: 95499 - DNA, 502 bp, Oryza sativa
attatcctctttggactcagagaagggaaagtggtagcgacataagagcatctctaacagcctctccattatactttccaagccaaaatttagccattcatgccaaaaaaaaacatgctccaacagcctctccaatccactagccaaatttggcaagccaaaagccactagccaaccatgggcccctcgcacattcctcctcccatctcctctccggctcctctctcgctaacgtcctgccatcaacgacgccacaaaggagagaggcgtcgtcgccagccgcgaccaccaccgtcctccacgaccgccgttgtcccccgcgccgtcggccgccgccatcctccgtgaccgccgctgtcctccgcgccgtccttcgtgaccgtcgccctcctgacgtcgcccaccgtgacctctgccacgaccaccgccgtccgaggtagagggcgtggggaggaggcagcagtacatgaggaagaagagagatgtatgggtggggaaaaat

SEQ ID NO: 95500 - DNA, 577 bp, Oryza sativa
cttcgccgccacgcaccggaactgtcacagcacccgccacaaggaggaagaaaaccagaggaaagaaaggacctcagccggttcggacggaaagaagccctccctgcacagcacacaaacaaaagatgaagcaagcataagatggatcaagaaaaagaagaaacaaaggtgtcgctgacctggccaaaacgcgaaatcacacaagaaggtgtcctcctatcaatcggcagtgaggtcgctgcaagaagcacacacgaagtaagcacaaggaactccgccaccaagcacagtcgatgcgaggatagcacatacctcgccatagccacgaacagcaacagagaggccggagaagaagcggaacaaaagggacagcaagacggaagagcagtacagtcgaagcaaagaggattaggctggagaagaagcggaagaaaagaagaggagaaaaatatggcgcctttcttgcgtgggacgccgtctcgggcagatctgtaccacgttgtctaacaccgattggccaagcagtacatttgtggggcccacccctctgtccacaaccaccctcgccataaaaaat

SEQ ID NO: 95501 - DNA, 592 bp, Oryza sativa
ctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctggcccgctgacttttttatatagtcatggtgctgtttgggtttttaagcaattgattggatacaatatcattgctttttgccacgtaagtgtgcatttttattgaccaatattatggcttaggctgattatatattgtgatcatttttcaggcggttggtaaatcctttatgagtttatttactcggattttataccacatatgccatatatttccaggtgtggtggaaccatgtgtcttctagggacttaagcacatctgttaaagcagtgtgcgcatggcgtatgcccaatactttggaaatttctttattcacaacatacaagcttccttatagctattttgctatgtgaattttcaatgatgtagccaactttaggttacactcatcatattttacaaagcagtcggtatatcacttggatcata

SEQ ID NO: 95502 - DNA, 528 bp, Oryza sativa
acaataaataattaggtttgtcacaattaattaatagtatgttgtttgctgcattgattatttatatttccatatgattatgtgtgtgtttctcagatattgtccattcttgtcccacttcacttttctttctttgttagatggcggcgtcagctcaatttgggatcgaacctagtattgaattcatgatattgcctgctacatgctcatgagagagattgaatgacagtgacaatttcaattaatgtaaaatctaatctgatgaggggccggcttattcgatcgtaccaatcaagctagccaatagaaattgtgattctctattattaagttatttcaattcgtcatctattgtgaaaataacactgatgaatgatcatggaaatatttccatttattgtgttaaaggccaaataacaactaggaatattgaaggggtaagatttataaaaactatttattgtaattaaactaatatatccgatataacgtttggtcgcaaatgtaaattattttgatcttatacta

SEQ ID NO: 95503 - DNA, 504 bp, Oryza sativa
tgatataaagtagtatcggagtattagccgattcatgctagatctatctgatcggttatgctataaacatatatagtcctgttattaatatatatttcggtctaagtggtttatactgtctcggcatggcgaccgatctatcccaatcacttgatttaagtatatatcgatataaggagtatatatcgttaacatctacagccgatcaagtagatttagttctttcttacttattcaagattgccgatcgatacacatattacatcggctcagagataaatgatatgtcatcggcacttagccgatcggctatcatttatagatttaaccgcgatttctttgcttctacttcttgttggttacatgatcaaatcaactggcacgctagcacacccgtaggcgagctttggacctgcactggagttaagcagatcttccaggcctcgtgttttctgtcaacaggaaggaagacgactacattttttaaatagtagagataaaaat

SEQ ID NO: 95504 - DNA, 1216 bp, Oryza sativa
tctcatgtggccagcatgactcacgcacccaacttatagcatatccgaatgtccattcgcaatcatgtcgggtgatcaagccgacggtgttcgcgagaaattatccgttaacaatcttttctcgagtagtccagccatggccgatgctatgaggtaggtcgtcggtcttcgttggtaggttgggcgcgacgactctgcatttgtcgagatcgttctcgataatgcggtgtactcgacgacaacctactcgggtgctcaattgttcctgaagaatattttctagaaggcaagacatatagcagagaatatcgagtatgtactcaacaaactgcatggatcttctagcattatcaggatataacgagcagatataaatatcaggcattatgtagaccataaacaagcatgatttatacagaagaaaatagagcgagcccccagcgttagaccgtagtcaatttaacatcggggacacccgcgcaacaaatattgtataaaaaacatgctctaggtaaacataataaattattgatctgacaacatctgaaaataggtacggtaaattgtgtataaaatattgcgtacctttatagatacatgccggatgtatctacgggattagtagattaatttaaaaaatcaatctactatataccttgatttgcatgcccgacatactatcaatagaagatataagtatgcatgcagtagacctggacgtcaatatcttgctgtcttggaagagcaatgccacctgtcgcatgcatacatgtgtctaggcatgtgtacgtggcatggttaggcaagcacgcttggttgaccaattccggctagcacacggcaagttggcgacgcagtggcgcctattctcggagaatttcgcgcggcatgcatcgaggtatattggttggtgggaatcggcgtcgtgtccggcctgtgcgcagccagccaataactcacaccaattgatgtcgtgcacgaggaggaattgatattggatcggttttggaagctgccgatactgaagattctccacggtggcgatgacttgatgaagcttggtcgatctcgccggatcgaatattcgacgacgatggttccgatcttgttggacgacatactccggtcgggttagatctccccataaccgaagttgtcaagtagcttgttgttgaagaatccatctcttaaacccatctcgtcgaaaccctgaagc

SEQ ID NO: 95505 - DNA, 1079 bp, Oryza sativa
taagacatgaatgaaaaatgataaataagagatagatgtaggggtaatagattaattttaacgatttatggatggttcaaacatttctggaacttcgttaattaaacagagcctaattaatgcatttcctattaggctgtgatgtattagactcgaaaaacccaggcctctaagcaagtaaacacgaaaatacctaaattgtgatcaaatgtctcactatttcgaattaatacctgcagtcagatagcagttaattgcccattctgacctctgaacacaccagcctttacacgaagactttaaccctttccaaattttcttcaaatttattccaaatctaaagtaaggccaaatttggtcgtcacactaactagcagaagttcaaatcaagctaccatatccagcagtatataattaaagaagttcatctctaggaaaataaaatataatgaaacccatccttaagttagttctaaaatcatcttttttgcaatgtcattttttttggtgtttttcgtgcattttcattctttctgccacaaatatcgtatagcgtgatacatataaaccagatatcatcaaataaaaagatttttgcagacaaggctccctagtcccaataggttgcaggcaggtattaactgctcctgcatgaaaaaattactcccctcgggattggttatagggccgcctgcgaaatgcactatcacggacggacgcttaagaccattgcaggcctctgcgaaaatcgccgttgtcatcacaggcctaaaaccacgaatagcaggttgacaacggcggcggtagactatggcaagcacgatgacactagtggtggtggtctagggtagccgatttggtgttttgaaattattttcacaagcggtcggtataggtgaccacatgtctcacatgtggttacgctagctgcatgcaaaaaaatgggattttcgcatacacgtacacctggtgtaggtggaccgtctggtcatctgcgaaaatcgattttgatcttatgcaaaaattgattttgtagtattgattgttactcgtcataaaatttaggcaattatgtttgt

SEQ ID NO: 95506 - DNA, 897 bp, Oryza sativa
aaaatggtttttaattatttcaagtttttgttttctaatttcagattaaaatgctttcaaggtaagagggcctagtgattcctaaataactgcagtcaccaacctctggtgaactgttctgtaaattactttgttgtgtgttcttttctacttcatttaactttattttttctcctttttcacgtgcacgtttaatgaactatataaacaatacagtttttacaaaagttttccgtacggaagttttttcacatgcacgtttaatgaactatataaagaatacagtctttacaaaagctttccatacggaagttttttctcctattttcccaacttctctctcgcttttcattttccgccgtgttttgctccaaagttttcttcaaattttcaacttttccatcacatcaaaactttcctacacacacaaatttccaactttttcgtcatatcgttctaatttaaaccaaactttcaattttagtataaactaaacacagccttcataggcataggcatgctttctgaacaaatgtttaaatgttacgtttctaaaaaaaaagaaactttataaaaagctgcttttaaataatcatattactatccaccattcctaacccccctccacagaacagtgcctcatgtactaaatagaacgtactccctccgtcccaaaaaaaaaaaaaatacaaaccctaagtttccgtgtccaacgtttgaccgtccgtcttatttgaaaaaattatgaaaaaaattaaaaagataagtcacgcataaagtgttaatcatgttttatcatctaacaataatgaaaatactagttatagaaaaatttcatattagacggataattaaacgttggacacggcaacccagagtttatcttttttttttttt

SEQ ID NO: 95507 - DNA, 627 bp, Oryza sativa
cacaaagaagagagtactagagacatattcagaactctgagaagactataggactgaggctcctaagcttatttcctactagaaactatagagaataaagtggaagagagaattgatccttgatgtgtgtgttacaaagtgaagagagctccatttatagcctctcaatagcagttgtatgacggttattggtctgctaaccatgcataaccaccatcaggagttgctgtagagtcaccatgcactacaccatgtccctaaacttagctacatcctttgtcggaaatgccacctctagcatcggtggcgggggcaccaagcctggttcggctgaaccctagccaccacctttgatgggaggatgacatgtgggcccctatgacggttccttgtagttggtctgatccaaagtcggtttgcgctgacttgtggacccattaatcctcttgctcgcacgtgatccaatttttcataaaaaatttttacattatctacataaaaaaattcacattacgacagaaaaaatcacataaatataacatatgaaatattcacattatctcacataacaagttttcacattatatcacaaaaaaatttcacattattcacattatctcacataaa

SEQ ID NO: 95508 - DNA, 514 bp, Oryza sativa
aggtggaggtggaagaaggtagaagggtgggggtttgggggcgtgcgtgtgtgttgattgggccgcttcctcggctgggcccaaaagcccattagggtagctttgctctgccgcggttgagagatgtggagattatcctggccgtccgattagttatggacgtcttccctgtaattctggatgttccttctaaaggaaagacatggcgaattaggtatctgacaaacgcgctccgacgcataatgataagggccaggttagggtttattctaagcactttggttagcgatgtaacagattatcctggccgtccgattagttttatggacgttttccccggaatcctggatgttccttctataggaaagatatggcgaattaggtatctggaaaacgtgctccaacgcacaatgataagggccaggttagggtttattctaagcactttggttagtgaagtaactatgttctccgatcaatagaactagtcgactagcattcccttaaaaaaaag

SEQ ID NO: 95509 - DNA, 537 bp, Oryza sativa
tgtaagtttccatagttattaaataatatatcttcaattttttatgcaaagttgactcaaataaattaatagcacacaccttgctctgctcgctgatattggaggactccaccacgaagtgcttgctcggttcagcactgtggttggccattgtcccctgccacaggtcacctccctgcggataagaagcattcgacgaaaaggaggccttggtaatggtagaactgggtcgtcccatgccataagtcacattggagctcatcagcttgccaattttaccgcctcgcttcttctccatttcaacaccatcgtgaatctttttcttgggcacaacgtcaatgaaccaatcttcaaatacgaagtcgcctccttcatcatccaaatcaggccagaactcatactcatccatatcgggcccatcctgggtatcaaagatcacgttcttgccttcttctaaacatcggccagattcacgatgaaaccacttgcctcgaacccgctgcccgcaccacatctgggcaggctgtttgcattcat

SEQ ID NO: 95510 - DNA, 527 bp, Oryza sativa
catgtaccaaaagattgtcaattcagttttctgctgacgaagaagatggctaaccaacccgccagttccaacggagagaagcatcaaggcaacaccaatcctcgccaagattacagtttcagcctaactccagtgccaggacagaggaatcaaaatgagaaaagaaaatgccgagtccgggaagatatctgttgcttcaattgtcaaggaatgggtcatttcgccgacaagtgcccaaaaccgagaaacatagctgccagcacgtcagtccacgcaactccctgcaatcggaagcttgctcctcagcgaattgtcatccatgcatcccgaagcagtcctatagcccgcgttgcaacagctccaactccagcgagtgcattaccacagccccagccatcagttgacaagacagaggccagtatcggcattgtacctttggatgttccagcacagcagccaagaaatcaagtacaggatgaagaacccaagcgtaagaaagttatttacaacggtagtacctgttaagg

SEQ ID NO: 95511 - DNA, 579 bp, Oryza sativa
aatgtggaccgttgatcaagagaggggtaaggtatggaataaaaatatattgtaaccaatggtagaggagtaattaactagtgaaatattgccattatcgccgaattgaataccttgctccgttgatcggtactgtacgcttgtcgaaacaagatttcggcaatactaaaaggggtggctatcaagctggaaaagtggatgggtttagagacaaggaattttatacaggttcaggccttcttaatcaagaagtaataccctactcctgtccggggattgatccgccgagtgtattattgattatatgatatgggtgaaagtcgtgcccctagaggcacccggacccctccttatataggggaaggagtccgtattacaaaatacagtccatatccctaacggaatatgtagttacagataaaatacaatcgtaaccaactaggatctcagatatttccttgacatacaagtttggaatttaacccgagtccttttaaatatattctatctatacatgacaccccatacccagtcagactatacatgccgtgtaggtatggggtatccataaactccaca

SEQ ID NO: 95512 - DNA, 850 bp, Oryza sativa
catatttttgcgggcaggcctgttaagaggcccacctaccactagccctccaggtcgagctcctccttaaaatgcataagtcctttcctcatcctcgtcctctactatcctctcctccacttcctttcttcttcaccttatctccctcacctcagcctcctctatctctctctcggcagaagctcggcgtcgacgacagtgcgatgtagaggtgagttcagcagtgaggcacatgttaatgttggtgacaggggtgaccatcggcctcgatggatctaccgttactggtgataggagggtcagatatgcctccactagcctcagatgagcagcaggcctccctagcttctccatttccatcatcgatctagcggatgcggcctcaagaggtgcggatccactgccgttgaactcgggaggggctggcctccctcgcctctccttctccatcgtccatccggcggcggcggcctcaagagggccagatccaccaccggcgcccttgggagcttcatatgcatccagtcaagctggggacggtgggagcagaggcaacgagttcggttgcgatggcgacaatgacgatggcaagtaggacgtcgctgagcagcaaagaccagtccatccactccagcgagggaagcagagaagcgtgctttagtctgtggtgacgttgatagtgacaccgacgacagcagtatggttgggttggctagggtttttagattttgatatctttcggaatttttttgccaaattttgttttttgcataattcattttcgcatccggttcagctaggcgcctcgaaaattactaatcttcatacacatcgtacgagtgggtgagcg

SEQ ID NO: 95513 - DNA, 594 bp, Oryza sativa
tcacaatttttttttgcaaatacattattcgctttttcctccaatatgcgacacgacgtggctaaaaatttgtcacaaaacaagcgtgacaaaaaaatgaggtaccttgttaacgtatgattaatgaagtatgagctacaaaagacttaaaatattaattaatatgattttctaaagcaactttctaaatgtatttttaaaaataagttcaggaagcgtgcgtatggaaaacgaaagggtggaagtgggaaaagaggagaaatgaatgcagcctaagtttacctttctcgccaaaaaaatatctacattatttactgatgttaaagaagatataattgctaatagggatgatttagatattatatagtataaatctaagaaatagcataaatgtttatcaaagcaacatagtataaatctaacaaatagcataaatgtttatcaaagcaacaccattcaagaaattttatggagaactcgtactttagatgtcatttatatgtcttgtcaagcgtagcctacgatgcatggccgtgcttcacatgggctacctttgtagttaaagaaaaatgcttgtatttgatatggtccgag

SEQ ID NO: 95514 - DNA, 2193 bp, Oryza sativa
ttgctagcatgtgtctcacactctgcactccctatgaagaagaccatccaccaggggagtgtcccactcgcaaggtgacatgttttctgtgcgaaggagcaaaccgtgggcccaaggattgccaactcagtgtgttgttgaccaagaccgcagaaatccaacgaacaaccctacgattgtctcgtcagctagtcagctccaacaacaacatcgatgatatcatccacagcaccaatgctcctcttgctccacctaactctgcaataaatcatggcaataataccttcagcattaaccattctctgcaccggcagcctcagcaaggaattgtcgtcgatggaaaaagttgtgtctctccccgacctactccaggccaagcaaagggcaatcaacctccggagggcgataccaagcagaagaccgtcatccgcttcaaacagcaatcagaaggaagcttctcctgtgaatgatagcaatatgcagtcctatcacataatcacagaaccaatcaaggatgatgcagtcactagaacaatgccagctatatctctccagaatcaaaatgagcagccatgtttgtggttttcagctcgctacttatcatggtgtaatcgaaagtttgcagcaatcatgtaatacataaatatattcatgtctataaacagtgagcttgctatgcttatggatgattcatgttgaggatacaatgtaccgatgttaagcaccgtccctttttgtttaaggcagtgcctcgtattcatgtaatgagggagaaatgtgtaatacagacaagttccatgggattcttttggaagagatcggaaaagatgtttggttactgggaaaagaagtaggtcgaaaggtgattgataaaggataacgagaaccatgatttgtgtcactcgaggaagactcccgatagcaaacaaccctacaacagttgccctgtcattaaagtaggtgaattcacgagtaagagagatgaccgcaggtagaagtacttctatggggacaaggatggaaacttttgtgacatgaccaagaagtcaagaagtaaaacctgaacagtggaatctaaagctcggttcaaccttgggctttgtatcagatgctactagaataaaagcacttgcaatagtatcgctcaacgcattttcctagcaatcgatccatcgagaaagaacacatcaaggctgaaggtgcacaggaatacgttgaatgctaaatgatgacaacatgaagagaatagcgggaagtaaactgaacataaagaaagtgaatccgagctgcttgttcggaaagccattcccaggtatagaaaccagtgattggtttaagatcagtctacaaaggccagatctaaatcacctctaacaacgaagcttcaaaactggcatgatcacgatcagacaataactagtgcagcagcaaagtcattcgggaagacgtcaaagcatgtcaagcgggataaattggttctcttgggaagcataacttatagttagagtggttgaccctggaatcgaatagcagaagtagctagcacccggagaccaggaaagctaatatgaggcagttaggggcaagttgccaaacatgatatcctagtaatgacaaagctgatgtcgacgcatgtcacgaaggtggtaactggtatgaggttgacgccaaagatatgaatgataagaagttctagaactgaagccccatcctcaaccaccgcagcctagtctgagtcagttaaaggtgcaaccagggacaagtcgggtgaagagaagatttcttctgcaacaggagatcgagccaagcagtccagagcggaagaagtcagacaagaagagaagaccgcccaacctatcttcttgctagccccctcgaatctcggggacgagattcttgtaaggggggtggatttgtcacgtcctgataaattcatcccgaaattaaaaatcattcgctaaaaggaataatagaattaattaaaattcgaaaagaaattggcaaacactaaaatacgtacaagaaaaattcaaatgcggcccggagaatttttgttaaattctccttggtctaaaaggagcccccaaattttacttgaattttcagagcacaaataataattattaagaaataaacaaagttaaaaaggttttataaaaagaaaagctctaaaaagtcttttttccccccccc

SEQ ID NO: 95515 - DNA, 732 bp, Oryza sativa
ctatagggcgaattcgagctcggtacccttttttttcttttgttgcaatatttgtagtagaaaatcaaggcatgacacactttgatactttcatggtctatagattccactgtccaatttcataacactgatatttttcacaatctttaagtacttatatatatatgtggatgcatatatatgtttctccttctatatatttgcattaactaatgtaatttctaacaaaagaagaaattaatatgatgttgttaatggactttctgatgctggggtatatatgagacaaggagaggctaggtctatacatctcagacattcatggaggctgcgtcatgatctctacatgcatattacatatttttctaccaccaaatacagaacatttactcacattatcactgtttagttaatgcataatttgagacagaatgcatatttgtggatatgttgcattgtcaagcacaagaggattagaaatattaatttggattctgcattatttaattatttaaatttgtatttgcataatccttgtaatagagaatcacagatttcattaggacattgagtgcaaacacaagatgaatctgccccttattcgccacagtaattgtcaatctactaaaatcttttttttaacgactcgcacaagacggtgcgaagttctattgatagagcaggagaaaaattacaaaattacaaccatggaaggtcgtaaccaggaaaagg

SEQ ID NO: 95516 - DNA, 717 bp, Oryza sativa
aataacatgttaccgagagattcttgaaagttacatacaaatttcattatagttacagtgtaattgcatgcaagttacagtgtaattacactacgattgtactgtaattacatctgacaaatttttggaggaaaatttgtcgacaaatatatagcaaattcgttttaacagtgtgtagtgtctatttggtttgaaaccaaattttgacatgcctaagaaaataggccatttcaataattaacttgggctattttggcttcaatccaaacacaactttgcctagccaaaatttggcatcgacaaaaattggtaaggccaatttaggtcacaaaccaaaccaggtgtcaaaatctacgcgaattttcgcactactaatgctgttccctctataaggcgcggttaaagttaaaatggtctacaaaactaatctttagttcataatatcttatatattataaggtttgtagcaacaaaattatagccatatacaagtaaatttaaatatcaatccaatgatataatttttaataaataaaattcattccatattatactatgtatgggtcaaatgttttacacgttgaatcttgaaatacgggcgcgtcttatattataggagggaggaaataattctttggtaggtagagtaatctgatattctagagccgacgggttttcatgcaaatttacgcagcacggcgcactatacattagatg

SEQ ID NO: 95517 - DNA, 628 bp, Oryza sativa
ccaagctgtacctcctcatgaaacgcttggacgaccacgagaaaaggccacaaggcaccgtcaaggccttggactctcacatcacgtgtgaggtctgtggcggcacggatcattctgggaacgactgtccggaaacctgtgaggaggcgatgtacatgggcaacaacaccgggtaccgtccacaaggaggtcaggggtggaaccaaccacgcccatattatcaatgaggtaaaaacaacggtaacttctctaaccagccctctcttgaagatcttgttttgcgcaagatgaaaccaccgatgcactaagcaaaaagcttgctgctaccgataagatcctagagaacataaaattcaaattagatggctttgcctacgcatttcaaaactagatgagctttataagatgaaagaaacccagttagctcagttagcatccttagtccctgcaactgaaactgggaggattcttgggcaacccgactcctccattgaaaatgttaaggcaatcacgacgaggggaggtaagtccactcgtgatccgccgtatcctaaccttgcaggaactaatgggatatcaaaagaagcgtcatctaatgactcggctgacaaggagattcagccagaaa

SEQ ID NO: 95518 - DNA, 1226 bp, Oryza sativa
  unsure (1)..(1226): unsure at all n locations
gatcatattaaagaaaagattagggagatttagaggagaataatttcacatctattaatgagtggaattaatcccctgtaacctcgatctaataggaaataaccgaacaaagagaaataaaagagacatgtaggctaatatttttatttaacctttcacataattttttttctattaatccaaaaatgaatgttatttaatcagcactatgtctagtaaccaatatacacaatttgagagaatctaagattgacttgggaacatttctggattgatgccaaaatatgccataccaattatttggcaacttaaatagtatgcgattggtttggattagagccagagcattgctaatgcccatactttatttggcaatattctagaacttccttcactgatatcaaacacatgaatagcaaaccaaatatatatactactagaaaatttatgctcctgttggcgcgcctactgattaacccgtacatgcgaaatatgtagcgatatagcctcttaatagtattttaatttccgttatttttaatccaaacggatagtatgtcatgatcaagctttaagataaggtgtggcttggttagcagttggagtagcacacagtggtaaagctcgagaagctttaccattgcacgtcatcgttgataggaccgatcatttttcaaatgatttcatgatgtgccaatagtaccttgctatgtatttaatttattttgcattaacatttgattttgatgctactccatttttattttttaagatagttttttttacttgatttagttctctatacttttgtagtgctaatattttacggatatataaaagtggcatttgtttactttgatgtcaaattctgtagncatgtaagagaaaatttggggggaagacattggtatatacttgaaatgttccttaggtagtaacctcttgttacatagttgcataatagatttattggtaattttttaattgcttggaattgtgtcatcctttatacaatttttttggaattttaattttgtgtactaaaagtcacatttagatctatcatatgacacgtataagttaatagtacattggctcataataatgaagagaggaaaaaaaatcctctcaaaaaacaagagaaaaaaaaaagaaaagacaaacaaccaaagaggcctagtcctacccctctcccactggctggcacagctgagctgcagcccagc

SEQ ID NO: 95519 - DNA, 579 bp, Oryza sativa
tgattttcgtaagctgtccttgaacgatccgagggggagcgatttttgcatacggtgataattatagtctgcctacaacctaaaagcggtctcatctgaaaaattgattcggtagtagtgagtaaatcggcacatatgtgatttctgtgagaaaaggtaaattttatagaattatatctaagttactgttggtatttcttaacgacattactagaaatattcattctcagcaatggcgccagaaattgtcctggtatatttatggttacagaagtaatccgcaagcgcacggatataccattgtagcattttacccggaagtattccacggtattgtatttttaatcccaagggaagataataagagtggactatgctaatacactttatacatatgttacttgtaattgtcaaagcctaagcaggggttaattttcatataggggtagaatgacacgaagcaaagctaatcaaatcctcataataaagtaattctaactaagtggaagaagaattagaaagcattcaattcctatacttctagtatacactcaaatcctagtttacatcggctagtat

SEQ ID NO: 95520 - DNA, 749 bp, Oryza sativa
aatcccatggaacatatcaattcacgtgggttgcctgtaaagttggagtcattatggggacgtagctagagtgttggagccatcacacgggaatcaattctttgattgcgcctattccaatggcaattggcaactaagggaatattgttcttgtaagcgcctccactctgtattatgagccacaatatgatcccactgtcaaattgcccgcgctcatcggggcacacagttgttttaatttatttgatcggttaagtcttgtacatgcgttatgccacgattagctcgagcaatttgacagtgggatcaatttgagctagctaatatgttaaaaaacgtactattgcattattgttgactactccctccatcccatttcgagtgaagccataattttctgtgctcaactttaatcgtccattttatttaaaattttttttataaattaaaaaacataagtcaagcataaactactattcatgttctatcattttataacaacgaaaatactaattataaaaattttcaaataagacgaacgatcaaaattagacacggaaacttatatggttacatttaaaaaaggacggagggagtattttctgaatcgcgtgtgatcttgtttacgacaaaagaaatcggtgtgagacttacattttggaaaaaattgggacatggcacatgttggacaagatttccatcgcgaaataagatgagttacttgtttgagcaatttgttttaagataat

SEQ ID NO: 95521 - DNA, 1094 bp, Oryza sativa
ttaattttgatacggcaaccatatactccatccaaactaaaatatatatatagctatttctcatgagtggcatatcaaagatagaataactaagaaaaacatgaataagattgaacgtacagagacatatgtacatcactagctaggactgcgcgcgggtacactgaggcgtcattttataattaagtgcctccggatcctgtgaaactataattttttaatgttttcttaagttgtcacagtgcagattaatattactaatttacatttttactgatgtagatataatagaagaaagcttgctgccggctgactttactgaaaaaaaaatcatattccgtggagtcacctcccagaccactcaagcggccggccgggttccatatcaccggccgcgcgtctccatttgctgattgccggatgtgtgttcagaaattaaacaaggttggtaattgaaaaatgtcattatagtcgtctagatttatcggtgtatttggcttcgccactctggatatgcatagagtggtattaatttaatttagcttaaaaggcagccccatgtatataaggggctaattaattatctctagatataccctaatagtatagccaactactagatccaatttatctatagccaatctaatagctcattcatacaatagttatatactacactattaatacctggtcccacctgtcatacacacactgcgtcttggagtccgtgctagaactggctacaaatctatagcccgctgctcttctttttcctcatttatctccttaaaatatgtttgcagctagcttatagcttgctattgtacctgctctaaacaacatccggaacaagtgtagccacacttataattatgttatccgagtggacttaaatatttaatgctaaatcaagaccttccaccgtggtttacgtcagtaccactagtcactcatatggacgtacacatcaaaaaacatcccttttaaatgatgagattgtcgtagaactatttttttattaagttcattttactcactaaactacatttgccacagaatttaacccggaaccctagctaactattttcaaactc

SEQ ID NO: 95522 - DNA, 1278 bp, Oryza sativa
ttggtatttcttaacgacattactagaaatatgaattcccagcaatgacgccagaaatggtcctagtatatatatggttatagaaggaatcggcaagcgcacggatataccattgtagcatttcacctgggagtattccaaggtatcgtatttatttaatgccaagggaacattgtaagagagaactatgctaataatgtatatatgctacttgtatgatcagagtctaagcaggggttgatatattcataacggtagagtgacacgaagcaaagaactcatatctctcattaaacaatcctacactatgtggaagaagaaatagaaaagcaatcaattcctatacttctatacactcaatcttagtttacatctgctagtatacaactatgtagccaataccccctaacagtgccctcctggtgtttcgagagaccaccccgggttgccgagttccttacgacaacctatcatgaccgtccaaccggggctaaatacggagtagtaccctccccaggaatttctcttaggaatatgtactaacgtggaggaatacctgcattgagctgtcaccatcagaggcccacctctactatccccgcatatatccctaattaatgatatttaataatctaagtaccgtgcttacattactaaatactactctacacccgtgcacatgacatagaaactgataaatcagacattaaacccgcaccattgcacctctctggatggctacccacaaaatcggtacaacacagatataaggtaagaacagtactcagactaaacaaagtaccgaagatatataaagaagaatatttcattaaaattgaaagtattacagaaaagaatacaagagctgctagagccataccgaaactctttcgaagactccgaggactccgaatactattctattctactccacttagcactaaaatactaatactaaagtatgaagaggaatttgagctaacttgagtgtgttgagagagtgaatgagctcctccttttatagggccggtatgacggttgtaccaatgcgaattgtgcattttaccctcacaaccgtcattaagagtgcatccggatcgtacacgtggagggccaggctgattgggcaccgccagttcggacgaaacctgggctagcccaacaggcctacagcttcggtacagtctttgacaggtgggtcctattgacggttttgtagttaaggcggtttccaggacgggtacacctggcttctgagccctttcatccataagcttg

SEQ ID NO: 95523 - DNA, 559 bp, Oryza sativa
  unsure (1)..(559): unsure at all n locations
ttaaatgctgtttactgcaaaacttaatccctatattattattcccttgtacctcccttgcattaattatgcatccgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggcctgaagcgcctttgtaataatgtaaatattgtcgatataataaagatgtgtcttttatatcatgtttgtgtggtgtaccccggcttttcctgggacggngattaatacactagcgttcgggaaaaggcaattttcccggtcgcgacagcgcgccccgctccctcggctgacgcaatanataggatttttaattgaaaaataaatgaagaaattcgccaatattcatttaaagagcatataaacttcaaatgggcatatcttggccatttgaactcggaattggaccgttcaagtctctaa

SEQ ID NO: 95524 - DNA, 594 bp, Oryza sativa
tcaatttcaaaagtgaaaaacctagtctaatcaccttcgttgttttttgcacttaggaacattcaaattggggggtctccttgcattcttagccatcacaactagctttgggactaaactcctgtgaataaacttgataaacacgttagtccgctttaaccaccttgtcattaatcaccaaaacccactagggggtttaagtgcatcttcaaagtccattccactaaaaaaattaaccagttgagttacactcacttcgttgcttcggtgtatcatgataatctcaattcaacttttagacattttcatgtttgccttggtggtttccagaaaagtgaaaaagttcttagctttttattatgatcttttaccaaacaatctgtagaactttttcaagatcatttttcggtatctgatttacctttggcaaaatttgctaaaggacactaaaagtttatggtctttgctgagacatgagacacagaaagagcacgtatcttttcgtggacaccacaaaaacttggtattgctggacacccgatgaattattttattatattcagtcaagaaggtgagagaaacttaaataaaagg

SEQ ID NO: 95525 - DNA, 767 bp, Oryza sativa
aaataaagcaatactcctaaatggtgagtaaaacttttgtctacacaaaggatgagatggaagacatctggcaaacaagatctattgctgaaggaggttgcattggatcaatattgagtacataagttcactcatactatattgcttcattacaagataatgcagtagtgccagaacaaaggtggttattcacaaaataaacacagagcagaatcccaatggaatcaacatcaagctaataatccaggactccatgatctgaacatctaattctgtcaacattttagccttaattttgtgcaaggcaaggcaaccactccatacagtataatgtttcatactaaaaaaacgccttgtattacaattcatctttagttcaaataaactgtctaatgcaccaagcacaggttctgattggccaaaacgtaatgttcaagttactaaatgtaaatcactgtaatgcagattttcacacgtaatattcctgcggttaatcagatggcaaattcagagcaggatggctgtcagaaaatatagtccactaagttatgcagcaggttcgtggtttttctcggccagtttggttgaggcttcttcttaatgaaaagccgtgggggtggtcattcccccgctggtcgacatttcttttaagttatgccgtacatttttttttctgcagttacctttgtcatagccacatacaagagttaaggattatctaaaatttccgcaagtaactgctacatagatagctagatatgaacaaa

SEQ ID NO: 95526 - DNA, 671 bp, Oryza sativa
  unsure (1)..(671): unsure at all n locations
cagtcacgttaataagcaacgcaaccataccagcgctagttccgatttacgacccggttctgccattgatgcttgcagcatccaaatgccggtgcaaaaccccgaagaaattaaaagagatgatgaacacgtccgagccagtcgagagggagatcagcaacgcgatagtgtacaagatgacaggacaggagtgnanaggtgtggggcgtattggcggaagtccgggtgcgcttttaaaggggcagcgagttaaccatggttaggtgctctaaccatgagtaggtgttccaacctgagttacgaggcccaaataccgacgtcgtcgatcaggattgagaaatgggaaaatatacggtgaaaactatgtatacggtgaaaacttaaaacctaccattaaatcgaaaaataaacgtctaagattcatctacgttatcacgggtaaaaattttactcgtaagtttacttatgagtaaaaattttattgagacttatattgacatggacgattctcgtacatttaattttcaatttaatggtaatttttgagtttctaatatatatgatttgcaccgtatatttgtcggactttctgtcccacgggaggttgtggttaacgtcggaggctcggagcgagaggaatcaccaccaaaggggatcctctagagtcgacc

SEQ ID NO: 95527 - DNA, 571 bp, Oryza sativa
ggtgttgccattggttcaatctctcaaatagtatttgggtccacatgtatgtaagataattcggtggcatgtgtgaataagaagatgaatgcaaaatacgatgcatgccacaagttattagtggtaaaaacattttttcccttgtctttcatttacatgtttaagtgttacatgcacaaggttttggggttgatacttgacacctatagcccgtttctttcttaattagtttgtttattctacttttggaatgaaagatgatatgctttgaataaattgggggaagctctaatcttcttgtgctagtaggaaaacataactatacttcttgtaaaaatattcttccatttaaataagagaaatttatagttggagttatgaattatagggacagaaataaatttaaaataatagtggtggtagtggtgaatctcctgccatgccaccacctctgctactattctttctacagaattctccctaagcatgcattttcatattatttataggtgttttacgccattcccttcttatttcgtttattagaaccacaatgtaacaagaaaaaaaa

SEQ ID NO: 95528 - DNA, 896 bp, Oryza sativa
agcaccccctaagtgtgtacaaaatgacatgacccttttgcacaagaaattcgagtctttttatgctattagaaaaatgtagtattgatcaggcggttggcctttcttacttacacattggtaatctccgaggatacatgattgcgtagtgaaagaagattactctggggggtgtagctactaaagcaagtagctgaggaagttgtggggttaaagacattgtgagaatagcacactagaacttttcgttgtggcaagttgttttttcttgtatttcctcttttttttttcctctctaatcaccgcgggtgattatgtacagttcttcctctgcttaatataaaatcagctaaggctgacttaggtttcaaaaaaaaaaaaagtagccgaggaagtgtataatgcaagacatgggtggtgttctagctccagatgtttgcaatgaagacgacacggcaggagcagagcacaacagctggaggagatgatgcctataagaagaagatagaagatgctactgatggttctttttatcatgtttagctgctgcttcctgttttacaaactactgaggctggaaaactgcttatggataactgattattctggtggtctgggaactttccttttggtcttgtagcaggttggtaagtttagtttggtggtccttttgctcttttccactttgtcagctgaaatagtgggatggcactattgcagcagctgataaagggtagaaaaaagcttttatctttatttttgagtaaagtgtacgggcggtccttaaacttgtagtggtgtgtcatctaggtccctaaactctcaaaatgcttatccaagtcctagaacttgtcatagtgtgtcatctaggtcccaaatcaccacaaccccttcag

SEQ ID NO: 95529 - DNA, 632 bp, Oryza sativa
agtttaggactcggaggtgaatcattggagtgggttagggttcggacattcgacaaagttcacgggtggggtttcaggacggaactccaaatagaagggataacttcgggattatattaggatggaaattttgtggagacgatctttgatagcaggaagatggactaaaggagggattcaaattgagatctttggcacaacttagactcagcactcaaggaatcaaaattttcgcaatagggttgtttgtaaattagcttttaacgccacgcagaaattgaggcgttatacgaatgctacttaccatactccgtaaaacagaagaagtctaggactggatgatccaaaacctccagaaatacatcaggatcaagtgctggtaggtactactaccgtataagcaaagcaggaacaacctcatgtcaaacagcataggatgtgagatgttatggaactactccctccgtcccataatataatggattttgagtttttacttacaatgtttgaccactcctcttattcaaaaaatttgaaattattatttattttatttgtgacttactttattatctacagtactttaagcacaacttttcattttttatatttgcaaaaaaaatttgaataag

SEQ ID NO: 95530 - DNA, 668 bp, Oryza sativa
tcactttgatgcaatttttaactatactatttttttagcaaagttgcttaaaaaatatctacgtttattttgttgtcaaatttagtcaatacataagaaatcctattaaaattttgacaatattatcatcttatcaaaattatattattactaaaacttgataaggtttattttggctacaatctgaacagaccctatattcgcagaatccaaagcacaaagccaccgacaggggcggagctaggattttgaaccactggggtcatggtttttacttgtatttatgtcgtatttgaaactctaattattctcgaagctagatatttttagctcaaatttcttttggagctagaggtatgagtaagttgggattgtttcattttgctaaaaataaatgtttaaactctattctataataattcatgaggttttaaggtcaaaaatttaaaagttaagactatatataaccgggcataacaaccatgtgttttttcagacatataaatatgttctaaaacttgtttattactccatctgtctcaaaatacaactacctatgtcttttaagagattaatgttagggtgcgaaataattatgattggttgaaaaaaaaagtaggtgaaaaaaaataaatcggaaaatattatgattggttgagatgggatgg

SEQ ID NO: 95531 - DNA, 1247 bp, Oryza sativa
cctcgagtttgtccatccaggtaggagcggatcagcgatggcttgcgccttgcgacggccggcgaggatgccctagatcgcagagggcgtcgcggcgccgtggtggaataggaggaggaaacctcgacgtgaggaaattattgggcctgtaggtgaggcccaacccaatgtacggttcattacagcatagctcccatacaccagtatctttcgagctggtttatggctgtacctttggttcgaatccagaaaaaggactctattaagccctatatgaaacgcaattgctaaacgtacttaaactatagctataatgcaataactatattatactcttttttccctcaaatgcagcaagttatagggatcaaatattgtatcaaatataacaatataaggcatgtaaaaggtcatttttgccacaaaagtatccatattactccctctcctatcccttggctctattatacttctggcgtacacctcacctatctcacctatctcgagaagtgaaataagtctctcttaccattccttaatacacgtgccatgctctaaaagttattacattttgagacggaaggagcggttatatttgaaagtttttcaccaaaagactgtgcgatagtttttaattagatagtcacataagaaaacatgtgagcatatgatttaccaacctagttaaaaaattatagctattgctaagaaaacatttgatagtttttctttccccccaaacatttgaatttgtaaaaaaataaaaaatcagttcacctcaaatatttgtgtggcacataagggtacagaaaaatgcaagtcgcaggggaggcaatcgaactgtgtgtaatgttaaatttataagttacactgtaactgtataagtactctatccttccacaaatgttagatttattctatatttgtagttttcatgtatctaaaactgaaataaagagataaattaaatatttaatcgaaacccaaggattcatctttatactcattggttgcatgcatgcatacactttttaatctttattacatgttagatgagttaattttcttgatcttggtgataaaagtaatatgtccaaattcttgtggatggaggggtaatatactataattacatttaaaagtttttcttttttgaaagaacccagcaaagctggttttatattatagagagaaagaaagaactatacatggggggttgcagtttagtgctggaattgcacttccca

SEQ ID NO: 95532 - DNA, 541 bp, Oryza sativa
taacgtcggaggctcggagcgagaggaatcaccaccaaattcgctgcatgcacactttgcacggttgcaccaggtttgggacttggataaatgaattcagacggcggttaactggaaattggttggattagctaagctacgaaatggatttgtcacacgcttttccttttgtatagatgctcagagtaaattatagtttacagtagttatccatcgaaacgttccacatatacacttataatttttttcctttgaaatcaacaaaaacaaattcgtggtaacttgttttcctaattagcaaatttggctcagtagatcagtgattcacagtagtcaccaccgttgtttccttctcaaaagagtatatctatatatttatattaattaatttttacaaaacttatcttttacaccaactggtactatgctcctgcttttcaacaggactaaaagaaatactaacaattagtttgatggggttgaattttatctatccacttttttatgggttgattctcgtgcagaaacactcttttatttt

SEQ ID NO: 95533 - DNA, 520 bp, Oryza sativa
ccctaggcagccggtggcggtggctttggcggcggtgggcgagcggatctgggaatcaattgtggggctttaatggaacctcaatgctcgtaaaaaaaagccactttcttccctgctaacttcttcctcggcgacatcatccccaatgccgtcgacgcctaccaatttcacagctccaccccccgtcgattcccagagccggtcgctcgccacctccaaccacctagggttagatttggatgagaatttcaggtatggggttgaacggtgagtgcgtttggttgaacctgggttacatgctactgaggttgggggtatttttgtccttttgaaatttctctctcatctttttcaccggaaatggtaacatattatctcggatgtcgctattgctaattatataaaggcaaattttgctacaggacactccttatatgtggttttagccctaggacactgcccaaactcacttttgggggaaaatactccataaacgtggtaatttgccagtggacaccgc

SEQ ID NO: 95534 - DNA, 708 bp, Oryza sativa
tgtactaattgatattttaatgaaatggacaaatagcagaaagttattcttgcaactctagttacaaaataacaaaggacattttattcttccttcaaaacggtgaaagctggcacagtttttcgagaaggatatttttttagccgggctctatatctaaccggatatatgcagccattttaatcatgaacttaacctatcgaataggaaacttagccctcaaataactcaatctgaaattcactcctatgaagatttgaactcaggaccttgggtgctactcatgtcactgcaaccactaggctacatgccatttcacgcacagtttttcttataaacacgatcactatagttaggctcacctaagttcagaacatttaatttatactgttaaacgtagaaatgcctataccatgtagtaaaataacctatgattgacttataaagatataacataaagaagaataatgtactagatatttttaaatgttttgtgctagctaacagaaactaaaaggttgagagtagttgcagcacaatttgtagctgattattatagaaaaagagtggttctccctccaatgtaatgcttatgtgctagtatatatattactagttttctatttagtcggtgatgcagtcgtgcatcatgcaaactcatctccaaccatctattatgtattttcttttgttccactttttataaga

SEQ ID NO: 95535 - DNA, 703 bp, Oryza sativa
gcgaattcgagctcggtacccgttattaattatttttaatatcggattttagttatttgtaattatatatgtccttatatggactctagactcgtcttttaatattcctttctttttaattccgaattttctgtaaattgtatttctatatagacactatgctcttcttccaatattatttatttttatttctgaattttcatattatattttatatacgtgttagttattaattatttttaatatcaaattttagttatttgtaaattatatatattcctttatggactttagactcgtcttttaatatttcttttttttaattccgaattttctgtaaactgtatttctatatagactctatgctcttcttctaatattatttatttttatttctaaatttttattatttctaattttatttctatgtggactctaaacttatttttcaatattctttaatttttaatttcgaatttcagttacttctaaattgtattcctatatttgtattcatatattgaccttaaactcttcttcccatgtttttcttaatttataattttagttatttgtaaattgtatttttatacggactctaaactctacttttaattttattatgtttattatttcaaattttagttagttttaaattcctatatggactctatactatacttctaatattccttatttttaa

SEQ ID NO: 95536 - DNA, 517 bp, Oryza sativa
tgtgtgtgtatcagatcgagaattcgagaggctgtgtgcagcttcttgatctcaggcaattgtagaggatggagaatcactattattacctctttcgtgtgagccacctgttgctgcagctttctcagcatctggcaaaaaaaaaagggaacaattttgatattttggatgaattttgtcctagaagttttcctgactatatgtcacatctccttgtgtaaacatgaaacattcagagggtagcattcaaaaacaagaagaaaagattcagacttcatagtgctatctggttcatattaacagattcaaattaactggtagttgcagagatgttggtgctaattagtttcttcatatattatacactctggtgaaatatgttcatcatgtttctttctgaagaaattaacaagagatttcacaagttgcacctggaatagctcagagcaacaaaaacatgttctctgcttggtggattattacagcaacaaaactagtaataagcaaggttgtcaat

SEQ ID NO: 95537 - DNA, 505 bp, Oryza sativa
gcaccaaggacaaggatctgatctctgcttggatcgcgcaactggctgacatgatttgctgtctatcatggctatttctggatccacatcaccagaatggaaggcttggggtgggttctacaaattgatgttaaacattgtagctatatcgagccaaagttttgtacaccttgtataaactgcagcatcgaactatagtgaaagctgcacttaacattcatctacgtaccacgatcaggactctgttcttagagcttgatgtcgtctttaaatgaagaaatttcatggtatctaactatttattatattatatcattataagataaccttgaaacacgtcatcatattcgtttgagggatttggtgcttcaagattttgacgagatgagttcgaggcagattttctgatgacgacttctatgatcgccctggcctaggagatatgacccaaccaacgtttacttttctccaagttggatccatcacttttctggtctttgctgct

SEQ ID NO: 95538 - DNA, 531 bp, Oryza sativa
tcttgacagctgcaacttcgtactagtgctaaaaaagtcagaaaaggttagaagcttgtctcctccactcagaatcttcagaaaaagatactagtagactgattcactttattgacaaaatattggttctgaaaaaaaaaattatgtgacaggtgatcagagatcatggatgtatcagtatcaggagtcgcagtcattagtttcgtttttaagcctacaggaagaacatgtttaattcctgatcgtgtgtatgtgaattgtgaaacggtgacgtaattagccaaatagccaggcatgttttggatgatgaggatcgattttgtgaattgagtttggtcaggtactcttcctcctctctgtctactgcacaacaactccaatgaaattatcatgatgcaacagcaacccagattaacagaccaactagaaaactgaaaataacttgatacataatttgcagtgatgaaatcaagttgggttccattgcacactagcatcccgactgcttacctaacagaaggaaaaaaaaat

SEQ ID NO: 95539 - DNA, 620 bp, Oryza sativa
aatttcttttaacattttaaaattttaaaaattaatagtaaaccttttagtcacgccagtctcattggtgtggtagtgtggggatataaaatacattgacaatataattgtgttgtttcgtcacgctagacgaagtggcatagccaaaagaaaatatttttttactataataaaaaattaaaattgttcaaagaaaaaaaatcaccgattataaggggctccaaatacacgagcaagcgtgagtaaaccaaattgcacgcgagcccctccaccttatactttttgtccatagttcaagacaatcttcacgtgtaagttgcagctgagattataagatgactggcgattgcgatggtgctgacataaaaaacattccccgctcctagtttcccacctctcctccctctaccctcaccctccagtgcttggcatcttctcttcttcaacagtgaaaagttggcaaactcaattcccgcaaatgcaatgctaacaaatctcatgacgacctctcctccggctagccagtcatggcaactaggtgagctatttgtctcatcttccctcctcctctaccacctcccaccttctatggccaatagcgccaccgtcttctcaccaca

SEQ ID NO: 95540 - DNA, 691 bp, Oryza sativa
actcctacgaatgctcttagtccgtcacgtgactcgatcaaatctaaccgttgattttcacttaaatggtgaacccgataattttaaaccattagattaaactttccggtggacccgatattttaggccattagattacatatattttaaaaaaagaaactaattccttaggcagttacgtgtttatgtatacaggagaaatttgtacgtacgtacaactgaactaatgaagagaaaaaaaactacacacagaattaccataaaatcaataagaaaaaaacatacgtacttagtaccttgcaaaagtttgataatatttaaaataggattttctattatttaaatataaaacatattacttcataaatttacataaatatcaccgtcgatttttatttaaattggtggacccgatcgatgttttagaacattagattagatgcctaaaagtccattaaatttctcaaaaatgctcctaattcgccatatgacattctacaaacgttcctaaattgtcatgtgatgctataataaatgagtgaaattcttaaaaaatctgaaataacaaaaacatatttcatttaatttggtggacagattatttatagccattagattaattttcaagaaatgaaattactctcctaaacctaggaccacctaagcctgtatgtaaaaaacgaacgtactt

SEQ ID NO: 95541 - DNA, 788 bp, Oryza sativa
gtcagctgcccgagcccgcgggtgcggctgacgcgcgggacccacggcgccgaccgccgccagcagcgtgcgcccggtccaccgtggaccgagcggctgacgcgtgggccccacttcccgtggacccggtccgcgcgtgtcacgtcctgataaattcatcccgaaataaaaatcatcttctaaaaggaataatagaattaattaaaattcgaaaagaaattggcaaacactaaaatacgtacaagaaaaattcaaatgtgacccggagaatttttgttaaattctccttggtctaaaaggagccctcaaattttagtggaattttcagagcacaaataataattgagaagaaataaacaaagttgaaaaggttttataaaaagaaaaaccctaaaagaagtcctcttttcccccccttccttcttgggccggctcggcccagtccctccctctctctctcttcccccgcggcccatcagctcccccgcgcgcgcgcgccgctgacaggcgggcccgcccgccactctcgctgacgggtggggcccacctgtcatcgccttcctcccgccgcgcccgccgccgcgcccgtgccctagcgccgccgccgccgcggattgcgccgcatcccgccgtccccgcgcgcattaaagagaggggaatcactccccgcgtttccctctcccgtttccccctcttttccctctctctctccctcggattcgtccggattcatcccgcgaagttcgccggcgtcttcaatggcgcccgagatctccgcgcgcggtttc

SEQ ID NO: 95542 - DNA, 748 bp, Oryza sativa
aaatgatagattttaatcaatcaataaatcatttttcaatttttagttaaaaaagtaatagcaactaaaacattacaatccggtaaaaagaattattacaattatatgcacgcataatctctacccttcaacgctctctttctctactcactcatttaattcctttatctcctaatttttaactaagtaaagaaatatcaataataagaaatctaaatgattataattcttaaattaaatcataattttaacttatttgaatttttgttttatttacaattaaataaaatgtttaagatccatattacccatatttcactttataaaaaatgaaaatatgtcatttaagcatagacatcgttcctttgcatggtaaccaaatagaaaaaacatggaccataatacaaaatgaaaataagtattatattaccgtaaatcactggacatcctctgagcacactcaaggcgtcgcgtgttacaccttaaataaaaataaaactttacaaattggaagaaaaaccatcttagcatcagtttccacttaaataggtagatccattattttcaaccaatagataatcttttaagaaaatcttaagcaaccatgtgttacgtcttaaaaattagaaaaaataacataaaatgtgagaaaaatatatcatcggtttcccttaaatcatttagataaaatagaaacaaaatacccctccacttcaccatccccccacacatacgcgggctgcaggaa

SEQ ID NO: 95543 - DNA, 1263 bp, Oryza sativa
ggatacgcagacgaaccattcgtactagcgaagcaggtcgaacaaattttctacataaacgaccccgcaaacaagaagatgcacgtcgttagggatggcaagcaaagaattgtgggggtggacaacgtcgtcaatgaagaagaatataacaagaatcttcatgtcagacctcagatcgaccttgacgatgatcccgaagatgaagtggcttacgttcgttcagaccattcggaaggcgtaccactgtgaatgatgcatttaatttgtattggagccttaatgaatgaattgcatatgttttatgccattccagttaaaactttttgaagaaatggatttgttaattatgtggttttaaaaaattatacttgttattttaaactatatgtgagatagccaattgttaattatatgaattttaaactatatgtgagaaagtcaattgtcaattatatgattttaaaaaattaataggaattttaaactatgtaaataagtcatttgttaattatatgattttaaaaaattaatagcaattttaaatcgggtagaagttaattataaatgattattataacttaaaaatattttaataagtcatctttgattggctttagtactttgcccgatagagattattccatctctgtcgggcttagtgctaatgcctgtcacagataggtatcatccgtatcgggcagagtactaacgcccgtcacggatgagtgtcatccgcatcgggcatagtaatatgcccgatagacatgaggattgactagggtttacttagtcaatcctcatccacgggtccttatccaccgccgacgccgcctctcactctctcactctctcactctctcagatccaccgccaccgccaccgccgctgccgcctcctcctcctccgctgccgctgacgccacctcctcctcttccaggccgtcgcctcccgaccacagccgcctccctccacgcctcctggttcaagatccaccgccgcctccctccacgccccctggttcaagatccaacgccgccgcctcctcctccaagccatcacctcccgaccgccaccgcctccctccacgcctcccggttcaagatccaccgcctcctcctcctcgacgccgccaccgcctcctggttcaagatccaccgctgcctcctccctcgccgtggatccggccttcctgaccaccgccgccgcctcccggttcaagaaccaccctccccgaccgccagcacctcctccacgcccaagacc

SEQ ID NO: 95544 - DNA, 636 bp, Oryza sativa
tgcacccctttaagacactatatttgtttatttatacttacacatatgaacaattataacaaaattgacagcaagtggtgcatactatttatagtcaaagttatcgtttatttctattttacatatgctaaatatcaacttgcatattttttatgatgtatcacatattaatttatcttattaaaatataatttttttatgatttcttgagcaacatgaaaaaaaaggtgcccctcaagggatgactggacttttccaaatgacgaatttattcacttcattaccaaaataaatcttactacttccatttattggtaaaaccaaggattgacaatgctaaatttcgtcaagtcaatgaatgtgaaaatgttgtttagtttaatacttactaaaatttggtgcattttgttaatggaaggttctggaatagtcaaattttgatagattttggtaaggttgcaatggtaaaatcttgtttagtttgttaccctataaaaatatcaaaatttggtcaaatttatttttgcaatgaagtgatcagtccgcaaacatagtacataatcaaattcaacttgtacatatggggggaattaaatccaacaacaaatgcagctgtaggttttcacaaaggaacac

SEQ ID NO: 95545 - DNA, 724 bp, Oryza sativa
tatagatgttaatgaatttagacacatacatatgtctagatttattaacatctaaatgaatgtggcaatgctagaaagtcttacattgtgaaaaggaggaagtatatgtcattcacatccatttttctctctaaaccgccgacatgcatcaaaacctgcaaaactaagttataaattggaacaattttatatgtaattagaaatgcaagtatatacagagacgagctacctaggactttactctaaagaatttaattgtattacaaagaatatttacaaaaatcaaatgtttgtcgcatatgcattgcaaatgttctgccattccgagacgagatacctaggacttcactctaacatccctttcggtgacaagatatcatctagtatgaattgtgctatctcctctctaatgatttcaaagttgattttcggaatccttgaaataaattcctgcatgttcggcgccaagttagtccacatacttgtaaatttgtcgtcctatgtgtgtataaacaattgaattacacacctaaggctttgtagcattggccacatacatatagatgttaatgaatctagacattaacatctaaatgaatgtggcaatgctagaaagccttacattgtgaaaatgaggaagtatatgtcattcacatccatttttctctccaaaccgccgacatgcatcaaaacatgcaaaactaagttataaattggaacaatt

SEQ ID NO: 95546 - DNA, 506 bp, Oryza sativa
tactgtagcacttatggataatcatggactaattatgctcaaaagatttgtcccgcgatttctctcctaactaggtaattattttttaatctatatttaacgctccaatacatatatctaaagatttgatgtgatgtttttgagaaagaaattaaggagctaaacgaggccttagctgggttagctggggcatggcgcacgggtgggggatcacgtactacgatggataagagacaggtctgtgacagagttattagtagccgtgcaatcaggtagatctctctcccggccagaacccaacacggttctatgggcagcggccgggcagccatgcagctctgccctgtacgttaagccactgttccgatcgagggagcgaactttcgtggaaaaagacgggtgcaggaccggccagccatgcatgcatgcaactatgcaagcaactcgtgcacgctgaaaacgtcttgatcgatccatcgatcgacctgcaaattaagtttctgcaa

SEQ ID NO: 95547 - DNA, 741 bp, Oryza sativa
ggcgccacggcagcgaaaccgctctccaaaaccgccgagggagtcaaatgcaccggttttaagagttagggggtcgagatatccggttttatggtttagggtcatagattagatttcgatcaatattgagggtcacaaagtgaacttattccgttatagagagagcacatggcctcgtagaactaacggcccaggatccggtccatgtgggccatctactagattgttgggccctttgagcattaatagatgggctttgagttgtaccagattgggctgaaaacatagcactcagtccccttccgtgggctaccacaatacacccgcagctaattaaaggctgtaatggaccaaatgtccaatggagaccatgtcttgagctgggcctcatccagtcatcctggaccatttcaaccatagcaaagccctactcacagaaggtttttggttttccttatctctcgtgcctttgaatagtcccgatgcatttggattatctatagtgaatttgctgcagaaaagaggtgattgctttgataagatcacagaggctaataatttactattatattcattctagaatataagcatcgttttgctatatacctagatatttcttcataataaatagccagaagcgattatattttggaatggagagaatcacctaaacgtctgcaacggtgcaaaaagaattccgagtcaaagatgctttagataaaccacctatactttaatact

SEQ ID NO: 95548 - DNA, 834 bp, Oryza sativa
gagacatgcttgtataaccaccggcggcaattgagtcggagataaagtgggatgattggggaggcgacgttggcggcctcgtcgttgtcgtgttcaccacggccggccatgtcttggaagggagaggggagaagaggatggggtcgcagctcgcaaatctcgacctcctccctgacgttgccacccccgacgcctagctcctctccagtggccgcccgccattgcgccgaccctcctctctgccgcgctccgccctcgttggccgctgacagtcgcccatcgcgtcggccctcctcttcgccgcgctcctcccctaccagccgccggccgctggccgcacccgcgatttgatgctgtccacttctcaagtcggtctttaaagttctataaaggtaggaaaatatgatttggaaaatatattagccccttagctttttcttcaccaattgaccaatctaccacagatttgatcatgtatgtcaaggtattgactagcactccagattgattaatcaaggcataatgcacggctgagtcaatatgatcctgtagagttggcttgcattcttctttagtcccatcttgtgcatcttcagtcttcttactagtctcctccagtaagcttcggcaactcaactttattcttctgaatcaacttgccttgccgagtaatgtgtaagaatcaagatacatcttgtcggtgacatgggatcgggagtatcatgactagaggtttgaggcagacacagtcgcccacgtggcctggcaccctcgggggacgtcgggcccgaaggtggtgtgttcgccctcctcttagtccccccgagggggtcg

SEQ ID NO: 95549 - DNA, 738 bp, Oryza sativa
gatcaaagttaaaagtttgacttagtttatagaaaaaattagtaaaatttttaacccaagacaaatttattataaaaatatattcaattattgatttgatgaaactaatttagtattaaaaatattactatatttatctataaacttagttaaacatatatttgtctataaatttagttaaacttgaaacagtttaactatgacggaagtcaaaacgtcttataacatgaaacggagagagtagtagccaaagtacatgtgacacttttaatctgattattttaacagccaaattcaacgaagcctaacgtgcacttatcatgattttttttaaaaaagaaaaagataaacgaaagtgagctaacaaaaaaaaaagattttgtagtacggccatgagaaaatgaagtgaacttgaaatgagaaaaaaaaatcttattattattattctttaaaataaaagaatagcataggccggcctggctatcactaggataggagtttcttagggacatattcttctcccttgctgttcatcccttttcggatgcatcgatcacaggcgacaaatcagacaaatcatcattcggagtttcagttgcgcaaatgggtatcggaacatattcttaaggctgattttacatcaaactttaggcgaaaaatactttttttttataatcgctagctaggtagccatgaagagcattttcggttcataatgctgcatgctaatcaagagca

SEQ ID NO: 95550 - DNA, 722 bp, Oryza sativa
attcttcactccttgatctaggaagtagcttagaaacaaaagagaacaaaaaccttgaagagaattttctgaaaacatcaagggcgtactggccccagcccaggttgcttcggcccagccctggacatggtggctccttatcggcttctttcttgggccatgtatatggcgtcagaactcagaagtcgattccgcaacaggaagaactcatccctctggttcctcttcccgcacacaaatttcccgtcgcccgggtgcaaaatcccatagctggcggggcaaaattcacacttcgtcttgtagccgtgcggtttactcttatctgttgatagagtaggaaaacagaagtcataaattaggatccttgttatgagagtaaaatcattagcagctgacatcagagagtcggcatagcagagagtgacataaattaggcaccaaaccaacacatgataaatgcagtttatgaaattcaataaatccgtaacatgagccgtgacttaccgatgatggtgcaggtcacaacggtcgcagagtcgtagtcgtcgtagcgtagctcggcgaagaactgcttgtcgggtgactcgggaggagccctgttgcgcttgttgcgggagcgtcgcttgcggcctcttttcacgtctgattcgtcatcatcggcagcagcagctgctgcttcatcggctggcttcaccgggctgctcctcctgcgagccaggaag

SEQ ID NO: 95551 - DNA, 789 bp, Oryza sativa
tcctgcagccctaaatttttgcattcattcgatcattcattcagtaaggctcttaggtttagcttgtaataagtagtggtagtttctattaaagcaatgaccaatttatccattgtcttaaaaaacttagccttgtcctatcaataatctcgttagtctaaaaggattataatcgtcgtattcaagtatactgatcattaacttttatatgccgaaacaaaatttcaatgcatttcattttcattttttcacaaaagtgatatactgacaacaaaaaatgtgggggcgtaaaagtgtgcgggtgttattatttagccaatagatctagttgaacgagtcgtggtttaagaacaacacaatggcaaagacaactatattaaaattaaaaatacaaatatatactaaatttactgttttactacaattgacgtctctatcgtagaatcgtggatatatatgctgcactcattgataaatgtttagtctcacaactgtatgctaacaaatgtttaattaattgagtgctataaagccaatggaacgcaaaaacatttctccatttggacccccaaaagtgttcatgctcaggaaacagagatttggtgcggaacactttcgcctgtgttattaacacaaggcgttctcacatcacgtcagtacgtcactaacctaacaaccctatgacgtgcccatgtacccgttgcagattagccctcctcccgtcggctacggactacccacccacagagaaatcaccccaaaaatgcaccccgctttcgcgcggcttaa

SEQ ID NO: 95552 - DNA, 505 bp, Oryza sativa
agccggtggcggtcgggaggtgatggcttggaggaggaggcggcggcgttggatcttgaaccagggggcgtggaggaggcagcggtggatcttgaaccaggaggcggtggcggcgtcgaggaggaggaggcggtggatcttgaaccgggaggcgtggagggaggcggtggcggtcgggaggtgatggcttggaggaggaggcggcggcgttggatcttgaaccagggggcgtggagggaggcggcggtggatcttgaaccaggaggcgtggagggaggcggctgtggtcgggaggcgacggcctggaagaggaggaggtggcgtcagcggcagcggaggaggaggaggcggcagcggcggtgcggtggcggtggatctgagagagtgagagagtgagagagtgagaggcggcgtcggcggtggataaggacccgtggatgaggattgactaagtaaaccctagtcaatcctcatgtctatcgggcatattactatgcccgatgcg

SEQ ID NO: 95553 - DNA, 603 bp, Oryza sativa
caactttgaaatcattagagaggagatagcacaattcatactagatgatatcttgtcaccgaaagggatgttagagtgaagtcctaggtagctcatctcggaatggcagaacatttgcaatgcatatgcgacaaacatttgatttttgtaaatattctttgtaatacaattaaattctttagagtatagtcctaggtagcttgtctctgtatatacttgcatttctaattacatataaaattgttccaatttataacttagttttgcatgttttgatgcatgtcggcggtttggagagaaaaatggatgtgaatgacatatacttcctcattttcacaatgtaaggctttctagcattgccacattcatttagatgttaatgtctagattcattaacatctatatgtatgtggccaatgctacaaagccttaggtgtgtaattcaattgtttatacacacataggacgacaaatttacaagtatgtggactaacttggcgccgaacatgcaggaatttatttcaaggattccgaaaatcaactttgaaatcattagagaggagatagcacaattcatactagatgatatcttgtcaccgaaag

SEQ ID NO: 95554 - DNA, 672 bp, Oryza sativa
  unsure (1)..(672): unsure at all n locations
gaattcctccancccattggagacgatagatttgactccgtgatgttggttgctgctggattagcacagagagggggagaactccgagccggcccaagccacgccgccgctacttcatgccgtcgcctcgagctgcgacatcgtcactgccacatcattcccgtgctgccgccgccgctgccgagctccgaggccgaagccttctcttttcgcgctgccacttccctctctcttcctcaactccggcagatgccgcccgtcgtcaagcgccgccttcccaccatttcggagctcgatgccgcgccacgagtccacctctatctcctcatgccggcgccgccactcacgaatgctgccaaagcgttgtctccaccgaatgccgccgtgccagagtgcacccacgacgcggtggagcgctgccgtgacattagaaaggggaaataaggaggaagaggaagaatatgacaagtggggcaagggatatttttgacttttcacgctctttatctctcctactcaactggaaattaatattttaacgcgcgaggtgtctagcagcaaataaccacgtttagatagtgttttcctctaaaattaagtttgtgctgtgtcctacagctaaaccacaaagtcgtgatgtcctatagcaaaagttgcctttttcttatggtg

SEQ ID NO: 95555 - DNA, 626 bp, Oryza sativa
agcatcgaaatggtatccaaagtatatttgatatttttctttctaatcactactagagaaaccatctttggtcggtcgacccaaatccacaatagtcccggttctatgaaaaaccgggactataaagcatttttagtcccggtttataagtgtaaggagactgtcatctttaacccggttcgtgttattaaccgagactaaagatcatctaacaccaactgggactaaagatgattttcagtcccggctcatctcgtgtcagaggctgtcaatccctagagatctttagtcccggttgatactaccaaccgggaataaaatcctaactttagtcccggttgttgtttctaaccgggactaaaaatcaatatactgtatataatcccttgctcttatcctcaaaaatttctatctcctattcctcctcctctctcacacacttttatcctctttctctaagtctctttctattccttcttgtctaagtctctctctcacacttatcctctcgcggtagccggcgaggagcgagtggcggggcgaggcggcgggggccgggcgcggtcggcggcccgtggtggtcggtggtggcgtccgcccgtggcaggaggaggcggctgcggccg

SEQ ID NO: 95556 - DNA, 668 bp, Oryza sativa
gaattcctgcagcccccattgccgatccattacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatctttagccccggttggtgctaccaaccgggactaaagtc

SEQ ID NO: 95557 - DNA, 659 bp, Oryza sativa
gaattcctgcagcccaatatatacggatttgaatgttgcagatccgttgacaaagtcactccctcagcctaagcatgaggcacacactagggcaataggtataagatatattcatgattgactctagtgcaagtgggagactgttagtgatatgccctagagacaatcatagagatgattgtatcacatactatgtttatatatttatccgacattgttccttgaaatagataactccgtattggttaatgaatatgtgattctttcatgagactctttatgatgtttgttactatttctaaaggatccctgatcaaatatcatatgtggaacaaatatgtttatatgatcagcacatgtattaattcacgatcatgtctcatagatcatggtatagagatatcaaattaataatgtggacacatgttggtgaacatgttgttggatagacccaacatgagacactgcaagagccatatgtgttgtgtcatcagtgatctcattgagtgttggtgttgaatccttagacctgagattatcatggttctcaacatgtgtagtagcttacttaaggactgctaaacgctactccgtaattggatagttataaaagtagctttcgggtatgctatgaaacatgtagtgggatatgaataatc

SEQ ID NO: 95558 - DNA, 662 bp, Oryza sativa
agccataccacgcagatttcatctgacaataaggtctgtaattcctctgcatgcctttttttttcccatcatatataaactcacattttcatgttgtgtataaggcaacaactgaggcagagggcaaagcaaaagctccacagccagcatcctctgttgaactgtcccctccagatgtcgagcataaggtatcaatcgatatccctgcttaccattcagccttcacagactaacaaaataaattgtggtgcaaggcaaaggcagcacaccagctcctacgagattttccatctacagacccatcattacttgctaaagacatccagaagaaaaggtacattttcatatcatttcctgcctagaatgtcattctttccttacgaaaaatgtaaccgctgtctgctaaacagagacaggcctgcaacatcagctccagccgctaagaagctgttcagagacaacgctcccagcaaaattgagaaaaggtgaccatatcaacagccatctgaaacatatgcaaagcaacatgcataagcgaatacatattgctgacctatgttttcctctactatttatgcaggcagtgaacaatgaagtggcagcatgcagccagctagcaccgcttttgcttaatgatgcaccatagtatcaatgtctgcact

SEQ ID NO: 95559 - DNA, 717 bp, Oryza sativa
cccgttttggttgggggagtttttaggagggattgggagtttagagggatgaagttattaactcttttgtttagttgggagacatgggaattttagtgggctggggatgaggaattgaggaatgaactccctccttttcaatacctgggtagggggtggtaattgggagggaattcctcctttacttcgcctaaataaatctcagccatccgttttcattaatgacctaatctccaactaaactccatatcaatttccaccacctctttcaaacaagagtctaggaataaaaaatatttgaattcaaatttaaatttaaattggatatataaactttttacttataaactttgggtctaaagtaactttaggtatatagaaatactatatataaaaaaatttaaatttaaatttaaattcaaatttgaatcgggtatataaacttttgacttataaactttgggactataaactttaggtgtatacaaatactatatataaaaaaattgaattcaaattcaaattaatatttgaatttaaattcaaatttgaatcgggtatataaacttttgacttataaactttgggtctataaactttaggtgtataaactttagatgtataaaaatactatattagaaaaataatttgaattcaaatttaaatttgaatcgggtatataaactttttgacttataactttggatctgtaatatt

SEQ ID NO: 95560 - DNA, 537 bp, Oryza sativa
ggcgaattcgagctcggtacccgaagtggtctttagtcccggtttacaacccctcctttagtcccgggttacaaaccgggacgcccaatccggaactaaagatggcagcaccacgtgttttgcgctaccatctttagtcccagttggtgttatcaaccgagactaaaggtttttttttcttttttttcattggtttttactgcttgcatattgatttcctcaaattgagttgctccctacatccccaagtcacatataacaccacatatcacagataacatcacaaattcacagatttacataataacatatcaaatacataaaaaaattcacagattcacatcatagatcaaatatgacagggttatggataccacatacctaatagtagttgactaaatctcggtaggatccaccacataccatgtcctatacggaaacaacctgtggatataggaggagttccggataaggaaagacaaccagagttctacatggaaacgacaaggactactcggattgtatccatattggttt

SEQ ID NO: 95561 - DNA, 902 bp, Oryza sativa
gcacaccagctcctacgagattttccatctacagacccatcattacttgctaaagacatccagaagaaaaggtacattttcatatcatttcctgcctagaatgtcattctttccttacgaaaaatgtaaccgctgtctgctaaacagagacaggcctgcaacatcagctccagccgctaagaagctgttcagagacaacgctcccagcaaaattgagaaaaggtgaccatatcaacagccatctgaaacatatgcaaagcaacatgcataagcgaatacatattgctgacctatgttttcctctactatttatgcaggcagtgaacaatgaagtggcagcatgcagccagctagcaccgcttttgcttaatgatgcaccatagtatcaatgtctgcactcatatttacaggcatgacttttgtctaggggctcttacgcatgatggcagctatacatagctgttgctatatatgctagctactcttgctatattctctatgatgtacatatagctgcactttcaatctaccagcaagcaaggcagctctagaacatatgctactttcttcatgttctgaactgccttcctagtcagctttcatgtatgcatgagctgtctcctctatgtgtaattatatgttttattgcatgcgaaccagtagcagtgctctctgaagaccatatattcattgctatggcattgtctcagcaccaccaatttctgtatcatgcatttcatacttcacatataaaacaaggctacgtaatccgctattatccaaggatagataactgctctatttaaagtttatacactgaatcagagcaaactgtctgctctatataccttagctacgatctatcgtaatcttctatatatatttcctcagctatcgtccta

SEQ ID NO: 95562 - DNA, 504 bp, Oryza sativa
cagtattatattgtattaggcacatattgtcttcccactcatccatagtgaatgttcaaaattgtagttaactgttttctaactcaccttggagaacctttgagctagtagtactgatgccaatggtggatgatgccaccctgatcaccaatatttgatatgcagtggttgctcctgtttagagtaccttatgtatgtctatctttgatgtttatccttggtcgcacagacccttgtttagcttgggttgaaagtgctaatacactggaaggatttcacctactttatgtctctgagcatttgtttttaagattgtgaggaagatgcacatgcacatacctgtctgagtgtcccccttagcacatacttgaacttatggaggttagggatgaatctgtctacctcacaaaaaatgtattgaagcgcgcaagtgtgcacatgaatgcattcactaggatttgaaccatggtaggtgagtcatacaccttctccacctctgtgatt

SEQ ID NO: 95563 - DNA, 613 bp, Oryza sativa
cccgtttttttgacaaattggtccttataaaaaactgttttcgaaactagtccataccaaaaactatatctagaaatatgccgttgggtcagcgccaacctttttagcgctgaggctggtcatattagcgccaatgggactggcgctgacatcgcgccagcataaacggcgagacacaacgtggcagggcctcagcgccaatgtatttggcgctgaccccttgtacaggctaattaaaaggatgcgcgcccattaataagcaatgcactcgtggtgcaatggtatgaccatttgcttgtgtaccctagcaccatggttcgactacctatcacggcaaccttgataaatctttttttttcttcaaattctccatacacttgggtacattaggacatataaatgattaatgatgctgtctgatttttaaaatatatatatataaatataaataatagaatatatgttctacagcggcgctggcctttataccggctaaataaaagcaaaagcaaaacaacagttaggtttggcttagctcagtggtaggtatttgaaaggtggcgttacagtgaccagggttcgaaccctctcctttatgtttttactaaacttg

SEQ ID NO: 95564 - DNA, 640 bp, Oryza sativa
agtcatgttgggtactatgtaaaaccaccaatggttggtctccttgtaaggtaatgcatttttttttgtttttaccaaaaaagaccattgctatccattctttcccgcaatcaatattccaagggaatagtgatattaagttgaagaaggtgatagttactagttaaatgaacagactcgtgaactggactaaggctaaatattgtgacctgaacaaggctaaattcccaagttttcaggtgaatggaggcactagtttggagctcgttatattcctatgtgctattaatcaacaaatgctttcatgagtggatgaagatagaaatttggaggagaatatgtgcatatagatatacctaatttgttactgtattttgctttccagtggaaggatgttttagtctgctactctgcttcatgatatatgttttaaggtgcccagtgtagattttggagaagcagagacaacatttttactcctttaaaagatgacagtagtggtggttgtcgatctgccaccacatcttctctatactggattttcccttaaatttcttcaatattacacaatagtacttccacatgttaattctccttgtttgccattaagaaaaatcaaatttaatatggaacagcccaa

SEQ ID NO: 95565 - DNA, 673 bp, Oryza sativa
ttcttgttgttcgatttgcaataaaaaggcaggattgtgtgggtgggtatggcaaagtaagaatacgtgccattctgtttatcaatagctcggtcacaaatatgtgttgtttttctgatgaaaataataatagtacacatgtatttaatctacaaacatctaagcatatatgtattgaaaatcgctgtctctgaatacccaagcactgcaggtggtaccttgatccatcatacgtcttagtcattcttgcaagctgaaactgccaaagtacttactgtatactgctagagatagtactccttcgtttttttaatatatatcatcgttgactttttaaaatacatttgatcattcgtcttattaaaaaatatagtaattattatttattttattatgacttgatttatctttaaatgttctttaagcatgatttatttatatatatatatatatatatatatatatatttgtgtgaaaaaattgaataagacaaatggtacaatatttgataaaaaactaatagtgtcatatattaaagaaacggatgtagtatcatagtgctaccagagtacaaatttgcaacgtatgtctagaaaaagtgtcctaatgcatcaatattcagcccaaaaagggcttatgatgttaggggcaacctactccaaactttttactc

SEQ ID NO: 95566 - DNA, 582 bp, Oryza sativa
ttgcaaatttgctgtgatataaaagtgagatttgatcatttgatcctgatcacgcacgacctatccactcgcaaaccactgaaaacaaagttgattatcttgtgctgtccagttaaactggaactgaatttctttcctcaaggcacagactaccaaacatgttcactcttggttgtgtgaagtttgatcaactgcaggcatttatacagactaccatagaaagtcataggtatgtctggcaaacttgcccaaaatcatgctagctccaaaactttggcacctatttgtaaggttgccaaaattttgcaagcacatgtttgttcgttcattgtgcatttttcttgcaaatcgtaggcgaaatatagttagacacaactacaaaattatccaacacaggctattaacatcgaatttccagcccatgaactcacttccaggtccactactctcttcggcccattagggtttgctcgcgagcatctgacaacgcccgagcctataaaatgcgtccacccccctccaccgaaggataccatcgccggcgcagaagccttcagtgttcgatccttcggttctcttttc

SEQ ID NO: 95567 - DNA, 636 bp, Oryza sativa
taagaaagctatcaatattagaaaacactaattccatctaaaacagcaagagctctacgtatttaataggataggagcggagaagctcacaatgattttcagcaaaatgaggtcttttgtcctcgtgtagtccatttactagctcaccaccgtctttctaagaggatctcctagttgcaactacacatcaaaccaacagaatggatgaaccatgcaactgtgcaagagtggtgagggaaaaccatctcggcacaaaacatgccctagaaagtactctcaagtcgatgattatcatagtctcccgagagttgtgaaggagagaaactcaagagttttcagaaatctcactaacacttcaagatccatcacgggctcatggccaagaataaggaggaagcacatttgtgggtaatggcgtgggcgggaagtgaagaatcttttttttgaccgaaaaatgattttttttttacggaagggagtgaagaatctaaccgagctatatcttgtgcaagataattcctttctttctttggtcaaggataatcctaactcccacggccagtgaatatataagacaaccttcttaccttgcttttaaaaaaaaaacaatgatgttcaaaactactacctccgact

SEQ ID NO: 95568 - DNA, 583 bp, Oryza sativa
  unsure (1)..(583): unsure at all n locations
aaggtccgcgacggagcgcagcgcgtacgggtcgccnagatgtcccatcgccgccatcgcgtgcggtccctgcagaaaaatcgagcgatcgcgggtgagtagccccgccgccgaggaatttcgtcgaacacgttgcgcgcggcggccggcgatcggagccgaaccggctcgatcacgatcaggaactcgcggacgaaccgagcgggcggaggcgcgcagcgtaggaagacgagaggcggagagggagaggcttgcttactgctggttggtggaaccggatttggaggggggggggggggatttggaccggaggagtcggagagatggcgagagagaggagcggctgcttcgcgagggaacgaaggtgggagaaggaatggcaggagaagccgcgcgcggataatgcctctggtgtctcgaggtgaggaggaggaggcggaggagatgagccgtggatgattgcaacggaaaggaatttcaaattctggtttgcgttagaagctggctcacgcctgttcgtgctagcgctactgtctcgatgcaggtaggagtagtccatttttctctacaacacgaaagcacc

SEQ ID NO: 95569 - DNA, 580 bp, Oryza sativa
cccgagtcagcgtgcggtcccgactccgactccgcgggcgcggttgcgcgctgttggttggagtacgccgcggcgaacgacgggaagagtggtggactggactggtagcgtgacggtggtggggttaggccccggggctcccgtgttgacgacgcggcgacccgcccgaccgtataaagggagacgtactccctccgtactcgtaaagaaaatcatttagaacaatatttaagttaaatcttagaaatataaatcatgaataatcacaagttgttgagtttaaaaatacaaaaattatataaatagatttatcttaaaattaatttcataaaagtataaatatattatttttcaataaatatttttataaaaataagaagttaaaattgtgttttggagatcgtgccgtttaaaaaacgatatcctttacgagtacggagagagtataacacgagtacacgaggcccggcgcgcgggcgcggagcggcaccgaaggtgaattcgccaaaacgtggtgtggtcaaagagaccgccccggccttttggcggacggcgacgggtagctatattaatcgatcgg

SEQ ID NO: 95570 - DNA, 595 bp, Oryza sativa
tttataattttacagggatgttttaggtctcactgttgactgtacaaacatactgttacataattatgtattattccctttcttgttaacattgttttgcatgtttttgtttgaaataaactcttccttttatcaggtgcaattgattatccatcatttcttacgctcctgaagcagctagttcctcccttatctgctcagctgtctgaccgacggtctagcatagtaaaacaggtatttgatttaacaccaattcttgaggggctgtcaaattagttcatccaaaaatatttcattttagaagtacatgtgtgttatggaattctgttagaaaaaaaagaattcttattgaatttgcaatgactgaacaaaccttggtgagaaaaaattgctgaccaagtttttttccaggcatgccatctacttaatatgctatcaaaagaactccttggtgattttgaagcatgtgctgaaatatttattaccgtcaccataaaagcaggttcaatgttttgcaacagtaagtcagtacttttatactttctcagtagggctaacatactgatcaaattatcaggtacttttcaagcttgtt

SEQ ID NO: 95571 - DNA, 638 bp, Oryza sativa
agatttgaagaagagatgaggccagtgaagttgacaccaaaggtttttggtatggttcttgtttctcatcatattgcaaatatttggccaaagcgtaagaattaggccatttgatttacttattatgtcaaagtgacaagaaactgtgtcatgaatacctccatcctacacatgcaacttcctcacagaatcagtcatgaaatgatgttcgaatagatcattatttttgttttactccacaaaatcatgaactcttgaaaatgccactttgattacttagcatgtcctgacagccttacaacacttaaaccagcaatttatatgtttgacctaatctatatctgtttcactgtgctatttaggttatgctccagcaagaaatgacttcctgtttgagagggtatgcattttcttactatctgagaatgttccttctttaaaatgagaagggacaattagggcgtgtgctaagtcagatgtcttcttcatctccttgagctgtactactgtactgataatttgtgcataatcactgaatcgaatctgatatatttattttctttatttctttctacttgtagagactccaaagtttcattttcggtaagttacatctacctatctgtcaattgtacttt

SEQ ID NO: 95572 - DNA, 603 bp, Oryza sativa
cacacacgtgccaatcgagaagagatgttgtgaccaagttgaagcctgtgctgctgtgcccaagtagcctgtccgtccatgtgttattgtgttgtactactaccatggtgtgtactgctactagttgggcacagtcagatacatcggaccaggagattcggagatcgcttcgagctggatggactgctagcatggtgtacaggaaaagcgacgtgaaggagcatgtccgtttgacttgagcagcagaaactatatatatatatgcgattcggcgaaggcctacaggctacaacttgacggaggcctacaggctacaacttgaccgacttgaatgcatggtaggccatgcgcacgtttcggcgcaagtcaactgcacatatggcaacgcacgagtacgacactcttaagacaggtcaactgtcctaggccagggcttgttccaatgggcacctgagcttgggccatatgtgtatcttgtatctcatcctaaaattttaaagccatgtgacatcgaatgtttaaacacctgcataaaatattaaatatagtctaaaaaaataactattgtacagattgcgatactttgcgagacgaatattttaa

SEQ ID NO: 95573 - DNA, 608 bp, Oryza sativa
ttcctcaaggcacagactaccaaacatgttcactcttggttgtgtgaagtttgatcaactgcaggcatttatacagactaccatagaaagtcataggtatgtctggcaaacttgcccaaaatcatgctagctccaaaactttggcacctatttgtaaggttgccaaaattttgcaagcacatgtttgttcgttcattgtgcatttttcttgcaaatcgtaggcgaaatatagttagacacaactacaaaattatccaacacaggctattaacatcgaatttccagcccatgaactcactcccaggtccactactctctccggcccattagggtttgctccgcgagcatctgacaacgcccgagcctataaaatgcgtccacccccctccaccgaaggataccatcgccgccgcagaagccttcagtgttcgatccttcgtttctcttttcgtttttgctcgtctcgtctgtgttcgattcgtttgtttttggatttgtggtgaatctggtgattgtgttcgtgcttcgtcatctggtcattgggaggattagtctctaatcggttcccaatcgactcgttcccttgaagcaaaatcggcctgttgtat

SEQ ID NO: 95574 - DNA, 674 bp, Oryza sativa
ttattttgcaaatccaaaaatatcaaatgaataaatgtaagttaatgctttcctgaaaaaaaatgcccggttaatgtgtagctggcgagcatatcttcaacctttaatcgtgtccgtctttagaaatttccttgcaggcatgagctagcaatagctaatagatattactcgctagatgataatgagttcacaccaaagatatgttcatccccagttcatcatatatgtttgagttaatcctctttcatatgcgcaaaaggaattcaatttacagctacagaaatgattttcgctacattcaaagagttccaaggattgacgatagctgccatcggatgggccatatccgccacagaatggatgatttcccccttcactaataaacttgtaaacaagggagccgccttcatgctcgctcgccatcccagcttgcatttgttaaaaagcatacatagttatcttgttaagaaagagaacactagattactcgccaaccgtatttttatcaactctacttttattggattgtttaaccatttattgcagttgagtggaaaaaacaatgaaactagctacgtaatttgaggctcttattaaagccccattggtctaaaatctcaacatatttgttgcaagtcatcaattatattattaaaatttagtaaagccacaat

SEQ ID NO: 95575 - DNA, 691 bp, Oryza sativa
aaactcccaactttctttaaatttttaacttttttcaggaactaaacacacccggagtatgtgagtctgaattagttctctgaaagtggtcggtgttttggcatgttctgttctgtcactaaaaaatgtaagctctaatggcgccttttacgccaactttggtttcttattagttcctttcaatctagttgcccagcatagacccaatcaaagccgggcatcattttcactaaaaatgtcgaagggagacaatcgtgggatcgaagatcaactagaatgtactcaaccaagtagcgatgttatttatttaatcttcattagtgatccctttgagttttccacgagagcatgtagttgagatataaaatatcttcatcttggggacttgcatatcctctgcggctacatgattgcaagagaaatccatggccaacatatggagaaaacgctgtgtaatagatactataaaaaccaatattaattttatcttagctttattaattgttatctctgttgcgatgtaactaatttcagtaacacaaaagagaaagggaaaagagaaacatcgttggtacgtatgatatcagctcagcgtcaactcttagtatctatcttatataagtccattaaacttcctacaaacgctctcaagccgccacgtgggattcctataaacactcctaaatcgcca

SEQ ID NO: 95576 - DNA, 663 bp, Oryza sativa
ttgggtgagcataaaagaaattcttcatggcacggttcctaggactaaattgcagagcgtgatcgagcctgcatgtggctaaacgaacaaaagaaaaacaaactttaaaaatgagagagagagagagagatcaggaaggcaaaggaaagcgagttgggggagaggttgttttagtatctcaacaactatgcacgactacgtcactgatgtttaaagaactaggaaggtagcgcatcagcgcgggcatcttatttagtggtgtttgaaattttgttacgaatgtttatgtatatgattttttttaaaaaaatattttttctcttctaaatatgtgtatatcaataatttgtttgggattgttttgaaagttagtttcgatcactggacgtacagacgtgcaaagaggggatatgtttctgggcatttaatttatctatacatatgttggaccgatgggtacgtcaggtcttttgagggggtgtctgtgacatcctagttcgattagatatggcctatgttttatttaaaggatgtgatttgtgttgtgtgcacttcagtagtactatcttgctagttaagcaagagtgcaactaacttgtaaggcattgtccctctaaccatatcattttcgtgttgactattttacatgaagcgacaacgaaa

SEQ ID NO: 95577 - DNA, 575 bp, Oryza sativa
tgctgggccacagtccggtgataagcgcctcgccagcgctcgcgcgaagtaactaactagatcaagtttgttatagagataaaatcaattggtttgttggttatctcttaattcatctggttttatctcttccgcatattaacttctgaaatcttggcgcgtaggcagctaccgtcttcggccatgggccgagcctatgattaatcactcggatatgcataggttgcttaatcacccaggcatgcacacacatacgaccgtctactgtagtacatgcatgcatgcacgtgattgcctcaccagccaatcttcacacggctagttattggttaattatacatgcacatatactaatccaagtatatatattcccagctgcctgtgcatgcatgtatttgcgtgtatatacatggccgagcattgcgtagaaatgataagctagccaacttacaaactgctttgttgctttgtccatcatgagtaagtcttgtgtacacatataatagccaaaataccatcaaataggtggacggcagggctacgtctcttctccatccgccggcgcgagcgggaga

SEQ ID NO: 95578 - DNA, 612 bp, Oryza sativa
agctcggtaccccagcacaactctcctctccccactggcccacccttcccaccaccccatgcacgtacgtatacatacatacactttttccgtctccaataattctttctctcatcttcctattttataaataataattttaattataaaaatattatgaagaaaacaaatctaaccatcaatttttaattaaattggcagacttataatttcatcaattttcattcaaatcagtcgagttataagtttaacaattagatttaaagacataaatatttcaaactgatgaacgcattaaatatacctcaataaaaacaaagtatccttgccaaataacaatgaaacattgaaaaacatgaaaacatatattatatattcttgaatcgttttacatagtaaagatcgattaaacgtgctctatagcactctcaagtcaccacgtatgatattttaaaaatttgaaattcaaagagaaaataaattatatatctatccatcggttttcacttaatttgatgtcccattatttttaactattagattgcttttctctttataaaaaaaactttaagccaccacatgtcatgtcttaaagatccttagaatgagaaa

SEQ ID NO: 95579 - DNA, 611 bp, Oryza sativa
gatcaatcaaggatgctatctttcctggacacttaaaagctcccaagaaaagtactgagtaaagcatctgtctccagcattacaagcacttcttttggctgtatgttcatgtccaagaaagcttttctggacatctgccggaaatctgtgctctagtactagcctgcagtatgcgggaagcactttggcagcatcagcttgcaagaataaccaagatgcaattacagtgcttcagtctcagtacatgcttagacgttcgtagattcaagtattcaacacatacatgctcttcccattctttctatcagaagcaaaaaaatttatgactgaagctacagagccttaagtacttccaacaccgacctcacataatcctgtctcttcgtgcaaataactttatgcatttttttttcgaacgaaaggaaataacttgatgtaaaagaagatataacaataatgctatctttcaaggtaaatatgagcatctcggataaaatattcccaagcaacacacaagcaaacatttgactccacaaaacaagattacaccgagacaacttcttatctgcttccacaagatacaattgccatgacctttgaagggggaacaa

SEQ ID NO: 95580 - DNA, 508 bp, Oryza sativa
tgggatacaaaatagaaagcaatgatatattggaatgtaaataaaggagcgacaccctccaaaattgatagttgaccatggtttctctggcaaaatatcatctaagaaaaagtccacctttgccatgttggccaagtaggcaaatgataatgagtctcgcattacttgggtgggactgaaaattcctaattggcctatgagaatgctgcaacactgttgaaaggctaagccatgtcaccattggatccagcagtgccgcttacactgctaccttcgaactgattgtaccccattgagccagtgccccttgcaacatccatcagccatccctccctctggattggtacctccgtgctcgacaatgagacagatgcaggtatgaggccttgctcacggagcttcttgaggcggtcgttgacaatcttgaggcgtgaatttgccatccttccgaggctgataatctgctcgatggtgagaccatcgaggcttgggtggcggccattgatgg

SEQ ID NO: 95581 - DNA, 558 bp, Oryza sativa
tgtcttcattttcttcagtatcaaaggttcataagaactatccatggatttcgacaacattagattggggaaatctctggatttcttgcgtatgtgatcaaaaattgtgttgttggtggcacttttgcattctgcctctactggttcagaagccaatacatctggaacatctgaacatgataacacaaattttcatgcaagagcacaaatgaaacacaatagatgtgcatagtgtcatatagaattgtgttaccttcataatcttcttcatgcagtagagtaaagcttggggcctccctgtagtcatcaaaatatcaccttagaagttagaacgctatattctatattcagatagtagagaactttcggaaaaaatggttataaataaagaaataattacaaggatgacgaatacatgttagaaatttcactaatagctgtgatctattgcaattctgtggtgacatattgcaatccttgcagaaaattaaataaaaaaaaaagtctgtgtgtagaatgatagccaccggataggcgttctattttctctgcactgat

SEQ ID NO: 95582 - DNA, 596 bp, Oryza sativa
aagaagaatactagtataactctattttacagcgaagattgcatgaaaacctcgactagttcgtaaaattttatctcaaatctgttagtggatttcaggaagcacagaagcacatataaagttggcttgcaatttacacaagaattacatttgggaatttccgtgccgcgatcatttccttcagttcttggacagaagatgacttttatacctaaccagatcaactttgcttgcatttgtaggatgttgttccaagtgtaattaagtccaaaatagcttgaagaaaccgttggagaaaatagaaactcccaacgctgaaggacaaaaaattgttgacctgacaaacttcataagcaataaaaaaatgaaaaccataaacccaatgtttttgcctaatatacatcgattctcagtatacgagactaactgccctaaaaaggagattgaaggaagccctggatcataacttgctaaattctactttccaaattaaattaatacaacactaaattaaaaattgacgataattacagcatcatagtattaactttgaattcaacaaatattaatttttggaaaatgacaaataaagagtc

SEQ ID NO: 95583 - DNA, 701 bp, Oryza sativa
  unsure (1)..(701): unsure at all n locations
agaaaaaattataaaagggagagaacaatgacagacaggtgccttaaaagaaaaagaaaaagaaaaagaaaaactgccaaaaagagaaacaaccaccataaaattttgtttcccctaagtggcgaaaaaaaccgtagatccgattcctataaaaggcaaaaaaaaaaggggggaaaaataaaagctagatccgattactttaaaaacggaaaaatgaagtctgattcctataaaggtgagaaaatctgaaaaaacatctaaaaaatttcgtccaatttcctaagaaagtggcgaaaaaaaaggttcgtaaaaaataaaaagctagttcatacaaaataaaaaatacgcgcgagaaaaaaatagaaagggcaaaacaaaatccgatttctaatcagnatatatctcttctctatctctaatctaatctaactatttaaaaagagaaaatacacgagaaaaataaaaacagttcaaaaaaatgcgtgagaaaaaagtcagaaaaagcgcaaaaaaatgctaaaaaggttttccatcttccataaaaaaacgtgcgagaaatattatttccatcgtcggttatttttttaaaaaaaacatacgaggaaaaaactggtagaaaaaatgcgcatttctaaaaatgatttgaaaaacacgcaagaaaaaacaccgtctttaaaaaaacaaaatcgcttcgaaaacct

SEQ ID NO: 95584 - DNA, 502 bp, Oryza sativa
tgatgcaacaccaactccaaagataattgaataaaaacatcagacaatgaggagaagtaattgacctacatttaatttgtaataactttatatgtctatattcgtaaattcaaattcaaaataatctcaaaattctagattcctgaagtgttactagtacaatgaggcagtcattaatggtatttttatctctaataaggcctgtcacaacttgaatatcttggcaactaccaactaccgagttgattactggtgtaccttatacaactatttcattgaagcttcgttgctggtttacttgtgaatgagattaagtaaatattttttatattacaagaaacatgttagcttgtagagctgttccatctcatactggaattttattgttcatacataccatactaaccttatttggttgctggttttctcctggtaattttgcagcttgttggacgcctatcagagggaattaatgactcaactgccttattttaccagcact

SEQ ID NO: 95585 - DNA, 742 bp, Oryza sativa
actttcgacgcatcggcaccctagttttactcgcgacgagttcttgttttggatttgggctacatcggtctcgatctccagcaagaaagtaagttccatcaaaatccttcctttgcatcagcgacgaaattagtacttcctcggttaggtcccatatactagttgctctttttgcttgcgttatgcatcagatatatggcatgagctatgatttgctatggtatctgagtttagatatactaatactcatttagcttgtctatcttatcggatatatatgctctcgctctgaatcgaactgcgttcagagttcagggtttctatatcaatgactctgaaaagagtccatcacgctagaagagatgtatcactgcacttgtgatacgacccaagtagggatggtatcccgatcttcacggtgtaggatcaagaaccgatagctagtctcaaagagaccaagataactagctgcaaggagccaagataatagtacaacctgacgatcgtactcgaagccaaccaccatctctattacggcaacctaaatcgagggttcgcccaactacactctaagttaccaaccaacacaacctggaatcaatcaaggaaaaacctcgaagggaccaggagcaccaattggggggcgttgaacgccacttctataatctcacaaggaaatcacaagagcaaagggatagagatctctctctgaatttgttagcacacagctgaacaaaagggg

SEQ ID NO: 95586 - DNA, 608 bp, Oryza sativa
ttgcgggtataaatattttgttgtcataagtttttaatttaatctacccgagcattatatccatataataggttagaaatttctatcgcgagctaaatatcggacgaaatcctagaaatattatacgatttaatttagtctatgactaaatgattaaatataatacatggctaaaatccctagtaattaaatccgaatttctaccgtgaatcgattacttatagggattacccaaaaataatctataataatctataagaattcatctatttgtttagtcattaactacatctaaattattaccgcgaattgatttcttatagaaattgccaagaataatccataatttatattaaattttgtaattctacaactataattaatctataattaaattctaattattttaaattttctaaacttccctgatctcccctaatttctatttatttttttcttttcttttctctcctctttctctcttcttttctttcttctctcccagctcctttctcccttcctctctctctcggctctttgccctcccggcggcgaaagcggtggacgcaagggggggaaaaggcggcggcttaccgacagcggcggtc

SEQ ID NO: 95587 - DNA, 609 bp, Oryza sativa
attcctgcagccctgatctgacgagccacccttgttggagtggccttgcacgctcgaggaagtactcatgttgtcgccgccgccgcctctcaaatctagatctgacgagcctcgggctagatctaacgagctcggtgccacagagtgccgtgtcgggggcattggtcgagggggactcgctcaccaacaacccaattgcattggtgggtaaaagaaaagggagaaaaaaagaaagaagggaaaaaaaataagcactaacatatgggccccctgactcaactgggtaaaactaggtcatgaaccccattaaccaaaacccgccccaaaaattacccaaggaagtaaattggactgaatttattgggtaaggaagtaacatttgatattggaggtgaatgaatacaattaaaatggaccctattttcaaaagtgaaatggacctggtccctggctttcccctttggcccccagaatcaaaacttaaaccttgcccaaccggttgatggagaacccggccaaccactacgccccccgggccgtggcttcgccgcgtacctattttccgttggcttttttttccgttacgggcttggcaattaaccaacccca

SEQ ID NO: 95588 - DNA, 654 bp, Oryza sativa
cacccccccccccccccccgggtcccggcgctctcatctcagccacaaatactcttatgacaataatacagcaacgcatcagcatcatcagcttaagcaatttgaggttttaaatccagatatttctctatagaagtgttgcaaaaataattagccttcatcccctgtagctggacaaggcaagcctctctaaaatcaggtgaacatctgtgaatatctcataacatcatctacatacacttctgtaccctcaacattcatcgaagtaccatctgctaacagaataaacctggaccaaaaaaaaaaaacaatagaacaaggtatacatcggactggactaccaccttaggccatcaagacgcacagaagcctccctgatgccatccatagcagagcacaaaccaaataatggaagatcagaagtgcacaagtcatttgggtttccttcagctaacatgaagctgcagtgatcttccaaatcattgtaagtattttcctctgacatgaagccaagtacagctccaaaatcatcatcatgagattggagatgatgcactgatgaccacaattctgtggaagagtcacacaagccttttccatcttgcttacaaggatgatctgtgtatggcgatagagagttcaaacaagcaccgt

SEQ ID NO: 95589 - DNA, 609 bp, Oryza sativa
tgttacatgtatccggaaacaccccgtacatgtgaaggtataccttatcgggatgttccataagtcataggatagagggtatgccttattcgtaaccctgacaacttcaaaatttcaacccaaatttggaagtttctgctaacaatttgaactttcaactcgaaattttagaaaacactactcgaatttttgaaacttttcaactcaaaactgaaaccttcaatttaacttttgaaactttgaacttatatattaaaactttcaacgcatctatttatttattattttattataacaaattatgcttagtgcttagtggtggaggcgtggggacacgtgcgtattgtgctaggtgcctcctgacgccattgcacacaccgtacctctatttaagaagagaaagggacattttaaatattgatgtgcaatttgtgccctaccaaccttttggtaggctctattttgtggtttagattgaacacaaaggttagtttggcaacattagctctctacagtggtggacgcacccattaggcagggagggtcggccggtccagctatgatccgtgtcgccccacgcagctacgccacataaaccttaggggtgca

SEQ ID NO: 95590 - DNA, 4738 bp, Oryza sativa
cggagtcgaacagcaaggcccccgcccccgcggggagcgccgggccggcggcgcccgatccccgcacgcggtacgccgaggcgtcgctgctgctgatggccggcggagcccgcgtccccggcgtcgtcaacccgacgcagctcggccactggctccggataaaggagtagaaccgccggggccgtgaggcgcacggtcgccgtcgcggcattggcggggtgggtcgcttgcggtgccgcatgcacgtctcccgaagcgatcggagcgaaagaagagaagaacggatgcttcggacatggcaagtggttttactttcacctcgtctcttttccttttaaatgctttttttcatgttaagaaaaaaaaatcatgtaggtttgaacttgaaactgaaggcgctagcttagcttccggtgtgtttatcccccaactctgtgtctcaaaagtgtagcaaatggttgacgaatgacctatcaacgcacgatttgttgtgcttagtggatacatatatgtacagaattaaacgagatgttatttagccccgttaatgccaacctgccatgtgtgctactggtatgtggaacgatggttacatctcgagtgaagcttttctctgtttcgtgagtttgatttcattcttaatatacttgctgtactgtttccagatttgcaatgttatagtttcggtccagatgattaaatttatacgtttagtccatccaacttgttttaaataaatcgaagaatctaaaatctgtggttgccgtccaccgatccggttattaatctagtatttgcaaaaggcaacaatgctttgtgttggaaaattttgccattttattgcacacggttgatgaagtggtgatttattctttgtgtatattcatggttaggagttaggacgacgccattgtgcattcttttttgtttcagggaaacaaaagtgcaacaccctatggtttctagtctctcctccttttttaaattagaagaggggaagtctttgttcttgttcagcgggctattgttggttttcgtcaaattgttcaatgtcgtagcagccagataagtttaaattatgcagagtcaatcgaaggacttgggtactttgacagtttgacccgcttttttatgagctattttggtctctgctgctgcagtgtatacgttttcaaggtttgatctcaaaattccgcgcttcttcaagatgaactttggttcatacacggtttcttctgtacaatctcaagctcaatttgaaacgagaaccggaaacattttcgcgtgaaaccagcaggagcaccaatagctattctcatttcagcaaggtgttgattccttgtggcgagacgattgcaatcgctgtacccaaagttgggcgatatcacattgggcaccgtccttgcgatctgatcataatcaacaaccattccacattagtgacgaccgttgcgcagaagtggttggcctcactgctgtgtcgacagcgacggagatacacgggagacgcgtactactggactaagaggtacaacacgccaggtgactgacagctgcgggcaacaacaaaagataaccgattggggcaaaggtagggaggcaggaattggcgccatcagaatacagtggttttggtgtgatataagtgcaacactagtgtttatccagatgcattccgtagacacacaaaaaatgaaataaaatataagtgtcacaggggcgaagtgtccacctaaatatgcattactttgaatgtgcttacacacctaaatattcagatgcgcttacacaggacgatagaaacacaaagagcccctgaagataacacaggggatcatcatatcccaaatagaagagaagaggtatgtgacattatttcaccaacagaaacacactgccaaatgccaagcacaaactaatgctagcatcctaggtcatatctttgctgatgttgcaccgaagaaaagtggaaatcaaggctgaagccattcacatcagagctaccggacacgaagacatccacttaacggacatacatgaagcaccgaaaatgaaagttgccggagggccttgtaccacacaatcatgctgacttgatttccgacgttcaacggttgtggtcgtcgaaggccaccggcatcgatgccctttgagggaaggaagccaaaggggagagcacccaccgaagatttttgccatggcctcccacatcaagccatcaagtgttaggttttattaagttgcaagtaagttcaacactctccaatgttctttggggaaggaagcccaaaggagagagagccaacgaaaattgtggccaaagacatccaagcaaaaatgattaagacgaagcagggaactagcaaacatcaacgacgacgacgacagcagggaaggaagaccaaggtgagtagctggtgaagctcaggcatgcacaaagagaagatgaagggaacacggatgctgtcctcactccttagcaacaatggagccattggtggtcaccattagccatgatacttgcaacagaacctatgaccaaaatccgtctaaaatgggaagaatcgaagggaaatgagttatccgggttagcccgtggtgttaaggcctcgtccaggttcgttgtaagctctagataccgagggacagtagacattggcgttagatctaggtgtgtcttgagctctcctttgcaggaaggaagaatcaattattgatgatgagaagggcatcgaagaggaaaaggaagaaggccacctcaactagacaatcaacggttaccaatagatgaagaaagttgccaaatctaaggaaaaggagggaaaccacaggaaaaggaagaagaatgtgaggaatgtcattgagtcaaggtggtggcaccggccgcggtggccgatgatgcagtggggatgtgggtgcgtctcctcctgggtcgctcgaagagagcaacacgaatatcaagtcttcaagtccctctgtatggaaatgtccctagacaaattttacatcattggcaggaaaatttggctaacttttgtcaatttcctttgaaagctccaacacatttgcatctagcacccatgcatttcaaaataatactcccttcattctatatcataagttgttttaagtttattctaagttaaatttcttcgagtttaaccaatattacattaaaaactagcagcatctctaacacaagctagaagtttggaagcactgcctaacgccaaccattgtcgtgcccctgcatccatgccaaacagcgcaagctagccatgcgcctcatagcaagtttaatggcaggggtgattgacgcctctaattttatccacgccagcaactaattagttagaaggtacttccttcgtttcacagtacaatataagtcattctagcatttcccacgttcatattgatgttaatgaatctagaaaatgctagaatgacttacattataaaacggaggctcactccgtccaaaaatataaacgatttttgatggatggaacataccctagtactacgagtctgaacagagagtttattcaaatttcatagaactataatgtatattatccatccaaaatcccttatattttgagatggaggaggtagcatgtagtatacactatctccaatacaatactactatttatttttattcacttgcatctaatcaatatcactcttttcattttctcccttagagtttgtgagagctaagtacaacagtaggcaatagtcaagcacatgtaaaggacagcggggaggagatagaagaaaaatgagctacatatttgtagctagttgtaagttgcaacacatgctccgagatattatgtgtgtatgagacgtggaccaaagtataaatgatacaatatatgtttatataaaactattctatgggtaagctattaaaatgactatagataatatgtcaattttagaagtagcagttgactatactattaaacttgctctgaaaatgctactccttacacgtgaggtgacttatcctctctcttcttacctctcttctccgctcatcatttaagtatatgtaacatcttgagttagtgtatactccctccatcccaaaaaaaaattctaattttaaaaatgaatctggacacatgtgtgtccacattcatctctaaaattgggctttttctggaacagagggagtaagactctagaggcttagaataaggatagtagtgtgttacaagcttacgtggagaagaaaaataaagaaaaaaaaagaaatgttgctctcacacatgagctagctctccacatgctctaagataaatacattagttataagttcatagccagagtaaaagagagaagataataaatagagctaatcttatatctaacctattgtaaatgttaactctaatatacacatatatattgttgttagttctactactattaattgctcttacagtaactggtcttaaaacgtgatcaagacaacttgtgtaaaaaaaaaaaggtaacctatcaagactgtgaccgtgtgcgacacttttagccccatcgtttggcctaaacagctaaagaataagccaaaatttgaatttttgaacttaattttgaagttgattttgaaatacttttaacgtaattttttttaatattggcttttaagtcgttacgaataaatctacaaaagttttacttataaatgaattttaattttctaataagtcaaataagctatttt

SEQ ID NO: 95591 - DNA, 1723 bp, Oryza sativa
tatgataaatatttttaaaaatacttatgaatagtatgtaaatttaaaaatcccacataatgtgttgtttccttgttaacaatctttttttgacagatgtataaaaaatatcaaattggccacctggtttaatgatgaactacgtggaataaaaaccaataatggttgattgaatcatgatctgtccacaaaataaaaacctcatttctcattcaaacactactacaaaaattatcaacggtatgttaataccagtggagaagccgcatcagtgttgcactagtgcaagtaaaaaaaaaaaaaggaaggctggctcaaagcatcggagccaagcgccccctccctctcccttcgcccccaaaattagcctcattgatgccccctaatccccatccacattgtagatcaacaagaagaacgcaagagcctacatcaagaataacaacaaagcgcatcagatatcaataacaagctaatcacatcacaaatcaaaatcttcagccattgccaaccataactcattcaacagatcggactcaccgccatcatcctagtagagatccaccaacaatgtaattgatctctcccactattgtcatctccctcaagccactgtcgccatcgatcgtctcctttgagctgctctgcaccggttcctaggtgtgttttggggggggagggtgagggggtgttggagggcttctctttggcatgtatgtcgaggagaacatcagcaacggagagatccacagtggtgagatcagaggcggctggatccaacggcccccaacctccaggcagccatttccgacactagaacggataccctcatctcaatcgggcggtaagccccatctcaatcgggcacaacgtccgtcacaggctagaagtcactgatgtgaagagttatctccatcgggcaaaagcgccgtcacagataatctatctcaatcgggccctaagtaaagaccgtcaccgatagctttgacccagacgaccagtcaaactatagcccgtcacagatgacctatctcaatagggcaacacctagcgcccgtcacagatgactactacttcaatcgggcctaaactagagcccgtcacagatgatactcatctcaatcgggcctaaactagagcccgtcacagatgactgctgacctcaatcgggcttaaaatagagcccgtcacagatgactactgacctcaatcgggcctaaactagagcccgtcacagatgactactgacctcactcgggcctagactagagcccgtcacagatgaccgtcatctcaatcgggaatttagttatggcccgtcacagatgactataatccaaaaaaaaaattttgttttttggctagcctcaggcctttgctagccatgctcgctgcaaaaatgacagaaacaaacacagatatccaatatccccatctccccagcatcacccattcatatacatatgcattcacatacacagacatcaacatatttcacataaccacacattcacagccatctcatatttcacatccatttacatattttacatccattcaaatatttatcatatttcacctgcaaaaccgagttaattggatcaaatatttatttagcaagtcttaacataaacatatgaaatatatacataaatataagcatcacagttacatcatcacagttgcataataagtgttcatcattgcctaaacataaaagttc

SEQ ID NO: 95592 - DNA, 601 bp, Oryza sativa
agagagccaagaacttgcacggtggcattttaaagaggctagtgtggtgcgctttatgggaaagaatgacaatgaaaggtagaaaacaaagtttactgtgttcagtacgtttattttactgaacatgcctcaaacatcaatctactaaacttaaatctgttgacaattctactacacttcatctgttgacgattcttcgttcctatcctacttctggggctcccaaacaaacttactaaatgtaggtataattgtagagctgtcactcctacctatttaagtgggacattcgaacaccttctgtcctccaattagagtaccaaaggcatggatgttagtaaaagtttaaacaacctctatacctcaattgatctgtcaatttttaccattttggtagcagctgctgaccaacagtcatgcttgcctgcaaaagttcagaagcaaacattcatgttggcatgtagctaaccaattacttagaagttaagcatcttacgactaacctgggacaattaacccaaccagatgtttaccaacaaacagagtcttatcagctttactgtgcaaccaaatccacagatccgtgataaaaaagaagagg

SEQ ID NO: 95593 - DNA, 703 bp, Oryza sativa
ggatccccccttatttttgtttagctacaatatctattaaatcttagaccaatgttttgggcctagccctcacattttgtaggctaaaatattggggcttattaccacccgtatgttgaccacgccgacattgctagttggagccacacttccgccggccactgccaagtctccctcgcccctcacttcgttgatgattcgtcaggcaggcaaccactttgcctcaccctcgacctcaactcctcaagctgactgatttgttgggagaaaagaaacaaaatgtgaacaagagagaggcgcttttgcaaaattactgagatggatgagtgacgtggaaaatattcctatgtggagccctttggatcaaagatgcaccgatcttgccattgaaccaatatatttaatttttaagttgttgcatcggaatgcgctcacagattaagttgttgtaccataagtgtaatttactctttaaaatatatgttatagcatgtccaaagaaaagaacctcctggggcctgggccaattactctggtggtgatgagaatataaaattcacatgagccaaaattctagcatagagaaagggccatagagcctatagaaagctcaaaaccattaccactatttatatctggttaagtagcaatgcaacaatgtttagcaccagtacatccatgcccagcatagaaatctacactt

SEQ ID NO: 95594 - DNA, 775 bp, Oryza sativa
  unsure (1)..(775): unsure at all n locations
ctgctgcnccccttttgatanggtacagctcgggctcccanaccaanccattcaattcatccagttcatccaaaagtcaccgaatcaattcatccagttcatccaaaatcaccgaatcaattctagcaaagaaagcaaataaaaacaatcaacacatcacggccgccgcccagccgtcgtccaccgctcgcgccgtcgtctgccgccgcatggccgcggccctccgtcaaccgcgccgcctgcgcacggccgtggcccgcccccctccggctatatctgggagggaggggcggtcatgagccttccgactcgtcttaaccccttcgccgaacgggccgcgccgtcttgacccttctagtctccattgattgccatcatgctccccacggcccctttggccaaaactgcgagggatgtgcccgaatccatctgacatcgttctccccccgccccactttgatcagacctgcgagggaggggccggtagtcactccacctttaccctcatcggagcaagtctttaaatgtttctgccgagtatggaataatgaagtggcgctcttccactgtgccatccctataattcattaatacctcttgctttatatgtcgatacttgtaaccttcaattatctacaaatggggagggtttaaacacccctccccaaccgatgctttatcaacacacttgagcctcacctatcttataagcccgcgagtcgggttacacaatgaaatttggttaggactttcgcattttttcttggactctccg

SEQ ID NO: 95595 - DNA, 874 bp, Oryza sativa
  unsure (1)..(874): unsure at all n locations
actccctcacgtgatagacaatcctgtacgtctgctaatactctgatcncactgcgcgctttttttntttctatcatgaatatgtcctacataattattctccctnnctcccccccccncnaagttatgtctgacatacnactcggaacccggcggctcccggtgacgacggctacaggcgccgcgcctgactgcgcgtggacggaggctcccggcggcgcgtggacggaggctcctgccgacggcggctcccgacggtgcatcgacgggcgcccgcgccgcgcgagagaaggcagcgagcggcggtgcgcctagctctcggcggattgacggtgcacggtggcgtgcctgactcccgagcttcccggcggactagcggacgacggtggtgggctggtggctgcgtgcggatctggaggatttggtattttgggtagagaatttgaagttgactggttgacttaggattagaagttatatatgcctgttaaatgggctttagtattatgggccaaaacatgtaaaaagtctaaaattagtcctctatacagtaaagtcgggtcaccgtggggagcggcgtcaccctcttgccttataggacacaacagccccaaaatatatgttgccctaaaaaaggggaccaatacccacgggaggaaaacaagacgacaaaggcaccggacgggggcaaggtaaacataaacacctcaaggcccgaaaagaaccggcacgtgaaaactacgaaataccccaatcacggggcgaccccttatttcggccagcacaccgtcatctccaacgccggtcaaaactggcaaatgttctgcaaaccgacacggacgccgcagcactaacccaacagcgcatacgtgcc

SEQ ID NO: 95596 - DNA, 545 bp, Oryza sativa
tcctgcagccccagcgagagcatcatagttgacatggtcggagctacagtccccatatccgtctctactctttctgtaattgactccctccgctcccccttttcctttgaaatggttgagggatatgaatctggatcccgatcttgtctccggactatcccgtagtggttctgtgaccgcaattggatctatttctttcacacggtcaactggcattggtttaactaactggctggctgctattgattgatatcagagcccgagcctttgcccctttttgcatggtctacctcctatcggctactgaagcccgagtatcaaactactgaaagcggaggttcaaatacctcggtacctgcttgatggtgctggcagatcgactacttggtctggggggtttcgtatcaatccatgggggctttagtcatagcccccgcctctgctttgttcccgctctaggcttaaaccatccttcgtcagtgcttcctgcgcttctgattatggagctgtacgaccttcccggtcaacgaatgaaatgaaacaac

SEQ ID NO: 95597 - DNA, 1080 bp, Oryza sativa
tcgcatttctcatattctaacctatattttgttagccttatcttaaccttggctttgaccgtgtctcccgtgcaatttcaatacatatggcgcaaaacgattccacatatatatcgaggtcagaataggatcgggtgttttcatgtctcatcgtagcgtccgatttgtcttgataggtgattgataattagaatcgggtcggatatggatagtgtcgaatatgaatacaaacacagcgggcataaatacgggacgaataggtatcaaaatgggtatgaacgctaccggttacgaataccaattaagatattaagtcaaagcaacaaccatatataccaagtggagtagaagatagccagtcaactattttatatatccataatgtgactatattaggggcttagggcgtagattgcctaatattatccacatactccacatcgttaatcattggcagtttttaacaatgtaaaaatcttgccagcagtatctcatatgtcataaactcacataatcacatttgtaattatatcactgagaaaaaaaaccatttatgttcgtttgaccagtgacgagttgcttacttctagaggagatcaggatgttgcaggatgatggcctcgactactgagacgtcgaggagccaaacacggcaaggggtcaacgaagcgaaggggaaccgagttaagggagatgtaacgcagcgactcgcgacggttgccgtcggtggtgcgacgaccatagcagtcccgacaactcgcaatagtggctgacggcggcatgacgggcgcaaggcaacatgcaacgtgcggtggcaggacgaacacgaaggttagactccatgcttttggactatattattggtttgtgcgttgcattgggctaggctagatgatgctatccagataatatccagatagtttgctgggtaatatccgtattatttatcgggtactccgtatccatcaaataccgccctccaaactagatctcatatccaccaaaaagtaaaattcggcttcgatatccgtacaagcacccaattattcggatttttgacccgaaattgtcccaaaataa

SEQ ID NO: 95598 - DNA, 635 bp, Oryza sativa
atgctttaggtctcacgttgacttatggaatgcatattattactagagatcaactgggtgctaaccacgggagcctacagccaatatgcgtacaattaacttaccactcgcctacaatggcctgaaccctgcctatgtataagccatctcacagagcggagaccacgcaatgtagattatggacgacatatatggccacttgctcacctatgttttctagcagtgcaaactcccatcatgaacatcctgtattgctagatgaaaaaacatgctatacagagctgcaacaaattgagatctatttaaatcagctttatgcttgagtaatgtcatataaaagtacatttcaggatactgtacaagcattctaaatgaatcaatacatagtaccaaacaattaacctgtatgactatgagaaatgctcaatgttgatgtttctgctaatgcacaggtgtttaatagaatggaaatatttttttgacttaaatgagtagcaatagagactattaatttctgatgaaatagagcatccacagtatgataaaatgcgtactatctcccgaataaatactagtaactgattatggacctaagcatgcacaaagattaaagatttcatgttcacataccatgt

SEQ ID NO: 95599 - DNA, 577 bp, Oryza sativa
gttcattttaagtttagtgcctgataaatgatttgctctatgtagagtttgctgtccttcaggaggtattgggcatggataaacccaatcagggatgtgccttagctatttctggatcttgagaggttcctggtttgtaatttgattgcaaaagacctgcacgttgcaattaattatctgtatgaatagtaataatttttttactaccttttacaaaggaaacactgaaaatccatatttgttaattgatagcattcgctacaattactctggcttggttcaaagagcttgaaatcacatttgttgggcatgcttctttcagagaatatagcacatcaaatttaccttatcatccatttaatattcttttgaaagatattgttctaaacttcttgccacaattctgtcatgtgctttgcacagttccaattcctcagaaacattcgtgttctttcttttttaaaaaaaggaaggatctctaaaaaaatataagccattccttctttaaaaaatctgctttttatactttattttttttggattaacgccttgggctaacaatttgccatttgcttgg

SEQ ID NO: 95600 - DNA, 629 bp, Oryza sativa
gttgcagatttgtgtcctaatccagttaatgagttggaaaaatcatgagatttggcacgcagaaaatattatacagccatcggattcatgagtcatgcagctcctaaatatctttccaaaaacagaacatcatctctacaaaagaagtaaaagtgcatagttaacaactacagaatatcacacccaaccactcacagaattggacagagtatctgcaaaagaaggaaatgctcagaattaacagctcctaaaacacaaattcctaaaactgaacattatctctggaaaagagggggaaatgtgtattttacactgcatagaaaccaaagacattttacactacgtagaaaccaaaaatttgtatttgataatgaacctgaaaactaattactaacttgcaccagatttcaggggtaaaatgccacctaagaaacgaggcatcaaccctccaggctccacggcactgtaatactactgtcttatcttctgataaaaagggctagaaacaaaatagagtaaattacatgttggactatatttttttaccatggtttcactttgggctacccttaatataatgttttcaccttaggccagattttataccaaaacctttcactttgggcgta

SEQ ID NO: 95601 - DNA, 611 bp, Oryza sativa
cttcagaacaaaaggatgtatcaactatcaagcatgacttgaccagatagagcatacataacagttcgtatataaataaagatcagcatcatgaacctaacatgtttcagggaaatcagacacctagcatcattgatgatcatgttaactgtagcacttcgcgtacaatattgggcaggcaaaatatcaatgaatatagaacggtacagcatagccggatagcccaaccctgagtaactatgactctatgagcaacctaaagataattaactaggagttatttcattagaatgaagtaaatggataaatatgatctgtcatttttgtcatgcgcaaaagcatcataaatttagaagttggccaatccggcgcctagaagtccaatacaacatgtacaatcaccatatggccggaaattttgatgcacaaattagaaaaagaatttgcaagttaattgcaaagggaattaaccaatcattctaggcggagaaagcacgcacctttcacctgctggcaggaccgccggatagcaatgtcgtcgcccgcgtccgatgcttcgtggacctcgccgcgacccgaatatggagctgttgcccgcgccgcctgtacga

SEQ ID NO: 95602 - DNA, 638 bp, Oryza sativa
  unsure (1)..(638): unsure at all n locations
ccaaaaattgttttttactaaattttgttcgcgtgattaacatttcattcttgctaattagttttccatctgcattctgttccaaaggctagaaagtatcatatccatgttctatggttgctttctgatgtttatttatttgatgtcaatatatgttgtgttactatgcgaatacttgtgaagatctagtaattcatgagattgaggtcaaatagatatagtgtttgtatgttttttttatggaaattgctgagctagtaattatgtatttagttttcttttaccagctcatgtttgtttaatcatatttcgtgtgtcattgcccattctgtgtggttatcgttgatttacctcctattattgtgcataaagtacatatcagaagatgtcttcaaaatgttttttgcaatgtgatacacttaaaatgcttacattaatgtaattttattatgacttgatcatttgccaagtttcttctgatttatgtcgngttttcttcagctatttcctttgatgcactacagttctgatttagtaagttacttaatagggtgatggatatggaattaaatttaatatagtgcacataggtttgaatctatattatttaaaatattttcaacctatccattcaaacg

SEQ ID NO: 95603 - DNA, 533 bp, Oryza sativa
cttcgaatccccaatctcaaaacacatttaacttatggaaagagaagtactactctcattctttccctgcctgcaattctgtccctcacatgacactccaaacaagaaccgtcttacactagtccatttcgctatcatattcttagtactagagaataacaaaaaggattctcatggatggtattactaatgggatgtccatcaagtcgttctgatataacaccattaaattatattcaagataggtttaacggtgtcaagtgaacagcgaatgcactaaactttcatgtaaagcacatgtagcaaagaaatgacataaacaaactgcaaaaaaaatagtatcatgaaagaagcataaacttacataagattcttttaaacaaccagcagttatatacccaattgcacataacaatccatggtaattttcgaatctggtgcaattcatcaaatatccacgtgaattagaagtagcataacagtacagagaaaatggatttgtgttttaaatttctcttccataccttgatggg

SEQ ID NO: 95604 - DNA, 575 bp, Oryza sativa
aaggaaatgttcagtgtttcaggaatccctgagacagattttcacactgataattttagttcagagattgttctgaaccaggaacttcatgaattggactgaaccatggcatcacttgtcacaatttgattagtacagcaagtttgcaactttagattagatattgtttctgaacataatgatatattttttttaaaaaaaaatactgcactcagctgaccaatttcatattgccattcaccagcaaaattttgaggaattgtattccactcttccgggtccaatctttagtgatacgatggctaaatccatcgtcaatttcataacatggacaagtacaccatattaaactttgggcaactgctcaattgaagccgaagagctctaatgatgcttttgtgaacaacagtttgacatgaacagaacaaagccacccgttggtggtgataggactgtttgagtacatgctaagaaatacaaaagtttctattacccatctaaaaattgaatttctgctaccaactttttcattcactagaaaaaaatacccgtgtgttgcaacgggaaaaattaaa

SEQ ID NO: 95605 - DNA, 597 bp, Oryza sativa
aggatccgtgcacgagttcatgccgtgttcaccaaaactataatcacaactgtatgcttaattaagtgctatataaaaaataattacgcaagtatgagatgaggtggtgagagcctcagaataaggagtctagattaattaatttatgaattaggtcattggtatgtctagattgataattcagacagagtggtacatcagggttgataatttcagattatccgtgtaaacggtctatcagaaaatccaatagaaatattaaataatccgcatatgccggattttagagataccacatccacatccgaaagcgcaccatactatttggaaacatataccatatcctcgtttcggatggattcggagcgattttatctgatccgttttcaccccttcataaatgtatgattttaaatccatctataatctacgagactatgaaggtgacatcttcagcttatacacttcggttgtttgggcattcagctcagtgagtgacatctccaaatttgtgcacaaatagctatatcacggtagtgggtcttactatgacccttcccctccttcacaatttcgaacaagattctttaacatatt

SEQ ID NO: 95606 - DNA, 630 bp, Oryza sativa
ggtaccccactataactggattgtagtaagaaactatgtggagtaaattcacaaccaaagtgtatagaagattttcaagtaaatacatttatgaaagtaagtttaataaagtctgaaagcaatttacataaatcataaaaaaaataacttagtacgaaatggaagtaagttgttacaacattagaagtaaatccgttatagggatgaaaaacatgagtttatcaaaaaattaaatttaatcggcaccaaattgtggaattgactaaaaacaataataaatgtaatctactcagagcactatgaatgaagtaacttaatcaaatctaaaagtaatttttatatatgataaaagtaacttacatatataataaaagtaatttaccagtataaatattttttatcataatataatcatgtaagatattgttataatgatttaattacaacgaacacaatggtgtaatcgaaatatagatcgaataagtaatctatctatcttctatctatctatctattatatactaaaagtccattaaacttcctagaaaccctcctaagccgccacataggacccctggaaatgctcctacgccgccatgtggcgatctaataaattatagaaattctaaa

SEQ ID NO: 95607 - DNA, 539 bp, Oryza sativa
aaaaaaagtagagatgataagaggcagtaatagatgtgattgctacctccaaatttatttatggcattcaccaataaattaagatgcaagatactccctccattccaaattgatctgcatatagttttttttgaggttattcctaaatgatctacatatttgtgtttatttattaagtctattcgttatttgtccattggagtaaatggacattgatgcatgcatccatgcacacaagtatttataacccacatgcaatatcttaatttgctattggctaggaaatagtggggatggtgcatgcattgggtttgttgctagagtaaataaaatatgagagagttattagctttttttggtcttggtgtacctatgaaatatgtagatcaatttggaatggagagagtatacaataggtcacctctaatacacaaatatcaatgactttagtactctcacatccttcttgaagtttgtgtggggggtggttcatcatctctgtcctcacttctctcctccacctcatcacccaatagggg

SEQ ID NO: 95608 - DNA, 666 bp, Oryza sativa
cccaccggcccacagtactacaactacgtacggacatacacgtagtatgtacgcttcctcctctagtactacatctctccttcctatataatcctattctattctatagctaataatttctgaaggtagctactaattttaatgtagaaaaaatataaaagaaatgaaacaacttactgtccatttccatttccagaaacctactatcttaaacattagatttgaagtgtagataattcaaactagtggatccattaatttgaactctctctctctctctctccccgagtcgccacatgtcactttaataaaatagaaaaatctgaccatcaatttacatataaattggtggacccaataattatgttagatttttctttccactaaaataaaatctcccttcgtccacatacgcctgcacaacgtacgcactattcatcttcacagcaatgtaggtacgatccctccgtatactttcttttccttttgtatttccatgataattaaaattaaaaaaaatagaggcctaaaatgtgcattaacctactagatctatttagctcttcgtctaggctctcctaataagttcattacacatcatataaaaaatctgaccatcgaattacatttaaaatggggaacccaatattttaatgttagaatttt

SEQ ID NO: 95609 - DNA, 561 bp, Oryza sativa
tgcgtgtaaaatcgatttttatttacgagccttgacaagggactctcctaattttcacagatgggtcttcttttgaccccacctaaaaaataaagcggatgtttgcgaaaatagtttttctagtaatgtatgtgtggcctatatatatatatggtatagtcactcaaatttagaagataatatgttaaagaatcttgttcgaaattgtgaaggaggggaagggtcatagtaagacccactaccgtgatatagctatttgtgcacaaatttggagatgtcactcactgagctgaatgcccaaacaaccgaagtgtataagctgaagatgtcaccttcatagtctcgtagattatagatggatttaaaatcatacatttatgaaggggtgaaaacggatcagataaaatcgctccgaatccatccgaaacgaggatatggtatatgtttccaaatagtatggtgcgctttcggatgtggatgtggtatctctaaaatccggcatatgcggattatttaatatttctattggatttctgatagaccgtttacacggataatctg

SEQ ID NO: 95610 - DNA, 678 bp, Oryza sativa
attcgtataatatttaaatatcaaagattgtatatattcttttcacaccgtactgatctcctttatcttctacttatgcttcatttgatctagctggatggctgagcttattcaggatacatgaaacgacacgtatcattatgtgcaagattaatcaaatattgaatataataaagccaaaatatatttatttaatttttaaacttttatataaaatatattttaattatacacaagttgcttttaaatatataccatgtaagttatggatgtcaatagaattatagtgcataaaatggttcagatggatttagatattattatcaaaagatatgtcttttgtaataattcctatatcaatgggtagataactgggaaaaggagcaaccaatccgataattactctagaacttattgcttatttactaaaacgtttaatgtgttgcatataatatactttatgaataaaaaaatatcctaatctatcaatcatatgacagcactgatccataagtatataagatctattcactaatcgcaagtcatatagcttacgaggtattcatgcatagtgcatctaataattaactaccattcaacgagcacttatgtcatgaagcaccatatataacggactatactaagtggagaactatcaacaaatgataggtaaagtaa

SEQ ID NO: 95611 - DNA, 600 bp, Oryza sativa
acatcccatttctgaggccaaaacgttttttttttaagagagagagagtgagaaagcaagaccactactgaattgtaatgtgttattttctgtagcgaccatgtccaaagaggagcagcgtgggctacagggaagtgggagtaggcgtatatatatatatatatatatatatgtatgtatgctggcatgtcccctctctgttttaaaatattaacatttttagcatggtgacaagttaaacaattttaactttaaccattaatagcaacaaaattaaaaaaaccaatcatgtaaaattgacgttcctaaatttatcattaaacaaactatcataatatgcaactctttttatttaaaacatcttacttttatagatattgttggttaaagtagcatctcggtgaccgtgtcaggatctaaaaaaatgcttatattttgagacggaaagagtatatacatgggcaatataatgatgttatgaggtgatggttgacaaaattcaaaaccaaatcattagcaaaccgtctgctaagagacaatcatgagtttatccacgcgagagatcggaggctctgactgacagtaatcactcagagcgat

SEQ ID NO: 95612 - DNA, 746 bp, Oryza sativa
tgatggtaaaattttcgccaattaggataaaaggctcaccatcatctgaaattattttatcagaaccacaaatgataaaaataatattaaatgctcataaaaaagatataatgacaataatgtttattttaatcagggatttctgcgtatatagttttaaggcatattttgctataggacatcgtgactttgtggttttaactccaggacaccgcacaaagtcacttttagggaaaaacactctcaaaaacgtggttatttgccagcggacaacgcacccattaaaataataatttccggttgaagaggagagagaaactacatgaaggctgcgttctttcttcttaggaacagtgattacggaaaacggagcgatccattagcatatgattaattaagtatctgctattcttttttaaaaaaatggactaatatgatttttttaagtaactttcgtatagaaactttttacagaaaaatgcaccgtttagtagtttgaaaagcgtgctaacggaaaacgagaacgactatcctgaaaagaacgcagccgaaatgtcaaaaatatcctcggacccacatgtcagctccttatctctcttctcttcccttctttccccccccctttttttcctttcccccccctctttttcgcccttccctcccctaccgacagaagcagcagcggcagcatgcaacagtagcagcggcggcagcggcaacaagcagtcggcagcggcggcagcaac

SEQ ID NO: 95613 - DNA, 694 bp, Oryza sativa
  unsure (1)..(694): unsure at all n locations
ttttgggcgtcccttccccccctttctgcctttccccttgttcctggcccccccctttccggtggttttttgggggncccccccttccctttgccggggttctcttctttgttggtggcccgtctccttctcctgggtcgggccgtcttttcttggttcgtggtcctttgcgcccggggcctgcttttgggttctctttctcctcccccgcgtttgtgttcccttcgttcggccctgcgtggttcttttgntcttcccgtcctcgcgggcggtctttcttcttagcctcgtccgttgtctcgggctttttgtttccccccggttgtttgttcttgccgggtttctttttttcgccttgtcccttgtcgctggcccctttttttgccttccgttgcttcgtctccggggtggtctccgcctttttgtgccccttctcgcgccctgggtcctccggtgttctgtggtcctccnccttcttgtcctgtttgtgggcctccttttccctttcgcggtcctccctggcgtcctgcgccgtctggcctgtttcgtccgcggcgtcgttcccttctcctgcttnttcctcctcgcccgtttgttttccttcccttccccctccttgggcgntgtccggngtgttgtcgtcttccgcttcttctttttccttttcnnccccttgctctccgtgggntgtccc

SEQ ID NO: 95614 - DNA, 1506 bp, Oryza sativa
tcgtattgcattttcgtaaaagaaaaaaggtaacatacatacgtacgtggcccaggtaagatcgggtttcaagagataaaagttttttaatgggttcatcaaatttaatgaaaatcaatggctagattttttttttttgcatttttctcaggatttttaggaagtctttgatttacctaggaaggtagcccatgcaaatgtgcaagcaccttattcaatactacttggatttttgttataaatgtttacgtgtggataaatttttctctaaatatatttatttactctattctaaatctgtttgttttgaataatttgtcttgggatagctttgaacaatggttataaattctttctaattaccctcgcaacgtataaatgaaactaaaattacttgaaaatatgctgtattgaatttatgagaaaatattctcacaaaatgaagttggttcatatgaaaattactaaaaattctttttttgggtaatatttagcatatattatttttggggtttataaacattaacctaatttttttttcttatatactatagatgttttgatggattttaggatatattaatttgaaaatattttctattaaaaatatggctaataggacagtttcatctaatcaaatactaacttctatttacttatactctcttttttcttcatatgctttcttattttgtttgaaatttaatttaaaataatagtgatattatataaatataagtaggtatagagtacctataaatgtttaagcgtgatagacaaaattacacttttggtagatcaattcttattataaagtatatcttattttttttagaattacacagtacaatatatatactcacaacgcacgcgcacttacccctatgaatgcacgctcgcaaatcctacccctatgagcatcttcgaagactgggccgacaaattcttaagattgacgaagtcaccacaggcgcttcgctgtcgacgggtacgtcgcctaccactgaaaacacagctgtgtgttccctaatttactaaacttagtatgaaatacccatataccatgtgttaatagaaaactagagaaaaaaatatgacatttattccctttattcttttacttaatatatatagggcattaatatagtatccaaaatagcttataaagggtgataaataggactgatagtttacgttattcatgtatgggcccaatagactgcaccctacatgttattaaatatgatgatatatcattgattttttttacgatttgtcataataattgaatgccatgctaaagcgccaacatataacctgttatatgttaactgataactgatatgtagtgatataatctatattttcatcattttcataattcgcatgtctatttgaattacatgcaaaatatgacctaaaatataatttcttttgcaatataaaatatagataatacttttttaatttaatggcaaataatacaatgggggtaaattttgtttt

SEQ ID NO: 95615 - DNA, 524 bp, Oryza sativa
ggaaatgttggaaagaactactatcttaatcccagcatttgttgtaactgtagtaactgcccatcatttgttgtaactgtagtcttctaccaagaattgtatgatattttacctggttaaattattgaatgattgatccaaaatttgccggcttgtttcaagttgcactctttctgcgtttgctgttagcctgttatgctgtatgttgcacactttgcactgcgggctatagagaattggcacatttgcatatttattactggtatgcaattatgagtcccattgtttcacttatgcttataagcagttttaaattttataacttaattttgaagttgattttgtggttttctcatcgtagcaacatttgcttttgaatcactaagaacacatattaaaatttttatccatattatgtttatattgctaataactgattcaaataagcataagcataaagccaaataatgagttcgtatcttaaatacaaaatatgatttcaagcagttaagctaactttgttt

SEQ ID NO: 95616 - DNA, 1259 bp, Oryza sativa
aacaatttatcaccggatctatagtcatgagaattcacgtgtcataaatatagatatatggatgataaattattaaacgctaaatctaaaagtgataaattggtattgtatcttttgacccaccatctattatatactaaagtccattaaactttctacaaacgctctcatgccgtcacatggcgctctaaaaacgctctcaaactgccacgtgacactctaataaaaatagaaaaatatataaattctgagaaaaaagaaaaacatctcaccattgatttttattaaatttggtggacccattatttaccgccattagattagatctattaaaataataattccttcctgtaattaatctcccgtgtgtcaaaatacgttcgtctggattagatctattacgaaaaaaattccttcctctaatctcctgtgtaattaaatacaatagatcaaaatacgttctcaaaaaaaaaaaagatcaaaatacgttcgcctccgtgactgatgaggatgtacgtacgttcctgcctggtggaaacgtaccggccctcccctcacctcctcaactcttttcctctcttatttgaaataatatttactatttatcataataaattttaaataactctaccttctaaactatacatacaataattatctattcacgtcatatatttttctacaattaaatcaataacacgttggatcgcattatcaagttataacaataaatattattttgggtcgtattttgaccctttatatcgtatctaaccaaacaaaatggcaaacaaaatggcaatgttcaaaaacaaaatttacacccattgtattatttgccattaaattaaaaaaagtattatctatattttatattgcaaaagaaattatattttaggtcatattttgcatgtaattcaaatagacatgcgaattatgaaaatgatgaaaatatagattatatcactacatatcagttatcagttaacatataacaggttatatgttggcgctttagcatggcattcaattattatgacaaatcgtaaaaaaaatcaatgatatatcatcatatttaataacatgtagggtgcagtctattgggcccatacatgaataacgtaaactatcagtcctatttatcaccctttataagctattttggatactatattaatgccctatatatattaagtaaaagaataaagggaataaatgtcatatttttttctctagttttctattaacacatggtatat

SEQ ID NO: 95617 - DNA, 558 bp, Oryza sativa
tttttttaatccaaatttattgtcaatatttgttcagaatcttggtacttgtcgaaattgcaaattttcttcctccaatcatacgtatccgagtagtgaaattatctgtcatgccttgagggaattttatatgtctctaacccgtatttttgtatcgtttgatttcttcagatattttctcctggtctgatatacccatttatatatttaggataaatgagtataataagttccttcagtactaccatcttgaataattattggttcatatccatctttccagatcagggtcttgaatagaatacctcttttattcaggccttcatagtcggtcgtcctaggtcttctttgtgtccactttatcatgtaatcttcaaattatgaatagtcatgcttatgtgtcgtaattactatggcacataagttactatcctattttcttgtataaacctttattccattttctctacacaatgtcgttatgttgcttagatttatctgttcagactccctttgtaggtcttgcttttttttatccagtcatagttttagcttggc

SEQ ID NO: 95618 - DNA, 526 bp, Oryza sativa
caacatccacgcttctccagacttctcgttagacactgtaagaatctcatgactactgctatctgaatcatcaccacgagctgctaaacttgcaatgccatctttcctcttcttcagtaacggacaattcctccttatatgtccaaactcatgacacttatagcaccgggcccccttctacttgctcttcaacacccccgcttcatgatcatgctttgccttgaccagcaaactcttagcctgagaagcctccattgcctcgtttttctttgatcttctcaagtctcgtgcaagcaacgacgaaattatcttctcagttttgatagtattcttgccgtgcattagggtagtcaccacatgttcatacgacggtggaagcgagcacagaagaattatggccttgtcttcatcatccaggttcacatctaacttacttagatccacaaccaactgattgaagacgtccacgtgctttctaagatctgactcctcttgcatcttgcaaccatacagctattgttgagat

SEQ ID NO: 95619 - DNA, 546 bp, Oryza sativa
tttaatatttagaccacattattgcactcaaatatttaggaaatatctcttttgaaagttatctccaaaaatagattcatttcaaaagttagccacctaaattccttccaaatattaatttggattcaaacttccttcttcaaatatcttccaaaattcaaaaataacttctatttgcttttgggccaaaattcccttttcttcttctatcggcccatctccctcttggcccaggacggcccagccaacccttccagctgagccgcccctctcctttctgtgggcaccgatgccaggtgccctaggcgggataagttcactttgggtctctctatttgtcgcccaggccgattttcgtcccttggtcgcaaaaccgggtacaactggtcccccaacttacgaaaccgtttaaataaggtccctcagcggtattgtacctggtttttgctgacgtggcgttgacgtggcttctttgactaggtcttcgtcatacatggcattaacatggctcttacgtggtaatttgatccttgaaaaatattaaaa

SEQ ID NO: 95620 - DNA, 632 bp, Oryza sativa
aaaattataactcaatctatgactaaaaataaggaaatttgtcgtagatggttcatatccttttttttaatccaaatttattgtcaatatttgttcagaatcttggtacttgtcgaaattgcaaattttcttcctccaatcatacgtatccgagtagtgaaattatctgtcatgccttgagggaattttatatgtctctaacccgtatttttgtatcgtttgatttcttcagatattttctcctggtctgatatacccatttatatatttaggataaatgagtataataagttccttcagtactaccatcttgaataattattggttcatatccatctttccagatcagggtcttgaatagaatacctcttttattcaggccttcatagtcggtcgtcctaggtcttctttgtgtccactttatcatgtaatcttcaaattatgaatagtcatgcttatgtgtcgtaattactatggcacataagttactatcctattttcttgtataaacctttattccattttctctacacaatgtcgttatgttgcttagatttatctgttcagactccctttggaggtcttgctttttttatccagtcataagtttagcttggcagaaagagctatct

SEQ ID NO: 95621 - DNA, 739 bp, Oryza sativa
ccatcaaggttcatttgtgcaccaaagaaatgttagaatgcataacacgacttcattttcttggtttttaggatcatgacatggatcatgaaacttttaaagtgccttaatagaggaatttaaatgcccatctagttttcaacattttaggagaagatacaaaaatggcagatccttggatgctgataagcacctccagaaagtaatgttgtctgtctttccttcatctgttgtatgacatatcaaaaggagttaagacaaagcatatgtatagatagatcacacattttacgtgaataaggtccaaaatactggcctctgagtggacagccttgcgaaccgtatcttgtatggattccatcaaagatcttttggataagaaacaataagagaccaaattaatgatggtagcatttatctatcacatccgtaacattcaaagtttgagatcagatacaaagaaagaatttcaagagaacaacgctttatccatattttggtggtgtttctgttacttggggaaaaacagaagttctatcctggtttatttgtacttatatataaagaatccaccgtgagctaacttctctctaacaaatttcagtagtgcagatctcttgcccaaactgatagttacaattacgggctcagaccagccatgcttgaacgatgaggaagattagttcgatactaagaaagtagtccatacatcaagtgatggtctccgaatgagaggtgt

SEQ ID NO: 95622 - DNA, 545 bp, Oryza sativa
ttagttaaaaaaaaaaagatgaacatataggacaaagggaaaggctagctagccagaatgtaaaattttgatttatctttttaatttgttaggaaaattgaatctggaactttgcatgacagtgaacaagattgtagtacaacagtcttgcagcattgcaccactccactgctactacaatattcaccacagctaatttacaacattcagttgctggcagtggaaagaaccccaatcgcagctaataatttacaacatttgaatactttcactccaaaaaagtatctcgtccatcacttgtcgctacattctcgatccaaccgaccaattgatcagcgctaacggcaggcggttgatgagaatgctcttgtgtaggcagttcgagttcaacccgggaataagccttattagttagcatgcttcccaataccgctcattccaatcggttttcatcatatcgtcgtcgtgcaccggccagccaagagatacacagaagcaataaaatataatgtggagatgtggaacggtgggtgatggccgcaggg

SEQ ID NO: 95623 - DNA, 521 bp, Oryza sativa
gaaaactgcaggctgagcaaggttagttcgtgtcggtgatggcgatccttggtagccttcagcacgagtcagaagcaatcgtatcggagacagaaatcaattatgcgattcccgcaccagccgtcttggcaaagatctgcacggcgcgcggcaactggcaaatcggaaccaaaaatcttccagacctttgggcttgcatatattagttttatcggcagagaaacaagggctaagatatacatagtccttacgacaaaaaaaataaaacactagtacaacagtaacatggatatatagatggcacattaaagcaaaatcactgcgtgcagcatttgtcctcctactggctattatgaacctacttctcccagtaggttaaacatggataaatattgaggaccaatcgatgacctcagagcacgaacatgatgtaagtcatgatacatttggacttgtgcttgatcataaggagcccctgttcactgcttgttggcaacacctccacgccggtgaagacagtc

SEQ ID NO: 95624 - DNA, 568 bp, Oryza sativa
gtagctcatgacttcctgcatgcatgtgaattaaactcgtaaatgcctcaacaagcaatctttgaaggctcgttttttttctcttttttttggaaaagagagctttattgatcttgtattagaattacaatcttgctacagtatgagcttaacacaggatggggcatgatcactctaggccagttatgtatgtcaaagatgcaaagatcttgcaattaatatggaagagataatatcgatctaacagtgctttaatcttagatgaaaacatttggccatcatgattttgtgttacatacatttttcttaaggaaggtggccgagtaaaacaatcaacacattttaaatttttattaaatccttgaaagaaaattgtgtcatctgtaatatttttggcccatcatcgatcccccacctctaaacttatgctacaacataaattgggcttgaaaatgtcttgggtgcgcgactttgtgaaaccaggttccccttatgtaatccatggtgggtaaccaagtcagtggatattgtagaaatgttttcaatgccgctcattcccattgaatcc

SEQ ID NO: 95625 - DNA, 647 bp, Oryza sativa
tctaaaatattaacatttttagcatggtgacaagttaaacaattttaactttaaccattaatagcaacaaaattaaaaaaaccaatcatgtaaaattgacgttcctaaatttatcattaaacaaactatcataatatgcaactctttttatttaaaacatcttacttttatagatattgttggttaaagtagcatctcggtgaccgtgtcaggatctaaaaaaatgcttatattttgagacggaaagagtatatacatgggcaatataatgatgttatgaggtgatggttgacaaaattcaaaaccaaatcattagcaaaccgtctgctaagagacaatcatgagtttatccacgcgagagatcggagggtctgactgacaagaatcactcatagcgagggacgatggtttgttcaacttgatatgccacaaacaacaagaaggacgaaaacggcccaaagttgatgcgtcgcccgggcacgtgcaccacacagtcgaacgtacggcgtgggattggatgcccatatatacggacgtgtgagccggtggcttggttgccaaacgttgacattgtgttaatgaattgctaagctaatattacctccgttttttaatagataacgtcgttgactttttttattacatgt

SEQ ID NO: 95626 - DNA, 721 bp, Oryza sativa
aagattttactgctaatgtctttatcttcttgcaggtcatggggatttgattgcgatgttgtccaacactgcaagctgatcttctgctgatgattaattgagaaccattatatcattatcatacaaacttttgtttgtgaccaaatgatcttcttatgcagcttattcaatatcttcatctgaaaaagtggtgggttgacttacattgctcgtacattaattgcttcaagagtgtagggttcatctaactgactaagtaactatgtcactcaaccttctccttgttgttcagggctgttcatatcatgacaattaaaatcttctgcgtttcaaccttctccttgttgttcaggagggttcatataataccaaatttaaaatcttctgcatgattcaaatgttttttgtgtaccaacatggttagccttattctcttacggtactcaatctgccaatcatgagaatttcagttttgctggtttagtgtatgtgcctttcaatctttcaattttttacagtaactgagcagtgaactgtgccaaactagatctgagaaatatctatatgatacctagaatcagtacaaaatccaaaataagtgcagctacacctaggcttggttgaatttatagaagcatcttgatgtgagccccttaatgatttctgctagtgttatcctgcataaataaatccataagcatattgccttgtcttatttgtg

SEQ ID NO: 95627 - DNA, 524 bp, Oryza sativa
ctaacaatgctgacagccgcacgatgctatttaacacatggtgctaattactaaagagggtaccatattaaccaactttatgcactgccatactctaacgtttcttgaagtggacaatgacacacgtgggacttcactcacacatcagctacagcaaccaagcttgatctccatttagtcgtttacagggcacaacgatcggtgacactaatttggcatgaactagtgccatcacaagagattgcctcttaactgttcacacgaatctgactcttaccatgccgtgactacaaatgcaggcacagaaaaatctagttctaaatccaaacttgtccttcccaccaagaagtactcgatcttcaagtcgacatcggtcaatccacgagatccctaaaacccccactagaatttactaccagcaactaaactagacgacgacgacgacgactaatgccatacttgccaagaacgaagcaacaaagcaatgcggtggcggccatcaagaaccgacacaaacggggcac

SEQ ID NO: 95628 - DNA, 677 bp, Oryza sativa
ccccctatagcaatgtacttcctccgtttcacaatgtaagactttatagtattgcccatattcatatatatgctaatgaatctaattagcatctatattaatatggacaatgctagaaagtcttacattgtaaaacggaggaagtactaaccaagagcaagaacaatatagtgtatgatatcggcgttttggagagaatgtcacattatgagcgaggatatatttatataccattcaataaaatatttaatacactatttataccatttcgtacaatacatctgttctaaaatatagcaacttttggctatacatagagatatactcttgtttaaattaaatgtactgtggaagttgtaatattaaaagaccctcattgttatttaacaaaatagaatacaaagaaaacaaaattttggttttattaagggtagcgcagtaatcgtacaaaatacaaggacttgtgtgcaaaatattcttctctccggctctcccacaccaaattcttgaccccccacctgcgccccgagcctcttgacggcggcggcggcggggacgacgaatttcttgcacccgcattccccttcttctagcaagctagccgacgggaacgccctccggttccccctatgaactgacgtcgagaccttattaccgggcggcaccagcgccaacgc

SEQ ID NO: 95629 - DNA, 723 bp, Oryza sativa
ggcaacggttgacaatcaggatccgtggttaattaatagttaatttgcccaattccaaatgcttgtttgaagtatgtcaagtccaagatatattaattcacgtgaatctaagttaagttttgcatcttctgcaggagttggttcttcataggccaaaccaaacatgaaacatgacaataggcagactagtacaaatacttccaaccctctccccccaaaaaaaaaaactaattaataaagatcctattacgtgtggagatgtaccaatcgagattctctgacttacttccgtctgatgttggcaactgacgtatgaattctctactcagctgatctacatgtcagtaatttaaagttaaagataagtaaatcagaggatcaaaatagtactctaacagtctaacacatcatacatgggactatttcaaagccgaacagttgatttgagccacgccgcacaaaaaagtatcatgttgcaagcctgcaattcgcaggttaagtgaggtcgttggaacttggcacatgaacccataggccataacaacaggcgacgctagtagttgtcgggaaagtggatgtccacccgtttattgcatgtcatctaaatggttatgaaaaaaattgaaaaaatatgaataagatagatcaatatgtaatatatcaatccacaaacatgcaatttaaaattcaacttctacagattgtaacaaaaataacaaacaa

SEQ ID NO: 95630 - DNA, 993 bp, Oryza sativa
aaacgggtggacatccactttcccgacaactactagcgtcgcctgttgttatggcctatgggttcatgtgccaagttccaacgacctcacttaacctgcgaattgcaggcttgcaacatgatacttttttgtgcggcgtggctcaaatcaactgttcggctttgaaatagtcccatgtatgatgtgttagactgttagagtactattttgatcctctgatttacttatctttaactttaaattactgacatgtagatcagctgagtagagaattcatacgtcagttgccaacatcagacggaagtaagtcagagaatctcgattggtacatctccacacgtaataggatctttattaattagtttttttttttggggggagagggttggaagtatttgtactagtctgcctattgtcatgtttcatgtttgttttggcctatgaagaaccaactcctgcagaagatgcaaaacttaacttagattcacgtgaattaatatatcttggacttgacatacttcaaacaagcatttggaattgggcaaattaactataaattaaccacggatcctgattgtcaacggctgccaagcccgtggtgtagttgccagaagttaaaaggctgctaatactccacatcaatagagcaaagacgaggaggacacctatccgcatggccaatctagaagagccactgcacatatacccactcaggagccttgaccatccttgttagtcgtcagatttgcctatgtcgtcgaatgtgttttcctgacacatcccatttctgaggccaaaacgttttttttttaagagagagagagtgagaaagcaagaccactactgaattgtaatgtgttattttctgtagcgaccatgtccaaagaggagcagcgtgggctacagggaagtgggagtaggcgtatatatatatatatatatatatatatatatatatatatatatatgtatgtatgctggcatgtcccctct

SEQ ID NO: 95631 - DNA, 536 bp, Oryza sativa
tgattatctgtaaaactatattaaccatacttttagagactcacctctgttgcgatcacaatcaaaggccgaaaaggaacagaagacatcaaatccgtttccttgttaccaaaaactgaaccacatgaccgctgttataggaaggcgatcgatcttcttgtgactagttgtgagttgcgaaccgactctgaagccgactcgcctagtgcgatgcaacacggcactgaatcggagtcttcgcctacagtatgtatgtaagagagccaaaagcgttgctacctgcatagatccaacgccacatactcacatctatcaccatgatggacaacacgagacatgtccctgtgccttgcaacgcctctgaagcactgatccgattcatacaagccggcgctatacatcatctcggagaaaaaggccatcgatgcctacatacccgggatgactaacagaaacgcctggccgacgcagctaggatggatcctgatccgcgacgacgccaccatgtttctgcagaacccacaggatcctgacga

SEQ ID NO: 95632 - DNA, 540 bp, Oryza sativa
catgctcagtttgttacattttcaaggtgtaatggcatattttcttttaatatgcctctttccccctaatcctgtaggtgcgattgcgtttgatattataatgcgcagtgtgtgaacaacacatttttggtacttcctccgtccccctaatataaaagattttggcattagcatgcactgtttgactattcgtcttattaggaaatttagcattattattatttttatttgtcacttactttattatccatagtcctttaagcacagctttttgttttttatattcacacttattttttgcataataggagtggtcaatcagtgcaagcctaatgtcaaaatccgttatatttgggaacggagggagtagttggtgacagcgtaacttaaactggtatttttgtgtcatggtacatatctcaggagccggtattgttttggtcacagttagggttaaagacaaatttcttgatgcattgatggtcccttttgcagaattggcccaatcaggttgtaagcgttaatgtcttttcttggata

SEQ ID NO: 95633 - DNA, 544 bp, Oryza sativa
ctagtactcgcaagcatgataccactattctttgtatacttgcttacattgctctgtaatccgaagtgcttgtcgtgtcctagactgtcactgtggatataaacttaagaacacattgtcaagtacataacggatggatgaggatttaaacgcacaaacctattggaacaagcacatagcctaaggcactgagctgacagtgaatagtagcatgaaggagcaagcttgatcaacatcgcagatgacaatggcatgcacaggacaactactggggatggattctaatagctcgagtggatgtccacccgtttattgcatgtcaactaaatggctacgaaaaattttcaaaaaaattggcaagatagatcaatatgtaatatatcactccacaaacatgtaagttaaaattcaacttatacaagttgtaacaaaaataacaaatttaactgtaaatatacatatagtaatttgagttttgtttgttatttttgttacaatctgtagaagttgaattttaaattgcatgtttgtggattgatatatt

SEQ ID NO: 95634 - DNA, 583 bp, Oryza sativa
ttgtagcacatgcttatgtgttgacatttctagcacaaatgtatatatcctcacatgcttttgttgaaatttgaaaaactatctgaaatccttaaatatgatcaaccttgcatgcatcacgtatgaaaatgtgtgtgcatgacctagcgacataaatatcttatattgcctgggcacaatggtcagcttccaatcactacaagaaaaatgacagcatatatttctatccaaagctatatattgttcctgatttccagttgtgggctacagcgctttgtcgctttcctatttggatcactatccagttgagcgactgctaatcattttgagacaacattgagttcaaaactcttgacatatatatatgctcatttgcataaataaagcatagctacctgtgcagcttctattaagtgtgtgactagtacaaaaaaataactcccttccctttctatgttaaaagacatgacgaccagttaaatgtcacgtatcaagcttcttacttttcattctatcagtgttcagtggtgcctacatacattcaaatctacccccttagtaatttatattcatctttggcaca

SEQ ID NO: 95635 - DNA, 504 bp, Oryza sativa
  unsure (1)..(504): unsure at all n locations
aggggtacgaattagattcggcctattttaaagggagtcaaagtggaccttttcctcgttaaaattctctgacggcccagctaggcagctaaaggcctgatataattatatttgtaaataaacgaaattatatccggtaaataaacgaaattatatttagcccagctaggctagccatcatttcgaataagcgaaacatatttgtaaaaaaaataatttgtgaataaaacttttatatatgtgttcttagcgatataaaagtaaaagataaaaaattaaaatttatgaaaaaaaccttgaaacaattcaaaatttaagattaaaaattcaaattttagccgataagcatgagtataaaccttgatcggacaattgccatccaattgtccacttgtaccacagtatcactagccccaacccactgacgcttgggacccgcacaaatccggcattctaatcctttttaacccacaccactatgccctgggacacgcgtngcgcccc

SEQ ID NO: 95636 - DNA, 578 bp, Oryza sativa
cgggctgggcggtggtcgaatcgggtgcacgcgcccggctaaatgggctacgagttattgggccgcgtcgcgagaggcgattttgggctttcggtctgcttgtcgcgttcggtgtgtgactgtaaagatgacgaggcctatggagcgcctacgagcgtcgctctgattatcagggaaaatatcagtccatgtcatcacgaggaattttactagtagatttactcacgagtaaaaattttagtgagtggtgatgtggacgaatcttagacgttcatttttcgattcaacagtaattttcactacatatatggtttgcagtatatattttcccaattatcatgacaaattccccgtctatgcttttgatgaatattgtcaaccaccaactcataatctcatttgtttgctcatgtgttctcatatcagtatgtataagtatccaatggcggatttaggccatttctgtggggtcggctgaccccacagctttttgaaaaacatcttataaatcttaattttcatgtataaatccaaaagaatttagagaaatgaccccacttaaatacaaaccactagta

SEQ ID NO: 95637 - DNA, 526 bp, Oryza sativa
tccccttctttttttttctccatatcatactaagtactctctcacttgtccttttccttgagaccaagcacaagcacagtccagcagatcgatggtagtggtgcattgtaggataatatataagcgcttaaaaaggcctagcaaaaaaattggatgatacatcgaacatgttcatcagttgctctctatcggaatgagcggcaccgggaaggattccatgaaggtggcagcaatatactgtacatcacttcctcgaaatgctgcggcgaatgctatcgaagtagaatggccacgatttttatgacttcccatggaaatggaagaatggaattgtgtttagtttagttccatgtcgtctcgatctcgtgatcggcacacggagcaccagtgcttagtctatgaggtgaatgcagaatcgtctatgaagagaatgaagaatcgacttgcttaattcaagcttagtctctcaactaaattcagtataagtgctaaatgttggcctcttattatatatctggttaaactg

SEQ ID NO: 95638 - DNA, 663 bp, Oryza sativa
aatagtacatataactatgtttgattttagaaacctagcacaacaaatgtaccaaactttaattctaacggaccatgcatgcatgcatatgcaataatacatttgacgaccaatgcaatttaaactttctgctctaataagccgggtctatcagatctgatggacggccggcccattggcatgcatatgtatgctatcgctgacctatatctgccatgctcttatgctgcatactgtacgtataacttgcgtatagctagtacgtgatagcgacattagataatggacatgtacctgccattcatgcaggaaaactggactggacgatcgcataccaatggatacgcatgattacttaattattgattgcctcacattatttcctttgctgcaattgttcttagagtaactttttcaattgcaacaaaggtatctatctatcttctatctatcgattatatactaaaagtccattaaattttctatgaacactctcaagctgacatgtgacatgcttaaaacgatcttaagctggcacatggcacaacaagatatatatatggacccacatttgcagccccactcaatgtatcgtgtatctgtgtgtatagaaagcgagggcccacatgtgcatttcccggacgatgcatgcattttatgtag

SEQ ID NO: 95639 - DNA, 600 bp, Oryza sativa
ccgtagtaacatcagatcaagcgtaccattagagaacaagcaatctgcagagagggtacgtattaggttcttgaaccatcatgcaacataaggcgcgtgtgattgcgatgattaaagaaaaaaactaagttcacatatttcagttctgtggcttactttggaactactagaaaattagtttcaaatataatcaattaatatagtgccggtatacatgaaataaatttaaaagatggaggagaggtacttataaattaaatatcactactgtcacaataaatgggaataattaaactgcagggcacgccggccgctgcaaggaatacttggattcatgccctccaaatcgtccacgtacacttcttgtaacattatggctgctaatattccagctatatagtgtacggtaagtttagttcttaatttaaaattatttttaaggtcatgaattaattaaagtggaattggtctagcttgtaagtgtcagtgtacttgatcgatcgcatgtgatcatgaacattctattgccctgccacaaaaagctgctaagagtcaaatccgtagcttgcataaatatgtaaaacgacgcctatattatcg

SEQ ID NO: 95640 - DNA, 596 bp, Oryza sativa
agattaggagtaggaagtggtcagtttgcatgcatgcaggttagttggttggtgcaagcaacgacgtcggcgaggactcagtacttgtgaagttgcggccaagtaaacaggacgtgggcgtcgtgtgtggctcgagaagcggaacaaccagcttcgtgtgtgtatgtgctgtgctcattgtaatcatttagttaagagaaaaaaccagtgaaaagggcacaagttgttttggtgccgcaaagatcctgtgtgtttgcttctgtgtttgtgtttcttcctcgctgcctcgttcagaaagtgtagcttgtattcgcgtgagttgctttgattcccaacatccctcgatctcgggctcctctctcccggcgttggcggtgccttcgacccctcccttccccccccctcccgggcggatgccgaagagggagagagagataatgtagagagagaggagggagaagggatagacccacagtgggccccacaaaatttccttttgtgtgaatgaccaatgggccccacatgtatgtttttaattgcaatgccaccctagcgccacgtcaatagcagactaggtcaacacttgcacgtagacg

SEQ ID NO: 95641 - DNA, 869 bp, Oryza sativa
ccgattagggtagtatcggagtttcagccgatcttatctaatttaaccatattcgatctatatgcttcagtgacatgttaaatccgccctttatgtcaagaaattattgcatttaagtatattaagcttttgtttggtatattatacttgttttgatatctttatatagagtagtatcggagtattagccgatacatgctagatctatctgatcggctatgctataaacatatataatcctgttattaatatatatttcgatctaagtgatttatactgtctcggcatggtgaccgatgaccgatctatcccaatcacttgatttaagtatatattaatataagaactatatgtctttaatatctacagccgatcgaatagatttagttcctcactgtctatttataaccgccgatcgatttatatatgacatcggctcaaagataaatgatatgtcatcggcacctagccgatcggctatcatttatagatttaactacgaattctttgtctctatttcttgttgattacaggatcaaatcaactggcacgctcatacattcgaaggcgagctttggacctgcactggagttaagcagatctcccaggcctcatgttttctgtcaacagaaatgctagaatgacttacattgtgaaacggaggaaggtacctacagctggtaaattaaggatgagaaaattcttcttaatgcctttggatttttcacaatttctttaatctttctaagtttttgccatcttttttaagaccattatgatgctctttgctactaagatttttctatcaagattatcatattagaagtgataccaatcggtaatttacgaggtctacagcagaaaaaaaa

SEQ ID NO: 95642 - DNA, 637 bp, Oryza sativa
ctgttttttaaacagttatgtaatttctcaaatagaatgagtggtcaaatatatatgtctaaatactacatcaacaatatcgtatatattaaaaaaatagagggagtactgcagtaaggatatggtgtggtcgggacctgtatatacgtaaaactcgtgatgatcagtcgaatccatgtctaatccattgcgtgattaatatttcgatcccactttcgcagatagttgctgggatcggcaaaatccctacacaaaaatactactaaaactgattgatctcgcacacgcgaatggagttattaaattatacatcatgcacataaacacttaatgcaagaaattaagcagatcaagatatatatataacaaatcgttcgtgtctagctacagagacagaaacagatcatccatgcatatgcatggtcccgctagtagatagctatctctcgatctctagctagtaggtaggtcgttaacctcttgatcagcatgcatggatgcagcttgcattgcatatatatagcttcaatgcattggttgaactctggaacttcaagctatctaatctactagctagcccttctctctctctctctctttctctcttacacacaaaacgtactctcttaattgatcg

SEQ ID NO: 95643 - DNA, 638 bp, Oryza sativa
catgtgggatgggtcctattactcagctatatgttgtttcccttatgccaatgataacttgggtattaaaatgactagatgttggtttaggagatgcttagccatgcttagttcaactagtgcacaaaaggggaccacattaaagcatagacttgattattggcaatagctttggattagtgccaccgcaatggtgttggctaattaaaatacactacatggtgggctgtgggtgcatggttttgctagacgtgcccatggcgattaaggaccggttcgcgggatgccctggaagaatttatcgtacttaccacaagccagcgtgggcaacggctgggcttgtagtgtagcttttctctagccgacgtatccaggcgagggtgggcgtgatggagttgggtcggccggggtgtcggttgatcggctgccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacgggaacgtgtcgtggggctgtgtcttgtgggtacagttgtacacctctgatcagagtaaa

SEQ ID NO: 95644 - DNA, 1058 bp, Oryza sativa
aagaatttggaattgcagatcgatcgagtgttgggccgcacttgggccgcacgcgggccggcagatcagcaagcgagagaaagagtatagagatataaattagactttggtcgcttgcgggctgaagaagaaagtgggctaaaaaagaccaataaagataaaaggatttttatttaaataaatgctaaaatgatatttgtattatcaaaattagcaattaagctacgaaaattccaagaaaatttcaatgagtgtaattaataatatagaaaatttaataaacattaaatccaaccataacattttatttctcacacttactttaattataaattaatttaattatataactaactacttaaaaatacccaaatatttccaaccagaacattttatttctcacacttactttacttataaattaatttagttatatacctacctacttaaaaaatacctaaatatttcagaaaatttgtatttcatttaattaaatacctaaatatgttttaattcaattttatcttttttatctttacccgtagcgaagaacgggcattttgctatccattaaaacatcatgtggcatctaaaccgttacatggctctctaataaattagtgaaatctattatataataaagtccattaatctttttagaaatacttttaaaccgtcatggggcaacctacaaatgctcgtaaaccatcacatgacactctaataaattagagaaaatcctagaaattataagaaaaaaagcaaaatatctagccatctgttctaccttaaattgattttatggacctgttattttcaacctttagatcttgagatgatctcaaatatatgtctaaaaaaatctcctttatctcggcatgcgtacttcccctcctcccttaacatacgtgcatgtccatgtgcaaaagttgcgtttgggttaagcagaatgaaagaaagggactgtggatgtgaatttgttgatcttcgatcaaacggctgtggcacttcaagtgatttagctgaatgcagcacaggaaaattgttataactacact

SEQ ID NO: 95645 - DNA, 1197 bp, Oryza sativa
ggcgacttaatgatgcaacatttatactgcctccagtcaccaaagaatgttgttaattaattacgtgatccttgcaattttgattaattacaattattgattaaaaatattggccctagacatagaaattgtatagccaaatttcttataatacaaatgctcttataaaatcaaatgtttgtagctttttcgtatttataaaaagaataaagttgtcaaagttgtaccttgtttggctttgaaaagtccaaaacaacattatattttattgggggaaataacttttacacacccccccactaactattctatactattatcgtggtgcaaaagaaatgtgatgatgtttacgtactccctctaattttttaaatagatgacgtgttgacttttagacacataagtgatcgacttatttaaaaaaagaattgcacatgcataagatataaatcatgcttgaaatatttttagtgataaaacaagttacaataaaataaataataattatgtaagtttgtttgaataagatgaatgattaaactatatccaaaagttaatggtgtcatctattaaaaacgttggtagtattttggttacaaaacacatgagtaagcatgattcatatgaaacaactctaataattaaatgatgattaatttatctctactacggttaaaagcggagtcgtccttcttccctctccttctcccacatgtgcaatgcgtacatgctcctgagtaacaaccggtcattctaccctgtcccctattatatagacctgacccgttatgacatatggacatattttccctggacatattactagtgtaggtaaaaatatggagtattataaaatatagcttaacctcattatcgatcacgatgactggagaacttgatccaaactttctgttgatgccacttgaacttctggtctaacctctcaactaggcaaagagctctagccagaactttcggtcactattactggaacatttttcctacgtgagtgtggtgcattgtgtctcacttaagataaggctagagtaaattctatgtgtactcctgaaaactcactcaatcccttttgtacctctgaaatttacccaatcccttctatacccctaaaattacaatttgatctcttccatgcccctaccattatattttccatcatttcactattacattggttgc

SEQ ID NO: 95646 - DNA, 1908 bp, Oryza sativa
aaggcaccaaagtactggatccatctatgtttctcctggaattcgttatgcacggtcgtgctgatgtcaatcagtcaatgtgtgccagccaacaccatctgctaattcactataattcagtctataacgtgtgctcctacaattttttttctttactattatatttcagtttcaatataagtatattacttttacgcacaaaagaaatgttggtttcatataactatccttcaaaaatgtattaactctgtttttaaaaatatatatatacgatgcatttgacttttagacatatcgttgactatttattttatttaaaattttgtgcatatatctaaaaatataaaccgtgcatgcttaattaaagtacaatagtagcggcagacaatccccgtcgacataaataccagttagattagattaccccgcaataactgaaaaatattttacaaaataccatgtaattgccagatattttagtttcaaacccctccattggaattaactagttttcatgtataaggtagtgctgggggtaaaataaaagctataaattaatgtataagtgacgctaaaacttaacccacatggaaatttcaaaaactcacctacttaaccacaagccagctgaaacttttataccatatttttcctcaagctcataataacacaattgttgccatcccaaccttataattttattttatttttttggcaagactttccctgaaccaggaaaattaaagtaaacctctatatatatatatatacatatatatatacacacacatatatatatatatatatatacatatacatatatatatacatatatatatatacatatatatgtgtatatatatatatatataacaatattgcaagttaatttgcaacgtcgtttgtcatgtagtaggtgaaggtgaagtccagtaaaatgaacgtattaaggtttgcatggttggctctactagttacacgcacgatctactggagaatgccaaaatgattttgtttcgttttccgttgtcgcctcgctggacgcaaggcttgttcttgtctacatcatgccatgtgatccgatgcctatccttattactactttatagtatgtgggaaatgctacaggtacatatatatatatatctatcactctcacaaattctataaataagtgctttttttaaaagaaaaaactgtcgttgttcaccgcttgcttatgctttcgtatctgtaattagatattcaagccgaagaaaatcatgtgttagtcatataaagaaaacgtcatgtatatgaagcatctccttacactactgaataacttatcttttatcatggtataaaacacaaatatctcggatagactaagaaccgatattaaagatgtttttagtaccaggtctaaaagtccaagtccaaaaaacaactttaattttggttggtattaccaactggtattaaaaatgttatcagccaaaactaatgctggagaatctttaatctcagttggtactggttgataacaccaacacatactaaagatagttttagtaccagttgtcgtaataaaccggtactaaagatgcatctagggttagttaaaaagaaagcatctctctaagttaagatgtgtgtagttgatgggatggttacacgcgtaagagctgagatgagagatcttgagttcaaatcccgtgtcccacatatttttggatttggtatgcatttttagttagtaccggttatttttagtctcgagttgtagagcccgatgactaatagtattttctaatgtcgattacattttacaatatcacttgcaggacatcagcagcaaagaccgatggccacccgactagttagcccaggagctaggtacgctgaaaaagataccaagggctgcag

SEQ ID NO: 95647 - DNA, 1630 bp, Oryza sativa
cacatcttgttatacctaattttgatggcccatgactattataaggaggtaaaggggtcttgagggtgtggggcgacacgagtcatagctgagtcggtccaccactctgcctaatgggtggatccgcccctgtatatagccccctttatctgacgcagttaagctgttaaaactgcctatgcacacgaaaattaaagtagtgtgctaaaaatttgcatatccacttccactaaggcagaagtaataaacaatgactctccctaattaatttatcaagctagcactctacattaattatagccagttgcaattggccacatactttgtttaaaactgcatcctctttggaagcaattccttttgttgttcttgacacactagctaacaatcttcacttggcataccaaaatgataatgcttgatttgaataattaagctaagccagattaagactgcgacactgaagtgcaaagcaatggcaaaccggtcattacacggtttttgccgacaatagttattaccgattgtagttaattaattggtcatgtgaataaataattcttcgacacagtgatacataggaatccaaagattgaaatcaaaaagaagaagaagaagaagcaggtgatcattccataaactggtgttatctgttggcgattaattaagcataatcaggggcctgatggatgattactggttgtgcttttaccttattttttttaagtttgtcttctcagcaagagccttttcggccaccacacgcaacaaagcattcacaggtagctaggcctcgccggtcggcaacgcaaagagtcacaaattaaattcccttttagctcagacagagtaatacagtaatttcaaaagagctgaatagtattactctgatttctttttttttttaaaaaataaagacagtagaagatctagtttttacatacctctagcgacctctgcatctgagatgcacaaattcatagttatactaaaattgatcagactataacaagtatgccctaggaaattgaaattaatgttgctttttaaaggtgtacaatactcttaacataacgattttatgggcttcatatattggaatacacaattggaaataaaaatgcacgaatagaatatcatggttgtggaataatatagggaatgaattcatattaatttctaaaaaatagagtttagtaatatcaaagataaatcatatgaacttcaagataatgaaggagataaaacatgaggtaagacctcatgctacctttcaataaaaatatcttatggaatagttccatccttggaattgaaaagagaactcaaatgaaatctgaaggatttccataagaattactttagttcctggagaaccaaaacaatttctcaagtttcaaagaagacataatcttttttttctatttttcttggttccaaagaaggcatataggtattcctcttacaaattgctatgtcaatcattgatttccttaagggcttattcggtttagagaggattggaggggattgagggtgaataattccacaccacaataggtgtggaataaatcccctccaatccctctatcacagggattaaccgaataagacctaaactgggcccgca

SEQ ID NO: 95648 - DNA, 604 bp, Oryza sativa
tcatgtacgtttgtatgttacggaaagaacatcagtaacgtttgtatcgtacaatctcatacatacggacagtagcagctagcgtttgtatgttataaacatgtggaagttattatttttttaataatagatctaatctaatggtgtaaaataacgggtccaccaatttaagtgaaaatcaacggtaagattagatagtgccatgtggcgacttaggagtgtttgtaggagtgccacgtggcggctttaaagcgtttgtatgaagtttaatggacttttagtacataataatagatgttaatgaatttggatagatatatatgtctagattcattaacataaatatgaatgtgggaaatactagaatgacttacattgtgaaatggaggaagtatatatattattggacagagggagtatattttagaacggattgcattcatacgcacatatatatacttcctccgtccaaaaaaaaagtaactcaacctaagaatggagattcattgtattaccaaggatcacatctacttctaaattgagttctctttttactactcgatcgatgctccttgttgtgggggattcctatttcgcgcgcgct

SEQ ID NO: 95649 - DNA, 625 bp, Oryza sativa
ccgctcttaaaaataccatgatgctaatctctatcccggaaaaaacataatgcgcttacgtcatacgatcgtctccctcccggaaaaaaaacaaaacttaaatacctacatcatatactataaaaaaaaaataaagccaaaaaagaacaagaaaacatgcataggtacatagtaaaatcggaaatatatactaataaggaaaaatcatcagtgtcggcactgatttgttgtcaacagcctttaatctacgattttattaaaaataatactacacatatatgcacaattaaacttaatataaacttattatagtgataaatatatcatgaaaaatgacgctaacatgtaatagttaatacgataataatgtttcaaataatttcatatcatattttacagtgtcaaatatcacttgacaaaaatatacaacgttaattttaatctacatgtgtaaaaattaaaaaaacaaaacctatcattgttttttaagtacatctgtttaggtttatttaattttaggagagattgagattctcaaagtatttggaagttttcaaaaattttcttacttgaggtgtgagaagcacaaataatagatagatgagaaaaattaaattaaatttta

SEQ ID NO: 95650 - DNA, 561 bp, Oryza sativa
aattcatgatgtaccgtatcaagtttaaatggacatttttcttattcctatatggaattagcttatatattgctaaggcgacgtcatggttatttcaatgttaagattccttagtgcaaccaacgtgctctgtacgatcaatatgatattcaactggttacgcgacttcatatatcacatatataatttagatgctatgatcatcttaagattatttatttatctcttaaaaagatcatttattgataaaagatcaatataggaatgtatgggtaaatagctcttatatacatgctgagggaaaaatataattaagtagatagaaagtcattagatgtctaatggaatataagtaatgggtctaccagttttatgaaaaattaaggtgggatattttgatttttagtgagaaattttagaattttcttttatttagtggaggcctcaatatggatgtgggtctagaatgtaaatttttgttagcaaaatatagtccatatgggtattaaattattgatttcacataaataatatggtaattcaaacagatcataaggggca

SEQ ID NO: 95651 - DNA, 567 bp, Oryza sativa
aatgccttctgttctccttcttaatcatgatagcaaggtttgcatttttttttagacattacaggcacaattggaattggtacttgcctggcagtaaaagaagaagtacaattgtaatttgatcaattttgtcaaaactgtccttccctaacaaagaattccttgtgaagtagtagcatgtatatgattccttattctttcctcatgcgtcatgtctgctcagcaaattaatgatttcttttcataaaaaaggagccttagtgattcttcttttttgatttgaaagcatacgatgattccaatttaaaaaagcacaccataaaatagccttttagagctgatcattctcatagttcccctttggtgcttcttcttttgaagataaagataggcctagcaggtgcatccacaagggaaaaaggcaaaccaactgtttccgttgtcaattctgaattactaatataagagtctctggatgctgcataatgcaggcaacttttgagaattatcaatagacccaagaaagagtactacgcaatggctttgtcatttcattccactgaatgc

SEQ ID NO: 95652 - DNA, 686 bp, Oryza sativa
tgacatcaaagattgctacaagttctttgccattggctaaagcagaaaagatgcatgtggtggttcttcgtatatgcaccctgagtaataatatgcaattcatgtaggatccaccaatacatgtttaactttttttaaaaaaaatatctctcaggtcataaatattttactttaacacaaaatattatcaattttttgaaattttgaccatcaatagtttattaagttcttagttgttaaacaaatggcatatatgtaggtaggttttcacttttcagtactatcgtaatatcgtgaagtcattcaattttataatttcttttttacaatgcaaagttgatgatcaatgctataaaagtttgacaaatgatcccattgttttgcttatgcttataaaccaaaatttaaattttttaaacttgattttaagttatttttgtgttctttttatcatggtttattttatggcactcgtcttttaccgctaagaataacgttttacccataaataaatgttttactaataagtaatatgaataagtataaggataactagaccacaagttttgttctaaatggtaaatatttatttataccccagaaaaaaaatgtgtgtattatggtcaggacggcatctcactgacctcaaaatgggtaaatatcatattttcttttaccgggggagt

SEQ ID NO: 95653 - DNA, 697 bp, Oryza sativa
cgttggcccggtaagttgaccccccccccctcttatgcattagtaataatcatgatgactagtttatggtaaacttgttaatggttttctggaaattgggaaaaaaaattgagtatttatactgccgccgattcagaacatatgtgaaggtactgctcggaactgtcatgtggctatacagggcacatagccacaatggcagaaggcaatgtcaaccaggacctgtacctagacttgcaaacacgtgatgcgagagggaaaggcacttgcccacgcttcaaagttgaaaaatgctgcaaaccaaaagctgtatgagatgatcaaatgatggtatcttcgaaatgtacccacggtgggctgcgatgcacgtacgcagccttgtaaagtctttccaagcagtacccaatcccctcattgctcctgagaaatttcgtcactcaccaaaactttttagtcaaaagttcagcggaaaaaatggatcatgccgtcactcttttccttgccctattaccatcaacccgctgtttgtttcgtcttgtcactttcttgatatatgacgagttgtttctctaaatgatatgtttatcaactctttgttactgtaggtcacatcgttgtcataacacggccctcttttttctcagatcacacgtacaagcatgaagcatcactcgcaggaataaaggggctgcaggaa

SEQ ID NO: 95654 - DNA, 600 bp, Oryza sativa
ggagtgcggggactatttaaggttgtgctagcttgtcgaattgaatgcatggatgcgtacatacatttacatacccacttgggacactttcaccttgcctccggacgagcgagctatcagttttaactgatggataccaacacaagctaaggaagagggagactagtgcaaccacgctacggacctactccctccgacgtaaccaaaaaaaaaaaaagacagtccctgggtttccacgtccaacgttagactgtccgtcttatatgattttttttgtactcagcatttatattattgttagatgatcaagcatgatcaatacttgatgctggacttatcattgaaataagatgactaatttatttaagtaagacggacggtcgatcgttggacacggaaaccgagggtatgacttttgctaccttggatgggaaagatttttgcatgtcaaggaaacgacgcactattaacttactgttgtatatacgaggagtaactctctgacgctccacctgctgactgtataaacatgccgggcccagacaggtgtactctccgtgtcatacagcacgcgagcaacttatctaagccgacggatct

SEQ ID NO: 95655 - DNA, 558 bp, Oryza sativa
tcacgtaagcatcgatccctcgcgcaagaacctgtccattcccagcgatcaaggaacctgttggtcaaaacactgtttgttcatagatcttagcagtttttttcgattcattctccactggtgtcattgtcagattgtcaaattgtcaaatcgatcgatcagcactctcattctttgaactgtccctagaaaaagaagcgactccggcagcgttcataattacggcctgatcgaatcactgattagttcatcatgttcttcttttcctctctcgcgccagcagccggactaacactgatcctatctgttctcttagtgtactgatgacattgtcatgcaaagctatgattgttgagattttagtggcacgtggagatttattaattattatcagtcttcatctccagcgatacgtctcgatcatcgaatgaaacaaattcaaattcaccatgcatagacatttgatgcgaaatctgaaacttccgggaagcactagacacgtcctgttaattttaatctgtggaagaaatgcatgtcaggtccagacacagaattgca

SEQ ID NO: 95656 - DNA, 891 bp, Oryza sativa
ttaaaaagcccactgggccaagttccaacacaacattggggagccgccgccaacgcgcacgattttttctagacggcggctcaagcgatgcaagtgcaacagtagcatggcctctctgaaacatagcaccagcttaactgtatcgtgtacaacgaggacggcggctacatcacatgataccaatgaggccgccaaccactgccaccacggtggcgaggagccatgagcataatgcggttagaggtgggctcaggaatcacggcagcgacatgcaaatgcaaacggcttcgcatcacgccatcaggccatggtttaaggagaagggaaagatggtggaacattgttcactccatgtggcatcatacattttgactcattttagattgttcactccattggcttgtggcatcatacaaatcgagatgtagggagtatttgctaactcgtgtttatactaagtaataccaccatgtttaattccacccacaagatggacacttatcaatataagcatctttgccagcaatttaaaaaatacagcaaatctggacaatcaaattttgaccaagggaaagacaaacggactagcaacagctattttgtccgtcaataattcaataaagcatgcccggcggaaatgttcaactgttcatgtcagcaactaccagttcatccaaaataagcttaccttaattacgtaagcaacagcctctgaaaccttcatcgagtgcccatatcagcagcaaatgggtcagccaaaacaaagtttacataaattaacttcgaccaacagccctgaaaccactagcccaggccacagccagtgtaatagcagtaccctggtctccgtagtacatatataaagggtaccgagctcgaattcgccctata

SEQ ID NO: 95657 - DNA, 562 bp, Oryza sativa
gaagcagctcaggcgaatgttgtttcagaagagaagacctgaaaacaccatagcagttgaattcagaagagaagacaaatgcaaaattcaatgcatggcagctgcatcaatttgcaccactaattaattaattaacccatctttttatagtgccctgtcatggtgatcaggactaatgctagttcagtacattgttacttcgattctcttccctccgattcctaaaatctccgaagcatatcatttacaacatgtgaacttaacttagaaatgccgacaaaaaaattcagaactttgaaaaacctgagcaaaaaggagaatattttgacagaaccagttcactacagcagagactacttcctcctgtacaaagatactgttcatggttcaacagccacaaagctagcaaaagatagaaacgcaagcatcatcaattggagaactgaatcaatgctagaccaatgtaattgaacggttcaagctaattaccagcattattacgacaggatgggtggattgactattttactgaattgaagcttagctatcaagcggctttaaa

SEQ ID NO: 95658 - DNA, 542 bp, Oryza sativa
  unsure (1)..(542): unsure at all n locations
tcggtaccccatgcaaggccaagacacgtacaatccacagcccaattaatcagctagctagccacaaaacagnnttggtcctatctgcttaacgnncaggacgcgggggatatgctccaatctcctggagagcctagctagctaactacccattctaattagcaatgggcaccacgaatgattaatgtagagtatgtaaatcaggaaattcttcaaggggtctttttgctgtattgaaaggcagaaggcccttggcgcattaattctgaaggatttaccatttattaaagctggaaataacacatatatatacatcgatacatttatacatcccataaaaatactaaaacacaaagtctagacccttgctaggcgagataaaggatatgaccggatatcattcatgcccgaaaaagagtcggattcctaggcgtggagccaataattcgaggcaaaaaacccgggggtgaaggagatgaaaagaacgtccttgcattataccacgaggtcgtgtattatattagtagggtctatccaaaaaa

SEQ ID NO: 95659 - DNA, 592 bp, Oryza sativa
tctacaaacttagttataaagcaatttgactttgaccaaaatcaaaacgttatataacctgaaacggaggcagtagtacgaacatatctgcacaaaatgccgactagatgcatgacatgtactacatatatttcctgtcgtgttggttactgtactgtctgtacattgcaatataagacgaatttatttgtacttcattttttgcaatttgcagcaataggatatttatgcagctcgatcgatcacgtaatccatgtagcactgaatgattttcagaaacgtgtcctgcatataatgttcgcgtacaggtcatgcatggcccacgtacagattcacaccacatgaacaaaatcttgctctagttattacacggtcaaaggcgcccttcgcccccaattgcttcatgcatgctgcggccacagtaaaaactactgtttaattaattaaataaatagtatataatccaaaaattaaattgatccaatacctgctacattatatagtacaggttaatatgatgctagctgttcattgatctggcctgtcaaaaatgaggtgcttattttacatggacccttgagctaacacccta

SEQ ID NO: 95660 - DNA, 642 bp, Oryza sativa
taataaaatatgcaatattgatgatagcatatggattgatttataaatgcttatgtatatgctttattgaattgttattcctcaaatagcttttatttgctcattgtgcaagagaataaaaaatatctatgaaagaaaaaaaaagaataccgaatccttggaaatagtcatgacgataaatacatattcgatgtgagcaaaaataatgagtgccgaatccttggaaacagtcttgacgacaaggacatacccggaataattgagagaaaaaaagtgagcaaaaaggctcaaaaaaaagtttaaaaattctcttgattgttttgtactaaagttaatttgagaaagagtgataaatgtaataggtatatatgtatagtgtttatttttcaatctatgtgcttgtgaatatattgcattataaatcatttgaaattatgaatccttattgctaatttaagcttaattgtaatatctttgattcatgtttatattatgatgcatgcttgctaactggaaaaataatttatcttctttgtcttgcaacacacgatcatggattgcttttggtgcacttcaaagctctcgaaaaaaattagaaaatagaaaagaaaaaattggttatttcaagtgacaatcatgaca

SEQ ID NO: 95661 - DNA, 666 bp, Oryza sativa
tgcaaaaactttagatcggtaaaaatctaaagaagaaaacgagctctgataccacttgcaggatcgaatactaactattgttgtattttcttgcctttttttttctgcaaaattgtgtcattctgtctattcatcttgcattttcctgcataagtcgacgtgttctatctattcatcttgcattttcctacataagtcgacgtgttcgtgccgtgggaacatgccatgacatgccagaatacttaagtcgacatgtcttaagtgctctctttaatagtagttttgattttctatacgtaccatgccataatgactgttatgcagaaaacaagaagatgattaggtaggatttcgttttctggccttttccagcattgggccggtatgttttttttctatctttgttcaggttgaagttttgtttccctctaactgcattttcctaaattctgcattgtcttatgtctatggtgaaaagtacctattactatattttctttaacaaaattatccaagcaagtgctaaaaaaatatgaaaattgctattactacattacaattgattctagcacacctttagggcccctttgaatcgtttgaatgaaaaaaaagaggaataggaaaaacgtttctaacaaggaatgtaattgcaaacaaaggattgca

SEQ ID NO: 95662 - DNA, 614 bp, Oryza sativa
ccgtgcaaaaataaggacagttttcagaggcctctctccatttctatgatgtaggcttgccttgccactgcagctttaaacttctggcaaattgtccaaccaaatattcaaaactgaaagtcgagaaagttaatcttcgatgtttcagacggggagacatatgccctttattttacagaaaatttaacgatctgccactccctagatcgtcccttgccaccccatgagaaataacaccaaagatcatttcagttagtgagacgtgagtcaggataacaaattatcatcacgtcttttttgtttaccagaaacttcagtctcctctcagtaccatcagagatttgactgccaaaattcactgtgcattcacattctactctttccgttccaaaataaattaacatttagagttaaattttgtcctccaaactatactaccttttctatctattattggtttgcagatcgataaattttatgccttcaatacccccacctactcattcatgaatacaactttcctacttaagggtattttatttattttcttatatactcattgtgatgttatgaattgatttttattaagatggatggagcatgtttataggaaa

SEQ ID NO: 95663 - DNA, 504 bp, Oryza sativa
catgtgagcttgggtccaaatgtctaatgtaatcccgtcagtttcgaggatgtgatagcgttatttctttgctccaatgataaacaaatgtagagtttcagaagcacaattctatatcgtgattcgtaaagatatccagatttcctttgcaatggtgattgtttgtgatgtttgctacaaattattgttgaaattttgtcgaaatcctgtcaattttttttctgaaattctatcggaattctgtaaaagtcattgctgaattcatgtcatatttgtcaaactttctgaaagttcgtaaaaaatttaggacggatttgaaataagcaaaattccattttgaaacatgtccagagtctatgcaagcatggctcctgtcgtaaaagtagtaggcgcatatatgcaagggtatacttgtcttcttaccacatatttaacaccgttaaccgaagctaacagaacaggggcaatcgattggttcatttcaaaaaagtagggataaaatca

SEQ ID NO: 95664 - DNA, 671 bp, Oryza sativa
ttctgtttacgggcaagtggaaacaaaaaactaaccaaatgtgcatctttcccacaaaaagaccaaatataattctcacaccaagttggtaaggtagatggttttaaaaaatttgtttttgtttcttttaaagttctagaaagagagggcaaaattccagcagacttaaaaactgttttctttagcacttggttttctcaaaatttcaccatgttcagtcacactcaaaacattggaatgatttttggtgaaatagttatgaacatcaaaaccaacacccctattgtaactagtcaccttagattgatccaaaatcatgttgagctgtttcttaccatcagaaaatctttgcaaagaacttttcaaataagaaacttctttttccaaattagcacaattttcacaatctaccattatacttttgcttttacaacatttggggcaagaaagcacttcatcagatttcacaatattttccatatgctcaaccagtcctaaaacatctttcaatttcatctcattcaaaaaacactttgaacaattttgagaaaccaaaacatctttgttttgtttaatcctttttgcacctaaaacattgaacaaagaacttgcagaaaaagtaactttgtattttgtcaaaatgttctttgtcaaaaccaattcatcaacaa

SEQ ID NO: 95665 - DNA, 585 bp, Oryza sativa
ccagatgaattcgggatataaaatacgatgtgtcctaaaatatataagtagttctgtaatagtataaatttcgtctcaaattgaaaccgagtttcattgagtttaaaaattttaaaccagttttcttgtcgttgtagcctactttatcctaggccacagacacgttctttttattttttttaattcgacacattttttttattttttttaccggacgtgtagtcacgtacatgtgtgcgcccctcatcaacacgtccgtccggcccagaacgccacggcctaattgcgaagagaaggagcaggcttgactatgggacccacctgaagaaataagtgccaaatctaccccaaactaatttactccaactttactaatctacccttaaaaataaacggttcagattaattatacttgtagtatatactacaagtaaaaagcatcggagcgtcgccctattacttatcatgttgccatcccatgagtctctctgatctgtgcctagctgctccaatggctatatctttttggcctttctgttccatccatgtttgcacagatataaataatctcagagattttatatg

SEQ ID NO: 95666 - DNA, 567 bp, Oryza sativa
cctgaaacggaggaagtaccaaactagctacctagaagattggtactccctccgtcccataatataagagattttgactttttgtttgcactgtttgatcactcgttttattaaaaaaaattgtgtaaatattaaaaacgaagtgcttaaaatactttgaataataaagtaagtcacaaataaaataaataaaaatttcaaacaaattttaataaaacaaatggtcaaacagtacaagtaaaaagtcaaaatcccttatattatgggacggagggagtagctaggtagagctagcaatgctacgtgtgtgtgtgtgtgtgtgtatatatatatatatatatatatatatatatatatatatatatatatatatatatatatatatatatatatatgctaccatcaaacatcgtacatgatgcattgctgttagataattaagtagctagtgaaagcatctatgggaaaaggactacatggatgggtctagcatcttaattagagcatctccaacaggggagcgtatcttatacacacaggccctcgcgtgtacacatcgtgtacacc

SEQ ID NO: 95667 - DNA, 582 bp, Oryza sativa
tgcagccctcctactattagaagaatatcactcagtcatctgtatagtagacaatagttctacggctttcaagttgcaatcaaacactgtaattgtgttatttgaacttgtggggtaaaagtagctcatcatagtccggattcttgcaatccacacaccaatatgtatttctgcaactaaatactattagttttagtatttttaccaacctgaacttcctaacaactaccaaagtaaggaacaaccgtgcgctagaaaatcaagcagattgacaccaattctaacaggttggtcagcacatcgatactgctaccatctcttagaaaatataacagaatagcccatgctgccagatcttaatgacggtcttactctaacatccaatacctccagatctgaaaccgcagccacttacgaatttccaaccttaaaccctacatataagctattatatcgccaattttccaacagctcggatgaatgaaacctccaccatatatttggtgctactagcctaccatacaaaagcacagctatgacctgatgatttacaccctttgatccacatccctgaaaccagcc

SEQ ID NO: 95668 - DNA, 584 bp, Oryza sativa
ggtacctaaccgatcagttatcatttataggtttaactacggttcttttgtctttatttcttgttgattgcaggatcaaatcaactggcacgctcatacatccgaaggcaagttttggacctgcactggagttaagcaaatctcccaggcctcgtgttttctgtcaacagattgttttttaggtgatagatacactaaacaatctaacaaagagcaatctaaacgatatcggcttattcaacgcgaatcaaccgataaggataaataacactatttaacttagattaaatagcgtatatgataaattagcacttgtatcgactggtttagagtgtcgaacttaaccgatggaaaccctagccctgccgatacaagcaactacagacggaactcatctcttgtcagagatcgaacttaattgatgcagcccaactcaaagacaagaactcatcgagaaaaatccttaccaacacaactcaaacttcccttaaggataaagcaaaaattacaagcacagtcggactatacaaaaaaagaaaaataactgactccacctaattaatagataaatcaccttgccatat

SEQ ID NO: 95669 - DNA, 1830 bp, Oryza sativa
  unsure (1)..(1830): unsure at all n locations
cggcggatacgtcctcgcgtccggtggaaaggaggcggaagggcaccgccgcactggaagcggaaaccaggaccacagcggctgcgtgtgggctcaggagcggcggatccaccctcacacgtggcggaaaggaggtggaagggtggtgtggcaccagaacggcaaccacgaacttgcgggtacgtgcgggctaaatcgagagcggacaacccaccgtcgacaagcttaggaatggtggattcgctgccggagtgctcgagagtggtggatccgcccttgcacatgtggagaggaggcggaagggtggcgcaacaccaggagtggcgaccacgaccacgacggcgatgtgagtgcttggaagagggcggatccgtcctcgcgtgctgcacggaggaggcggaagggcggcacgacatcgcgagcggcaaccacaaccgcaggcagcgggggcaagggctgtagcgcggcacacaacggcggcgaccaagggtttggttttggatttttttttctttttttattttttaaatcattgcaatcaagcatccttatttgcccgcatgcaaaaatcgggtctttgcaagcggctttcttaggtcatctgtccgcgaaaatgattttatgcatgcaattgtgttgcccgcatgcaaaatgccgatttttgcagacacctggcgctccaggcgagtgtcactcgcctgtgaaaattagtttttgtcggcatgaaaagatcatttatgtagtatagtggtatattgtgcagacatctaaacaacacattttttttcttctctctttctctcggtcaggaaattatggagaataaaaataaaatggtattacactttacaagtataatgggatgcataaaacccacgaaacactagactcacacggtcatggcgtaaacatgtacaccaaaatgctgtctaaatatctttgtatttagaataatccctctggtttttgacggataatgtcgttaatttntgaactaccatttgtctcatatttttttgcaaatattaaaagcataagtcatgcttaaattatttaatgattaaaaaaatcagaaccaaataaatggccataacatattttttttaacaagataaatggttaaatgtatatttaaaagtcgatgttatcgtactctagaacacgtaggaatataatgcatgtgtatgtgatttgttgggttagaacatctatgttcactagctataactgaagaaaaatatatgaaacttcttgaatgtataccatgtttcacaatgtttatttcagattctgtgaaatttcatgatagttttataggtttgatgatgtatcctggtgttaagaacttaagtgaaacttatttcaagataacctggtgtaaagtgaaagtatatgctaaacctagtgcaaaacgaaacacgatgcggtttatacccgatgtagtacaatttattgagctagtgtcatagtgatcacgccgttgtccaaaacatcacatattctgtgactggagatagaattcgttccaacatgacaagaaaacacgcgggaagtcatgttgtccttaggatcttgtcaagagttttgacttgaaaacagcaaaagtatttagttatccaaaaggtcagccgtgcttattgcaggacattgaattcatcttgttgaatgtgtcgcccatcgcacttggttcatccgtacttggtcctgcgcgttgccaaactcccgtaaaatctcaatcctatgagtcatgaatctcgaatcaaatttgtaccatgccaagttaccaagttgcctcgttgtagcgcgtcgctgtttgaactctttgcaaat

SEQ ID NO: 95670 - DNA, 1879 bp, Oryza sativa
aattttgtgtttaactaaacacagccataattaatttgtatatgtcgttcacctcttgccaaaaacaaaggcatcctctgaatctcggtttagggatatatcagtggaaaatttcatctgcaaatgtcatttgcaggtacatcaaagtacatcatgctcatgtgaataaaatttgatataggtgaacaaacagtatcacatttaacccggtgatatataccagcttggtgatatattaaatttataaagaattaatttgtgtatgtagtactccctctgtctaatatgatacatctacatcgctaaattagttttattaaatataacattgaatatatttttaataatatgtttattttgtgttaaaaatattattatattttcctatagattaggttaaatttaaaagagttttactagaaaaaataaagtgacatataatataaaacaaaggcaatacttacctagtaaatatttttgtaccaatgacatgttccttttctcataaataattaaaagtgcaactatttaacgcagagctgaaattttgaatggatttgcatgtatttctagctgtaccgatgtaatatagtattattagggcaagtttggtatagttccaactcctaaatttagctccaggagttgggtctggagtagagttgtggagtagcctaaatccagctccaactctctagcttattttgtgagagatcttcacctagtgcagctcccattttagctgtaactgaaactgtttggctgagcatcagtccaagagagttggagaaactggagttggagctgtgccaaacatgcccttagattaacgtttgaatttactttcatatagcatatgagaattaaagctaaaaattagttttacttgaagaccatgataaatttaactatgctttatattatgagatagcagggagtactaaagacaaattatcctgccatttaccataggaaagtatgaattatccctctgaactattgcgacagtacgaattaccccctgaaccacaaaaccacacatattaaacctcgaactattgataccggacaaattaccccactgactcaatcctgagcggtttttctcctacgtgccatacacatggcgtcgacgtggaaatccaattagcaaaaagaaataaaagaaaaaatagggcccacctgtcattacccctctcccctcttccccttcccccttctctctctcgggcgcgcgtggacgggcagtgggcggcggcagcgacgtgcggacgggcggtcggcgtgtgggggcggcggcagagcacgggaatggcacggtgtgcggcgctgaggagggtgttggaggaggccagctacgtcatcatcatcatccctctctctctctctcctcaggctagcggcgagcccggtggggagggcgagacgagtagcgggcggcgctaaggacattggagatggtaggcgtctctctctccccctcgttctctctctctctatggcgccgtcaggagagccgagcaaggaggaggcggcagatcctgaccggcggcctccaaagaagaggacaggcggatgaggtggacggcatccagctgccgccaggagggggcgaatgaggttggaggatgcaccggcgagggtgcgccctcctcgccgcagcccgccgcctcccgcgccctttccgtgagtccgtgacgccacagccccacagcctcctcgctggcatccgtggcccgcggtgcgcctcccacgctgccgcccatcacccgcccccgcgcaatgccgtgggcgccgaccgtccaccgctgctcgacctgcgctagacgacccgaaccccaacgagaacgtcaccatgaacgccgccgccaccgccacg

SEQ ID NO: 95671 - DNA, 617 bp, Oryza sativa
  unsure (1)..(617): unsure at all n locations
ttcctgcagcccgtgaatttttctggatcgatgggcacgacgtttccttcattgacgtcggtcaatcccaacttctgggatctgttccttaacagtgcttggactaaccgaagatggcgatagcggggggttctccgccctgaagaagaattgcttgctgacttcttttggtcccactgggcatgcaaaaaccgtggtgaccgtaaaacacaaggccggcaagaactggctaactccgtgcaaggtccaaagctcgccttcgggtatgttagcgtgccaagttgatttgatccctgcatcaacangaaatagagacaaggaacccgcggtaacctataatgatagacgatcggctaatgccgatacatatctttattttgagccgatgtcatatgtaatctatcggcggtttaatagattataagaactaacctactcgatcgacggngatatcaaccatatatattttatatcgattatacataaatcgagtgattgggatagatcggtcgccatgccagacagttaaatcacctagattgaaattttattaataacagacttttatgtttatagcatagccgatcggatagaactagcatgtatcggctaatact

SEQ ID NO: 95672 - DNA, 552 bp, Oryza sativa
cagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcacatgaaacgtaagtccaaagtaccggacac

SEQ ID NO: 95673 - DNA, 632 bp, Oryza sativa
attagactcgattctattgaagggatgatactctgaccacgtcatagttggactaagtgacagtgtgaaacatatggaaaatgacaataataaaagggatttacatcagctttgcatgttgacagatgacaagggaagagtactgccaaggcgatccccccggtcaaacgattgttttcagaggaaattacgtcatatggtatttgttgttttgcctgtgctgatgagcattgtttatcttctagtagtaacttggtcacttgcagacaaagaatcataatttattgcatactgtttgatacggagtatgtttgtcagggtttgttccaatcgtatttcatttgtgatttaaaattttctaaagagtaaatttcacaaaactacatatactatgatcaaactatcacaaaactatatatttaactcggtgtatcacaaaactacacattcaacaccaaatttatcacaaaacaacatatttaaaatgaactattataaaactacatgttaagtaactaaattattataaaactacagttttagaactaatttagtcacagaacaataatatttatagctccagcataataatggtgctagggatttaaactcttaaagctgtagtttcgtga

SEQ ID NO: 95674 - DNA, 576 bp, Oryza sativa
aaatctaatggtaggggtatgtaaatgattaaatcaaatttttagaggcatacaggggattgagtaactcttcaggacacagaaggaattttctctttgaatctactgacactttgattggctataacaaaagatagaagatacttattttgttaattatgccagcatagtcggttttgtttttcaaaatatcaatcatttccttatcttcgacctcagtttagctcattggtgccatccaaacaaggaggcaaatgctaaacataaaagatggtgtgccgcgcggccggccggccggggaagggggggacgctagatttggcaacgatgaacatggttcaagtgggaagactcgcataaaagttcaattttagtcttgattgtagcataaacatgataaaggaaatcgaattatggatcgttggttgtcatgcacgatctaaaacattgtagcttggcctaatcgaaaactgtgtgtgttcaatggtagtaaaaggaatagaacagagcagagtaaggaagtgttttacattgatttcgttcataagtggatccaatggcaagcaacatccaaaa

SEQ ID NO: 95675 - DNA, 586 bp, Oryza sativa
ccactctgaatgaagaaaatggaactggcttcctcattaggttcgagtatggaaagaatattgcttgtgagttgtgaatcttctcttgtgaaaagagattttttttttaaaaaaaatctgaattactgactagtatagctaattggtttcttacggtaggagtatgtgttatagattgctcttcaataggtaagggccatcgttagtatcaagtttaagcttttcccgaacaggaaaaagggtcatcatcttttgttatcacctaaccaatttcacctctttaaaatgcccctcaacatgcttttcctgatatatccttggtagtaaccatgttctaagaaaatttggtgattttggcgttgtgatgtttatgacactagattgcaaaaggtgccttagctattgtaagttctagttagtgattatgactaagataagtgttctttctagttgtttcttatgcaattatttcagtctttttaagcaactttatgtgctatccttttccacatttaggtcttgttaatcgcaagtacctctgtagcatagatactaactaatgttcaaacactaatcttgagaaaga

SEQ ID NO: 95676 - DNA, 554 bp, Oryza sativa
ctgtctctcgtgactccctgccaccgaatctgccaccacctaccactctcctaagcattcactttgctttgccccgtcaccaaagctggcccatccccttcctcaatccccacggcttcggtcctccgccggtggtgcctcgccaccctcacatgtccaccaccaaccgccaagccgcaggccgctgcctcccatccccataccccttcccacccccatcccaacctaggatccaaccctaacttgtcgcgggtcatcgctgatactggggggatggattctaatagctcgagtggacgtccacccgtttattgcatgtcaactaaatggctacgaaaattttttaaaaaaattggcaagatagatcaatatgtaatatatcactccacaaacatgcaagttaaaattcaacttctacaagttgtaacaaaaacaacaaatttaactgtaaatatacatatagtaatttgagttttgtttgttatttttattacaatctgtagaagttgaattttaacttgcatgtttgtggattgatacattacatattgatc

SEQ ID NO: 95677 - DNA, 625 bp, Oryza sativa
agtccaagttcaagagagttggagtttagtttgattttgtaattagatgtgaataagggaggctatgcattgagggtaagccacaattgagagattaaagagtttactactctttgtgttagggttatgtgagaaattcgtgagaggtgcaatgaccgtcttatgaatactacttgaaaaagaaatatcatattcaatcaacaaggcgtcaacgatcttttctggttttgtaatctttatttttttcgtttttggcattaatttgtgattcttagttttgttatgggtttgttcaagttaatccacccgaaacatttctattatattatagatcagatctaaaaggtttcattggtatttgcttgactcgaatttgcttaaaatttatgttttattcatatttgatgaaatttctgagacgtctagcttttgagatgttttctcttaaaccgtttattacttttgcatgacccttcgatagatttgtctcttagtttcctgtcaagattagagctcgatctaatggctggttttagagaaaacaagattttacacaagtgatgtaaggatctttttaatctgacgatcgaactagtaattgtacttcagtcaaaccagttctaag

SEQ ID NO: 95678 - DNA, 776 bp, Oryza sativa
  unsure (1)..(776): unsure at all n locations
agtagagctgcgatcgtattcctgcagccccaacaaaatcaatttggctgattcttcttcaacttcatcgacatcggcttgcttggtcccaatctcggcaggcaacgtgaaaaccatgttgaccgaagcagttacgacacttttccccttaactaacctttttgcctcctcagctgtagcttcatcggctacaggaacctgatcttaacacgccactcctgcctcgactttgttttctgcaaccgatggttaattcctgttcaacctcctaaaagcactccctgttcctcaatctttgaacccttctcttttgattcttcgtgaaaataccagaaagacaccactgatttttcctgatttcattgtcctcttggccatgatcttgattcactggacccaatctttgatgaacaggaactcttgtctgccttagccgattgcccctaccatatgatcggcttgaattcttggcatatcactgcacccaagacagtcttcaatagacgggaagctttagaccttcatttcaacaaaatctaaaaaactcacaaccctcatgaggaataaaaccatcgncttcttctttatgatgcctctcctggtgcttgcataccttctctgaaatttggtggaaaaccttaccccaattcacctggaaaccccttggccgggccctaatgggttgttggcccacttgtttcccccatttaaccggaaaagggttggcttaacctttattagccttttaaagtcgccaaactgaattttgcctcccc

SEQ ID NO: 95679 - DNA, 782 bp, Oryza sativa
aatgtaacgttctccatcaggtgatacaataggttagatctctttgctgatatgtgagcgtcagtatcatgggttcctatgtgccgattaatattcgttgctgtatttgattagactcgcattcgctccgtatttgtgtacgataatattcgattccattacagtatcccggtgtcggtccacgatatcgatttcgacagtgtgggtatgaacagtgatatgataaagctagttgccgatcgtatccgatccattttcatctctagtgacacaggtcggaattcaggttatcctatgcggtggtgatagtctagctcaattatcgagacgtattgaaaaatagtaaagatacgtcaggacaaccacagtagctcaagtgctctgatcgagaagtgctttcagataagatggactagtattcataccacaagggacttctgagttctcctagacaaatcgatcggtgagtgactgggcggtgttaaggctggatggcgcgtgaacgggcgaccagtgtaggggcgaacgcgtgcggatggggaccagtgagtggaagcgagtaactcatacggcgaggagattacgtgttgataattgtcacaatacgggcgccaggattacaatgaggtatatagcttcggttcagagtttgttgtgagagcctagattacaggtataagttctatctcttctaactaactcaacaaactctatccggcagctatatggagcatcatcacatgtacacagtatagggccgcaggaatacgaagcagtctact

SEQ ID NO: 95680 - DNA, 830 bp, Oryza sativa
aatgcttctggagaccaacgcgtactgcgcttagtttgtcgtcctcctcgttttatttaaggtactagagcgtaggtttgcgtgtgtttctgtccaatgaacaatgtgtaatattgaccagcttatcaacaatatatagtgttcgcacgattcaagagtcggccatttgacatacgtatcatatactcacgagctacctagttctcgaagggaatattacaataatttgcacttggacaatacatgtatggataacaaacatccaccctaattacgaaactgctgagaggatctccagtagcagtaacctctagtttagagctcctaaatgtcaaatgggggctgccccaattcttttggacctaaatatgtcatcaactctagcagtagccctcatatcttagcctctatttcttttcctcttttattttagtatataatttatgtttatatatagtttaacaccataataattcaaacataaataattctagcacatagaatttaaccatattcgaatttacaatttcaaacatcacgattcaaatttgagttcaaatttttctaacatgaaaatgataaatcttacaagcaaatattgaaaataacccatagttgatagaaaatgcaaatgacaaactaccgagcaccatgaagtgcccacaaatatttcacaagatcatctcgaagttgctcatgtgcttgttggtcttcaatttctttatgtatctttagaaacttctccaacacatgtttatcgcgtcgctggtaatcctccttcctcaacacctccctgtccccctgatcatagtcaaagtctacatcttcat

SEQ ID NO: 95681 - DNA, 657 bp, Oryza sativa
aatgcactggaatccaaaacaatttttgcagctagactattaacatatctaaaatgtccaaaatactattgagcatatcagttttctttgaaaaaaagtattagttaactgtatgctcaacaatgagattactgtgcctatcattagatcatcaggataaaaaaaatctgaactgcgttggctttcaacaatcctattgactgctacaactattcataatgatatagccaaaatggtttaactgcacatttccaattctgacacttggtcgtgattggagagtatagtagtacaccacccaaatggccaaatcattatgccccttggagttgaacaacagtatgacccagagtagcacagtcaaagaaaatatattgttacatctactctgagttacttagtaataacaaactaattgtaataggacaggagggaagttgaaaaaagactgacccaagcttgcactgtatttttctcctttcgtgtcaacaaaaatgtttgaacatacagtaacttctacaagtagccactacttttacatacaagtttagataatattttgactgcggtcaaagcatttagctagtagaacttgaatttgttattaagtaggcattggttgagacagccaaatctagtagtatctgggccgcagga

SEQ ID NO: 95682 - DNA, 779 bp, Oryza sativa
agtagacttgcatcgtattcctgcagcccggccatcctctagaaaatactagagggatagctggttttatcttcatgtcactgataccactccttgtcttgctattcccgaagaaaatccctcatattctggggtcatggacctccaaacattctctgacccctgctctgaagggattcaatgacaaaattcatgatctctaaaacgcggtctgactgggtacgaagttgtagagaagactttgttcgtcgtctatccagtctctccaagcccgtgctcaccctgcatacgagtacatgggggcaaaggacatgacgtggatatcgcactttggtagaacccaaagttttctgataaccctagtactatgaactgtctctaacatctaatctttcactgttatctttgttatagctgtttctgatgcacccgtggtgaagtgggtagggcatgtagtggtcgatccaccatcggccactgctgacatcccgatgccgataagcaacctgccataggccaagaaggacatcatcgtgaacgtaagcatctcggactattctccatatctatcatatatttggctatagaagtagtaatcttgacccatactagcatggcctctaacggatgtgatcggccagcttgtcaaccactaggcgttcgcttctttgagagagctggctgtgttggagcaagcaaccgccaccctcgtgcccagggcagtggatcccaaagaaaacgtttgccctctctcgagaagactactggggtggagacac

SEQ ID NO: 95683 - DNA, 1107 bp, Oryza sativa
gtgtagagtggatagtacggtggacccatctaaaaagttatttaaacatgagtcatgccaattgcccaattaaaaaaatagatgggacccaccataaagtatacctggtagtaagcttataccctggtagtagttctttaccacctccacaatgtataatagctggtagtagggatgcattcaatacttattaaccactacttcattacatcgtggatgcccgaataaaaacctgctccttcgccatcattagacccgcgcagaagcgggagtcatttggtttgaaaacgaactaggacattgtttatgcttttaacattcattttcagaatctcttgtcacacgccatcttggttcaaagcttaaaaaatcatttaccaagaagtcactttctttcgagttctatcctttacccgttccgattttagttttgtcctaagttaaattggtctcattttaattacttttataaaaattatcccaatatctacaataaaaagtcaatacaatattaagatatatttcatggtgaatttagttaaactaatttaatgttatgttgatatatttttctataaacccggtcaaaattttaaaaatttgctaataacaaaatttaaatgactcataatatgaacggagaaagttggtcgtgaatgctcgcaattgatatttttgttggtacataatctctcacttaaccaatttatgattcctccttggcagtaaaccctagatcaataaaattaaatatacgttagggtatgaaaaagaaaagcataaaattattatcgtctatcgatcgaactaaacatatatgatcgttgctacatctcgatccagaccagagaatatataattaatttggttggaatagtaatcctcctgtcctcaaaatcaagaccgatcattttgactttctgtgtatcatcttaatttatcatttgtatgatgaccgtcaacttgtaccacttggccgggtgaagaataggaaaaaattaacctggcccctcagagtatcttatgaaatagaattaaagcatcatcaacatactaccaaaattcaatcctctttttttaatctctaatggtatttaaagggggagt

SEQ ID NO: 95684 - DNA, 763 bp, Oryza sativa
tcctgcagccttcctcctccccttcttctcttcctactacactacaaatttaaaaaaaaataaaaaaccagttggaagaatgatgtatagaaatactatatataaaaaatatttgaattcaaatttaaatttgaagaaggtaattaaacttttgacttataaactttgggtctataaactttagtgtataaactttagatggtttggaattcctttttttcaaaaaaattttggattcaaaatccaaattggattgggatatataaattttgattaataaactttgggtctgtaaactttaaatgtgtaaacttgaggtgtacaaactttaggtgtataaatttactaaaataggaaagtaaagcggtgcctaaaaaggaaaccacgttgaagaaaagggggaaaaccgatcgcccctggcgatcaatccccattagagcaacttcagcaaagaccctaaactcagcccctaatcagtttttgagggtttagagataaaaactagattcagcagggaccctactagagcccccaaagtgaggaggaccctagattttcctcccaagcccccaattctgggggttccgagtacggcccccatcgactttttttcctggcgtgaaaaaaaatccgcttcgcgcgatctcgcctcgcccgcgcggcaatacgaccagatctcctccgaccgccgccatcgactcccccacccacctccgccaagatcgccccaaaaaaggtgaggattttttcctagggctgcagg

SEQ ID NO: 95685 - DNA, 1696 bp, Oryza sativa
ggtctcaatcgaaaagttcggcggataacggaataaacactagctatgaacttgtagctcaaacaaacaaaatgtatatgaatcaaaaggtgacaaataaggtatttaagcaagaaataaggtcccccccttaatcaattaagcatgcaagtagatcaggtaaaaacaagctcaagcacaatatgagagaatgcaagaacgggcaaaccaagaggggagatgcgtgatttgtttcccgaagttcggatccacggatcctacgtctccgttgaagaaccacaaaggccgaggcctatttcaaccctttcctcacgagggtgcacaaatgcactcctcggtttcactattgatttcttcccttgcggaggcgaaatcgaagccttcacaaactttccatggcacaccacaaccttgggtgctcaccggcaacgcctagccgtctaggagaccttagtctccaagagtaacaaacacaatcgaagatttgcttgctatgaactcgagtgctcaaagtatggagtgaagctcactagctctcaacttctcaatcactcaatccaactctttccccttctcaaatccctctcacaaagaggcacacaaaggatggagtgaagctcactagctctcaactcctcactctctcaatccaactctctccccttctcaaatccccctcacaaagaggcaccacaaaggtagggaaatggggatggctatttggctttggatgtgtctaatactccccaagagcagcagcccctcaaaagaggggtggaggagtttatatacccgagcccctcaaaaactagccgttggaggccaagactgtaatttttggagtttccgaaaagcattttcggacaagtccgaaaacttacagaagcaaatctcatattcgcagccactttcggaatgtccgaaaattttcggagtttccggtaatttttcggactttccgaaaagcacagagtaaaacgactataacttttcactcgggagtccgttttcgatgaacttggactctatagaaagctcactcagaggactacccaactcaaccaaaaacaaggtctaaaaccactcaaaggataggttaaagcttgggcttctctcaaggtagcactatgataggtcactttgagcaccgagacatacacaaacacctcgacgttgcatccctcttaatagtacggcattcctaaactcaaatgtaaataagaagataattataccattaggaatgcctttttttcatccttctttcattgtctagagggacgccaatgccgataccgtttcaccatatattcttcaaatgattgatgcggttacttgtagcttcaaatggtctctcacggtccatcatgacaaagccggcactcgccctttaccaccaccggatttggtccttcggcgccaagccccttgcttgcccttcaccgccgcatggtccatcgcgaccgagcatcgcttgcccttcaccatcttgccataatagccacttcgtatcacacatcttcaatatcttcactttgtcattcttggtattgttaggtgtaatgatatcacttgagcatcaacacctttgtaatccctgggacctatttctatcattcaactcaataaaattattagtcccgatgatccggttgtcaaccttcacatgttgaccaaccgatcgcatgtataaaag

SEQ ID NO: 95686 - DNA, 1586 bp, Oryza sativa
cagcccatataggtctgggctcatggaaacatacgaaatagcctttcctcttttttatgtgtggactaaatgttgacatgtacaaaagtatatggtggaagcctagcaaactaatacattgagattgtgatctcgatgggttgtggcaagggctcctgatggattagcttttgtgaaaagagcttagccccctccatcacaaaaataacgaatggatgtgacaaatcctagttatctagatttgttatactagaagtgtcacattcagtcttaggttagttttttatgggatagatagactatgtctctgtattgatcctaacgaaaacttctacttgtcttgtcgtactcaactcggactttggtagttgtgttatgaataaaatttagcagtatgagatatacctagtaagaggttcacaccttaggatacgatttcgtttgggcaggttcccaactcctcttcctcatcttctacgtgcacgcttttcgaattgctaaatggtgcgtttttttaaaaaagtttctatacgaaagttgtttaaaaaatcaaaataatctatttttgaaaaaaaattaccaaatacttaattaatcacgtgctaatagactgctctgttttccgtgcaggggagttgggttcccaaccgcctgacacgaaacagagacactcaaaaatatggtttgcagtatatggtatctgcgaggagagttaacttgtgtgatgcatatacatatttactttcttgatacaactcatttagataaaaggttcaacaatgaattgttctaagataaaaataaaataaatttataataactgacagtaatatgtgcacaagtaattaaacttagataaaaataaagtaaaaccattggtaacaaaattaatgcttaactaaataaaattgtatattagatatcattaaaattttagtcctagcaatgtacaactttaaattactgaaacattataccttttcgagcccttggaataccattacaaatatatgactaacttgtgtaggggtttgaaattatatgcatgcaaatcaccggtgctttgcaaacttaactttagtcgaggattacaactcaaaaaatagtaagaaatataatatattgaaaatgtttgtcctaattgaaagtaacgacggacctagttagatctcagcacctaggtcgctgatcttttcttctttctctttcaccatgttaattcaaacaaagctcaaaatagaataggtcgacttatgcccacttgccggaacatttaactatttgccactttttagatatggcagttaacgatttgccactcgctgtctatgacatgtgggtccactggcaaatcctttaaaaccacttgtaagagtagcaaatagttaattattcccaccttgccaaggtttacaacaattaacaggacatctcttagccaataatataatatatttcttttgtttagtgaattacagagaatgaacagacagaaccaagccttaacatttgacggcttggacacaataaggtacctgtgtaatattgaaaatcctccccgtcggccgctcgggggggagggagga

SEQ ID NO: 95687 - DNA, 1197 bp, Oryza sativa
cctctctcgttgatcactttgaacctatgttttagaggttattgaaaatgtttgcaaatcttgcatgtcgattgtacactaataaattataattttgttaaacttgttagacaaacttctactacttgcattatcaccttaaccccacgtatatccatatccccattcctaaccttaggaataatataattataacactttatatatgagttttgatgtcactaggttactataatgcttagccatgcttagaatgatcttccttgtcattatgggctcattacaaatatgaaaattgattttgaaataatctggacagaattttaatacttgtgattttgataaataaaatgatggaaaacatagattctaggtttgggccttaagtggtgcacatatggtgattagttgtgtaccgatagggggagagtgcgcctaaaccgacctaaggacttcactcaatgtcagttcatttcgtatacagtataaccacatgtgctagtatgggatagcccaagattagtaaattatttatggtttagccttacattctggtaggccggtgtatatgagttcgaataattcaaaggagcttcctatttaccccgatgtggtagtttaggtgactaagcgtgtccaatacaatggtattgtgccacgtggtgggttcccgttgtgtccgccaccacagtgttaagtttaaggcgtgggcccgccacttaacggttctaggttatataacgtgtatggcttaggatggagtaacacatatcgtgctggtgtaaggctaaatcatgaattttggaaaaacgttgatgcgggtaataaatcgggtacttatgtatcgcgtgccatgctcttgcatgattattatttcgcatcatgtgggtaaagtgtacaaactcttcagagttaaaactaatcaattagccgtgctcgcggttatgagcggtgtgtggatatgtattgagtatagacttgtgtttattcttctaaatgctgaattttattttcaaattatgatgagatttgagaatgatctccttgctgccgtggatggcaatgaggtgtatatttatacatgattaatgtctactttgatgcccatatgctaagtactagcttgctgaaatttatttgaaagcaaatctgatttgaatgtgttttatgcaaataaaacttgctgggctgcaggaa

SEQ ID NO: 95688 - DNA, 810 bp, Oryza sativa
agcttcgtgtggagatctcctgcttcttgcgtgtgtccaattggccatcctagatgccatttcctttggaatcttttgattcatttagggcatccacaatgttagaaaaaaagcaggtagtaggcaatatactattcctatgacttagtaataagcattgtggaagtgggtagtaactaatgctcggtactaagcttatgacccactcataagaataaaaaaacattaaaatctctctcactctctccttccaacacaagatgtgctactactacatgctgagttgacaaaaagcaactaaaaagcaatatttttttctcatgcgacccactttacaaaggcctactacttagccctgctacttattacttagttaggtaagatacattgctgttgcccttaggatgtttctgagcagtgaccgtaacaaagcagtgaagaataatctatattatctataactagcatggtggcccgtgcagattgcgcgggtagcatcattatattttctctcatataatagcatatatgttttcccattatattattcaaatatattaaaattacaacataatttaaattttgcaataactttacaaaactactaatgtataatattcatattatattttatatacgtgttagttattagttatttttaatatcaaattttagttatttgtaaattatataaattcctctatggactctagactcgtcttttaatattttttaattccgaattttctgtaaattgtatttttatatagactctatgctcttcttccaatattatttatttttatttct

SEQ ID NO: 95689 - DNA, 956 bp, Oryza sativa
agtgacttgataccaatatatagcatatgcggtgtgaatccccgaataatatgatccagatgatataccgactgctttgcagaatatgatgcgtgcaacctaaagttgacaatatctttgaaaattcacatagcataacagctataaagaagagcttgctgttgtgaataaagaaacttccaaattattgggcatacaccacacgcacactgctttaacagatgtgcttaagtccctaaaagacacatggtttcaccacagttatctttgctagtttgcccagaaactaatcgtttgtcgtcacgtaattatgatatttatcatttttctaatttgcttgtaaattagtcgtgtgattccgcggaagtgaattaatctcgaaatcggtttcattagccgatctatcgattttgaggactctattatttacaccgcaaatcgttaggtgatcatatgttgataaaaaaacgtcaacagcatggccactcttcaagtagattgaaccgacgccgttacctcggaggttcttgccgctgccgtcatgtccgtccatcgtcaagatcccgtcgggcctctgtaagccattttcaagcttcggtgagcacccttgagtaccttaagaccacatgcatgcactatctcacatcacattgctctagaactcgacatgcacaagcaacccgagacatgccgctgtttccaccatcgccaccatctattctgtccactatggcttgtaacaagaccaccattggctttgcaaagaactcatctaaattttctatttttaccccaacgtcatccgagccacctatcgccgccggcaagctcgccaagtcacgaccactcctccctgtacatcggcggctggaggttgaagacaaggaccctgtcttgtagtaaactaaaagcttagggtttaaagcgtaaagcactagagacttacatgtggggcc

SEQ ID NO: 95690 - DNA, 714 bp, Oryza sativa
attcctgcagcccggtggcagtaagtttgcccctaatttttttctgattccttccactattcagttgtcgtttgaaatctgtacagtcagttattgtttcacccatcttcttgatggaacttgattgttgtctctttttgttctccaggagctcaaccttgggagagatagggtgagttcatggctctctgatcattgtgaatcttgggaagagttttggacttttgattgttgatggcattttcaacacgcatctgattagccaccatctttcttcttttgaagctaaaaaagctgcaacatcaactcgcttgctcgagagctgttatcgcaacaaaaacatcagaattggaggtataggaactgatgctaatgtcgttcttgctccaccttcgtttcataaattccatggaaaatgttgatgcaatttgctgttcttatcctcttattattgcaggaggccaagaaggcgatgaagcgcaataggaacctgccactgccagagaaggctcctcctgcaagcgaaacggcgcagcagcagcagggttctgatagagcggcacagatcaaggatggagatgtcgtcaatccagagcccgccgcggcttcagacgcatcgcatgcggcaagcaccaagaaactcagcaacgccagcaggaaacggatgcaaagatctcgatgtaacaatggccgctaaccattttgcttgcaatg

SEQ ID NO: 95691 - DNA, 683 bp, Oryza sativa
acgccgccgcctgccaagacgccgcagcctgccgccgccatcgacggcgccgccgccaacgccgcagcccgacgccgacgccgatgccgcctactgcatctgttagggctcgggagggagacggagaaggagagagaacgggagggggaggttggtggaggtagttcagtggcattttcatgtaaatacactaaaattttaaagggtagtgtgtcttttaaagtggagtggagctgtggagcagcaaaaacccagctctacccccgtagtacaaatttgtagagtaactatgccaactccgctccaaaaaataaatgatctgaaccgtttgacacagctctggctctaggtaagttggagttgggagctggagctgtgccaaacgggccagagattaattccctctcaaaggcaaacacacagcccacaggccgctcctcgcggtgtccacgtgggatacgcgcgaacttgcaatattgccataaagcccccgttttgtgcgtaattctatatagatcctcacaaacagttcctctgaggcattattttacataaaaacccttacaaaacccgggtattccatgcgaagaagagaaaatcacgaattagaatagatctctaaaatgtggaagccgaaggggatttctcgcaaaacgacgcccactaatccagggggtgcagga

SEQ ID NO: 95692 - DNA, 517 bp, Oryza sativa
aatctataattgaatatattttcataataaattatcttggattaaaaatattactacttttttctataaatttggtcaaacttaaagcagtttgactttgactaaagtcaaaacgtcttataacctgaaacggagggagtaataaattttaaatggttaggccacgataaataaaaccttagtgcttatgtttaagtacgtagcacacaacacatcttatttaagtgtttataattttcttgaaaaaaagacacgtggttatagtcaaatatgaatagcatccggctacaggtatttggaaactagctagaggaatataccttttcgagttgatggagggagcaaaataggagaacatatgttgagtaattatcagagcacgtgacacgtgtgcactttgaagatgtgttcctcgatccacaaattcgcgatagcaagcagggtttacgattccgacgaaatctggtcggatttcgcgaaattttgacattccgacgaggtttaaaagtagaaaccg

SEQ ID NO: 95693 - DNA, 599 bp, Oryza sativa
cccgatctgtataggtaatcacccaaactaaaatataatagacctactctacttgtttgcatacatagggtttttggggcataaacttgtctgcgtacttaggttttttttgggaacatagactttatgcgtgaggagatctacatgcatgagattttctttagggacataagttttatccgtgagaagttctgaaaccatatagatcatctactcatctacacaatagttttaagggaacatcaattatggatctttaacccaagaagatctgaagccgtatagaaatagatctatctatacctaaaactcacccatccaaaaaaatcatctattaaggatgcatcttcatcaaaaattgattattttggtacggagggcccaagtttttacaggaaaaaatatcttgattttgagggatctaaacacatacaaaagtatggtatcattgtgtcttctacataaactagaaaatcggtgtgttgttagcatgcttgctaatcacttaaaaatactacataataaaattgatgtgctcactaatttaaaatatatatatatatatatgtttttcttaaataagaaaaataaatgtaaat

SEQ ID NO: 95694 - DNA, 681 bp, Oryza sativa
aagcacctgagggacttcaatgctggcaacatagtgacttccattataccatggtcaggaaattttgtctcgagttgccattgctgcaaagtaagccgcaacaagctcaaaccattacgagagttgcgaagccggttatggcaatctttaagggtaacagaacaagtcatatccagcaatctcattgaaagcaatggaatagggtgagcaacaacatcaatcttgtgataagcaactatttccctgtaacattcaaggatgctatgccaaataggatggtcactttctttcttaagtatatttccgtagttctcaaagaagttgcagtaaggctggagaaggtgattgcaccaattgaaccatatggcatacaatttaagatcattttcagtagattgctccattacccagtttgcagcaataaaaagcatctgatcagctaattctgaattgaacaacccagttacacaaggcttgacagactgcttatcagaaacggttggaaactgcagttctaataaactcgtggcaggcagaatatatgggtggatgctagtgataggtcccaacaaggatgaattacttttcaaagtgcttatctgataagcagcgtattgggaacccaatgactgcaaatacatacaatttctttggacacaagtttcctttgaataccagata

SEQ ID NO: 95695 - DNA, 528 bp, Oryza sativa
tatattccctttccaatcacacaaacttatgctcttttacttctataaatataccatgcctactcagtactacttctataactctaaaatatatagtaaacccagaattattaataaaaaacaaatttaaaataacgaatttacatttatttttcttatttaagaaaaacatatatatatatatatattttaaattagtgagcacatcaattttattatgtagtatttttaagtgattagcaagcatgctaacaacacaccgattttctagtttatgtagaagacacaatgataccatacttttgtatgtgtttagatccctcaaaatcaagatattttttcctgtaaaaacttgggccctccgtaccaaaataatcaatttttgatgaagatgcatccttaatagatgatttttttggatgggtgagttttaggtatagatagatctatttctatacggcttcagatcttcttgggttaaagatccataattgatgttcccttaaaactattgtgtagatgagtaga

SEQ ID NO: 95696 - DNA, 707 bp, Oryza sativa
gcacacacacgcttcctaaattgctaaatagtgtgtttttacaaaagttttctatagaaagctattttaaaaaatcattccatttttcaaaatttttaggttaatacttaattaatcacgtgctaatggacaacaccatttaccattttccgtacggggagccgaacacagcctaaagctttttactacctccgaggtcacaaatgcatctcattattgtactaatatactatattcatgttgattaatttttgaaatgtgaaaaaaaataatatatctatcttttacaatactatttgagggattaaaataataagagtgaatttcactttggactatgttttttttacctaaattgcattttagactaggcattggcaaagtcttccactttagacatgattttattaccgagaaaggcacattagactagtggcccacaagtcagccaccagcatcttcttcctcctcaatcccccattcccccacaggcaagctcagcttcccccacctgcgagttctactattgctccttcccccctccggcgagctcttcgtttcccccgctctccctctccctcccatcagggcgagagattgccgcgcttcattctgctgtcaagctcctccaaccccacgtcaaccaatgcctctcctcccccgcgctggagttcgagcttcccgccgtcaaccccgcgtccttactt

SEQ ID NO: 95697 - DNA, 760 bp, Oryza sativa
tcctgcagcccactacgttggatccaaatatgagtgttttagatttgttcgtgtcaccaagaataaaacttttactcgtggttaaatctaagagtaaatctaggaaaaatatgtagtgcaaatcacatatacagtggaaatataaaaactatcattagactaaaatggacgcctacaatttatcaatgccaacaatagaaaaacttataggcgtccattttagtctagatagttttcatatttccactatatatgtgatttgaactacatattttcccaaacaacaccatacttttgcgatgaagcccacctgtacccactaacggccgaggatattgtctctgttctactaccttcgtcctagaaaaagacaaaccctgagtttccgtgtccaacgtttgacagttcgtcttatatgaaattttttttataattaatatttttagtgttgttggatgataaaacatgattaatactttatgcatgacttgtctttttaattttttttcataatttttttaaataagacagacagtcaaacgttggacatggaaacccagggtttgtttttttattgggacggagggagtatattacaaatctttcaggtttatcctaagttaaaattcttttaagtgacattaatttgtaaatatttatcaacaacactaaattaatttgtaaatatttatttacaatatatttattttgtgtggaaaatatacctataatttttttataaaatttaatcaaacttaaa

SEQ ID NO: 95698 - DNA, 753 bp, Oryza sativa
cgcttttttttcttcttcttgagttataatgttctcaattttgccacttcttgcagagttagccattgggctgtttttttttaaaaaaaaaaccccaaatgctacaaaaagttaaaccgatacatgtgccaatttctgtgcttttggcattgtcaggtatagtgtggagaaggtggcaactctatcatgtccttggtcccagaccatatgaattatgcatatggaaatcttgatttcttgggtcactggtccaatatttttctttttctagaatccactaatccaatattatactactagtactaagctatttaaaagtctcttactagagttggttagagttgcacaatttcactgtcaccatgagcttactttaagatttggcaatcctgtacatatgatgcattgtcttttaagtttcactaatcactgtcaaaacacgagaaaaacatggcattattttgctgaaccagtcaaacagttaccattaaaaaaagttaaacagttaaagtagggggagagaaatatggtagtagctcaagaaaaagtcatgaatccgttaatatggttcattctttcgcttatttgtagaataagccaaaatcatatttgcaaacaaaaaataatttgtgaataaaacttttatatacgtgttcttagtgatctaaaagcaaatgctgaaaaataaattacgatgagaaaacccaaaaatcaacaccaaatttaaggtggaaaatttaaattttggctgat

SEQ ID NO: 95699 - DNA, 535 bp, Oryza sativa
ctgcagccccaagcaaatcatctaccagcctgccagtgagtcctgaatgtgcaatctgaattgattagatggctcatgatgaacttatcgtcggacatgttggatcggtatgttcatcacatttgctccctttaattagctttaggcacaattgtgctgcatcattggtgcttatcgattgatatgtacatgcaagtaagaagtgacttggaaagtatttgttgctatacggatgggtctcaagatctacactcgtgggttctactgttgacaagaactaatgcactgtttacaagaatattagcaggattctgcatatttccttcaccaatcactactacccgtatcaacctaagactatcatgttttcctttttccttgcacctgtttctgatagttaaaagtgacatttttaagtgcttgttgatacaaaccattcatttatattcattttcataaaaaaaaaaattcatttatatccaaattttcaaattttcaaacaagggtatccttgttcctcgctgacctcgggctc

SEQ ID NO: 95700 - DNA, 701 bp, Oryza sativa
ctacccaaaggaaagctgctttcatctttttcttcctactggttgatacatccattcatccactagccacgcaggagcttttacagtctccttttgtcactgcattgctgaatgatgcattctactgcatacttcagagttgcttgcctcttactcaagagtcaagaccaaatcaatcctgaattcttgatgtgaaaccatgaacaaacataaaaagatataggtagataatcgaaaatcatctatactaatataaaagatgatagtgatggcggacacccaactgtcatgcagaattcagaaacgataaacgggcaccaaaaaagtaaatatattagacaatatatataatgggttattttttaaaaaagaaatctgttagtggatagaagaagaacatgtacaccgtatctatcaatgttggttggatgcagcaagaaacaggcttgtgatcaggtgtgcatcaccaaccatgcatgatgaaccaatagtttggtgatatgtcgcttgggaagaagatgaatcaaactggcaggagggcaatgccgatagaaaggagttttctgtcaccggatggcatatgcaaacctcacaccggcaggcagtacaaggcaccaacaaccaaccatgccaccattcatatgcatgtttacattactctgctactactaatctacttctccctcgttccattttaaatg

SEQ ID NO: 95701 - DNA, 894 bp, Oryza sativa
ttcctgcagccctatccaatgtactttaagcacaacttttcgttttttatatttgcacaattttttttaataagacgagtgatcaaatattacaagtaaaaacttaaaatctattatattatgggacggatggagtagtattaaagactttctgctgcccccacccaaaccacaggttctgaaattaaagtaaaaacgattccaaagaagctttcccgtcggtctccacctccatcatttcgttaatcatgggccacaaaacaccgattttggtcgccattatcggagctaattaatttaaagaggttttcttttgctgttatgcccagctttagctacctaagctttgcattgtggtgtaagccagtgctgcactgactcaccatactgtacccaataggtctcaagtcgctgtcatgaaagctaaacatatagttgcaacaaacctgacctctgaactagatgacatttttaattaataactaacaccaaatattctttggagcttaggtatttataggaccaaattggaagaataatgagtaatgggcatgaataatttcgattggaggcttttcaggccaggactgattttttgtctgaatctgaagattacctgcatgtaaaatcttgatctgaagattagcttcaagtgaaatgttgccccatcgttttacttatgattatagttatagccaaaatttaaattttaaaactttattctaagttgattttgttgttttctttatctttgtttattttacaatatttgcttttgaattgctaagtacatgtatataagaaaattatgtatgaatttttttagttactaataagctttacaaataagtataagtataatctaacagaattttgtacaaattaataggatta

SEQ ID NO: 95702 - DNA, 747 bp, Oryza sativa
tctggttttgttatctctgggcccgttttttttaatttttcaccgtttctttctaatttttttaaatctttcacacatctctttacaaatgtagagttgaaagttcttaattttgacttgaaagtttttaaatcttgattgaaagttttcaaattttgcgttgaaagtttttatgttgttaataaaccgtatgaataaacataatcatatgagtaaagatggacccgttaatccattcatccatccatccaaaacgaaacaagataacgagaggcgcgtgcagcgtataggttacttttcaccagcaataccactattcattcctccgtcttaaatcttcacactacagatcaagcgcgtctgatcggcccaaactataatccacacagggctaaaataatactctctacatcctaaaatataacaacttcttatacttaaaatttatcttaaaatataataacttctccatcaacattctctttcccaccaatcacaactatctatcattcactttttctacctacatcaacttctcaatcaatcacaattcctcccctctcccccaatttaattctaagggtttattcgaattagaggatcttcacaggatttttggaggaatactgtgcataggaatttttttctttcctgtcattcgaatcatgaaaactggtcataggaaattcctttggtactgatttcacaggaaaagtacatgaaaaatccatccacctcaagctcttt

SEQ ID NO: 95703 - DNA, 683 bp, Oryza sativa
cgctttttacatcatagcggcatagatattgtaggcatagccattagccgagctggtgctggtgcatgctcgatctatcgcttttttggactgaaaaaaaggggcagaaacaaaggttgccgttgatatttccttcctttaagtggagtggaaactggagtatcgctcaaatagctagctagggaagttattttattcacctgtgcttgtttgacgctttgaccgcaaaggctaacagccccatcctttggctgctcaatggaatagaacttttatataggtgttctaaacaatctagaaataaaagctaaaaaataaactaggataaaaaaactcgatttaaaatcagaaaattcacgcgagaaaatataagtccgtacgctgttcgcctctggtgcgtcgcatgacggcgacgcgatcccgcgagtgcttgaccggttgacttgtccgccgcctgcagcggcctgcaacgctgcattcccgctggttcccacgatcgtatgttatcccgtcccgcgcgacacgtccacgacgaaagggctcgccgtctgtatccggcggccgtgcgtctctgaatctggtggccgtgcggcacgaggagtccttgggaatttctaaacaaaaaagtttcattttattccttaaaccttctaaataatttttttagctcgttttacactcca

SEQ ID NO: 95704 - DNA, 698 bp, Oryza sativa
attcctgcagcccttcataatgaacttttgctgcaaaaggttatatcaacaagacagttagtactactgactaaatatggggcagagtatgtgagaacaacaaaaattcacaactcgattaccatatatcccagcaggtactgctccagggataaaaggccagtgcatgaaacaacaggaaaggaattaatcatagggataaaatttcccggcacctagctaaaagaacagaaatcaaacatttttgaaagaaaatagggattataggggtgtgtgctaaaggatgatcaccaagtacaaacatttcagtatcaataagtctgcaaagcaggatcaacatagaatgccatccacttgattcgcttttgtgtattctgcctaatccattgtccttattgtgccactttatgctagataaccaaatcagcagtgaacttgatttgaattaaaccacatgaaaaagtcatttcgtgattattcttctcatcgtagtaatttgttgacagattgttcggatagaggctaactgtcatccagaatgactaagctgacagaagatcaattgccatagttcgttggatatccatatagtttaatcaacatgaaaatagaattaaaagtcactaactatgtaatatattatatatgcatccacatagcattgcatttatgcccctaaatctatgtcaggccttaca

SEQ ID NO: 95705 - DNA, 823 bp, Oryza sativa
actctttttttttttccttgtcagtgaccaggagggggcacgactggtgacagaggagtccccgcgcgaccgattcccccagccccacgtctcccgattttttttaatcttaatcacatgcgacctcctaattccaaatgtgagcatgtattgccctgaattctgtttctaatcaaactagctagcagccacaaagcaaatgatccattaacatgtttcgctagtattataattaccctttgttgatgcagcttctatgtgaaacaaattaagatttgtcaatgattttcatgatccaagcagatgattatatttcaaccgaccgctacagttccaattttcaaaacgaaaacatccaagtgatcaaatatggattaagaaaaaaaaagacaaagaaagctcgagactaacggcacgacggcacggtgccctatctcgtaatggttgatccaaccaattgcaaatggtaataagattttcttttccgacaacaaacaatcaattagacctaaacaagttgctacagctagtgatttctccaatgataagcagccattagtttgttatatttcgtttgacgttaagtccgatggaagaccactgcacacacatgtgggcttcttgattaaaattagaatttcatccattaccttctcatatttggaattagaagattgcatgtgcttagatgtgaaaatttcggccacgtctctccctatacatatatatactttcatgggtctatatttatatgtatgtatacatgtatatacacaaaagtatgtacatgcaaaattttacacctgtatagaaaaagctttct

SEQ ID NO: 95706 - DNA, 514 bp, Oryza sativa
cccctcgagggagttgaatccaatccctacttatggttcaagttttacaatcataaatttatgaatctcgtatcatatgtacaggtaacattagggtgtttttacctttattctgtacagttaaattgggtaacattactgataaattgcattttgttacttgctaatgtgacaatgcctattttttacaatgtaactagtatagatgtttggtgtattaatgggatctaatggtcttatggtgtaaatttgattgtttctgtttgttattagttaatattactcttatatgccgcattgttaccaaagcttattttctttttggttcattaaggaatatgagtttctctagagagcatatgatactagtcagttgaaagctgttagttgtcaccaatgtctctgtgttactttgtgcattctacttagggaatcctatccctaatatatgcaactttttactatatggagttcaactgaccaagcacctaaaaaattgatgtaggccaatcct

SEQ ID NO: 95707 - DNA, 678 bp, Oryza sativa
ctcgacgcggccaggaggaggcggccgtacgccgacggctccaggaggcgggcggctggggctgggcttggcggcgggcggcggcaacaggggaggagggatgatttgggttggattggattggaggggagatcgtgagataagcgtccactactccgcggcaacatcgatctgacctgacgaagcctcaccgtcaccgcaatgttttagcctagctggctggctgggtttaaacagtaaacacagggccaccaatgactgcggcatatttagaatactgctaaatttatacatgaaacttctatatgcgtgtttcttagcgactgaatgataggcgcgagatgtgtctacaatgaaaagccttcggcattaactccaatttctttgttgacagatctaaattttaacttatattgatatccctaagccatcgatgaggctgtgatgcatcgaaaataaaagatgctcatgtatggtgggtctattcgatcattcctgcaagtctatgctaataatcagaaggataaatgtatcttttccattatgatatggatggcaccatctcacacatcacacttatatatacctgcaaatgtatcctttaacgcacgctcaaaggaatggaaactaccaacatgtcctcgattcgtatttggaaacatattacaataagcatgc

SEQ ID NO: 95708 - DNA, 680 bp, Oryza sativa
taacaaaaaagaagttcaaactcagttcaaacttgttagtaaagaagttaatgttcatatctaaacatttaaaaaaatttcatactcattcaaattgggtatatactcaatttgaatcttggagcccatactccatgtagcaccatatatatatatatatatattacatatatatatataggacactcatatggggcaatacacaaattcgcccaattttttcaaaattttcaaattgtgagtatatatctagttatatgtattcgattcatatatatatatatatattggtaaggatcggcagcatgccagcatcaacatatacgaagatgcagaccaattgcacaggaaagctatgggccagttgtaatcatagctagaggcccaataagctccaagccaggcccaataatactgtgcgcggttggaatggatagagcggaggggaggggagtagaggcacagcagcagcagtaagaggtctgctagggtacggtatcccgtccaaacaagatactttatattgatgatgtcagctccgcctcagctttatccactcatgagtccacgacttagcaccgccctacacgctcacgccacagccggtggaagagcacgcgtgaggcgctaggagaaggacacgacactaatagtggattaggtgacaaagttggtccctg

SEQ ID NO: 95709 - DNA, 911 bp, Oryza sativa
aatcatttgaggactttcatggggtatgaattgtgtgctataataaattaaattgttgcatatgtgatgttgtaaattgttgctttgtgatggatctgtgatatgtgatgcatctgtgatgttgggcagttggggaatatgtgatatggagggggggtgactggcacctgtgatgtttctgtttttcagagggcatggctagcaattcctgaggctagccaatatttatcatttattttttttctggaatcaactcatcagtgacggttcggaagaaacatccgtcacaggtaacctcacctgtgacggactcgcaaacgtcggaccgtcacaggtgacccacctgtgacgggcctttactttcgggcccgtcacaggtgggtcaccctgtgacggctactatataccggagatcatcacctctgacgggcctttatttaggtgctcgtcagagatgagacacctgtgacgggtcctaacaagccctagtctagcttagaccaacacctctgacggccttctattaacttgcccgtcagaggtggatgtcaccactgacggccggccacccgtcaaaggtgactggacttaccagtgaccactgatcactgaccaagcccaaaaccgtcaaaggtgagggtttgggcccgtcacaggtgaccttgaccagtgtagtgataggagaacttctggaggtacccgacgcggcggccatcggcgccgatcacggccttcttgccgcctccgacttccacacgctctcgccgccgaccgcgcgctgccgcctcccggaggccttgcgcttgctggtgtagcgcggggagcagaagaagtaccagacgctgccgctcccatgggttcccggcgccggtctgtgctcgccgacgagctccgtcggatcggcggagtag

SEQ ID NO: 95710 - DNA, 714 bp, Oryza sativa
taagataaaaaaaggtccaaaacgatttataatataaaacggagggagcaattacatggttattggaggatgtgatgagaaaaaataagcggcaaaccgcatatatatatatatatatatatatacgcatgcgcttgtgcgtgggctggtgcgtacgctttattcccggttgatattatcaaccgggactaaagatcccagggatctttactcccggttgataatatcaaccgggaataaagcgtacgcaccagcccacgcacaagcgcatgcgtatatatatatatatatatatatatgcggtttgccgcttattttttctcatcacatcctccaataaccatgtaattgctccctccgttttatattataaatcgttttggacctttttttatcttaatcgaacttttttatatttaaataaatctatagaaaaatttagcaacgaccaaatcaatttaaatataatataaaatatattttaataatataattgttttgtgtcgaaaatattatatttttctataaactaagtcaaactttttaagtttgactggaaaaaaaatccatgataccagcgaaaatgacagtactctgtctcggagtcatcatgtgccatatctattgatatatttaagaccatgcatatatggccgattgatccaggtcaggtccaattcggtatgatacgatcgatcatctcttgatgatctg

SEQ ID NO: 95711 - DNA, 691 bp, Oryza sativa
caacatggttaagtatactccaagataggagcaggtttgcttaggtaggcgtgactcggtgagactgtgagagagctcagctgggttagcggttcgctaagctccttcgaacttaggcgtggcgcagaagatcccggtgatgagtaaggatggggctaactatatactgtgccctccccgaacagcaaatcttcgtctgtcgttggtccaagctcacacgtaaataatacccggcggggagggagcaatcagcaatagaaaaagatcagcatagagagagagagagagagagagagagagagagagagagagagagaggagaggagaggctgtcccatgcgtgccccaccacgacagatacctttgccggccggtcccaccaaagcataaaccgagtttataaccagcggcaattagagaaaaatcatcaaacgattcaaacaaacctgatttaaaccttttttttactttaacaccgtaacaaagcaaacacatgcattgatttgacagacgggagctgtacccggcacaagaatcaaagcgtttccaaagcagcgtcaaagcgaccggtacaggtacaaaagcaaatggatttagggagagatatactaccaaagtccagataaaaaaccagtccatggacatggtccacccatggtccgcgcgccccacccccacgcctccactaccg

SEQ ID NO: 95712 - DNA, 1754 bp, Oryza sativa
cgagacgcgcgagatcgtgccgaattgccgatgtcacgagttcacgactcagtgactcacgacgagtgcccatctcacgagatggggatgtggcctagtaaagacccaaacgggcccatgtcacgggagcccattaccttacgaagcaaaggcaaagaagcccactgcaccttcgtttgggtcgggccacgtctgacttcagcgttggtggggcactcctcccattccattttctatacgaacgtgtgaataagttggccagttctttttttaagagaagttggccagatgtgatattcattcgaaaaaacaatgaagacggcatcaacatgtacatcgtcatcacgatatctagatggatgaggcagacggcacgttgaatgtagtagcactaaagtagaattatgtcatgctttctattgcggagtgcgccgcctgtttcgatcattgccgctgtttctcccacatatagatgattctcgccatctgctgcaaaagaggaataagcaaccgccatctattttcttggctagaggaaaggagagaagtcgagtaacgaactaacgactccaaacaaactcgctcaagctgtatactacaagttagtagcaatagcaatccttcttgtattgtggtacattggttgtatagataggatcataggaacagtaacaacttgcgttgcgtgccaccgccaaccccacggcacgcaatgcgattctttgcctggagacggtagctactccacttgttgcctatcttcacgttatgcgtgcctgcccagtgcggcagtgcccacgtacattcgcgaccttaaattaacaccaactggtcctgctgcgcggcggcggtggctaccggggaggcaacgccaaattgcaaatccccttccacactggcccaggcccgcttgtttatcgtcttctatcatcaggcctctgaattctgtcacacctttttttttctcatcggaacactactggttgctgaagctcctttagaagtgtactcaattttcttccttaatcatccatccgacgtacattttgtattttgtgctgtcctatcttctgttatacaattagtagtagcatcttcgagagataagctcgatcgtgtatatactagctggagtatactctgtgtgttctcatcacctcatgacttcgcagtccccacaccattgattcgataaatgttccagctagcactgtctcccccgtacaataatgtttgcaaattgtaccaacagtgagtgatgccacggccaagctccaactagtcgcaacacaagaacaaagtgaacgacgaaatactactctctccgtctcataatataagtgattttgagtttttgcttataacgtttgacctttcgtcttattcaaaaaattttaaaattattatttattttatttgtgacttactttattatctacagtactttaagcacaactttttgttttttatattagcaaaaaaaattgaataagacgagtgatcaaacgttgcaaacaaaatcttaaaatcccttatattgtgagagggagggagtatatgcagaagaggcgtgtcagagagaagattactggcgggagaaagttaaaaagtactgtcaaaacaaaacctgcaaacaccgcaccggtgcgaaaacgtacataagtacatactggtgcccgcagcctgcgtagacgtactggagtacttgtattggattgatggatactccaacctactgtgccgtagtactagat

SEQ ID NO: 95713 - DNA, 536 bp, Oryza sativa
acgggggatgtatgattagaacttcggggcatatatatcaactactatatgggcgtgaatgaatatcggatagtgacatgatgcataaatttatatgggcgaccgacccgagaccaaaaaaatttgcatattaccatattatataaactgggttttgctgagacgccctgtcaaactacgattacgttaacccgccgagtaatcaatagggtaccggggcctaatgcccgactttcatagcgtggcccatatggcaacgccctgcgctgacgtactgacagctgccagggccccgaactcttgcaaactgacgccgtctcacacacaaacgtggccacacccccacacgccagtacgccacccacgccacttcactgcccttttggcccgaggccgagggcgtggatcgacgcctacgtgccgtctgccgccgccaccgccgtctgggaggatacggcacagtgcatactggattattaccgggcactttggttgagtggtgcaacttaaagcaggtccaatagcagattataaaa

SEQ ID NO: 95714 - DNA, 517 bp, Oryza sativa
ctgcttgagggccgggagaccgagcgccgcgcgcagggtgttgatcttgccgccccacaccggcccgtcgccgagcggcacatcggaagagtcacgcggcaggctgacgagatcgatacggctgccatcagcgtggatgttggccacgatcagcatgtcggtgttcatcccggactcgccgagggcgacccgattcgcgaggaaatcgcgccccacgaacaggatggtgacattgaggtcgtccaccgtgaccgtcggcgtcgggctcggcgtggcggtgggaccgggcgacggggtcggccggcgcgtcggcctgggtgttggccgcggcgtcggtcgcggtgacggcgaggccgtggcgacagccaccggcgtcggctcagggtcaccgagcagcgcctgcgccccgagccagcccccgccggccacgagtgccacaaggagcgccgccgctccgctgagctgcggccatgatcggtccgcgacgaaggagcggatgcgttcggagatccccacg

SEQ ID NO: 95715 - DNA, 600 bp, Oryza sativa
tcaagtatacgcatactccgtctgtagtagtagtaaaaaaacacgagactaaaaaacactagtaataccatgaaaagtagagattggagagctttggaagctaatagttgtacaaaggagtggttcacgatgtcggcatgcgattttgcgtacgcagacagacaggcgcacgccctcgtcgacgcccaacctccccaagtttccgggggtttccacgtgagccgtccctccatcactggccgttgctacgcgcacatatcgtggaaaaaaaaaactgccaaagccacacaccctggcccggtacgctgcacagcacgactgcacccaacaaaatatcaggaggattactactgctgctcgtttccctgtctacagtacaacctcgtgcgcttcatcaattaattaactcgttaattttcactatctgaagggaaaaaaaaagcggttacctacaacgttgtgtgattggtgcgtttaccggttgcaagttgcctcgccgcacgggctcccgtcacgactcggacctggcccgatacaccgcacgccaggacagaggaggcgacgcgacctggtccgcacataccggctgcgcgcgcgcgc

SEQ ID NO: 95716 - DNA, 503 bp, Oryza sativa
caaattaatatccgtgcaattatgtgttgatacaatcatggtgggcagacgaagaaaaactcgttgtgatggctactagcacgtacgatagcttcactccatcgatttcagccaacgggaaagttgatcgatagcagaaaaaaaaattaagtcacaaaattgttactatatactagtatgagattatacagtttcatcctataacttttgtttcgctcgggttctaaacttaaggcctcactgcagctgaaaacatcgtaaaagtcgaagaagtgcgatgagatgcagcagatccattcatcggttcatcagtcatcatcatgtcacgaactctcgacgaaggccactgcgatagagctccacgccggcgttgtcctccctctttgtttttctcttagaaaaatgtttgacggttgacgccggcaaacttttctccattgatgcgtacatgctgattttgtaactgctgctatattccgaaatataattattttagttaaaca

SEQ ID NO: 95717 - DNA, 629 bp, Oryza sativa
ccctccgtatcattaaaaaaacgaatctagaattcgatgtgacacattttagtacaattaatctggagaggatagagaatatctatatccatatttattgtactagaatatatcatatctaatcattgtttttttatgaaatggagggagtaagtagcgcgatctaccacgtagcgtgtatcatacacatacaagtacatagcatgcacgtacgtaggcaaacatatatatagctcatttggacatttaaagcatatgaatgataaaacacaaaaacaaaaaaaaaactagtattttcaatttgataatatctatattgcaaaacatatggaaaaaatacacgaatgaccaattggatacaccataaaaaacacaaaaagaaagtgaggataaatagagactcaaagtaatttgccgttggtttctgtttgtctaaatgtgtgttaggaaacatatttgttggggtgtgggtgagcgtgatactatgtttatagtagtgtgtgtgcatctgtcgtataattgtgggaagaaaatcctaagaatttcatagcggcctataaggtccgtaactatgtttcaaatgatcaaagaggaacattttccatcgtattaaaaacctataaagttat

SEQ ID NO: 95718 - DNA, 638 bp, Oryza sativa
taaacgtgactacacagtagtagtagctgttttgtctaaaccagctatcactccatctaagagaagatactatccacttatatactttaaatgcaattttctcttaaactactcatccgatctataatccgattgcaccgttgtgttcgtaacaattaaatctttataacaagatcttacatgattatattttgatgaaaaattataaattactttagatttcactaaattacttcttagacatataaaagtaaattcaataaagtctaaaagtaatttacatatattatagaagtaacttataataaaaagatagtaactttaatgaatgcctctttttattggacgtgaagtcatatttttatccctacaacgaatttacttatagtgtcatgacaaacttacttccgttttgttttaagttacttttataatatatgtacattacttttagactttattgaatttacttttatactccctccgtttttaatagatgatgtcgttgactttttctcacatgtttgaccattcgtcttatttaaaaaatttacataattataatttattttgttatgaggtgttttatcactcatagtactttaagtgtgagttatatcttatacatttgcataaaa

SEQ ID NO: 95719 - DNA, 556 bp, Oryza sativa
atctagcagctatcttcttagctataaatttccttcctgatcttgtgcaaatattcaaaccacaacctagagctcatctccggttttagtcaccaaacaattgaatacaaattaattagtagtaaattaaaaatggccggctagctctttcaaagagtaattaacttgcttgttggtctaaacttccaaggagagatatagaatgaattctctctgcactagacaggactcgccatgcgtcacctacagcttgtctttttattaaaagacctatacctacgtgtacttgggccaccaattaactaaacccacaagcaacacaagatcccaagatgatgcaagcctagattaccagtagttccatctcatgcaattcgtagccaattagccagtaaatcttcgagaaaagatgatgccatctctcaattagcttgtttaattatgattggtttatttgatttcgtcaagactgctaactaaattaagccaattaaagagatgtagagggggtcaatatatgtgcagttttgtcagctatagatttgtcgagtagact

SEQ ID NO: 95720 - DNA, 624 bp, Oryza sativa
agcctgggttctgccattgtgtattttcgccttttcagtttagattcaatacatttcattatgtgctatggagagtttgcttggtctgaagttccgatgttatgaattaacagtcaaaggcttgccttcgctttcttttaatgcaaatctgctttgatatctgtaatcaagaaatacattttagtaaaaaacctttcttgtgcaaaggcttcaaatgttactatcttatactgaatgcaaaatagagtagacatgttccaacttgcaaccacctgcagaacaaaatctgtcaacttccaatagcatgatattcataaatatacaacaatgatttttccaaagtaatattatctcactttcatatctacaacagagtcttgtaaatccgcttatgatataatatgactctctcctcaactactaatatgcacatctgtctgaattacttgatgatttgctgatgcaatatttcctttgtgaaattctgcgaatatatcgatctcataaatatactgggttacttcctttgcaactacaatgaaaacattggtaatttgtgtgacaggtgacactgaccttcaacttggccgcaaatttggagtcactattcacttggagcacaaa

SEQ ID NO: 95721 - DNA, 613 bp, Oryza sativa
tttctaacatcacaaggattgtcatttgtcatagcctcataggtactcctacaatccaacatcacaaggactgtcggatgagcaatctgagattttctacagttctgaagaacgtactatgaatttctacagaacgatctgagattaacatcagcagggtatgcaaaaaatggtatgtactcatattaaccagtttgaacaagtccgctgtaacacatgttaagcgtcaatattgttcctccaatgcaaggtaatcaatttagcacgtagagataaattacacagccgtacgagagcaaacagcttcgtttgggtggaaactagaacgcctaaaaaggtagaaaccagaaaggcatcccaagttcccaacaacttatacagtaaagttggggctaaaagatcaaatcagttcttgattaaattaaatgtgattttacataagacatactgaacaagtcattgtcactactgctttaaagtccacgcctattcagaagggataatcctgataacatagtaaagacgatcaatgagtagaaagcttgtacacttactagtcatttctgactagttaggagttggtcatttagtctatttcatatataaaaagagc

SEQ ID NO: 95722 - DNA, 540 bp, Oryza sativa
acacatatcagatcccacaggaaaatgggaaggactctgcccgagacgcgtcaaaacattttaaattaataatgcttttaacgaaacggccggagccccggaacgtaggttgcgattatagctttgttcagagtattcttgtataagaattaatccaaatcagcgaattagtactaattgacttcatcattggttcttatccctgattatatgttctgtacatatcttatgctagctatatgtggtgatgcacatttatttgcatgcatgcatgcatggccggtatgaaacggctagggttgaaaaggttattatatatatatgtacatttagattaatttaatttcgtccaaatcagtggatcaaaggggttaatttggaattatactcctagctatagctagctaatagtataatctaccgataaagtaactgcctgtacaaaccttttttcctgcgtactgttagctagctgctcgatcggacaaattaatattttgacccataatgaagtgcgtacttacgtatgaattactatat

SEQ ID NO: 95723 - DNA, 912 bp, Oryza sativa
ttacatttgatgcagacactgtatatttgtgcggatttaaccgaacatttctcggacggcgtcgaaagcggtgtgcactgcaagattatttggcatgcacacatatgataaatgaaaaactactgtactactccgtttccagctggataagaaaaaagaagacttgaaggaagaaacatctctccaaacatttttttaagaaattatgagcatgttggaatttagcacgagagcttacggttgaaaccacacacattaccactgcactatcaagtgtatctcatccaactagctagatgattatacatagtagtatatggtcttccataacaagttaggtaaaaaatactaggccgacatcaaaatttgtctgcatagatgaaggaaacaacctccaattctaagtgtgccagggaataatactccctatatatagatgtattgcattgtgcttcgaaattaaaaaaacatattaattgttgaataaaaaacctatgcgagtaaaaacataagtgtgtttaaacgtgatcgtcaactccctagacgacaccatctcactagttcttcggtgttgtgccaacgatattgatctgtggtcccaccggtgtagtagtgtcatatgcaagcaacaactccacatttgtgcgctaaacctctcgctgtaattagcttctaaaatgccctctctctctctctctctctctctctctctctctctctctcctgtcccatgtaatctcctcttgttaatgtttttaccatatcaataaatgttcaggccggtgacaacacccgccgtagtttttatcaaaaaaaaatatgcaacggaggagacgtacatactacaacatattgtggtgtgccacatcagtttgagagaaaagaagagaacacgcaaattatatatacaaa

SEQ ID NO: 95724 - DNA, 1229 bp, Oryza sativa
cgcacgagggggaaaatgacctagctaattaaccggccggggtggatgctcgattagtggactagagatagacgctcgtttcatagtcctatatatggcgacatgtcgtgtatcacacatagcagctaggcggtcagttgcataattagctagtgttaattaagttgccatgtgcttaaatgtctgatattatatgtgtgtacatataaaatcaatcgagagaagcatacacatgcgatttttagatggtggaaaagaaatatttaattctatacgtaaaagaatgactgcaccaaagtactttgcatgacagaaccactaaaggtatgtacaattctcttagtgttgctaattaggaatatttgtcgatacgaaagagagagagaaagaggagagacaaaaacatcattgctttggtaacaacggctcaacaatgattcttagcctctataatatgaaacatggttgcatgagagtgaagaaatgaaaagaataattatttaaatacttttttagttaatgcaatggttagagtatttgttgtctcaactgttgtaaacatatactacctccatcctaaaatataacaacttttagttatgaatctggacacatagttgtccagattcatagctagaaatgcttatattttaggacggagtgagcaggatctaaataatattatattgccaaagagattatacttatctctaccattgaacgtgccctaataatatcattttcgcatatattgaatctggtgtattgacatattttagtatgttaaagattatacacatatgatctacaatggcgtctactttagaacatgggatacatagtatatatatagcaaaagtaaaaggtactttattattcacttttatatttttgttatattaagtattgctaagagcaagtttaatagtatagtagctctaaaaattgacatatcatctacagctaattatttaatagactacacatacaatagttttatataaatatatactaaaccattaatacttgagccaccttttgtacacacatcatcctgaagttcgtgctatatcctgaagttcgtgctatagttggctataaatctgtaacatgttttttctctctcctccatatgtgctaatagctactagcttatatatagccttctattgtacttgctctaatacgcttatggattgtttgactcctaatacgattccccctccccc

SEQ ID NO: 95725 - DNA, 666 bp, Oryza sativa
aatggagatccaaacatggtcatggaatcctatttatttttgaacttttagcagtttaaatacttgaagttagtatagcatattacaaaagtatattagttccacatcaaatatttagaagttttcatggtcaaaatgtgaataacgcttgtggcaacttaaccctgaaaaatatttgaaaaatactttcttcgttctaacaagaattaacttattatggctatatgcaaattcatagccataagttattactcttatcatctactatattattaggataaccttaaaattatgcaccacattcgctatagagcctaaaaatttccacattaatcattaaaaaaagagtccaggtagaaatataatttaaaaataactgaaattcagaattgaaaataagcaataatatttgaagaagagcccagatagaacacaatacaagattaaataaaattgagaatacaaaaataaataaattctaaattagaaaaggaaatagagagttcaagacttcgagtagtaatataattttgaaattaaataataaggaatattgaaatgaccatccattagaacacaacacgagtttaactaaattcaaaataaaaataaaataaattctgaaattagaaaaagagagtttaagtatgaataaaatttataaat

SEQ ID NO: 95726 - DNA, 512 bp, Oryza sativa
aggcccccctttgccggttcgcccgggggcgctgagtgaggttcttcgccctcgatctgaggaaagtcagcgggagaggaagtgcacaagacacgggcgacgtagacaggttcgggccgctgagaagcgtaacaccctactcctgtgttctggtggatctgtgcttgaaggaatacagagaaccggagagcgagagtgagttcaggctctcgcccctcttccccagagtcccaaccccctttctcctaggcttgggcctcctttttatctggtcaggggtcaccacatgggcctctagttgcctaagaagggaaacatgctttttacaatgagggctagtctacagccggaaatgacctctgacaagcagagcacacgcctcctgccccgctcgcccgctttcccggtggacgcccatttcaaccttcatttaatggccagcgacttccttgccatatttgcgctgaagcctggaatggatctgaccgggactgacataccaactccaggag

SEQ ID NO: 95727 - DNA, 573 bp, Oryza sativa
aataagtcctttgtatttatactagtacacagaaatagatactaccttcgtctaaaaatgttactgcctaatataaaatgagacatattaggtatgaatttggataagggttatccaaatctgtagtactatctctatattttaatgtatgacgcaattgattttttatctaacgtttgaccatttgtcttattcaaaaaatttatgtaattatcatttatttttattgtgacttgattcatcatcaaatgttctttaagcatgacataaacattttcatatttgcacagaaaatttgaataaaacgaatggtcaaacgttggtaaaaagtcaatggcgtcatacattaaaatacggatggagtactatacttggtgtactaacattttggtacaaagatagtatttttttttatggatgtaactgaagagaacacatgacatgtagcctaaaaatatacaacaccacaaggatgtttctgtaaaaagtaacacaacagagaagaaatgggtaaaaatggaaaaacgaaagtcgtccccaccaagctagcgtggccatcaaccaacccctttt

SEQ ID NO: 95728 - DNA, 532 bp, Oryza sativa
agggcgaattcgagctcggtacccagagatacctctagtgttgcattgcattggcgcccccctggccctgcatactcctgccatttcatgcagcattagctacacagatatatacactgctactgccactgcatgcacctctctcgctggctgcctcttgctgcagctagctgcatgccattgccatgcccttttaatttctttctttctctctttctcatcgatccatcgatcacctgtatgaatgccgtgcataatgcatcgatctgatgatgtgtgggggtgtcactggcatctgcatctgcattgccaaagtttttatatatatattcagagaactgatagatcgatctcctgggccccgtatacgcgcgtctccctcaccatgatccaagtatccaaccctctcgatctatcgctttatgcatcgtgtgtgtatatgtatgtatgatcgatcttgatcggaccacaaactaaactatagcatgcatagcagctgatagctgcagtcatctgcagcagggcaacgatg

SEQ ID NO: 95729 - DNA, 846 bp, Oryza sativa
cctttcattgaatagtgcttaggcacgtagctttcaggcgacagtttatttttatttttattttttgaaaactttcaggtgacagtttagggaatgaattaaacttcatatggttcaaaaatcaaaatgcagcaacaggacctaagaatccaaacatgcgagtgatgttgaattctgtacttgtaagaaactaagaatgatgcttcaacaggttgtcacacgcatacctcatgggtcagcatttgcatatgcttgctcttttttttttttaaaaaaaaactgggtgttttcatcattatgcgaatgggtgtcaaacccatgacttcacgcctgtgcacccctggagtccatctggaactcatcgaaggccctacctttccaaatgatattgtatgatacacgtggaagtgtttgctagcatcttccgtatacaaaaaaaaagcagcagttattaggagtatatggatggtaaatttggggagtaataaatttgaactgcgtgtccgagaaaatctagtgggatgataatttatagattaatgaatcatatatgtagtatgtagttcagtaatgactgtacaatggaaaattgatgagatcataattcacattccatatcttgtggcatatgattaagcaatccttcagagattttttggattaatgatcattaatattggaaaaacactttttttatgtataaattatgttttagaaagtttgtgtcaacatgaaagcttgtcgtgcagttttaaactcctgcatttcatgtctgttataactttttttttgtggtattcaaaatattgacttttgtcattattgttcctgttaatcaaggccttt

SEQ ID NO: 95730 - DNA, 523 bp, Oryza sativa
gaccgagtacacagagacggtccacgggtcgacggaagcggatcccgtgtgtcaaccgaggcgagtggccgacaaacggactccactagacaccacacgggttgcacacgaggaaacaacgcggttaccaagcgggcacactaacacggacactacacggacaagcgaacgactaccgataccgatacacgggtaccggggccgacaaccgcacaacgagcacgggcgacaccgaaaggacgaggacggggcagcgagggagagggacccttaccactacgcaacgaggcgagggaacgacaatgacgaacgggcgcggcggaggcggtcgggaacgacggagacgaacggcgaggggacggcttcggcggcgatccttggacgaaggcgagacgcggccggcacaaggcttgacgacgcggagccgaggacgaagacgacgacggggctgcagcggcacacttgacgaacgcggacgacggacgaaaacggcttgacggagggacgaacgccacgacgaccg

SEQ ID NO: 95731 - DNA, 545 bp, Oryza sativa
tttgcgtacggaaaaggtatgaacaatatgttttcttttaaggctataaaaaacagagtagaatatagatcccagtgtaatactgccaatatgaaatggcttgtatagtcaatcgctattagcggctaagtgggggtctatatatgattccaccaggcgacagaataacatttattgctcttccaagaaactgattaataaaatacaaaattggaagaagcgcaagtgctaagaaatccaacgtcattcaacggattaaagccgcaggagcaacttcctcgagcacctaaatcaacttacaattcatagttggatcaagcaaatcaacaagcacaaacaaattaataacggatggtaagcaatcaacaacttcaaagctcaaatcaccgacaaccagagtagttcgaaataataaccctttagcttaacttgtagatttgtagctgtatttctctagcttgatttcaacaagggcccacttgcacagttgcatgctctaaacagtagggattatctgttcaatttacttcatatacgtacacaaa

SEQ ID NO: 95732 - DNA, 592 bp, Oryza sativa
tgaatgattaagatttaagaggaggagagggcccaaatgaaatgccatgttaggtcaacaccgtaggttggcaatcgtccatgatctctggtggagctttgtctcacgattgcacagacgcaagtgctctagtccttgctcgagcacactaataatcctatcttaattctgaggtacagatcagattagcattacaaaacaatccacaattgatttagttcatataattggctgatgcaaaagaaaaaaaaacattcagacaacgaaaagaaggtaggttcatgtcaagattaagttacaatttaactgtaaacaatctccatgttgcagaattggaaacagaacaagtggagcagcgttatggttttctgcttttgtgctctgaatatgcttcgtatagtggttccgtgaaattcagaactactgttattcgccacttacgcactcaaattatcttgcaacttgtttacggccggataccgcgggcagtaactgaagatatgatacattaagtgatccaattggttaacgcaggcctgaatcgattataatgtttgattagatataaaacaccggctatgatggctaagct

SEQ ID NO: 95733 - DNA, 1302 bp, Oryza sativa
cagacatacgtgtcaacgacatgcagctgatgagcttagcaaattaaagatgacgtatgcatctgtacaagcatgcatgcaacacgtcaccttttttatcagctggaaatcgactaaaaatattaagagcactaattagtccaagcatattgctaatatattgatcttgcaagataagcatagttaagtgaaatgagttaggagatggctactccgttaatgggcaatggtctcggctctcaaacagaagcaagaaaatttctttttatggtaatgtccggcgaatccctgcatagagattctggtgggccccacacacctacgcacactccgaactcggttcgtctcggccacataagctataaaaaaaccggcctccacgtttcgggctctgattggacgaatcatccacccagtgagagctcgacacgtgtcctgcactctgtgccgtccgattggccgcctcagcgacagcagccacgaccatgaaacgttggcaaacgcagggaaagccacacatggcagccaataggatcaggctgtgctgctttactccaagggttttttttgttttgtttagtgcatgtgacaggggtttaattggtactattattttgttaattttgtaggcatcccctaaactaattaagattagctagtcaacatgtgcacagtaaagacactcagggaatggatgatgatagatcatcctaagatccgtatcacttatattaatcacaggttgcccacttttgggctttattttaactgatcatccaccagctgtcatgcgtggtcttattggtcccctcttccttcttccatcccttttatcccgcccctgaagaccgtattataagacaaaactgtcggtgatatattgcactctacgcatatattaattatcggtagttccgtgcgcacaagcttttcctaccatatatgctaggttcaccggttagagagtgctccaaaactagagtccatagattaaacaccattaatttgtgtgcctagcgtaataattaatttgttgcgacgacggactcttaccaaaaactcgcatcgcattcagatcgatacgagtggattatgctagtttaaactatacagggttaaccctattcgaagctaataaaatatgcaggttaattgtataatgccctacacaggtcattatgcagtcacttcacttagcaaagcatcatcatatataaactaatcgccatcagctgctataattgtgcgggatgcatgtacaaagcttttgataggatgtctccagacaagcaactagcttag

SEQ ID NO: 95734 - DNA, 1244 bp, Oryza sativa
tgcatgagttcgcgcgcgtggtcgacgacgacgacgacgatccggccacactactgcgcgagagcgagctagctactgtttactatggtaaaaaagaattaattacctactagctgcctacgtccgtagttgatccgtactaagatccctctccctggctaggtaattagcactagtagtacttaagtaaattaagtatttttagcttctgggacttggagagctgcatgtaagctgcctgtaactcctgttcttattgatatgcatgatttcagagagatcaatgaccatggacgccatgtaaatttttgtccccaccctatagcttgttccttgcaattttcagacgaaattaccaccgattctttggttgatctgtatctaattaaattggagtgtccgtgttttgttttctaattaaggaattataaggagacaagacaattaagcaagcaatctaattgggcgtgcatatatacacattagcaatgtaattaacccttttgtgtttgagtgctccctgagtcagttttcctctttcttttctgatgccaccaccttagactttgccccttgatatgttttactccattaattaatcatcattttttcaacatgcatggcttgtgtacaacaaattaagaagactaatcaagcactaagatctttttctagagttaaccccggcccccaaaatctgttacttttgcacgtaatcagttactgaaagctacccataacctaaattaatattacaacttacagtgagcagccagctagctagtgcaactctagaatttatatatttttgcagcgtactacacatgggtgaattagctctactaggttaacaattatcatagcaagttgagataattagatgcatgcatatgggtcattgcaattggaaggattatgcgtgcagcaccaagctagctagagataaatgttgaagagcgcaccagaggtgatgtaacaatcttgttccgtgtgcaacaacctagctaccatcaaaaaaataatatttttttatataaaaaatgtccatcacttgtgcatgcccaagttgtgtttcagcgatagattcatcatactgcactgttcatgaatactattcagttcagtcatacgtgtcaacgacatgcagctgatgagcttagcaaattaaagatgacgtatgcatctgtacaagcatgcatgcaacacgtcaccttttttatcagctggaaagtggctaaaaatat

SEQ ID NO: 95735 - DNA, 598 bp, Oryza sativa
taaatggttgcttgattaaatttatggttatgcattgcattgtctggcattggaagtgtgtgaaagctaaaggaaataagcatgcaccccttcaaaaataagatgcaatagctgttgggttcttcattcatattcggtgaagagatgcaaatcaaattttaaaaaaatcatcgatgttgagttactattatacattggtccaaaatacccgtgttttagtaacaatttgtaagctgctacttcctccttttaacatttctagatcatcacttaaaatatcttgtgaaagaaccatctagaggtgaatgtctcatgaagtggaaattctatcttatgatgatccaaatgtgttcgtttcttgctggcttaaaaacaaagtgtaacattaacttaatcagttctttttactagtacatcaaagtgaaaatggaaagaactagtccaagtgcagtactacctatgttccagaaaagctagagataacttgtggtgtgatattaccaataaggcaataaccaccaggtgatttgtctaatacatcacaaagatacgatatttgtcaaaagcttagttttgaccctgggttaaaagaccaaaa

SEQ ID NO: 95736 - DNA, 848 bp, Oryza sativa
tttgttgctcaatgagagcagtacaatggcagactattagccagttataaacatattttaatgagataaaagatgagagagaaaagcagcgggctataaatctgtagccagctgcaatacggactctaagacgcaatatgtgtatgacaggtgggatcatatactaatagtatagtaagtaattattgtatgaattggctatagattaattggagttagtagtaggctatactattaaacttgctctcaaaactgcaattgacattccatatgaccgcacatacacgtacaaaaagagaataaaaatatacatcagctagaagaacaaaataatttataaatctaaagtattcttgatggtatagcagtgaagttgtggctacatgaccctatccagcaaagttcaaatcggcgtacaattacacaagtgtattttcaatataaacgaatttagtgaggctagtaatttgccgctggttctcttttcttcctcttaggcatatgttagaggcacacttgttggtgcctactcctttcattccctaaaaaaccaatctagaattggatgtgacacatcttaatactataaatctggatatacatatattcagattcgtcgtactacattcggtcttagattcgttttatatgggaaagagggggtacatgtgtagtgtagtgatgtgtatatgcccgtgcatttttcgaaaaaataatgcataaatccaaccatttgttgagtggaagagtcgctgcttcttccatgttctaaccgacgccgtcgtcacacgcagcacatgtccactgatacgtacgcttcatcgatcgcccacggctaagcagccacc

SEQ ID NO: 95737 - DNA, 544 bp, Oryza sativa
actatagggcgaattcgagctcggtacccattgcgacctattgctcccagacttgcgagatatttcaccacttctagaatggaacaatgaagagaaaacctccaaatttttcattctttcaggcagcgtgttctattagcacgaataaacaagaaattgacccaattgatggccctaacaaagtcaacagctggattataccactaagattcgttctagttctggaccacataaacgagagagagagagaagtccaagccgcagaaccattacagtgtgcgtacacatctggccaagaaattcttgtgaaaacaaccaagcagcataggagccaccaaagcctgaaacgtcacattcgaacaggaaaaaaacacatccatgttcttgacaacccaaatgctaacctccatgaaacccaaatagatcccctgtaaactgtaaaaaaaaatccgctaaaaaatctgcaatttaacactgactgacgtgtacccagcgagtagaataaactgcatgctccaatccaacccagtcaagaagaactcct

SEQ ID NO: 95738 - DNA, 687 bp, Oryza sativa
gttaccaaaattcatgaaaaattaaaataaattaaaaatttcagctgaaataatatcgtattggaggggtccgaaatgacccgaatttccgaaattttgatcattccgaaatttccaaaataatttaggaaatttcagtccgaaatgtgaaaccctgcctccagcttctcgccgcttgcagccgccctccatcgccaacgggggagagggacgacgcaccacggggccgagccatcctcttcaacacttcaaaccatgaccgggtagaacagccgcagaaactcacaccatggcttaagctctgataaagagagcagatctgaagaaggaattggaggagagtgaaagggatttggacatgatggtcagtgtaagtggtgcacattttctcatgatctttttctcttgatttactctatagttctggcttatggatgatatttataccttatttcatctaccgatcagtcttgcatcatagtaaattatatagcgagtgaattgacagcctgctaatttgttccatgctgcaccctgcattttttttctcagctcatccattgtctgattgtttacatggaaggcttactctgttttggttgaaaaagcttagttgggagaatctgtcttttctttgtatgatataaaagtaacatactctttggacgtgctttttctgcatttttt

SEQ ID NO: 95739 - DNA, 657 bp, Oryza sativa
cacttgatttgggagaaataaaaaagaaaaaaaaaagaaaaaggggatcatctcactgccgcaaccctctctttaatcccggttggtgttactaaccaggactaaagatctatttttagtcccgggtatttgaaccgggactaaagatagcgatctttagtcccggattactacagagggttgcgaaccgtgactaaaaagcatttctccaccagtggcatcaccctttgcactcctaactgtgctcttcgtcttatcctactccgggcattccactgccactaccgcattcgctactgaggaggccaaggatgtcggatctgccgatcccagccttaccactgatggattcggctggctgtagtaagggcgcatgcggttcatagctcggatggcaacacgctcattgcagctcagaagctgacgacactcatctccaagtcgccttcccttcgtccaatcctggcttcgccccattgtcgttgccccggtgtcgcttctgtctcctccttcgctctcctgtgttctcatcgtctggagatgaggggcaagagatttggtgggtgggcaatggcaagggaaagagcggcagcctccccccccccccccttcggacagaagatgacgacgaccatgctagaggaggtggatctggtg

SEQ ID NO: 95740 - DNA, 1162 bp, Oryza sativa
gggggggggggtgttgagaatgacatgtggggcccatgtgggccacatcattttaattattttttttaactgacatgtgggatcatagttgtattattttccaaatcaaattaccacgtcaatgccacatcagatgaagaccgagtatatttagccacgtcagctaaaaccgccgtccaaactgccatgggacttatattgcactgattttgacagttgagggacgaaaatcggactcgttcataagttaagggacctcagatgaactttttccattcagtcttggggagtctaggggattatcggagtatatgggcctgtgaggtcacgtgctctggtgggcttttttctttttcaaaatgggcctgcgtaaggtttattgatttcatttcggccttttactaatttatgcccaacccaaaactttgtatgggtttcttttagatataagttcagttcaggtcccttagtttgtctatgaattcgattttcatctttgaacccaaaaaatagatatgatgggcccctcaactattaaaaccggtgcaacattagtctgaaggcactatagatggttgttttgtcctatgtcgcacttggactatggtcagcctacatggagcgccacataagcggtcaactctggtcaaacgcactttagaccaactatggttcactaaaacaagatcatcgatcttaatacgtaattgataagtctacggacctatatgatacatatgctcaagtttaagtatcgaccatgtattttactcttaaaattatttccataatcatgcaccagttaggaaaagcttcaacaagcaagcaagccgaacgtatatgcgccgtattttggacaggggagtcaaatcaaccacatcaccatgcatatttctacatatacactggtcattttttttgggtacatcggaaatcattttcaccggatttagcccagacaaccagtatcccaatgagtgattaattacttgtattatactcattgttgccttgttggctctttgaggtcagaaagggacaattgaaaggcctcgattgaacaaacgttaggacatgatgcgcttctatataaattcaaggaacaaaaaagcaagctaattaaggttttgtgttctgcataattaatccattaagtatagtg

SEQ ID NO: 95741 - DNA, 654 bp, Oryza sativa
aaatgatttatgcaaacaatattttggagcaaaagttagatagtagtatatgtctgccgacgacctcaacccaaaatattgttttgaggaactcttggattacagaacaaaatactgattccaaaatgatttatgcaaacaatattttggagcaaaaattttgtttctccaagaattcagagaaacaatcatacttttttaacacaaccatcacattggagatttcaaaacagcagagatgataggatctactctttccatgtcttcatccaaacttaattaagcttataattgtccttttatcaatttgcgaagaaagaatgaatgttgataagcagtcaatgcaaatgtcaattatatgaataatatctaaagtttagcatgccaactaaagcttgtaatatgccagtatgtttaaatgagagattgaaaatgtaggggagtatagtcgatatagactttcagtaaggcaagaagaaatgcaatgtcattatgttccaggataaaagggtcaacagaaagacatcatcatgatctcaagcctttgcccgcttcattaggaaaatactcagcagagtgtagaatcttttgagcttaatgaccaaaaatctgcatgaccacatggtaacgtaagtaaattcttttctactttca

SEQ ID NO: 95742 - DNA, 1284 bp, Oryza sativa
acccaatggttcacggggtaatttgtaatttttcctaaaattattttttcctatagtacgttagtaccccggccacctggagttgtcgattatataatcaaagtaaagatctgcatgtcaatacatcagcaaattaaggatttgattaacacaatttgatctttatttattgcaggaaattaagtcgatcccgatggatgcgagcacattgcaacttgcaagagatgtagcacatcaatcaatatgtcatcatttttctttttgcatggtactagtaagatgcaataattaactaacaattgtattatttgcacaccaaatatgtgagttgatgatgcccaattaagctggccaagttaaaatttgcatgtcgaccgatcgtaccgattctcatgccgcaaatttgcaatcttttatgaatatatgtacgtgcaactgggatgcatccgttccaaagacgacccatcaaatatatataccatgaccgtccaagtacaagctccattgtatccaagcatatgtgtattttcacgtgcatatgtataccgcgtataggaagtctatacatacgtacttcctccgtttcatattataagattttctagcattgcccacattcatatatatatgttaatgaatttagatatatatgtgtgactagattcattaatatatatatgaatgtgagtagtgttataaagtcttttaacctgaaacgaaggtagtatatattaattaacccctgatgtagatgtactatatagcgttctccatctgatttcaagttcaagtcattttaaacttgtgcgatatatagttcaaatgacttcttgctcttcatacgtatactgcattattgggaaagaatagtcattttttttcacaaggatgaataatcaaaaggaaattaagatgaaaaatgcaaagaagtttaaaatgacttgcattttggggaagttgagaaagctaaaacaacttacatcttaaatcggagggagtacgaattttagtttctgttttcctcaatagcagtgctgacgtcttgtttgtataaagctgagttaagcctgcctacaatctcctctgccttgactgtgaagccttcctctacctaaaatatttatggagtttatatatgagaaagaatgattatatgaaaagaatgatttattctgagcaatttcatttcagagaactaagtacaaagttttctttttaaaaaaggggcattttttgaattatatatatgtatgattgtttttgttttagcacacgatttttcca

SEQ ID NO: 95743 - DNA, 721 bp, Oryza sativa
aaatggcttcatgtttccgaacttgccacatcaggaatcactaaaactaatatttgagttttaatttctcatatcatatactatatataataatatttatagcaataaaataatagttgtacgaaataaactaaatgcaaatgttgatctaatgatattgtttttaccaaatacagtttaatttatattatactccctccgttttataatataagtcattctagcatttctcacatttatattgatgctaatgaatctagacatatatatctatctagattcattaacatcattatgaatataagaaatactagaataacttacattatggaacggaggaagtattaggctaattgtcagttatatatttgaagacttaaatttcaaaatgtccgcccatcttatttagtggaaggagcaagtaaatgcataacttcccccattaaatttacatagatttaaattcttgtgcacatttattttcgctagaaattactccccccatcccaaaataagcgcaaccataagttttcgtgtccaattttaatcgtccatcttatttaaattttttttaaaaaaactaaaaatatgagtcacgcataaaatactattcatgttttataatctaataaaaatatcaattataaaaagattttaaataagacggatgattaaaattggatacgaaaacttatggttgtattttttttaatggagtacg

SEQ ID NO: 95744 - DNA, 510 bp, Oryza sativa
cctgcagcccaaaataaaaaagaaatgcaactaatattcataatatccagaatacccttaggaaaccctatccatccacccaaccttatccacatttctctctctttctccttcctccttcctgctcgctcgacttgtggcggcggtgctagggggcggcggcggcgactgagggggcggagggagggagcagcggcggcgacggctgaggggcgtggagggagggagcggcggcggttgaggtggcgccggtgcggcagctgaggggcgcggagggagagagggagggagggagcggcggcggctgaggcggcgccggcatgggatgagggaggcggcggctgcggcgctgagggggcggagggagggagcggcggtggcggctgaggggcgtggagggagaagatccatgccggctgaggggcggcggcggctgaggcggcaccggcgcgggatgagggaggcggtggtggaacctccggcgcacgcgcgcggaaggagggaggaggc

SEQ ID NO: 95745 - DNA, 903 bp, Oryza sativa
aagcagtatgtctcttcaagaaaaacggaaacagtatatgttgagttgttgacacttgacaatgttcttccgcaaggaattaacttacaaaaaagtaatatagctctacacatttcaataagatgttatatatggaagatgcagcaagtccgcacctatcttttggcttctttagaatgtgagtttttttctaaaaaaaaaatagtcctgagcaaaatgcactatttattgtgaaacttatgcaaaaatttcagtgaaattcatggcaaactgttgcattccacaaggagtccataatggctaaaatgtgctccaacatctcaaaaaacacaaattcatcttgccattgattgaattacacatccgtgtccgaaaaaaaaaaaggtcaccatgccacctctcctaattaattaagctcagctcagcgctatctccctctctctcatcttggataacgctatttctctcatttctaatagccatattgttgcaatggcgccttctcgaatcgatcttgctctaaatcttgaactttaacctcagaccgattgatttctaaatatcaccatgattacagatctatcgatatatatagctacttagctagtactaatactttatgttacagataagattatctgtacacctattaatgatgctagaggctagtgatgcatgaaccgtggtgcgaatctaacagctagatattccattgatctcttgagtgttgttaaccaaaacccaaaacaaatgccaaaaacaacatgactcacatgagatgcataatataccatatggtaccatataagagcatcatcagcagtgacgttatgcgtgacggatgtgaccgattaaagcattcactaatctgtttttggaaagacacacgagatagtgtacaga

SEQ ID NO: 95746 - DNA, 660 bp, Oryza sativa
agctaattatgcaactgaccgcctagctgctatgtgtgatacacgacatgtcgccatatataggactatgaaacgagcgtctatctctagtccactaatcgagcatccaccccggccggttaattagctaggtcattttccccctcgtgcgaactgaaagactaaacgttttgatgtttgtatatataatttgcgtgttctcttcttttctctcaaactgatgtggcacaccacaatatgttgtagtatgtacgtctcctccgttgcatatttttttttgataaaaactacggcgggtgttgtcaccggcctgaacatttattgatatggtaaaaacattaacaagaggagattacatgggacaggagagagagagagagagagagagagagagagagagagagagggcattttagaagctaattacagcgagaggtttagcgcacaaatgtggagttgttgcttgcatatgacactactacaccggtgggaccacagatcaatatcgttggcacaacaccgaagaactagtgagatggtgtcgtctagggagttgacgatcacgtttaaacacacttatgtttttactcgcataggttttttattcaacaattaatatgtttttttaatttcgaagcacaatgcaatacatctatatat

SEQ ID NO: 95747 - DNA, 860 bp, Oryza sativa
cccacacctttcaatgtgcatcctacaaacatccaatttggtattttggttgtccaaatttgaaataaaaacaattggtgttttcttgggagtaattttgtcaaatttgattgaatttgatctagccggtgaccagatttgaatcataacattcgggtaggatgtccattcatttgggattgttttgctaaatgacaattgttgtacagagacattgttatgactttcatttagcagatggccctttggcatttgatttatttgtatgcatattttatacatcctttatattgcaaaagactaagataaattcagtcttagttagatagtatattccttaataaaaggatagctgctagtgtatttctcgaaagaaggacagtggctagccctttcagcctttgtaatgctaaagcagataagtcttcacttatgttcctccattatgccgaagaagctgaagtaactagattttttgctaacagcattcttaataggacatattcatggttaaaaagttttacggacttggtactactagaagtactagattattatttcgtgcttatagcttaggtttcattagagtatggcactgcaagtaaaaaaagatgaactttggtcatctcgatctttgtaatttacgccttcaaccattcatcaagttattgtgtgaggtagcaaaatttatcgaattagtcctgatctattaccatacactgtttgagttttggttagtatctactcttcattgatactatcatttatctgtaattgtctcagcatctcaatatcattgtgaacatatttttgttactctctttcacacaaatcattccattgtttccttgtttccatta

SEQ ID NO: 95748 - DNA, 608 bp, Oryza sativa
aaatttatcggaataaaaaacccctcaaactgataaatccaattgaataaattatctatgtttaaaagagtaaggttgttgataaatcctaatgcaggacaaaaaaatattcttatgtaattttagatttgcataacaaatatttttttaaaaaaaataatagccaaacacaatagtattcactatttagtgcttaaaaaaagaatccagggtatttcagtcacaaaatttctggtaattctgagaaaatttttggaaattccaagaaaatttctggaaagtttctgaccgattacgagttctgacggaaactgcccttatcatttccgattccgtttccgagaaaatatttccgaattcgtttccgtttccgaaaaattccgaccgacagattccgttttcgaaaataggtccaggatccggaaagtttccgtactgttttcacccctaactctatgtgctatatatagcctgctatatattgtagttggcaattttattgaacttgctctcatttgtactaatttatataggataccacatgtacatatacatgctccctccatcccaaaatacaatacgtatactccggttttttcttttttgca

SEQ ID NO: 95749 - DNA, 553 bp, Oryza sativa
aatatgactccattggtgtgtagtactagctttaggtgatcaaattgcaatattcattttacgctctagctatgacgcatgaattccgtgttcaaccaagggaaagaaagctccttgttgacgcaacctcctctatatgccatatcaccaccggagatccatcacccatcaataaatagaccatgaaccctagctacgatagtgaaatcgctgaaatctaagttggcatcttcgttaccacggccaattgatgcttgaatcattcaacccaccaatctagcaaccgattgaaatctctcctatgattttgagttgaaattgaggtttttgtgtatgaacgcaaggtgcctgagtggaaagatgggatgatcaaaatatggcaagatgtagaaaaaaggtagggacgaaaagaatgacatattagtgtacaaccattatgtggtatagtgatatatataaataaactccatgaatatgatatgaaaatatgtttacaaccacctcaaaacaatatattccgtcatcatattgtatagttcatgtaaaaagctgg

SEQ ID NO: 95750 - DNA, 568 bp, Oryza sativa
ccccttcgcatcaaaataatgcttgtgctgttaacgtcagtctacaaccaaagactagacactagtggaacgacagaattgagtccagctgagtctaccgagcaactagtatactgcaatactatgagtaaagacaatcgtgttgtttagtgcgggtcaagccatcacaagacaccgagattctaatataatcgatcacgaattgaacaaaaaagggaagaggtaaaaaagctgcacgagtaaagtaaagctggaaaagaagaagcatgatcagagcagtagctgctttttccatcttttgtttcctttctccctgaagattactaaactggtagtattactgtagtacgagtgagtatatatgcagaaaatctaagagaattgatctcaaagggaaatcaatcaagagaaaaaaaaccatctagtattaaacaggaaaggggagagaggattgaggatgggaggcgtgagtaggtgaccatgggaagccgcggggaagaacctggagaaagaggggggcttgcggtggaagcgctccggacggtgaagtcgtcgcccacccgcagct

SEQ ID NO: 95751 - DNA, 706 bp, Oryza sativa
ccaccctactccctcgtgcgggtcgccgcctcgttatattataaaccaataggtatatagttaatttaggctgtgttcttcccccaattttcccaactcatctctcttggttaccgcgcgcatgcttttcaaactgttaaacggtgtgttttttgaaaaaaaattctatacgaaggttgctttaaaaaatcatattaatctattttttcttttaaaaaatagccgatacttaattaatcatgcaataacacagctagttttatttttaaacttgtaatattcattcatttaaaataaaacgagtatcaaaagttctacgggaagcaaacataataggtttgtctatttgcacagaactttcgagcaaggacgaatagtcatacgtactaaaaaataactgcatcatattctaataacatttaaaaggcggtatagtacaacacatacttttcatttgctgatatatacatcagatgtacagctagtgtgagagttactccatccggttagaatgacatgacacgctgctacttctaatattatgcaattttataactgtgagcaggcaaccaacgagatcaagcgacacagattttatttgaaactagcaggtatagagttaatttacgctgtgttattccctagtttttccaactcatctctcccttttttcgggggtaccgagctcgaattcgccctatagtag

SEQ ID NO: 95752 - DNA, 501 bp, Oryza sativa
tcctcagtgctaagtgctataaggttgtctgtgattctttgttatgtgttgtgattctttatactacgtgtgtgtgtatatatgcacttgttttcctggtgatgctaaccgaataggacttggtataattcaaaccaagtcctattcggcccaaaaggatatggccagcggttctatttttttccttggaaacagacgggagtttgtttctttttttaaaatcgaaaagattcgtttttttcgcccttttttttaccgcgtcgacggaatcggatttaattttttttaccgtgtcacattttttttaccatgtcgcatataatcggattcgattttttccgctcttttttcatgaacggacgacggaaacacttctaatttcttagtagagattatccggctagctgcctaaatccgaaaaaaaaacaaaactagttaaagtagctatagttggatcatcaaaatccgaactcgatcgtgtcaatattggttaatcgacac

SEQ ID NO: 95753 - DNA, 556 bp, Oryza sativa
cacttttggctaagctggagcattattagccccaaaatataccattacagaagcatacagcgaaattaacgaattgaccgatccgtccggtcgcttgcttggtgtctgtagatatacagttttatttaaggagaccttgacctggccggccatggctctcatccctagtcaaggtcacctcgagcaagttcaataggagccaactactagctccaattcatctatagctaatctaatagctcattcatacaatagttatatactacactattaatatctggtcccatctgtcatgcatacattgtgtcttggattctgtgctacagctggctataaatctgtagcccgctgcccttctctctcctcatttatctctttaaaatatgtttgcagctagcttatagcctgctattatacctgctctcacgagccaacatttgctgcgacccaatggacctgggaacaaagaaatgtcagtgatgtcataccaaagcaattggcttgacgtcacatctttgaatgtaagcaggtgaggtcagtacgtatggcctccatt

SEQ ID NO: 95754 - DNA, 617 bp, Oryza sativa
aacaggttgtcacacgcatacctcatgggtcagcatttgcatatgcttgctctttttttttttaaaaaaaaactgggtgttttcatcattatgcgaatgggtgtcaaacccatgacttcacgcctgtgcacccctggagtccatctggaactcatcgaaggccctacctttccaaatgatattgtatgatacacgtggaagtgtttgctagcatcttccgtatacaaaaaaaaagcagcagttattaggagtatatggatggtaaatttggggagtaataaatttgaactgcgtgtccgagaaaatctagtgggatgataatttatagattaatgaatcatatatgtagtatgtagttcagtaatgactgtacaatggaaaattgatgagatcataattcacattccatatcttgtggcatatgattaagcaatccttcagagattttttggattaatgatcattaatattggaaaaacactttttttatgtataaattatgttttagaaaggtttgtgtcaacatgaaagcttgtcgtgcagttttaaactcctgcatttcatgtctgttataactttttttttgttgttattcaaaatattgacttttgtcatta

SEQ ID NO: 95755 - DNA, 680 bp, Oryza sativa
aaagttggaaaaatttatgtatagaaatatatatatataaaatatttgaattcaaattcaaatttgaatcggttatataaacttttgacttataaactttgggtctataaactttagatgtatagaaatactatatatagaaaatatttgaattcaaattcaaatttaaatcgggtatgtaaacttttgacttataaattttggatctataaactttaggtgtataaactttagatgtatagaaatactatatatagaaaatatttgaattcaaatttaaatttgaattggatataattcaaatttgaaacgggtatataaacttttgacttataaactttaggtctataaattttagatgtatagaaatactataaaaaatatttgaattcaaatttaaatttgaatcggatatataaacttttgatttataaattttggatctataaactttaggtgtataaactttaggtacataaatttactaaaatagaaaagtaatgcggtgccaaaaaagaaaacgtggagggagggagggggagaggtggtgatcgctaccgagagcgatctcggtagcgatccatcgcgcattagactttccgacatctagaatgcagtagcctttgtattagaatataatacctacggcccacccaaaccatgcatggaatgggtcatag

SEQ ID NO: 95756 - DNA, 687 bp, Oryza sativa
atgaaaaaattaataattgcttaaacttttaaataagatgaatggtcaaatatattttaaaaagtcaacggcgtcaaatatttagaaacggagggagcatatcaataagatcaatttgtttattttgaaacggaacgatgacgtattattagtgtgaagctgatcaaaagctggaggcaaagtcgtagcacgtacgtacttatcagtcagcagatcggagcaaatcctgccaattagagcagaggccactacaatcattcagcttggtttactaaactagatggtgaatctcgccatgaactaatttattcaaaatggataatcttgattgattggctggctgaaccaacgtttggcgacgcttgaatgaaatacgtactaaaaatatactggattctattctttttttagtaatagaagtgccaacttccggccaaacaatatggatttgattcgagagaaaatatattaatgacgaaatggtaggcggcactgagccgtacttattcagtctcatgcatagtaaaaaagccggaccggaggtcaacccgctctagtcgtcggttcaccggttcaccggtcgaaccaccggttttttatttattaatattatatttgatttgcattattttaaatatataatcatcacaaattagtgaaaatatgtataaataaactagtatatct

SEQ ID NO: 95757 - DNA, 636 bp, Oryza sativa
atggtaccaatatgcaaatccacttttttaaggatctagagctggagggtcgacctcttttggataagatagcatagggcatgccccgcccactcttaagactaggtacccgtagactagtttttactactcaaagaacttccctatgcaatggtgctttctagttcttatctgcacctacatttaggattaaccctattcttgataatggtcattccagagttgggtgggaatcgttgatagaaattttattttccctgaggtatgatagcgtctgaactaaagaaagggaatatggaaagtgaatgtggtaaaggataccaagagcactgaatgatttttaggcgtcttttctctaaaactctgatgaaatattgcataaaaacatattggcttagtagaaataataaacttattaataacaatctaattgaccggacctaaccgagatattataagattaaagataataagaaaaacttatttagctgatagatcaatttaaaacaacaatgtgattagaagaacatcaacttagtcagaatatcgaacctaaccgagaaagtcctagcttagctaatacgactcaaatcaacaatgtagttaaaggaatcaatatatcttataggcaatgct

SEQ ID NO: 95758 - DNA, 725 bp, Oryza sativa
cccgatatgcttgtgatgatgatagtgataatataagggttaattgtttgttttattttttttaagtgtcattgaactaattatcgataatcaacttctgttacaaactcctattaagctactgaaaatctgaaactaacatgacctgtagaaagaacaatccaactcatgtgacactttgctctccagacaactaatggaattagatagtttgcaattttcagttgttttcattgagaactgaacatctcagaggctctaagaactagtttgtgtcttgatctttgtactatggatatgcaactttttttaattagttacatgatgcaactttatctatggacagttttctgaatatttttcggtttttattctgaaccaagtgtgttttatcaaacatggttcatgcatcaagacaaggtgaagcaccacaaataaatactgttatgaaagcaacacaaagagtgattttgaaatattccaaatctgatagttaaacagaagaagttcattggtttcaaattagctcagaatcagggaggtaagtacttgaatctagagtttttcatctatttctgcacatacatagggcttcccaaatattcagcattgaatgaccccccttctcatctctcttcatcttcaacgatgcatgcatgcaattcctccctaaaggcaatggctccaacctctaccaccacgccagaaaggaaaaagaggacagt

SEQ ID NO: 95759 - DNA, 545 bp, Oryza sativa
ccctactgcaaggcaatgaatttgcaatcaaccggtggatgtagcttcagtagaacatgtcgcatagacgtactccaaaataaataaatctaaaacaaacataggatataacctaatacaacgaatctaaataaatcaaaataaacaaatctaaaatataatgttatataatcattacaataaatttgaacactcgttgtactaaattatctctcatctcatcctgggtttgtttatttcgggatataatgcatggagtatagttgctgactcccactgtccataaatataaatgaataaatggactctagtactatattttcaattcattcaatcattatatatatttagtatttactagtagccatgggcggatccaacgtgggtgcagggagactcaattcccctctacacccacaagacctatggatacccccgaaacacccctttcaattttttcaccatgaatgataaactaaaggtccctaaatggctagatattgaagaaactgtgtaaatgagccccctcaattttttttattcct

SEQ ID NO: 95760 - DNA, 675 bp, Oryza sativa
tgaatccgaacttccggaatcaaatcacacatctcctttcttggtttgcccattcttaccttctctcatattgtgcttgagcttgcttttacccaatctacttgtatgcttaattgatatagttcatgaccttatcttgcttaggtaccttgttttcacattttgattcatatacattttctttgtttgagctacaagttcataactattgttttattctgttatctgttgaacttttttgtttttccagaacttccaatcccacaccagaagttccgatttgaaccgaaagttcccatcattctaatatgctatgaagttgtgataatttttaggaacacctattcaccccctctagtccacatcaatttcttttgatagatgaaagtttatctagatcaagttgagtttaaggaggaatcgtgaagatcgcggcaatacaattttatattttcatagcatcattctaatatgctatgaagttgtgataatttttaggaacacctattcacccccctcaagtctacatcaaggtcttttcatagatgaaagtttattcagatcaagttgagctaaaggagaaatcgggaagaccgcggcaatacaattatatattttcttaagtatatctcttaaataggcatgatgagttattttccttttttttgttaggaa

SEQ ID NO: 95761 - DNA, 545 bp, Oryza sativa
cctgcagcccttctggtgttctgcatattgcttgcgattgtttccgctggatataaggactacgctaatatttaactttagaagttaattattttagtaaaactcacttagctgtcatctcctttgaacttccacttcaattcagattttagagccatggcctaccaaacaggccctacattttccagataggttccattgctcaatgtttttttggctcaaatttcttaatctcatcgttggcaggagcctttggcatgttctcagatttggtttgttatcaactgtgtattgtaggcaattttggtcatagcaacactgggtacaaacttgtactcaagcaagagttacaattgacaacatgagtacattgactagggcgtgcagtttttttagatggttagggcatgcagttgccactggtgcaacgtaatagttggagtctcctttgtaaatagaggatacgagattctgaatttttgtagcaaatagtcaatgattttttcacccttgtgtagatgagtggcattcgcatgttctgtatt

SEQ ID NO: 95762 - DNA, 999 bp, Oryza sativa
tttcccaagtgactaataatcctcgaaggttttcacaatataattatagatcataaaaagaggaatatttcatatgtccagaaatttagcttattgtataatataaatcacgattattgatttcaatgtcatataagagtattattttgtaagccgcgctactatcccagaactcaggaacaaatcattcaatattgagatgaaaagcttcccgtgcacactccgtgcacaccaactagcaaatgtcacaaaaaattatacaaaaaattgggtatttactcctattatattacacatatatacaaagtatcatattcaaattcattatattttagtcataacaaaaaagtgaaaaatctccatcaaaaaaaagtgaaaaatctgaaaatctgacagttttaagggtaaaaaatgtcagaattttgtctttttttattacggctaaaatataatgaatttgaagataaaatttcacatgtaggtgtagtgctattcgaagtaagtgtacaattttttgtataatttttcgtgacatttgctagttggtgtgcacggagtgtgcacgggaaactagtgtgcataggatatgttccctacttataaatatttgcagagtacataggcagtacaaaggcaagagtgaaacaaacccattagcagaaccatttcattttttttattagcaagaatcttccccattctgttcagtaagatagcaaacagggatgcaacattggcaggcacacacaattctttgtgattttgagtgccatcttttgaattgataagacgaatagtaccaagaaaagaaacaagtttgttctacatgtgctatttatcataatcataactattataatgcaagtacaggaaacaagacttgatacaaatttatcagaagaaaaaggtcctgaaatacctcccctgaatgagctagtaactccaagcttctggcattcgaaaggctgcaaagcaaatcctggccactgaaagaattgg

SEQ ID NO: 95763 - DNA, 865 bp, Oryza sativa
gtcacttttgctcccgatcatttttcatgctaagttagaaagacaagtaaaaaacgtacataaaattattctcaaaattcaaaaattttttgactacactggtacagaaaatattttataggcggtattagcttgtttacaaaggcattttttgaaccacttgcaactaaggccctgtagaaatctaggttttgtgcatgcacatttgcataaccacctgcaaaaatcaattttcacaggtggctctcttaaggaactgcttgtgaaaatggatttccaattttttgattttgtacctgtagaaaaacccataaaaagtattttagtaggcaacttaaagaaaatcgtgcgcgaaaatcaattttttagacttccccttattagaactgcctatattacctagctagccataatctgttactacatccgtaccaaaatatatcaacttttagctataaatctagagagatatatacaaatcagacgctcaattttctcaaaaaaaaactaagcagttaaatattgttaaaaaatatcagtgattgaaatatttaaaaattttgtgaaatacactaaaggtatatgttgaaatatggctatcacgtataaaacattgagttttaaagattttgaaacatatgtttttctttttttaaatatataatcatgtgatatcttgttggaaagatttaattacaatgaataaaacattgtaattggatcgtacatcggataaatattttataaaaatatttaaagtgataagagataaagaaagaagctagcttgccgcatccttaaccgtactattatgcagtagtggtagttgtccgattttttttttatcccgagaactcgagcctaa

SEQ ID NO: 95764 - DNA, 570 bp, Oryza sativa
acagtttctttttgtggttttcacaagcaccacctaatctaaagaaggtttgggttgattaatgcgataaatttatggagtaaatgccccttagtgggtaccaactatatatatgatgaataagtagcttctttatccaacggttgttatctttgtactaatatgatttgatggtttaaaattgttgatgatgtggtttcttgcatgtcttactttatagaagtaaatgtcttttagtgggtaccagctatataggaagataaattcaataactcgaatgcacaatattatttcgtggtttcatatgctacacatatcatttaattattgaatggtcttgtgaaagtatttggtcacggtggggtttcattccctttttgaggcatatgataaaaatgatttagtcacagttggatttcattctattttcaagacataggtaagtgtataaaccaatttttttctagatgtaacttatttcttatatatttattaatatgtcatcaatttaatgaaaatgaaacctttataaaacttataccgggaatggcctaagatcagtcaacaaaa

SEQ ID NO: 95765 - DNA, 523 bp, Oryza sativa
cgaatggagtaaattaataacatatctgcatccctgaacataataagaccaatactatatatatatatatatatatatatatatatatatatatatatatatatatagtaaatttgtttggtgctccatggtgcccgggcaccattgttgaaattgagtatatacccaattcaaatgagcatgaaacttttttaattatttaggtattaatattaactactttactaactagttgaaagcaagtttgaactgaatttgaacttgtttttgttatattttgattctaggtatatagcatccatacatataattagttaggtatgtaatcatggattgtgaaataaagttaaatttgagttgttttgttgataggtataggtatgaatcgaattcttataactaggtatatactcacaatttgaaaaatttgaaaaatttgagtgattttgtgcatttgaaaccatggtgcccggacaccatggtgccccatatgagtgtcctatatatatatatatatatatat

SEQ ID NO: 95766 - DNA, 505 bp, Oryza sativa
cctgcagcccctctctctaatattgtgatgctaaataatgccagcttccgtaaacatccttaataatgcatgtgggaactgaattttgcatgcaaccatgttatctgaggatcaccaattgatttaattagactgtaaattaacttatataaatcatgttcgatcggatcgaagaaggaaagaggaagaaagaagcggagtagtttcatggctacttgttatatgcgttcctcaaattaaaaacaaataataagccaacaaatcaggaaagatatatgcatggcattagggaacaagcgtgcattacggacgaagaaacacacatgtagttagctaaaattcagtcgatttactctacagatggaataaattacttatttaccatgcattttattttttttccaaacctaccattttatcagatgtactagaactaattgtggtgtgttatattaaattaaatggacggttcatatctctccaagggtgctttaaacatacccaa

SEQ ID NO: 95767 - DNA, 670 bp, Oryza sativa
tttgaaatgagcccataatgacaaggaagaccattctaagcatggctaagctttatagtaacctagtgtcaccaaaactcatatataaagtggtatagccatattgttcctaaggttaggaatgaggaatatggatatatgtggagttaaggtgataatgcaaataataggagtttatctaacaagtttaacaaaattttaatttattagtgtacaatcgacatgcaagatttgcaaacattttcaataacctccaaaagataggttcaaagtgatcaaagagagggagatgggacttgccttgaatcaggaaaatgtcagcacctaaatcacttcttcaccgattaagcaatcatctatacaaagtacacgttatgcaattaaacaccgaaatatgcgaaaaatccaaaatgttctaaaatgcgtgatttgtgcacagagaataggtactggtataaaatgaatttaggtgaaagaatttctattttatctcattttatttgggagttatgaattttagaagtttcgtcggtatagtgtaggatttacttagttactattgtgaaatgctgttgtaaggtgattcttattaagtttatgtttgctggggtgaatatatttgttttctaagactaacacatttggtttcataatttttagagttaatatg

SEQ ID NO: 95768 - DNA, 716 bp, Oryza sativa
caattacggtcctcatatttctaatgtcattttataaccttatgggaaaatttttaagaaactatggcggtagtggaagaaataaattgttgtttccattaacttcctttgtcatccttgctaatagagtagtcctgaatttattatcttagcatgtgatttaataccatactttttgatatttttctttatattcaacctacaaaaatacatcaaataaagattaaaaaatgtatagccgatgcattcaaatttcgtacaccaccatgaggattgataatatggaaatgatgtttgatgtactagctccgatgttaaactctaaccatttttttcatactatacccttagcaactatcaaattaatatcatatgatatatattcaaatacaaatctattaacaccactgttgtggttctaaacatttatgttattagcttaatcatcagtaagaaattacaaaaagttgacacagtcattgcacacctcggatgaaatattctaaaacatgcaaaattcattgaattgatcgaagcaaaaaaaaaaggttcgcataggtgtaagtacaagactattataccttttacaatttaaaagtcattctttgaaggcacaatttaggtgaacgaattattttgtttgaagctaatctctttaatatatcatcacaacacaaccttatctttagttaatagcttacatatttttgttcctt

SEQ ID NO: 95769 - DNA, 667 bp, Oryza sativa
cgattggcgaaacagtggcagttcatttcattcccacaatattaattaaaatataaataaagtcgttttggaatttttcctaggtgcctcttttgtgtatgatgtccgcctatgttgttctctcatcatgagattctggtgaacaaaaacatcgagatgcttatgcaataattctaataagtgatgatacacctatacaaaatggcattaactgcaagatggttgtatacaagtagacatcgttcagttgtagtgcttttcttttgagatgccattctatcttggttcttcggtatatgctctaataaacatcatgagcaagtgttgttatcgtaaagcttattatagatatgtcaaataagcatgtacaagtggaaaggcgattagaagatatggtagctcaaactagctaatagtaaatcttaacaaggaattatagtccacactatgatttatatatctttttctatggtaagcatcattttattgattatggttgttgaaactctaatgcagaaaaaaaatttgaggctacagggagtacaataatattgcacttcttgtcatgtaggtactacaatatgcatcaattagtgcagcaacatcttattaaaaaaaagaagtgcataaacacaagtgaactcaaagcataaactatttatggatt

SEQ ID NO: 95770 - DNA, 677 bp, Oryza sativa
tactggattccaaaaaactctgttcacctggcctcacaggtttggacgtgactctgccactgatgactggcatgatgaggttcaatttagttacattatgtatgcttagaggaagtggccattcagcattgctgcctcacaggggtagggaattgtggaaaatcaaaatgaccatatctgaaagtcaatttgtgaatatgaaatggctgtaaggctgttacagatttagtatataatctggcaacagattaatatattgattgattgttaaaagagaagcgatgctatagatcacttcttggataactatatacacaacaaataacctcccaagaaagcttaaacatttttctttaggagtgtctactagaataaatgcacttgtaccttcagatatggcaggtacattagagctgccatagtacatgttcctccataatggtgctaacttcatccaaattctgcagaaaagctgtgaaattcttgcgcttcgtgctcagattttctacagtagccagcttaaagccttaagctaggcctttatattggtatacatttttttctggtgggggatatacattgtttgttaaccatataattcacaccctatctaaaataagttgatttgcggggtttgtaaactagattatatgataagacctaaatatatttggtga

SEQ ID NO: 95771 - DNA, 1194 bp, Oryza sativa
cttatctatggtgtcgaatatatattataatttttgaatgagagtaggcaaaagaatagtatttgattctaagacaagcacactaactataggtaaggagactttgggtggaaagagagttcctgagtttgagtcttataaaccacatgcgcatatattgcgtgaacaatcaagtgagttatgggaaccaaagtgtaacctcaaatagatgcatagtaaaatatgattttcttttttttttggttttttacgcctgtaagaaaagggtacacccctatatttgatgactctaaactagaatcggcaccaatgatacccttattagtgtcagttgtacaatcgacacgaatgactacccttctcattaattccactattatggtgccggttccaaaactagcctatgatgggtttggaatcagcacaaataagggtgtttgtactagtttattggatattctgatctagtgttaggtattcgtctcactcactagaacagatctaacatttatgatgaaattctaatgatgaccagctaaaatgtcattggtgaatgatatttttatagaaaatgtcataaaggttagcctcgagcgaggaattgaaatgagcataaaaaggtcatgacggatattctgatacaactgtagcgcaaacaagccagccacaatctaaatcaacatattacgggcccgtttggtatagctccagctccatccccatctttcctggagctagaactcaaccaaataattgtgtcatcggctaagcccaagggattagggatggaaacggtttgggtcaggcacgagtagagcaaaaccatgcccgatcgacccattgcccgatgctgcccgctagggttagcgggcaaaacttcatgcccatagccatgccctatgggtacttgtcggtctcacatgcataatatctcgatagatatataatttaataaagagaaacaaaatcaataagttgccaaattattagttgtcaacaataatttgaattgcataacaagttattaccagctagcatcacaaatgagccaagagaaaggatatgagaattaacgagaattaactattaagatatggaccaaaatctactaatgggtcatttggttgggggagtttttaggaaagattgggagtttagagagatggggctattaattattttgtttggttggaa

SEQ ID NO: 95772 - DNA, 925 bp, Oryza sativa
cagcccaacctgctagcctaaataacacatttgtcaaaacattaacgaataatcaataggttactcaaccttcagaagctactccactgagcaagttacatgttccatcattaagctagctcttaagccttacccatgaggacctaccatcatcctcctatgttttgaacaaaattccacatttctttattgataaccagtgttcaataggtgcatttcaaaaaggtactgctcaaacccactacacacaagaagcatgttagtgtatctaagcccacactagcttcattccatgctaaggattacctcgtgcacgaaatccttccctctttctgtttttgaaacacttccagagcttgttatacacagttttcatggttcctagagcttgaatttagcattcatgttccatccaaactattcgtaaatccatttcatactatactactagattttcttcttctgcattaaaattcatactaacttcagcactaaatgtccaccagaagagttatgggaagaacacttgattaaagcagtaaacacaacaatgctttcctcctgctgacacactgcgcatgcacactcggaggccattattttgcaaagctagcttagcttagctgtctcccactccaagccaacatcaccaataccaatcctatccagtcgagccaaagccgcacacacgcgccccacaccgcccacacgtgtaaaaccagagaagggacaaaactcaccgtcgggccccacgtgcagcctggggaggccgaggggaaccgggaggcacgcctcggcggcgtcgcgagctccttcatgccgtcgtcgtcgtcgtcctcctcctcctcctcctcggccacggggtacctcctggcggcgcccgcccctccgacgccgaggccgacggagtagagcgaggagaggt

SEQ ID NO: 95773 - DNA, 1826 bp, Oryza sativa
ccgccgccggcgccgctgctgctcgccgccgtctccgcagctggcgccgccaccgtgcaggcgtcgtcgctgggctccatcggaggaggagctagcggcaggtataataaagcggaggaggaggagagcgagcagcggagagggatgggcaagagagagagagaggggaatggggtttggtttgcgttgggagaggagggggtggaggtcgaggaggatgtgcttggtggagaggggcggtggtcaaatataaagctacagctccctccctccctctctcaaagctagtactactctctagtactgtacaagagaagatgaagcagagagagagtgtgactatgagcagcagtgcagtggtgtacagcagctagcatgcaacaggaggggattgaggtatggaaaggtcacttcaaatctcttgtgcgcgcatatacgtgatggatggatggatggatagatcgtgaatggatggatggattatggtatatatcaaatcgatgtgcctacgtttcaaagttggaataattaatgggactgcctacatagtagtatatgtcataaaccctttgaaacgtatacatgatttgagaaaacgtagaaattaaaaaacataagattttagtagaattgtatatttaaaccgaagattgcaaaatatgaaaaaaaaacatgggaataattgtttgaatataccacatgaaatatagacttagacgaaagttttcaataggtttgagctcttactaactttccttcaacataatctacatgcaatagcaaatccatagtagttttataggatttggaaagctagtaaaatcatttgtatcaaagggccaaataaaaaaaaatcttatagaatttgaatcctatgaaattcctccatacaaaaaatcttacagattcgtgtgatcccgacctaactctattttgcatgtgttgtcactatgatctgcccctttcctctgccgcctgatctccttgcctcctccgctgctattaccccaccatgccatgcccgagcagccctggcgaggtctgccagacctcctccttcaccatccatttccgcctctcctcctccttagttggcaactaagagcccccccttcccattcttcgtagtgtagtttctagcggaaaggaagtcatcaccatctcctaaccactcaatttgctttgtccttgccacctagccacccatcatcaagttgccacatcatacaacaatgcctttaaggccctcatacaaccatgcctttaaggccgacgccatctcgccggagctggagaaggagtgtaacagaattacttcataacacatataagtttaaatttggtttataaaaataaaaataaatatgactattaatttgaagttgcatatttatgaagagatatattttatataatagttttttgatgaatttttagtgtcatgaaaaatgagcgaacggacatcccctcggagagacacgaagattttcccaagcgtatagcgtagggagatggcattggcatgggaaacgaagtttaaaagtacttaattagtagtataatgaacataactataaaatcttaactcgttatatatcagattgtcgaaacccagatctctctaccatcaatccaaatttgatggctatgagtatttccacttggtcaaacactcaaagtgccagccaatgccggactcctcaatctgatggccagttgaatgctgcatgcatgccacccataataaacaaaatgtgttacactatatatatatatatatatatatataaagaaataatctaagcaaaacctaactctaaacaatg

SEQ ID NO: 95774 - DNA, 522 bp, Oryza sativa
ggattagcgcgagagaagggggggtatttataggggcccgtggagatggtgacgtggcggggaccacaggtgggctccgcctccgcgtggggacgagtgagggtttaattagcttgatgctcgagtattaataagttaactgagttagattctttggttaaatgttggttagagagtctaatagcaagttcaatagtatagcccactacccctattagctttaaatcatctatagctaatgtaacagccaatttatacaatagttgtttactatactattaatagatagtcctacctgtcatacacatattgcgtcttagagtccgtgctgtagctgaatacagatctgtagcccgttgctcttctctctcttcctttatctctttaaaatatgtttatagctggctcatagcctgctattgtacctgctctaagagcaaggataatagtatagctcacttcctagtattagcctatcttaaagccaatatatatataataaattagctataattttcttct

SEQ ID NO: 95775 - DNA, 504 bp, Oryza sativa
ggaaaagttgaaagtttgaagaaaaagtttggaactaaacaaggtgatagtgctccacaaaatcttataggtccaaacttacacattgatacacgaaaagaaaaacaaattcagcaaatgaatagtagtactatttatattcgaatttgtcttttttttatcattgtttagattgaatttgaacttggttttttcgcggagtgctagacgttactacactctacattgtcaatttttttaaaaaaataactatttgcattgaatttaaaagaaaatggtacacaagaagacatgtcctcaagagaatagaatccattactagaaaaaagtttaaatttcaacatctattagagcatctccagcggtctctccaaatgcctctccaagctaaattttagcaagtcaagcaaaaaggaatactccaatagagttgctaaccggatggctaagccattcgactggccaaacgttctcactgcctgggcaaatgtggagaggcaaact

SEQ ID NO: 95776 - DNA, 600 bp, Oryza sativa
tgaggaaatgcttgaagtgaatttttcagagcatatcaaattaaaattttcaacaaaaataaactgtgccacgaccgcactgaccgttggatatccatcggccgaaagtggggccggttgagcccaccaggggttcggccgaaccgaccaggcaacggtcggatgcctaactttttgaggcaacagctagtgggtcccacatgtcattcttgaccgttgtgggcaccctataaaagccagccggccaagagagggaattccaccccatttcaacacattatcattccctctccaacagtttgctctcaagtttattcatgctttgatagttcctcaaattcaaatctttaattgcatatatacaagttgctttggcgaaactaaccgggtggtgaaactcttgataatactaaccatcgactagttagcctgttcttgttccatcggtcatgatgaggaggcgactgtctcctctggtcaggtatcacgctatccatcaagtcgtcatgacaaatctcgtactcattcatcagctgatgtatcgattgaagacaccgacgctcagagacaactgttgagcgacgctgaccttaacatgac

SEQ ID NO: 95777 - DNA, 555 bp, Oryza sativa
atggacgacgctgccccgacgcaggagaggacgcctcctctgccgccggtgtccgccgcctcctccaagagccggcaccgccgagcttccgccgcctgcacctgctgctcgccgaagccgtgcagcgccgcggagcccgacaccgcagaccacctccgcccacgaaatccaacaggtcagatctcgccttgctttggtagtttgcccgattgcttgttgttgcaatcccgtggtcctctgctgcttttatttggagaaattcgagtccaattcttaaccaaatcgaagaaactctttgttccccttccgtgtacgagttggtcaccggtttggctttttccatgcgtagccaggaaggactcgtaatccgagctatccgctgtgcctgcaaaaacccgagtcggtctcctgcgtaaatccggcccaaaacagaaccaaccagagcaccacgtctagtcatctccctgttgaaagcagccatcgaacgggtcagaccgccgcctgaagtgttcgatccaccgatcaaattccgttgatcgccgccgtgctctacct

SEQ ID NO: 95778 - DNA, 511 bp, Oryza sativa
agggcgaattcgagctcggtacccctatacatttgtcgacaaattttctcctaaaaatttgacagatgtaattatagtacaatcataatgtaattacactgtaacttgtatgtaattacactgtaacttgcatgtaattacactgtaacttgcatgtaactttcacgtaattttgaatcgttagatctattataagatttgttctagcgaggaagaaaaaaaaatcatagcacacatatatgtgaaaggatttgttcccacgacctccattttaccgaaataacatgttacggagagatttttgaaagttacatagaagttacagtgtaattacactgtgattatactataattacatttgtcaaatttttggaggagaatttatagacaaatatatagcaaaattgtttcacatctactaaagtttctgtgttgaattaattgatgcatgtaacttaataccacaaaagtacactgcgagatcgatcgtcacaatcgcattatggattgg

SEQ ID NO: 95779 - DNA, 763 bp, Oryza sativa
ctagctgtaaacatattttaatgagataaaagatgagagagaatagcagcgggctacagatctatagccagctgcagcgcagactccaagacgtaatgtgtgcatgacaggtgggaccatatattaataatatagtaagcaattattgtatgaattggctattagattgattatatatgaattagagatagtagcgggctatactattaaacttgctctaagcttgcatcatcatatgaagcgcgcacttctacaagtttgtggacatcgttgttgtgctctaaactcatgaaaaatttaatggtgcagagatcatgcttttgagttaatatggggaacctataaaatactcaaaaatgaaactagcacacatatatatatatatatatataatgtaaaaaaaacaacatgctactgatccaatcgtttataagttggtacaactaaggctgcaatccgttacaactgtagatcgagtaataacctagcatgattttttttcttaatctaaccattttctttaaaaaaaatccctgtttgggaagacaaaaaataagtgagaagatttctgcaccctccactactgtcctagttaattaatttaagaatattttcattatatgagtgggtaaagttatacctttacatgtgtaactatttcttaattaagcataagcaactagctataagagcaggtacaatagcaggctattagccagctgtaaacatattttaatgagataaaagatgagagagaagagca

SEQ ID NO: 95780 - DNA, 542 bp, Oryza sativa
ccggagcaccctcacagcatctctctttaatatgatcaaggcaaatgatttttgtcgattcaaagaaaggcaaacgacttttatctacgaaaatattcaatgcaagaaaccatgattattttctctcccaaaacatttaatatgagaaagcattccgttaatgttttatatattgtaaacgcaaccgaacgttacttaaaaaaaccactaacatcgaattaatttcaatttagggattcaagcatatgtcatcatataaagtactccctccatcccaaaatataacaactttcccttaagatttgtcctaaaatataacaacttcttcaccaacaattctctcgccaactaatcacaaccctccaccattcacttttcccacctatctccactactcatcctatcacaaccctcccaccactcacttctacctactttcttaataactgtgtccaactttaaaactttttatattctaggatggagggagtaaatcagtatatccataaactcgcaacgttaaatggggtaccgagctcgaa

SEQ ID NO: 95781 - DNA, 1303 bp, Oryza sativa
ttgggttgaaaatgttactacttttttctataaacttagttaaactttaaacagtttgactttgaccaaaatcaaaacgtgttataacctaaaacggagggagtaggagtttctttcaaagagtacatgggcgataccacaagggaaagataagtttcatgtaggtgactatgcaagtaaaatcatttctcacataatttctcttgtgctcgatgtagctacattatcactatttcaaaggtgatcgtaaatagtatccaactattggagtataagtgaattgtccatctttcttcatcaacttaggctgttggagtataagtgaattgtctatttttcttcatcaatttagccacatgatcacaattaatcagtgcatataacttcatatggtatgaaagccacatatcttgagcttgttggacagttggagtatatattcattcctgcctttcctcatcagcaaacactctcactcatcagtttatactctcatgatctgcttgttagcttattaatagcagccaaaaatatttagcatttaattttggatgtgattttgggatgttttcgttgtagtttatttccaagcattgagttttaaaccgctaagaatagaaatataaatattttatctttgttggctcgtttatttttatatggattatcagttggagctcaaatgatcatatgcttaattttttggttgaattggttgctgtatgcaactcaatattaacaatattttagaagtaactataaaacatttttcctactgggtatcatcctcttctgcagcatgtagtgttttttcctggtaaaacaggcacgccgcagtccaataatttaagcatttgcgtggatgcacaatctaactttagaacaaacgtccgatatgctggactgcgacaatgatcaagcgcacattagcaaataattaaccatttgtcattttatatttcttctattatgtatagccatataaactatatctaaaaaaaattcacataaagtacatgtgtatgataatacggtcaagctcgagaaagagaaggaaaccaaacaccaaaaacaaaaatgttcggcacattttacatggtttcaactttcaaataagttttacaaaattatttccaagaaaagaaaaaataagaagaaaaatgaaaaaaccaccacctcttgtatggacaatggcgagcaatgaagctaccgatcgccatggatttccttcaccctttggtcccaagcttcgccatgccgccatggccgtggtaccacgagcttcctctgagccctctcgcca

SEQ ID NO: 95782 - DNA, 606 bp, Oryza sativa
ccccaatgacgatattgagaaagtgatcctacttcaaggaacccaaatatgccattggagaataattgtgacgaactagtgtagtggcaaagtagtctagtacagcagacatattaattagctgtgactgccagtaatcctatatatctgcaccactagcagcgattagtgctattttctcctgtgtaatgaaaccacatcatctatgttttacacagccggaggtctccatctagtaatacaataagattagctctagtcgtttctagcatgatcactgatcacattgttccatgtccagataaaatttttaccagtctggacaaatttagctgctataaaagttgggagttggtgctggtgggccatctaaccctctttcacctcactaaaaaaaaagccgcagaaagaaaacgttgctcttgttccaacaactccctctcttaaaaatttgaccagagtaccagacatggcatcatagctcacactcacggtgtaggatgagcattgcagggtcggtgcaatgctgacatagggtaaagctcagttgatgcagtggattactatgagattcaaactgtagcaaagcatgtgtattcaaactgt

SEQ ID NO: 95783 - DNA, 689 bp, Oryza sativa
aatgatctaatggcgtatattgatttgaccttccacttaactagcttgcagtataaaatctgaaagggtagacttgtctttctgtgtggtggtccggatccgatgccgccaagggctctcaccgcgccattagagcaggtacaatagcaggctattagccagttataaacatattttaatgagataaacgatgagagagaagagcagcaggctacagatttataaccagctagctgcaacacggactccaagacataatatatgtatgacaggtgggatcgtatattaatagtatagtaagcaactattgtatgaattggctattagattagctatagatgaattagagatagcagtgggctatactattgaactttgctcttatagcgctatcgggcgcattgcacgcacacggcgtggatgcgcgacgttccgcggcagcgtcgaagacaacttgaatggcacctgaccggctggtgtgcgggtcagcgggtgaactaaaatgtgcttgcatgcacaacaagccatagcaccaccatatgagaatgattaattttggtattgggttgtgttagtagtccaaactataaggtctatttcttatctgggctgcaaaagtgaaatgaaactggatttgtgtttgctactgtctctcacgagcgtaagttaaggggcttgttggatgccca

SEQ ID NO: 95784 - DNA, 668 bp, Oryza sativa
ttcgaagaatcatcaaagaggaaacttggactgagactgcagtagggagacgaatttgcgtacaaccattagttcgcaagaacaatcctggacgagatcgagatagagatagtcaggcagatagatatcggtagaatttccagatttctgaagaatgggtctcagaatcagaaactgcttggttctgattgttaacctatcaggtggttttcatgacagtgatgtgtcataataacaaagaacgggtgtactgacatcagttgttgacatactgtgagtctgtgatgactcggccaaaaaattaaaaacgattatcattggccgtttgttttaatttacgctggaaacagattaacagagcagtatttttcgggaacgcaggaaacagagcagtagagcaccatcaggcatcaacatcacaacgtcagctgcaaaattgaatagtggtttcgtctcacattacgtacaggtatatggcgatcagtcgatcacaaaaaaaaagcatattattttgaagtcgatagctcgcgcaacacataactaattaaagaacaaagcatggatcagtgtcgcagtaatccaaaagttgaaatcctcagacagagaaaaatgaaagcagacagagaattcacatgtcaagatcctgaggaactgagctcgacaaatct

SEQ ID NO: 95785 - DNA, 1273 bp, Oryza sativa
aaagtcaaactattttaaatttgaccaagtttgtaggaaaaagaacattttcaaccaaagacaaatttattatgaaaatatatatttaattatttatttgatgaaatcaatttagtattataaatattactatatttatctgtaaaattagccaaacttaaaacagtttgactttgattaaagtcaaaacgtattataacctgaaatggagggagtagaaaaaatagtaggcgtcgggaaacagtagtgggtgtgtgcttttaggtcttgatcgaaagtgcttcctcgtaggtaaaaccattcaatctgagcgtagctttattcgattgatctttctttttagttgttactaaaacaacttttgtagactcttcttaccttagactcttatgtgttgttcatattgatggcatttcaaaccacatcattttctttaaagttttagtaacaagatttattttggctacaatttaaacaacccctcagctctaaactgtatatgaatcgaattaggagaaactgtatatggattagataaccggtatagttggtctaacattttttttaagtctgaacaaaacccactataacatatcgtcaataatctatctattatattattaaaacagccttgaaaggaggcaccacgttcgctgtggaggctagaaattcccacattaatcgagaaaaagaagaaaagaatagtccaagtagaaataatatttaaaaatagctgaaattcggaattaaaaataagcaatatagaaagaagtttccaaataagaatccaatacgagattaatcaaaattcgaaataaaaataaaattaaatccaaaaatagaaaaggaaaggagaatccaagtaggaatacaatttaaaaatagctggaattcggaattaaaaataatgaatattgaaagaagtttccatataagaacccaatatgagattaatcaaaattcaaaataaaaaaaataaaatccaaaattagaaaaggaaatgagagtccaagtaggaatacaatttaaaaatagctgaaattcggtattaaaaataaggaatattaaaagaagagttcatataagaacccaatacgagattaattaaaatttggaataaaaataaataaatccaaaattagcaaaagaaaataaaataagagttcaagtaggaatacaatttaaaattagtttaaattcggaattaaaaataagcaatattgaacgaagaatccacgtaagaacccaatacgagattaattaaaatttagaa

SEQ ID NO: 95786 - DNA, 625 bp, Oryza sativa
tgggaagtagttatctagtgcacattatcatccagaagaccaattttaaacatataattacatattgcaacagttgcagttataacagattttttttctctatataattgtcaacaaccatagccagacgaagtgtacattacagattttgtactcaccagataaaataaacggtatactagtacttataaaatatcatttcaaagttacaataaaatgtaatatgcgaacatccatactgattcctgcagatcagaggatgtgtattctgaatagatcctttactgccagtgcccccttgcattgttccaattctttaagagaaaatcgagcatgatccggcataagttgaacacctttgtgctacggcgtttgtcaatcacagaagccgtacaagctgcggcaatggcccccggccggccactcgacgacgagtttaacttcactggtgagtggtcccctgaggacgcctaagcggcgaacccagaaaaatttatgttgggcgtaatatgaagggctaatgaattaatttggcaacggactagctgacattgtaatatccaaaaacaccgccgctgcttagcgcctcaaacatcaaataatggggtgtttcgtttgtgcaggg

SEQ ID NO: 95787 - DNA, 998 bp, Oryza sativa
gcctcccttctttattgtcattgagattttaaaatcgaacatgattatcattgcttttttttactttttggaagttccgaacctttaaaacttgaacttgtagtttcattttttataatttttagaagtcccatcaaacgatgccactatgcccctctatagcccgtccgccgccaactatttatcgtcattgtgattctaaaaatcgaacataactatcgttggaattcattttctattttctagaagtcccgtcaaccgttggcggctctgcaactatactcttaacaccgcgcccgctgcttctcctttttattgtcattgagattttaaaaatcgaataaaattatcaatggggattattttttttactttctagaagtcctggcaaccgccttacttatttgtttgcttcttggcctgcctgacgtccctccttttaatcgtcattaggattccatttggtgttttattaataattttatatgtcgtatcaaccgccaccactctactcctttataggcttgttacttaatttatctcgtcatgtgttttagatggtcttttctttcaatagtcttcatttttctcacaaattttagttatttataaattgtattcctaattgaaatcttatttttctttttctaatttcagaatttatttttaaaaaaaatttagttaataccttattgtgttcatttaatgattttattttttattttcaatttcagttgtttcaaaattgtattcctacttgaactctcttttaatttttctaattttggatattattttattttttattcgaaattttaattaatctcgtattgggttcttatatagattcttctttcaatattgcttatttaattccgaatttcagctaattttaaattgtattcctacttgaactcttattttattttcttttgctaatttcggatttatttatatttttattccgtattttaattaatctcgtattgggttcatat

SEQ ID NO: 95788 - DNA, 736 bp, Oryza sativa
tcttaaattactcatccgatttataatccgattacaccgttgtgttcgtaacaataaaatccgagttaatccgatttagagaagctttacaacaagatctcacatgattatattttgatgaaaaataacaaattacttttatgatatgtctaaattacttctagatttcactaagttacttcttagacatataaaagtaaattcagtaaagcttaaaagtaatttacatatattatagaagtaacttactgttaacagtgaaatttggtaagcccggagtagtcatcggcttagagttagcatcggcttcgaagtcctgagattagtcgatgagatttgtcaagtcgtcaattgtcggattcttgctatattcggttaagaaaattgaattacaacaaaaagaattaaagtaactttaatttagaactatatctagattcattaacatctatatgaatgtgggtaatgctaaaatgacttacattataaaacgggaggagtaactctctgtagtagaaattattatattgtgagtgagctgaaataagaaattatgtagagtaaattcacaagtaaagtgtagagaagatttataaagtccacaaaatatagaattaactaaaaacaataataaaaataatcaacttagagcattatgaatgtatagaagtaatttagtcaaatttaaaagtaacttatatacgtgataaaagtaactacgtatataataaaagta

SEQ ID NO: 95789 - DNA, 536 bp, Oryza sativa
gccgtgaccgatgcttcttgctgagttgcttgctatgtttgcttcttatacgtggacgtgttgtgtggatgtgtctttgttgcgtttactgtagccacaggtttttgtgtgtgtgtgttactaccacggctggactctccctgcaggcagcatccatcgctgttgcacttttgagcggtagttcttccttgcaatgcaggcgcgtctagattcattgcaaagttggactgatcttatttttcctgctattcgtgacgagacagatcagcacgacgcatacggcaaaaaaatggctgctctaattttggcattttagaagatgcgccgtgattttcaggagagagtgatgcgcgtggcgggctatttcttccattccagcagtagctagtaggcgccagatcattcgtgtgatatggcaaacgcaacagttcacacgtagccgactatccttctatggataaacacattgcctatatgcgacacggcgctaatgcagtatcaagttgccatggtggcatacttgcctttcccaaccc

SEQ ID NO: 95790 - DNA, 616 bp, Oryza sativa
cgattcaaacaaggttttcaagatgaagacagcaataggaatgctgaattgtcaaatgcagatggagcatcatcccttggagaggctgtggcatcataacttggacagaattgtaggtgtatatcgcatgtttgctgaacagattattaatatttctgaggcatgagaagctgtataaaggtgttcatatgccaagttatggctattttgctagattgcgatttccacttcgcgcaggcgttcaatctgttgaatctgccgataactagtggttcagttcatgaattttcagaaatttacttgacgatttgatctctgttcctgtaaggctgtaacctagcactagggcatgagaagttgtataaaggtgttcgtggtttttctgaaatctgcttgacgatttgttctctgttcctgtaacccatcactagcgtatgatgagtagtagtctcccgtgctcatagcttggaaagcctgagcctctcgccctctccctgagagtttacctgtagtacttgttaacgttttgataacatcttgcaatctagttctcctgtccctttttttttttcctgaaatgtaccagaaagttatcttgcattttcgttctttgggg

SEQ ID NO: 95791 - DNA, 1123 bp, Oryza sativa
ggaggcaacggcccgacagtgggaggtagacacgagttggaggtgaggcatcggcggccacatcgaagccacggagatggaggaggatgatgggttggccttgatgacgggggcaaaccagagcttatggttaggagacgatgattagtggtgacggatccaacggcgaggagctgccgaagacggggaagacaacgagacagggacacttgcgccgccgacttgggaagagaggtgggagggggagaaggcccgggatgaagggggagttgccggcacagttgacttcattcggccaaccggcaaggccgggctgcggcacatggggctgaggcagaggcatcgcatgcatgcaagcttgcgagtggcagcggttgcgctgggaatgacaatagaagaaatgaggggttagggttagaaatatggtgcacgattcttaatatgatccaatggtttaggatttgcatgatttgtaaggtgtttttccgtcaaatagcatataaacattctcaaaacaaaaggatgatatactatttttatttatactttatccatttttaaataacgacattttcctccaattcgtttgtttcaaaatatttttatcaccaccacacttttattagcagaattttaattttgaccctactctccgtagctatacttgtgaacataaatcaatcttcaccatagagcaaacttctaggtgcttctattttggatccatttcttgccctccacctccactttatccattctttaaaatcatctccaaataactaccaatgacaatttggttataaattttgttaccatgatctacgtgttttggtgaaaatttctacagtatgttattcgaaaacagagggagtactcaataattactactacctttatttgtaaatataaatatttctaggttattggacagatattaaggtagacaagaaaagatagaaatcccacaataaataaatgatggataggtagggtgtatgggtaggtgggagtgagagatgtgaagaaatttgaacgggaaataataatttataggacaagtagtatgtactccctagaatagtgtgctagatattcttatattttgaaaccagattcaaacgtt

SEQ ID NO: 95792 - DNA, 532 bp, Oryza sativa
tagtgttccaagtgaacatatttttatccaaatgtacatcaatatacacactttaaagtaaggcaagcaaattaattacagaaatgaaaacatcaacagccatcccaaaaggaaaacgccttcatatcagtatatccatcataacacactcaaagtcatgtctgaatataaaaaagtatctcatcaaatggatccaaaaaaacaccaaatttatcactcaaacagccaccacaacactctcggtgccacatatccgccaaggtagcactcctcgtggcaagattttttctcaaacgcacaaacaaccgctcgtggaatcacagacagggcaaattgccagcgataaaaccacacaaccatcggggagccatccacgaaggccccatttttctcaactaccacacgaacttaggtactaaccaacggaccttcctagatccctcccataataggatcccaactgaggggaatcgggcaaagaacttccttacctaagaccggagatggaattcgccgagctagacaccggcgg

SEQ ID NO: 95793 - DNA, 521 bp, Oryza sativa
agcaaataaagaagatgacataaggggtagcaactggtgtgaattttaaaaactatataattagaaacatgaggatgataaggtttggtctctcaaagtcttaagacaatgagatagctatttaataaattttaagtaaaatcatacttaaaaaaatatatgattttgtttgggtgctagccgcgcaattgggtgggccacccagctgatgggcatcaatcccagggatttccgtgagttttttatgccaaccaaaaacactaaccattcaaaaatcagagttttttttaccgctttgttagctgatatttgctcggtgctttggaccacaagaaacaacatgatatttagatcgaaattggtttatttcccaccaatattaactttacaaatcatttttaatttggtgcactgaaaagttctttatcgcgctgaggaggtcgagatgatagacctgatgactgataagatgaaaagggtgatctcactgctttgagagatcagagaactgggattggcta

SEQ ID NO: 95794 - DNA, 727 bp, Oryza sativa
gatcaagaatcatgttgaggttctttttaccatcagaaatctttgcaaagaacttttcaaatagggaaaacctcctgagtaagaatagcacaatttttgcaagcatccaaaagacctttttgttttctacaagttgagcaagaaaacacctcatcttgtttaacaatttcctccatgtgtttaacacgccctaaagcatctttcaacttcatctcattcaaaacacactttgaacaatcttcagaaatcaaaacaccattgttttgttttgccttatttgcacatgaagcattcgccaaagaacttgcacaaaaagcaactttgtattttttcaaaacattctttgtcaaaatcaactcatcaacaacacaagcatgtaaagcaaacccaagagcaaaagaagattccaattttttagatttttcaatctcaaattctaattttttgcaattaacagaattgacatctcgcaaagcattaatttcagaaaataaaacttcacaagactgacaattatcatcatcaggaatcgaagattttaatctatcaatttcagcatttaaaatctcaatagtgtgatccttctcatcaagcacaatagaacatgtttaaagtttttttagcaaatttgtaagcagcaagttctaattgatcataactatgcttttcttcattatcatcatcagattcatcaacatgagaactttcattacgagcaataaaagct

SEQ ID NO: 95795 - DNA, 541 bp, Oryza sativa
gatcccccaaaaaaaagttaatgtatggtttatttttaaaatttattgaagaagtttactataaatttcaaaaaaaaaatcttcaataaattttaaaaataatggaaataaatcattatttttaaaatttataaatggctatttcccatcgcaagtttccctataaatctctaccagtttactataaatctccattatttcaataaatttatagaaatttatagggaaatggctattatttttaaaacatctctaccagttaccatgcatttcaaggaactccatgctcccctacagcctttcacggggcagctttcgttggtgagcgtagcacggtagcagcgccgcacgttgacagccagtgtgatgagtgggggtagcagcagcaactgcgtgggagtaatagtgcgagcaaggccggcgatgccgagacgaaaagcagggggaggaatcttaaatgaagcttctggcccaacgagcgtagctcggattttgagtctgggaaagcgtatgggtcacatagagagaaggagagaggggc

SEQ ID NO: 95796 - DNA, 656 bp, Oryza sativa
tatgaaggtagtgaagttagggtttagagtttttgattgtggtagggttggaggttggtaggggagggcaaagaagagggacatcgccatgcttaaagagatgtcggaggcaacggcccgacagtgggaggtagacacgagttggaggtgaggcatcggcggccacatcgaagccacggagatggaggaggatgatgggttggccttgatgacgggggcaaaccagagcttatggttaggagacgatgattagtggtgacggatccaacggcgaggagctgccgaagacggggaagacaacgagacagggacacttgcgccgccgacttgggaagagaggtgggagggggagaaggcccgggatgaagggggagttgccggcacagttgacttcattcggccaaccggcaaggccgggctgcggcacatggggctgaggcagaggcatcgcatgcatgcaagcttgcgagtggcagcggttgcgctgggaatgacaatagaagaaatgaggggttagggttagaaatatggtgcacgattcttaatatgatccaatggtttaggatttgcatgatttgtaaggtgtttttccgtcaaatagatataaacattctcaaaacaaaaggatgatatactatttttatttatactttata

SEQ ID NO: 95797 - DNA, 722 bp, Oryza sativa
tgcagtagttcatataggcgccctgtagattgagatggagggagtaactttatcatacggctcttatcctagcttgctgtcgtgaccaaagccaatgacaggttgactttccgttgaaacatgacaccgatctagtcccagggtgacattgaccttaggctccatgtgtccatgtcattgatccgtatatatcagactctccgagctgttccattacttcgtcgccgtgtctaactaaccacgttgcaccggcccgtggtatgtatggccaatcccctcacaagcaacgacggcgttttccaggaccatatctgatgggagatgtgctgcgagctcaggccaccgcgtcggcggaggaggtggccggcggcgtctggccctgcgagctcgacgaccacctcataggcgagctcctcggtgacgacggcctgttcgtcccggccgccgaacaccccaccctctactactcgttcggcgcggggtcatcagcagccgccgccgccgcgccgtgcaacgggggcggcagcgctgatcacgagcggcggccgcggccggcaccggcggtgagcagggatctgtgctcggtgtactcaggcccgacgatccgcgacatcgagaaggcgctgtcgtcgtcggcgtcgccccggccgccgtacccctccggccgccgctacagctctctgtatttgtaggtgcatgcacaattgtgcacacatgcatag

SEQ ID NO: 95798 - DNA, 707 bp, Oryza sativa
acgtatttcatctaaatcttcctgtttgcgctacgccatcccaagctcatgtggcagtatgtctaggacaatttgaggtagcttgtcgtgatgggcaatgaggaacgtaggtggtggaggcatgcaaacctgttgggagtaaggaattgcaggttgagatgcaattgcaaagatctggagctcaagctttagctttaatggtggtgtggtggtagctcgttgccgatggtagccaagaaaggatcaacctagtccattgtgaaacatattgtaagaatacctggtctcaagtgaaagcatgaggtagaccctggttcatagtgcaagttgggtaaaataaccttgcccaaagtgtaattcactctattttaaaacgaatggagtatatatgttgtttaaggataagacagtaatatcgttatttctccattttatatttgacagccttctttgtttattttacaacctttgtagattattttaaagatatattccctctatcctaaaaattattcaatccgatgtgtgtgtgtgtctatacacacatacatgctatctagatacatcttcacgattgatttttttcttttttgcaagaggagtagtccctccatccaaaataataacatcgcttttttaccatttcacacataccaatataaattaaaaaatatctttcactttatcaaatcctaatataatttcac

SEQ ID NO: 95799 - DNA, 686 bp, Oryza sativa
tactgaaggcaggactagaatacgcctaatggttcaacaagactaactgatagcaacataattatagccaatgaaaccttagtaacaagcaaaagcaaagcagattgaatgcaatacattatctttatgcaggcacctattgtttaaacgccccaaatgatgtaaagcccttacacaatgccaaataggaaataaataatactatcagctgagctaccataagctcagaaaataattaatgataattggtaactatccagcttcctcatcaaccatcattatgtatttaatgtgtgcaatagatcccaaaacattaattttcgaaatctattgcacacattaaatacataatgcaaaccttccaattcaccaaccaagcactcggcatgcaagactagacctaagattcgtacttagatccaagactatataatccataatacaaaggccctcatctcgcaatatgtgcattcttagcagaagtacaccccgtaagttcaaatatggatcataacagtatgtgaagatcgaatgcaaaacgcgctcacctcaccccctccatagccccatatcctcggatgcacacctacatgctgttactctcttcctccccaaagacctcaacgttgagctcaaaattgccatcccactctgaagatctaaagcccacgcacggaatatcagct

SEQ ID NO: 95800 - DNA, 564 bp, Oryza sativa
aacagacctggttgtttaaactactaattctaaactgcagagggtcagagagaaagatcgtacgaaacttgtactgctaatcatgcaataagcatgtgttaatgccaggacgattcactggggaaggaatcacaccgtgggcatgctgttgactagcggaataataccactgatttaagtagggtcatatattgatatatagcataactgctaactgccagttgctagtgcctcttcggctcttccagctgggagtcgaaacaaacaaaagagccgtcgttaagcacgtccaagtaattaaattagtacgtagtagtaatccctaagctaaaaatatggccagttgtagctgacagctaggagtaagagatgggcaagtagagagtatagagaggaaggagagaggaagcaatatgggagaacagtagtgaagcctcgaaccggctcggttcagtccaactcaaccacgtagaaacgtgcgggtttacacggtggcgaccgcttcaaatgtgcgggagctttgactggtccccagccagctcgcctataaacgcgcgcacgctc

SEQ ID NO: 95801 - DNA, 660 bp, Oryza sativa
attaactaaaacatattctggtgttttttttttggaaaaagaaaccaagaggcgtgtgtaataagctgcaatgttaagattggtgctgttatctagtagtatagtgtgttgtcctccctatgaagcatacctatataactttttgatgaaaaaagcataataatatatgactttgagagccagttaattttcacagaaggcatagaaggtgaaatatcaattcctaattggatcatgaaaggcttgctttaggaggtcatgcttcctgcttgtaaaaaacaacattatttgtcacctttcttatcttagatcaacttccgctgcattaccttgcatgcgcctttttatttgtgagcctttgaagctaaccatgcatggccctccaggtcaattctataaaacttcatcaaccttttcctctagttctttgtttctcaagaatttgttttttgggagattgttgtcggaacaaaaagaaaaaaggaaaaagaaaggaactaaatagtgccgttacgttgcttggagcttgtgtgcaagttgttgaagtggagccagaacattctttttttatgtttttttctatatatgattcatttcatccagtcatccaaatcaagtgaacagaaggctgttggccaagcggcttttccgatatggatt

SEQ ID NO: 95802 - DNA, 515 bp, Oryza sativa
ttcggccaacaggatgtagggttattatctgacaattcaggggcccgaacctgtataaaaatccttgtatctatcttttttaccttagtctgagatctatcctagtaccaacgatccccatactatgcaaataccggaatcgcgacatcaaacatcgacaatgtgagttatgtatccacatgtcaataagatcaaacagaggtgcagattgatgtcaaagtgtgaagagcagctagattgtcattaatttattattcccaaatttcatgacagtacaatttattctataatcaagcagtaattaacctcaatgattaactctaaacgggttatgttcaaggcttggaaccagtgtactttaattttaacagtatatggatgtgcatgtttagtgggttgagtaaagattctgccacactccaggagatatttgatgactgaaaaattcctagcatacggtggaagccgcacacacgtgtgtttggtggtttgcgttggtgactgcataggagtct

SEQ ID NO: 95803 - DNA, 588 bp, Oryza sativa
ggagctctttctggaagcaggtggaggggaacaaagagaggtgatggtgtgctttaaaaataagtgaatgcccctgctcacccacactgaaggacatcacagtgtcaggaaacttcacagcaaggcaaggcacagggaccccaggacccgcgctgtgccactggcccccttggtgccctcagggtaaagggagctgggaaacactctgtagaagggcaaagggcctgagaacacttggctgctggatggaaggagacgtcattatgagaagatgctgagaagtgcagatgagcaatgaggtccaccaagctggtcagtaatggatcatctactctggccgacgcttgcaagccattcatgagtgagcctgcatttcctgtgatatttagctcctaataaagtgatccccaggagctgacacattcctccaaagtatgcctcaagccaaacacaacctaattcatatgaaatgaataaatatttcattaaaaagaaatggattccaaccttcatgaagatgtctgcatgaacaatgaaggcttctagtaaatgcatcattggtaagaattccaaagatgattcctacat

SEQ ID NO: 95804 - DNA, 691 bp, Oryza sativa
ctggaagtatcagcaccaaaattcatctttgtggatcaggccatcgtcgatgatggagcagctgatcttctactccaactccaataccgtaaagtcagtgacctgcactgaaaaacaaataaatctagaagatgtaaaacagcatgctaaaatgtttaccagaaagagttgtgacttgttaggtacaaacgcagcagtacaattttattaattgcaacctaaatcctcctttacatcacagcagaataaataatcaatggcaatatattttgtccctctgaatcagaatgtgggtaaatgcactacccggtaataacccacacatatttactaacccacatatcatggttactgaaacatctagcattaatgttctgaattagatgaccatcctaaagatttcctatttttttttttggacaggctcccagtttgccccaaggactgcccaaactaaactgaaataccatcacatattctcaatttaaaatcagttccattcaatcatggacctagagctaaatctttcgaacttaaatatatttaaaactgaccttcgcgtgaacaagaatcacagaacaagagcagagcacataactaaggacttgattcaaacgcgtccattgcctgtaacacacagagagatgtagggttacatatatttaataaaaagctgtcaattgaacaccat

SEQ ID NO: 95805 - DNA, 648 bp, Oryza sativa
aatagattactcaccggataattgccacataccatctacttgattataggaaaaaattaaatattttgaggaataaacttaacaaatagcactataaccagaatggttatatatgccaggggaagtgactagttttcatgacacagcagtgcaacaacaggaaaaacagaaaatgagtaattcatactacttgagcagctgacatccaatctgcattattatctctccatgtgcatgcaaagttagacaacttgagcagcattcagaaatgtataccttgttcagtgttacatgaggcagtaatgttctgtaagatgtgtctatggtttagtataagaattctgagtgtgcaagacatgtcatatattcgtgaattattttttttttgctgagtgagatagagtttggaatcggataatatcatcggatgcccataaaaacaattgtattaaaaaatgctgagtaaaagaataactcttacgacaatcccgtgtcacccgttttctctttgccattgggtttggccattccagtccttagctgagatgtggaaactgctgaccctgcaaatacaatagtgtccgtgaacagaagcagaatacatataacctttagctcaattgttcatgtttctctgccatcagaatg

SEQ ID NO: 95806 - DNA, 720 bp, Oryza sativa
acagtggacgaaaatatacataaagagtttcaacattaaaaatgtggactcttttattttttgttatgaatctagacacctgtgtttgctgagatgtgacattcatgaatgcgtaatttgtgtattcataatatatgaaaatgaacctatgcgctgcatttttaattatcttaacaataatgaaacgctctgaatctggaatgaaggaaacatatattccatacattttaagattcttaacaagtccaaaaacaaataggcctatgctgatttttctgtcaaatgcatttcgcacatttgcaaattatgaaaaaacgaattatatcattttggtgcttacgtgaatatctacaaacatacaaattgcaaaaacactgcttatacagtatacacaaccaccctatccaaggttggtcaatacatgaacttatggaagaccctatttgggtttttaacacaaaatgcgcttgtataagccagctctgaaataaaaatgatgaacagtaaagtctaattgacatatgcttgagtaatggtggccgagttttgatttctcctttaaaaacaacaacaataatgcactataattctatacatacattcgcccactaacatggaatctgtgcatgtggtgtacgacaaacagatctgactagtaaaacgttacgaaaaaacactgctctgactatactgcatttaaaagcaacttatcaaacatgc

SEQ ID NO: 95807 - DNA, 663 bp, Oryza sativa
tgtatccttccaatgtactttgcagttggacgtggcatccaaagctcgcataagagatgccttgtatcgattggccaattgtgttgagcataggcatcgcattgctagtacaacagagaccgttaaccaacttggagttatggaatcatcagcttcaaagaggtacaacggtttaatgtgatcttcaattatgtttaggacacttgaagtgatcgacagctgagtttttgtgaagtgtaattttctgacatgttcaaatcaaacaggtggagagaaattcagatgatgaaccctatggatcgctcagtggcacagctgcttctccagaaaccgctccaccataaatctccacctgattcggcgctcggcattggtccctgaattgtactgcaccgtgaaaaacacgtaggagtggctgctgatgcgatgtggttttttttactgcacatgtctgatcgattgagcattctaggtccggcaattttttttccctctcggttccggtacgcatgtatatacagtaatcactaaagagtacagacttactagatgaaatgtaatgtgatagcaacgctttgctgttcagagatgtgattctaaatagaaactacagtgttttttttttgttgtcttcagcatttacctgtgacttgtcagatgccc

SEQ ID NO: 95808 - DNA, 752 bp, Oryza sativa
tatacatataagtacagtatcttatgatatatattctgttttcttctgtcacattcatcgtcgatgctccaggaccagaaattaaaaggacatgcgaaggaataatgtatgtgaagtgaagatgcaacaaccgtcactctgaaagactgaaagtgggactctcaactgaagcgacggtttaacaactccggaaggaggcaatgttcgatcgatctttgtttaatcaatcaaattaagcttcattagtttagtttgagctagctggtcgtgagtgccaatcagaacttaactagaagtagcattttttttatgaaaaaagaaacataagaagatgagacttatgcatatttatttcgcagcgtgtgcagtcagctggatactccagatcgatgaaatcctaattggttgctactcgattggacattttggcagtttaataattaattatatagagagaataaatttgagtttgacatcaagtacttcatgctcttcatgtcttatcacaagttttaagaaataaaagaaacgtcagtgttaagctagttaattactagtgttgtcatttccttgatctgcagttgtatgcttgaggactagtacaactgcgttacattatagcactttagtacatccatttgttcctattgctggctagtcaaccaatgaaggccaggccttaatatgataattaacgaacatgttacaatgttaccatacattcggcatggtcagacaatcgctacgtgtaa

SEQ ID NO: 95809 - DNA, 761 bp, Oryza sativa
tagtacctaagagaactttttattttttctaataaatcgaaaactttcaagttagattcgaaaactttcgacttaagatttaaactttaaaatcaaattttaaaacctttcaactcaaattttaaaattattttctacttgaatttaaattttacaataaaatttgaaaactttcaactcgatatttggaaactttcaactcagattagaatacttttaactcagatttgaaaactttcaactcgagatttggaaactttcaactcagatttgaatacttttaactcagatttgaaaactttcaactcgagattttaaatttgaattataaaaagtattttctaataaaaatatcttataatagaaatttggataactttcactacatcctaataagatgaaaaaaaagaaagaaagatcctatatatgcatgcatgcgtgtgtaatgcatgcgctgggtgtacgccatggcacatgcatgtgtgggaccaaggtgcatgcatgtgtgtgtaatgcatgggtggatgcaaaggtgcatgcatgcatgcgcagttggcctgccgcgggcgagcgagataagtatctggcgcgtcagcgcgaattagcgattccgcaaaggattaaaggatttatggcttaatgcatgtaggttttgaggaaagttagcatgaggttcaacctcttagtaaaaatcctttgagtctatctctctcatccgattcctgtatttttcctgtggtccaatcaaacgactattctta

SEQ ID NO: 95810 - DNA, 656 bp, Oryza sativa
accatgcgaaatcgacttcactgagagcatgatgctccaactgctgtatgcgcgggaggaggtgaagagaccgtcgatgcccaccacgctcctttgttttcttgcgcgccatttgagataagtaacaccaacctaggtcctggagtcttccttaaacaacatatgatattctacggataatatttctgctttaaattcatattccacatcatgaagtgaactatacaaggctcggaacattgatccaactgtacacttatctatacaaagaaaatgatttgtaacccaacatgtgaacaatcatgaagctcttggattaaaacaaaacaatgttgcatactatagaaaaatatatattaatgtacattgtgagcacaggtaccatttacagaatttgatgtgaatattactcaactaaaatggctatagtgacggctcatggagcggccgctgggcgatgccacggtccgataagaacagtgcgcggagtgataatttttctataaaaccctctgatttatgcgtaattagatctaagttcctcacaaacagcccttctgaaatgatatgttacataggggtacttatagaaaccatatatgctgtgccaatgacttacaatatcgggaatcctgatatgtataacgaagaagatt

SEQ ID NO: 95811 - DNA, 523 bp, Oryza sativa
tctctctaattagaatgtcacatgacatcttaggagcgtttgtagaagtgtagaaacgctattactcgtagtcgcaattaagttgtagtcaactattgtttgtagtggattggttgcatcctctactcacctatttttttgatgatcattgcgcacatggtattgtcatttatcttttgtgctcgataacagacatgctcattggatatcagttaatcattatgtgcactatgcacggataccgcataagaaatatgacttggcatttagtggatagtgacttatatataaaacttacatacatggcgatcaataaggatatacgattggtattttagtctaggattgaccaagtatattatatactacatattaagtgctttagtacctaagtaataaatttaaggtcgagttctaaagtgctatagattagctacttccttatttatagcgagcgcgtttcttaaactgctaaatagtgcattacacgttgcatgatttagaaatactttctatataaaag

SEQ ID NO: 95812 - DNA, 1869 bp, Oryza sativa
aagttgtcaagtggcgctctaatcaattagagaaattctatgaaaaaaaagacatctaactgttggttttaatttaatctcgtggacccattatttttaaccgtagatctattgtagaaaaaaatactttcttagatttatctttaaaaacggcacatctaggacgctcacgtacgtctgtacgtgtacgtacttaggccccacgcctccttttatttttttttctttctcattaataaataattaaacgaaattaataattctatcccataggtctaaaatatatatgtacgtacttcataagccagccccacgtctctccactccctcacatcagataaaaactaaattaataaatccagcccataattgtaaaatatatatattattttaagttctattctactatatatacatcatcgaaacatccataaaaaatcatgaacagatgaataatatacaatatataattgtatatcacttactaatatgcatagttaaatgagacttacattttcaaaaataaaaacacagcccgtaattgtaaaaaatatatgttattttaagttctattctactatacgtacatcatcgaaacatccatgaaaaaatctgaacaaatgaatagtatacaatatataattgtatatcacttactaatatgcaaagtaaaattagacttacattttcaaaaataaaaacaactccagtaattactgcctccctactataaaagatatatattgatatatcaaaataatataactaaatttatcatgaatgtatttttcatatattatgagttatctttatttatatattattagaaattaaagatcaaatatattcttttgacatcgcgtcgatgtcttttatatcctacttaggttgtgcgatccagctcattagaatgagcttatctagggcatacaaaatgatactggttattaacataggaattgaatattagatattaaaaaggaaaatgaatttattttttaaaaagaacttttatatagaaagtatttctaaatcatgcaacgtgtaatgcactatttagcagtttaagaaacgcgctcgctataaataaggaagtagctaatcctataagcactttagaactcgaccttaaatttattacttaggtactaaagcacttaatatgtagtatataatatacttggtcaatcctagactaaaataccaatcgtatatccttattgatcgccatgtatgtaagttttatatataagtcactatccactaaatgccaagtcatatttcttatgcggtatccgtgcatagtgcacataatgattaactgatatccaatgagcatgtctgttatcaagcacaaaagataaatgacaataccatgtgcgcaatgatcatcaaaaaaataggtgagtagaggatgcaaccaatccactacaaacaatagttgactacaactaaattgcgactacgagtaatagcgttcctacacttctacaaacgctcctaagatgtcatgtgacattctaattagagagaatccaagaaaatctattatctatctattatatactaaaagtctattaaactttatacaaatgctctcaagctaccacgtaggattccggattcctataaacattcataagtcgccacgtggctctctaataaattataaggaaaaaaaatccaaacaacaatttccacttaatcacggtggacccattattttttactattagatttatctaacagtgtaaaaacataaaaagctcactttccatcccttcacgtcacatactgtatcagcctccacgtatagatacgtatatatctttccttccctccgctcacatccttctcttttatccccta

SEQ ID NO: 95813 - DNA, 544 bp, Oryza sativa
ccagtatattgaccttggagtgtatgctatctagattggaccatgcagtgttgttaccgattgatcaaggttgtcgttaggggttctaatccaaggcgctgttctgggaatgtgactaactgtcctctatagtgattaatatacaaagagacaaggggatgcctggcgcatttagatatgcatgtgcatttgtgcttcttcgttgagttattcgttacctaaatcagttaggatgctggcaattcatgcccaaatgatgattaccattaaaggatcagttttttgtcagttttgcaattgcaattccaacttctaaagctcattggttcattttgattctgcatcaccatttgtacaactgtggtatgatcctgtctgagcgtatgaattatggtgtagcttatctgcaagcgagtttgtgtaatgtcctattggaataggtcacaactcatttcctgcaagaaccaataaaatatcctattaattatttactgttctagatactgaagtttgttgccctgtatatatctgtgactcatatcac

SEQ ID NO: 95814 - DNA, 721 bp, Oryza sativa
ttcctgcagcccgtgcatatgcctgaccgattgatccgcacgcttcttgccttttgggggtaaaatttgtgcacaccatcggtgaatatattctacgtgttcaattcaaactgttgagaatctcatcgggttgatgatcagatcaaatggatatatatctgtttctgctttatatgagaatgagatagtgcatttggatagtaaagatgggcaataatgagctcatttttttactcagcgcacttctttttcctcaatataatatcaatactgatggtccattttctgctaaaagtatacctcagtagcatggccattaaaattttctttcctttgcaatggactatggcataaacataactgcatagctgcatatgcatgtcttatgaagtaattaaaaataactgatccagccatgaacaacaatgccttatgcgctgccataatttatgatccagcattagatctgagctaggaggtaatatctgaacatcacttctgctatttgatgaacatcatattttcatcatatatactttctttttccagatttcctggtatatattcacatatataaattgtgtagattttagtagatcttttcagttagagcatgaaaaatatcatggtttttagatggctgttgtaggtccaatgcttctcttacaacaaaagaaacctgctatatattcacatatataattgttatagcttcatgaag

SEQ ID NO: 95815 - DNA, 520 bp, Oryza sativa
aacgcataacatgaatgaatttatccccttattttgctatgcgaatgtaagatccaatttctaactgtcctacatgtatcaggggtgccaattggagctaccatgtcaaagaaagcctggctaaaaaatgttcccttcttttgcgctgcaccccctcaattggaacttggcaggcatcccaattgtgccaagatcttgattccatgcgagcgcattccctagtatctgtatagacatctaacacgaaagactaggcacacatcaatcaaagcactgagcagtatgaacaacccaagggccaaggccctccaacaccactgcatattacccatttttggaccaaaatctcaaccagcacattgcaattctttctagaattgaagcgattgactctagtagaacttttatccaacacagacacactgtaatcaaaatatctatacatcaaaggaagatcaccacaccaagtataggtgatagtatcattcaatccacaaagtgtaatctactattctgattt

SEQ ID NO: 95816 - DNA, 538 bp, Oryza sativa
tgacatggcatatccatatgatggttttggtggacctaaggactattctaggtcttatgacaaaggttaaggatttctttggaccatttaaaaggttagggactaaactgatcctacagagaaactttagggactaaagtagatattctctcttatattatattggaattacatgtgaattatactatatttatgtctaacaaattttatgaaaaaagatttgactagaccctatgtatcacctattacaaaattgaaaatgagttttctatttgttaaagaaagttctatctatatagaaagtttttttaagaaaatatgcactgtttagcggtttggaaaatatattaatggtaaataagaaagtagcaaaatcgaaataagggaaagaacacacccttaacaatatgtgattattatcgaaaagggtagtacacaaacgttcgtggttacctaatccagcgaataactcagaagggacacgcgaaacaggaggacacgccattttcttccgttttcatctttttcccttcttttt

SEQ ID NO: 95817 - DNA, 620 bp, Oryza sativa
tgccaactttgttccagtgagattttggtatgcatttagacttttagtaactgcataaccttgcctgatgttggtgtggatgctaacagtgtggcagtcagtgagcaatgttgattttgtactgataatgagttgccatgttttaacctgacaagatagcatgcataccaaaatccttgttcattagtagtagtgcagcactactaattgtaatctgtggtacaagtatactacttcatgcatcatgggattactccacctgttgtttcttcatttctggatcgttatatgtgagtgactgcaatgaatatattttttgacacatgtatttgaatactgattactctttatttccacctgtttaccctgttttagctagcgttcataattaagcttgtcatgatcctatttaaatacttcgtagctgcaccaacatcaatcatcagattcgttagcatatgatgaaactagctgggtggaccacgcaattacgcgggtggcacacatataaagttatatattttttaatataattttaattaaaatttattaaatagatatcttggtgtcttaaagatttgaaaagacaaaccttatcatcctcgtggttttaattttat

SEQ ID NO: 95818 - DNA, 532 bp, Oryza sativa
tatacgtgcacttaaacatatggacccattatttaaatcatcggatctattttttatcactggggactattattatcaaataatgcacggttttaaaataaactctacacttattatattgtgtacccattaaattaacaatttaaaatctatattaactaatttacattaaccctataaccggtggacccattatttaaatcatcggatctattgttaacaaataaagtgtccgaagttctcttttttggcccgctgcataatgcacatttgcatctttgcctttcgcacgtgtgacaaagtgtcatgtctgaggcatctaaggtgatcacgaccactgcagcgctaccgctttgccacatatcaaatcatatatggagatgattaattttgttaataacatgaaaagaaaattaaaggtgtgatgtagagagagaagaattaagcaccgtgggttgagtttttccaacatttagctctatttaaactgaaacccagagttgattacataataattatatcgtattgtgtt

SEQ ID NO: 95819 - DNA, 565 bp, Oryza sativa
gatcccccgttgtcagagtagcagtagcagcagtagactactagtaatagtagtagcacattgccgggtagtagacatggttactgttctagactgcagctgcaacaccaccagtgaccaacatgcctggagccatgcttgctttggcgccggccgctgcgcgcccaaacatgccggaatctgatcgagagctaattaagcgagagtttttttttcttcttttttggtggtctccttttcctcggcggcacaggggacggaatcgaacagctagcgtgtaaccaccacgagtccgtcgcagaggccaaccacagaaatcatcggaaaaaaatgggggtagtacgtggtgttggtggggtatgttcgcatgttcgcatgattgaccatcttagtttcagtttcttacggcctctacaccgtgtcgccgctacactctcggacgaatcatcaacgacgacgacgacgacttccgcttccactccaccagcctgagcaagaactccatcacctgcagaaacgggtcaaaaacgttttatatattctgtacgtgctgtgctcgtgtgta

SEQ ID NO: 95820 - DNA, 748 bp, Oryza sativa
tgtcatggccttgaagcagcacggtgtggtcattcatcagagcaaagtcattcataacaacgtgggtgacctgagaaaaaaatcgcttcatctttagtagtccagaaaagctactagaacattacagttcaacagtaagaaatttatagcagtaccaatctttctgtactagtagtatgatattttttctctgtactgttaaacggttagttattatttcttcaatttttcctgatgactctcatctagttcgcagatcagatgtagtagatcaaaatgaaagtcagcagcatcaactccagtccataccaactactgtactgaactatacagagtacatacgactccgtttccgtacatgaacttcaagcataattgttctcaaaaaaaaaaaaagaacttcaagcataacaagttaacaaccaaacaataaccataagttctttcttggagggccaatacccatattaattttgagcaagatcacaacaaaaatacaagatactacatcgattctactgatcaaacaagctggagaaacaaagcagtatatatgcatcatgcaacgagaaagctgaagaacacttacctcgtcgcaaggatcaaacccccatctcctccccacggacgcatgcattattgatccagccaaacaaacaagacagcagctcaaccaaggatcggagcgcagagatggcaagggagaagacgaagaagaagaagaaaaaaaagcactgtgcacggcaat

SEQ ID NO: 95821 - DNA, 693 bp, Oryza sativa
tagagaagctaatgcaaagggtggcattagctataatccttccatccatcaccatccaatggttgtggctagtcttcatctttcttatctccgttgctagaacgaatgtcctgtttcatgtttgattcgctgaatcaataccaagctcttcataaattttgatagggaagagaattgttgcaaagtctaaatgttcatggttctttgctcgtttgtagtactgacttgtggcaaaagccaaactaaagcttcataataacaattagttcataacaaggttgattgagggacaaagtacaaaaggcatttcacaaaggaaaataaaactataaccctgattaagtacaaaaggtatcttagggaggaagataacactataatccataaaccaaaatatgcagagtagcatcaagtccacctctcagatgagtgaaatgtcattacttttcaccaaatagactacctgcactggaatcattctgcacaatgtagcaataagtatatatcaatcatgaacaaaatatagttttctagataaaaattaagtataagttccagattaccataagtaattatgggtacgaagtaaagacgtcgaagttttcaaatacttcttcacttttgtggagcttttttgttcttgtccttgaaattgagacacatgggtaagatcttcttcctgtgaacaattct

SEQ ID NO: 95822 - DNA, 686 bp, Oryza sativa
attcacttcatattttattagcttgttgccgcaccgtaaggttaaggcttctttttctctatggttcttatggtgtgcttgcacaatgcttaaggtgttgtactgtataacattaattgcttaaggctaactttttaccaacattgtggatgcccttaggaggcaaaagacatggaccttccaacaacgcacaaccacattgagtgccattgtagctaaaataaagagtaaattgcacttacggtgcaacaacttagcaggtgggtgtaatttagtacaataacttaaaaaatgaacgttctagtgcaacaacttggtaggaatgtgcaatttagtataagaactttataagtgatcgtataaatgcaacaacttgtaaggtaggtaggattttgatacaataaattaagaagttacgtgacaacttaattatttagagcatttttatataaattcaaatttttaagtacttattttaacaatatactagcatggaattatataaacatatttatatttttatcctaataactaataactaaaaatcaattaaactggattaagaaattattatatttcggttgataattgagaaggtgaagaaaacaaaaattttaaagataattggatgtaaattgtatgtgcaacataattcttaaagattaaattcatatataaggtaatat

SEQ ID NO: 95823 - DNA, 563 bp, Oryza sativa
  unsure (1)..(563): unsure at all n locations
ttaccttggcggccgagctcggaggagaagccagtgatggtgatgaacagcgagcagcagaactactccgccggcgacgaatgcgcactggaacggggaagcaggcggccaaagcggtcaagaaacaggatccaaacaatccagcccatcaaagaccaattagagcccatctcactctccttgatttacgaggcagtgcggcccgtgcagtttttacaagtcagttatactagccacttagtcatgcgttgcacgactttagatacctgtataaaaagttatatatttgggttataataagcaattatacttctntaggtttcaaattttgcgaaaggacttgataagacttgagcatacaaccggggaatgaaactgtgagctgctgttgcaagatttaaaatgagggcnctntgtgngcttagcagttctacgaatagacggagaatttaagctctgcttcatcaagtgaaagagaacaactaccacgtcaagaactcaactgaatcaactaaacacctcatgtcaggaatttaaggatactgaacatgtaccatgcctta

SEQ ID NO: 95824 - DNA, 707 bp, Oryza sativa
atagtcggcatgaccaagatgcccatatgtgttttggttacagtggcagacgagaatgctagatagcgatcagtcgcgcgcctccctccccgcgcgactggacacgtgtcgtgcgcggagagggggcggccgacgcgtcgcgagggaggaccggaggagcgagttttctttttttttttccgtttctgttcagttgttttttctttctccggttttttcgtttctgttcggcctggttttttttcagtttatcttctgtttggttcttttttcggtttttttaaagatatataaatacaaagtttgtattcatatgtatactaagtttgtattcgtacgtatagaaagtttatatacgcgtatacacttgtatagaaagtttatatacgtgtttgtatacgcgtatacaaactttctatatgcatatacaaagtttctatatgcaatacaaactttgtatatgcgtatatattgtttatgcattaaaacatattcataaaaattatatatatacgtatgtatatactatatagtatgtatacatacgtatatacatacgatgtatatagtacttacatacgagagagactagggggcgactgatcgcacgcgcgcggaggcgcgcggctgatcgcgtaccagcgcccccctgttcctggcccggcccagcagtgagcgcaaacgaagcggtggaaggccagcgacgc

SEQ ID NO: 95825 - DNA, 820 bp, Oryza sativa
acgagcgccctcggtccgtgctctcgctgacgctgcgtatgaagtggggcttgccgatgaaagtgaccatcaggaagtaaccaacaagagtgctctcgcgcctcggtggcctcgccttcccggacactcgatcaatgcgggcaagaatttgggacgtgtgtccatctcggtaggccgaatcggtgagcgggcttatgaaagaatccttttaagtcccttatgtttgttgctaacttgttttggcgttgatagattctggcactgctaatcttggattgtagcccaagatgagatgcctcccatacatcacagctctcacatggtactattgggaaaaagtttacttcagatccctcatctcattgtcgagtttcagaatcgtctctaaaccagaatatcagatataacgcatcactatttttgcaaaatcgggtcccaaagtagtgttgaggacggttttggataaaacaaaaattaaaataaataaataaaaaccacgaaaatgtaagtgaaacattatattcctccttgtatatcttcccatcctccggtttctctccctaccgccccatcctcaccggccggtcaccgccgctgcggccttcctgcagctgctaccactgaagatcatcgataatgcggcagatgtcgaggtcaagctcccattcacaggccttgatgtcgaggtcaagcgtcaaaagagtctcttgaggctcttgacaagcagagaaggaagtttttgtgggcggggggagaagccttgacgggtggaaaatgcaaaatcaacctggacccgaacctgcctacccactggttccgg

SEQ ID NO: 95826 - DNA, 511 bp, Oryza sativa
ccgccgctgccgggcggcgaggaggagagcaggcgggagagtagggttctggacggcgggcggcggcgggggaggaggaggagggggtggcggcggcgctgcatggccgccggcgccgtagggtggaggcggggcaaagtgggttgggctcggtttcgttgccgtggatgggttcgagtcaaaatggcagaaacacttgagctcgagtcacatatggcccgtctgcaaaagtcgtgaacgaaacaggaatacgcctttcgttaatacgtttccatgcgacctaaggctgattgcaccaatgcaccaatctgggagttttttacccggtctctatatccaaccggatatatgcaccatttaaattagtaacttagcatctcaaataatccaatctgaaattcactcatatgaagatttaaactcaggatcgactactcgggttaatgcgtcatgctctaaatttgctttgcagtgttacttttctggggagaaaaatcacaatagacaagca

SEQ ID NO: 95827 - DNA, 673 bp, Oryza sativa
gtaagtgtggctacgaaatagttgatcacaaatgtggtatggttagctataatccatctgccatccaccgattggtcgagctcggaacgtaaaccacacacgcacggcgctggcgcggggcacatggaaccatagcacgattagcccggacagccgcccatactcatcgacgaaaacttcattaaattttaatatttttgattgataataaaatttttatacaaataatagttatagtgaagtttgcctaggcaaaaatatctttctagctctaccactgtaatgaagagagaggttcactttatatctatgtgcattgtctatttatgcagtgttttttaccgtaaaaggaaatgacacagttattctcactgttctactgctgtgaaagggcaacatgatccgaaaatttgttaatagacgagttgattttacacagcccttgctttcatctgtgctaacaaatcagagcttagcaggcctctagtcaataaacctggcccatgtcatactacctttacagtttcggcccgatctaacagtctggactttaattgtctaggcccagcccatggaaaatgcgaactttttcgagtagatttctggccatgttactaacatatacaaatcgatgtttcgttccgcagaaatagattagttgcaaatcatctct

SEQ ID NO: 95828 - DNA, 685 bp, Oryza sativa
tttagaactgtatttcatcacccattttgccaaaaagcaggccaaagttcttcatttggaaactgtgatattgagaactgatgtttagttcactaacacagaatttcagaacgcactcaagtttattttcatgagagattgcatggataaagaaaatatggcaactttaaacccagagaaatttgctagaacaaagtagatggttgattatatattttaagcttatgccgatcttactgttcactttcttaaacttctgaaatctgaactataaatgaacacttgcagggaggttcatcaatgaaagttgtcgattgcatactttgcctcaaagcataccacgaatggaagctctctggtgggattggcatatggcgctatggtggcattgtgaaaattgcatcctcaagtaagaggttgccttcatattcatccaggggaggaggttcagctgatctgaaccaacaaatgctggaatttgtgcaccttctgtctgaagtctcccttgaggaatctagagttggagaatctcagcattcacttttccagcaatttgtgcttcgagttgtgcgggcattccttcaggaatggggtgaagctgagggcttgcccttagatgatatggtaggtaagttctacttattattgtataatattcgctgaccacctgatttctttagtggtg

SEQ ID NO: 95829 - DNA, 649 bp, Oryza sativa
tagacgtctcacatgcaacaaagatattttttcgatatacaaggaaaacgcaaactctggaaattagttataagtctactattaaaacgtcaaagcacaaaaaaggcgcacggtttaaatgcgatcaactattttttttcacaaactagtaagcaaaagtttatacaaaatttaggaaatggagacttcagaactaaaatagagctttaaagtccgaagataagttccaaaaagagaaactttataattgaagaaatcgaactaaaagtaccaagttgaaaaaatcgtcacgcgagaaaccaaagtaaaattttcataaaccaggtatcaaagttcaaaccaagttaaggaagacaaacggtgataaccgaaaaatttggaaactccaaaaaggatatttgaagaatcaatgcaagaagaacgtttgaaaataacggaatccaactaaaactacaaaatttaaacttgtggatgaaaaaagaagcgtcaacgaagaaaccaataaatcggtcgaacaagcaaacaacagtgatcataaaatcaataggatgcaaccaaatgtagacgtctcacatgcaacaaagatattttttcgatatacaaggaaacgcaactctggaaattagttataagtctgggctgcaggaat

SEQ ID NO: 95830 - DNA, 924 bp, Oryza sativa
aaaggaggagtcctgtagggttttggtgcctaaaatcgacctggacctatggtgcttcctctaagacctgtctcatctttgccttatgtaatagaaaattatctacaaccgttagatggagatggatggccaagattagagctaatgccaccctctgcattagcttctgtaatgcagaggatctggatccgacatactccctttgtccccaaaagacttaaattttagagataaatatagacacatgttaaggtaatatttttttagtgaatcttctgatgaatgagataacttttgttttattatcaacgaggaaatggattttatatcttaaagtgtattcgctgaactcatcaaatctcactcatatctgaaatcagtccggaaaacctaatgcgcgaggcgaacacatttttccttttctgttcaccccgcggcctgcatgctcccacgctgaaaatgggcctatgggcctatgggcaaatatgatatttgttattgggagtacctatacatctttcgaaagatttttatgatcgtatcacacagatttttaatctttagattaaaatccgatagatataataaaaagcaaaaagcaattaagaaacaccataatggacactaaattaccatatcctcaagaaaaagaccaaatccaatacaaaatttaaaatttacatgtgaagattcaaaaattacagtgtaacttacaaaagttacagtgtaagtttcataaattacactgtaacttacaagaaaatgcactgtaaatttgagtgagaaaatcgagtgagagataagaaaaaatctttcgtgtgagatatagcaaaatcgtttgttatttgggagtacctatacatctttcgaaagatttttataatcgtatcacacagatttttaatctttgtattaaaatccgat

SEQ ID NO: 95831 - DNA, 669 bp, Oryza sativa
cggtggatctcgtgtaccgcggctggggcagggatgggagcagcagcagtagggagaagagaagagaagagaagagagaagagagaaaggagaagaaaataagatatgcagctgacatgtggaccccacatgctttgctaactaggatgtcacgtcagcgaaaccacccatatatactgcctagggaccttgagtgaacggttttgtatagtttaggggtggagatttctggttttgtggttaaggggcctaaaaaaatctcgctgttaagttgagaaacctccggtgaacttattccaaaaaaaagacaggttgaagcccatgggctggtttttctagcttgcagcgatgcacgctggttgccacatgcggatgtacaatacataggttgttgcaacgttcgcgggccgcgaacgtccacgtactagacgcccctcaaatcagtctctatcataagaaagaaaaatgaatttaggatatcgtaataagaaaaataaataaatttgactaaatataacccatggtgacgtatcgactatcaattaattaagcaaacggcttgcaacctctgattgccagctaaaaaaatccacgatatattcttgtcctaagtacagtgacttatgacctctaatcccaactacaggtctacagcgatcaaatcacttg

SEQ ID NO: 95832 - DNA, 650 bp, Oryza sativa
  unsure (1)..(650): unsure at all n locations
attcctgcagccccgagcagagagatattttcgccttgatctcgattacgcaccccgatcttttttatggtcgatctccaggctgtctctcagtctctcgcgtgttaatttggagtgagtacgtgtaaagccatttttttttntccgcggccttnaatggccaggctcgcagcggacgtccacatccacagcctcgatcgcgattcgcgcagcatgggttgtgtttggttggttttgcaagggtggcatgtgccgtgctagaatcggacattccgcaatgagaccgacgagagggagatcgctcgatcgatcgatcagtgaaaggtgctttagctagcatagcaagcgatagctaagcaggcacagtggttgcccgaccggttcggcgagatactactgtacaagtggatgatcgatcgagcagctcgcgggcgagacgaagctcgcgggcgagacgaacgacaagtgaagcggccgtggccactagctgtagcttttactagctcgttctcttcgtgatctcttttgggtgggaatcgaattttttgggaaaaaaaacccggttggggggggggggaaacgggaggaaggtccccatcgttttctctaatatagcattgctaaattttgtttttttagacttaatttta

SEQ ID NO: 95833 - DNA, 591 bp, Oryza sativa
  unsure (1)..(591): unsure at all n locations
accgaactgtaacacttccatcacctgatgttttggccaaaagcagtttcattacccacacgataaaaatggtattacttcatgcaaaagatgtatttagcccttcagatctgcatcaatgttggtgaactaatttatcaattttcaagtcaggtgggtaatggaactgtgttttgagtgagaatagtattttcttgtcagcgaaatgtcacagttcggtcctcttgggtattgcaaaatggagtacatatgacaacagtaaggtaagtttttttggctgctcnnnnnnnnnnnnnnnnnnnnncacgaacagtttgataaagcctattacggaatacttgtttgtttcaagtactggatatttgatgttacacacttgaactgaatctgtagcatgttattgtcttcaagacatcatactgcatagtctttatatccttagcagtagggactgtcgttattatgctgagttcagatctgtaccctggtgttcgtggactgaattttggatcccctcttgcagagttcatgtccaaggtcaaaactggaagctgaccgttggcaaaccaacatttactggaatttaagcag

SEQ ID NO: 95834 - DNA, 701 bp, Oryza sativa
cacaccactcatcctttcttgtcatcatcaccggacgcatgtgatggcaggtgacaaatagcattcgtgttctttgcttgctctcgttgttctgttttcccttttaattattcattttgtcttcatcgatcattgttttgatggatttggcttttcttttaagatctcacattgttgtttgcttttcatttaaagtttcaccattattggttttacttgtgtcgtcagtccatcacttggttttatgcttttttttacttggttattcttatatgcaaattctgtatctctttgttcttcggggctaactctctaatggatatcaaagaaaattgaactgggtgtaatttgatatagcttgactttctatgcttgatgcaagcatcattaacaaacacggccactgaaagttggtttgcgagctgattggagcatggtagaagacctcctcagcataatttgtttctattgcttcatgactctctcctgagtgtatgtcttgtgtaatgcactctggtatgatggtttaaaattgggttggtgagacctcagattcttccttcttccttggatcttctcattttcttttgatagtatatcgttctttggggttttcttatataagagtacattggagatcgctaataagagtggtgactgggcggctctggcatacggagattttaacggctctatgaaaa

SEQ ID NO: 95835 - DNA, 1069 bp, Oryza sativa
cggtcggttccgtatttcctttgctgtacctgttattcggcatattgctcctagactccaccgacaatgtatttatgtcggcatttcttttgtcatttacggtggaaaataaaccagggattctagttcttacacttctgtcatgaaaaataacttatgcaaatgcctaacagtatttctttggtgggtagtactagatatatgagtaaaatgcatggagggtcacctaacttgtttaggtgtgtcatgtaggtcacttcactttcaaaatacacatataggtcactaatgtgaattaagcaagtcatttgcccatctaactatccacatgagcataccttgtacacatggcatgccacctataattgaaaaaaatgctctcggacatgtgcagaaaaccgcatgtgtatttttttttcctttctcacaaccctagcacttggagatacacgaaattagggaaaccaaatcatttcacttatgcttgttttgatgagttcttctagttctcagtcctttatcttgcttgccatcaaacatggtgacggcggctgcggcgacaagctatgaatgtaaatagcaatggaggcaaaatcctaggtggcagcaacgacaagcttaaacagagatggaggcgcaatcctaggagacagcggctgcggatacccagccaatttttttaatcctatgtggcacgctaggtgtacaaggtgtgctcacgtggatagttagatggctcaaatgtgcattttgaaagtagagtgacctatatgacacatctaaacaagttggatgactctccatgtattttgggtttgtagatgctttttgttgttcttgccccttttgtattgacagccaaataacatctttaggctttaactgcttgactaaattttttgtggtttttttctacctcttttctggtggcttagttgtcccttgtggtactattgtgtcatttcacgatgtcaggtagtcattgccttcacgcgctgtagttaactagtttttcaaatgctatttgtctcccccaaggccctaactttatgtgcaagtatatgtttag

SEQ ID NO: 95836 - DNA, 2153 bp, Oryza sativa
atgtttccgggcaagcagaggccgtggcttgcagtactagtgccagtgggtgcaaggtgatcaatcgatcctaggctcaatactctgaacggtagtctagctgccacggctgcagctagagtcgtcatccgaaaatctgaaaagaacggaccctgaatcaattccaccggcaatcgaccggcaaatgatcactatcgttgagtttaattacaaacgtcggggaatagcagtgaacgtaaccttcctatacggtttacaagagtatttatagaagataaaagaaaaaataactaacaggaaaaggcatcaagtcctactcgaaaattaatctgaatatagtgtagacctaaattcggatcacatatttaacaatcgctaccttgagacgaattttctcttatagcataaaaattatcaatcaccaaaatacctcatgtaggcaaaatcaccatgcgccaaatagtatgtagaattaaagtattagaaaagttttggatggattaatttgaacaaaatcatagcgaaatgattaatcacaagttaatgccaaaaaccgaacaatctctatctccactattataaaaattaaagatgtttttgctggtactttgtttggttgtttgtttgtttgccggtattataaaaatctctatcccatgtatttttgtttgtttgtttttacactaaaatgcgacataagcgacatgttaatgacacgtgggatgaagaccgggtcaacactcccacgtaggcgccacgtcagccaaaaccgcttccaataccactaagaaatatattttgcattggttttgatagttggaggagtcgatatacccggttttttgtttggaggttttaagtcatacttggaccatagttgagggagtcgaagtatactttttccacaagtctgttccctcgctcatctctttgggccatcttatatttctagaataagtctattctgcatccctattctcttttatcatgccctgaattaagtctgttttgaatccctcgaccatatttttctttcgtgctcattggttcgtgtcatgccgggccagtccaccatgccaaggcatcaacccagacacggcccaactatcgggctaggccggcatgggtcgacaccagtcatggcatgccatgcttagaccgggccaaatagccatgctatgggccgggccgtctagcctagcttcgggccttatggccatctatatgacgtgctagtctgccgcatcaagagtgaggcaacgtcaatgtgggtgcctacacacaagcgaggagttagggtctgtcctttagccttcccgtttaaaattttacaccgtgatggtactcatgaggaaattaaatttgaaaatataccgttcatatcttttttttcttaaaaatatcctagatgcaaatctttggacacaaatataccgttggtcttgctgaaccgttgtgcaaaattgacgtgggatgaagatgcagacagtcttgtagaggggcagcgtgagaccgcgcggtgtcgagcgacgagcgtgtcaaaccgcgagcattctcgtgcaacaagtctacgaaagtgtttcgaaaattaaaggcaaaatttgctcttggacactcgaaaaatatggtctttgctgaggaacaccataagaacgtgtatttgcttgaggacacttaaaaaacatggtaatttgttgatagatacttatacgtattattttataatttttcgctattacagagagagaattttcacaaaatgacacttttgcccctgagaccaatcttcgtcgacggggatcaaatccggtcgactcagcaccaaaaccggcctcgctgcccgtcgctttgtccacccccgccatcttccacagcagttcgtcacggtgtgttctccccggggcgacaactccatccattcattcacaacaaagagcagcagcaagtggaaagtcgtccgtctgcccatcgcgacggcgtccttgccaccgccgctcggcgcctcgtccttcaatcattcgtccgcgacccatcctcgatgtccaatgccacgagccgtcgccagcctgtgaagtaacagcaacaggagtagcatttttgtctctgtttatgaagcaacagcagctgcgaagccaacatcctcgccggcggca

SEQ ID NO: 95837 - DNA, 672 bp, Oryza sativa
atcaaatggaagcatcagccatatccatatccaatccatccctctgccaatggagtagttgccctgcaatgcacatccacaggctcgatctcaaccattttcctcatcagaatgcctcagatagtagtagcaagtagtattacatattgtacatattgtgattgctcgagatcgtgttggtgtgatgatgagcgaaggggcgcggcggtggcagcatttatttgctgccggaaacggcatatccggcagcacaatgctttgctgcttctccagctgaattcgagagccctttcccctttcgtcgtattgatatttgacggccgatgcggcgatgccatattgccatggaagaaaaaaaagggaaaagaaaagagagggtgaaatgccaagaatccgagttagctttattccgattttggagatagatctcgcgtctttcctggacagcctacgtggaccctgtgttacgcgacgagaggccgctgctgcatgcgatgcccagcgtttgttctcttcttgtctgattttttctttgtaaaaatattttgcagtccagacagcacatagatagagagagaaaggtaggctgccatttgtgctgtgaacagttttgcagaatgcgatgccattgttctttcgcaccaaagaggaattgccacttgcgatctcagg

SEQ ID NO: 95838 - DNA, 2101 bp, Oryza sativa
ttcaagagattggcgttttttttttcaaatactaccattctttttccctactgctctagctggcctgtcgaaatcattcgtgacctgagttatcgttgaaagcttgatgccgtccgacagagacgtcgagctgcctctttttttctttttttttatgataatccaatggttttacatcgctctctgttaattttatgttttaatttcaagcggagtagcacagctcaaaagcttgtgttctgcgcggtggcgagacggagttgttttctggccggtcaccggctgcaagagattggcgttttctgatataccgcttttgtctcctgcttccagttggtcagtcgaaatgcttgatgcatccgacagagacatcgagctgtgtctcaagaatgaatcgggccccttttcctcttcttcccatgcggtttataaaataaatgctcgtggtccaagcgatgaaaaatgattttaaggtgatcctcactagttttaaaacatatgctctgatcatttaagaaaaatgaacaaagcaaaaaaagtaataattcacaaataaaacataaatatttgtgttattacggtttaaaagccaacgataaaaaaacagacttaaaaaaaaccctaaaattaaatctaattatgttcacaaaatttaaactttgagagaccaaggacctatttagtagggctctcaaactcataaatctaatttcaagttatggattggcccaaaccccacttcacctctttattcattttttgatcatcacaaccagctccactttctttccactgggactgaaaacgttaggtcgggtctgccctgagactaaacaaaaaaactctataatgttctttttaaaaaaagccttgaaatttagctgtgggcttaacaggaaaatttggctagttatctttcatcaattaccatcacctactagctgaataattaggagtatttttttttaaaaaaaataccacatcatgttctggttttgggggcattcttaactcaaaatcccaagttttataatttgcttcatgcaatcttacgttttagggcaaaatatttcttataacctttaggtccaagcctaaatcatccactttggctaatatttttcttttaaaactgtaaacaattgtatgagatattttgtcttcctccgtttcataatgtaagctttctagcattgcccatatacatatagatattaatgaatatgagcaatgctagaaagtcttacattgtgaaacggagggagtatataatataaatgtcagttgctttgcaactagcgttgatcatcgatggtttgataatttatgtgtatatttagcttattctcatgtcatgaattacgttaagttttttaataccacagtgcagaattgaggaaaagaagataaaatacacgagagggatgcatattttgagtcaactagtatgaatttatgtaaaaaataatcatatagtacctctattttttaatagatgacacggttaactttagaataatgtttgaccattcatcatcgggctaattcgatccatgccaccgcaactttgccaaattaaaaaaatactactactattcatcgtatcggctgggcgccactgcaattttgggaaattggatccataccactccgtcgcgttttccatccactcccgttgacgccgtctttccccgtccgaggactgagccagaggacaccaccactgactccggcttcggcgacgacaccgacgcaggcgcaagcggcggcggcggcggcggcggcttagggttctcgtggtggcgcaggcgcgagtgaaggccggaatcccgtgcggagcagcccccatgccatgacggcggttgaggacaccgcagggagcgatgcggctgctcctcgtcgcctcgccggtcgttcgctgcgaaaaggacctcgtcgtgcgcgtccttggccagggacgctgacgctgctggccggagacggtggcgcagccgcggcccactctgccgccttctccttggatgcctcggcttcctcaccacatgccccgacagcacgatggtcgccgagtcgacccgtgaggtggctttcgttgtcagcg

SEQ ID NO: 95839 - DNA, 1068 bp, Oryza sativa
tgaactgagagaacaatgtgtttttttaaatgctctataggaaagctattaaaaaatattaattcatttgttaagtttaaaataattaatagttaattaattatacataatagctcacctcgtttttcatatcttattaatcttctcctttcttcttcctcaaacaccccttaagtacgtaaccatatttattgagaccaaaatttcatatagactgcacaacttattttcatataatgttgttccaaaggctaaataatgaaccaaccccctctatattttaaaattttaatgtttcactaccatttcgaaaacactctttttcccaaaaaaaaaagattatagcatcccaaagaaaatatatatagtacaacatcccctcattaataaaattatagggggggtcattaaataatcggtattgaagggaatttttgtaaaattttaaccgagaggaggtagaagattaaaagtcaacttttttttagataaattttgaaccctagaaattgacttgttttgggagtaaggttagtttactttgaagtaactaaagtggaccgaccaaaatgaggtagtactactacctaattctgactatatttcaacatcattcattttttgaaaagtttagttcgacaattcgtctgtgtaacaaaccctctgtaattcaggacttgagtttccactaagcataaaaaatcagagctccatcggttgacctaataaactaaagcaaaagccaaaatttaaattttcaaacttgaatttaaagtttttttttggaaaaaattgaatttaaagttgattttaagatatttttaacgtaattttttccagtatagattttgtgtcactataaacaaatataaaagctttacctataaattaaattttatttcctaataaaccgttttgatttattagaatatacgggcgaccaagctctcagaaacaagcctggatagcaaacgtgtgccttgtggggatcaaaccctgggtgcacgcaccacgtccatttggataatcaaccccccaccgaccagagaaaaccaggtggaagtttgc

SEQ ID NO: 95840 - DNA, 2230 bp, Oryza sativa
catacattgacttatgtactaatgaccataaaactaatgtggcagagttctggtcttcaaagggattgtgttaatcaagagttcatgatagtttctcctttagtaaaaccaaatactactatatgataatttttagttttgttccatgccctgcgtggacccatcagccaatggagctcacgcttacatgatgtgtgatgtgtgctttgcttatgtggacattgtaatgttcatgagcaaatggctaggatcatatgttgggcagatcatctttaattgtgagaaattatttgcttggttccggtgatcctccacatatgcactattatttcttcatccacctaactatcattctcaaataatcagaatgaattcatggtacaagttcctttcttccttctgtaaatgcatggctcagatttaatgaccaaccttgcaaggctcaaaatcaaggactaccatgtcagcttttttacatgagcataagcagaagatgtacaccgatgcctccattgcatgaggtctacattagcaatagatgatctgtggcccactgtcactgactgttgtgtgttatggtttgctatgatgtgtgcatacttattgcctcatgtacagtatatacgcatggtgtttcacttactgtctatatatacttcaacacagcaagcatcatcaacagatcatgttctcaatctgaaacttttggagccttaggtctttgggatgagcgaggaagaggaagaaagaggtagtctaagagcagtgggaatgggaacatagaggaaaaatgagctctcagtgttcacttctggaagtggaggtggatatttgtctcagtatttttcccgatgcctcccattcctatcgttcttaggtgctccttcctcttcctttcagctcatagagatattttagttgagaaaaatatattaatgtttaggtttggatgatgagattgagagagtgggtcaggaagaggaagaatagagcacctaagagcagtgggcatgggaacatggaggaaagctcaaactcttctgtccctctaaaatagcggggtcgacttgttttgatgttttcccgatgcctcccaagcctattgtccttaggtactccttcctcttccctttggctcatataatctgcttggcagtagtatagatgatgaggtcttgaaggcaaattgggaagaggaagaaaaagagcacctaagagcattaggcatgggaacatggaggaaagcctcaaccattatttccctttaaaattaggggtcacaatatgttcctgtgttttcccaatacctcccatgcctattgttctcaggtgttcctttcctcttccttttggcttgcacgaagttatcaaagaggggaatcaaggatttgccagttgccacttgccagtttgccactacaaaagttgccatttgagaatatcctaacccagatagctcagtgaaaaaatctcaagtgtacccttttctcgactttttctaaacaaaaggcagcttcatggttcagtcagtctcagaatgaatcatgggcagaccctcattttgtctcgaaacattcataatgccgcatggcttttaccacttcaattctaacaaataaaatactaaattgagtgcgttctattcccaaaaaaaatgagtgctgcattcctatcactctagctcccacatgtttatcttccagctcctgtgctccactactgcatgagtacagtcaactgaacagagatgttaatttgccgttgagttttctcctaagaaggtgaccaacttgatctaatacgattccactaaatctaacctgacgtatgtacctacaaccaacaacttttccgtgaatttagaaacaaaaatacctcacgggtgggttggcaaaccatcaaacaaatcattttcacgagccaagcacagacacttgcattgattcgaaacacatcgcataaatcacaggatcgcattgcatcacagattctagttgcagaagagcacgagagatggagaagaggaactcacggaaccaactcgccgcaggtcctcggccggccgtagctgaagcgcctccaaccgtatcccccgcgcgcccccgctgccctcctcgcgcacggcgtgctcccctcgctctccgatccggcgagcggcgatgctatgtcggaagcggaagctcgcggtcgccgccgacgaagaggcccttcccttctctctttcccgaat

SEQ ID NO: 95841 - DNA, 580 bp, Oryza sativa
cctgcagcccaatgtctatacaagattacagtaacacttttgatttgattactcagtgattcttaattctgcagtaacatcttacaagacaggtgggttttaccaaatgaaactatgcaaaacaccatcaatgaggtgataaagaaacagaaagtgggtgtcgtcgtatatccaacagaaagttttgcaatttatgataatgccctgagaaggcttactgaaatattttatgtttgagctcataatcccagagcataccacaaattgaaaatgggtaacttctgaaccaaatattgtaatactgacatttagaagcactaaagttcaacagaaattcactgatttaattgtggtatgataggctcatacatgcatagtaccattgttatgatcattctgtctttctctatttacttactataaaaatatatactatatcaagtgctgctaggtaattctgttatcaactcaaaccatgtgtttgctctttaaaggaaaagtaaaccactagtatggtcaacaagggaagtaagatatccagtgtggacagagactaaacgtaccaaagtgtactcaacac

SEQ ID NO: 95842 - DNA, 721 bp, Oryza sativa
cacttttgcatatctacgtcgtcgcatcgacatacttaagttgtcatactttaatacatcctgccgaattatcagatgggcatgctcaattttaaaactagagtaaagtacacattcgatccttgaacttgtacggttatgcatataagtctctaaactttcaaaatatatattcaggttctaaaacttgtcaaagtgtattttctgatctccaattaccacggtccctctgagatcctatatagtgctgacgtggcatgccacatagacgctgatgtggcatattcaccaattttacacggaccgacccattgaagcccactaaaaaagtcctccttttttctttttagagtaaattacacagacggtacaacaaattgacaggtgatatgctatgtcaacgcctatgtgatatgccacatcaacgtcgcataggatctagcttggatgagctgtggcaatttaggaccaaaatgacacaatttgacaagttataaaaaaattgtattttgagagtttagaaatctaaataacacaactgcacaagttttgggaccgaccatgcactttactcttaaaactattatatcaaacatactgatgtgccaatttcttagaactagtgcaatttaaatacaatgatactctctctattatgaaatatataagcacttctagctatctatatagaccaggtcagctttctcttagaagcgaattt

SEQ ID NO: 95843 - DNA, 2047 bp, Oryza sativa
  unsure (1)..(2047): unsure at all n locations
cttgaacttaattaatgtgcacaacttgctctagaagtttgcttttgatgcaatatcctctcatagatatgccatgtttttatcatcttagcaatagctttcggcacatccttttgaatgctcacgcttgattgttcatgggtgcatcaattatgttctttctatgctttatgtgttttaccactgcttttgtcccaggctactgagtgtgtttacgcataagtagtgctgaagatagcactgagactacctgtaacaggagctctaactggaaaacttgtttgagatttgatgacactgtttggcgccctcatcactcgctgactgataagattaggcgtaccatcgcgattgtgctatagttttcttcaaaaatccgaaaaggaataaaatgcaaatgtgatagagctaaaagcccatgttctatgttttattaccatcttgatactctcttgaactgggcattagcatggtatcatgggttcatttttgtttttgataatgttaatcttgcatatttatgcgttggattgcttactcttaagcttcttctgaatagcatgaaagcttgctagtgatataaccttgttgctcttgtcatgtttcatacttcttttgtatatgtctagctggtaacctccaaagttcactcaaattaaagtttgcaatgtctcattttttgcatttttgcatgtcatcattgccaaagggggagaaatattcagcnaaaatgcaccttcattgagaatttaanaattttgcttttagaaatctttggtgaaaaggggagttaggcacatagggggagcattcttgcatttgcatcatacattactcttcgcgaatcccgacacctgcacacttgaccttgtgaagcccgttgcgaagtcctcccaacattgtgtccgttcatcgtgcaccgcattgtattcaagcttgtcaaccggcatccctgatcgttctggacctcaactcctccctgagtttagtctcgatccgtcgttgaccccggttgacctctaaggatcctgacgtcaatcccaccttatcacatggcctcttgacctcaccggactgctcctccctgagcatagttctggtccttccattgaccaagattgaattcgatcacatgcacacacgtaacaaaactaccgtttttcgggcacaaatatcacatcctgacctatgttagtcaacacacacattttcttcacttttgacactctccattttcccatcacaatgaatcaaaaccacactttgtttcacagttgggggtctatttataaaataagttttgtaaaagagccacattgtcaaaaatctagaaggtctggaaccacgaaacagtacaaacttcgtatttctatggtagaaacatcaccctattagtaaatgtactgtgagttagaactctagaacctctgggaagctcttctcaccatcagtgcaattttgtcatttgtctattttgtttactaattgagcagttcacttggcattcagcatcagagcatgtttactcatgatgattgttttttatacttgcagaaaaaaactatctaattgaattgtcaatttatcccttgtttcacctttggatacttgttagtactgtctttttacggacccaattacctctatccatcatggacgtattaacaactgtttagtgactggaaatgcttggttatttgaatcatagaaatgcctaccaaattagcaagtttcatactaacaaatgatctgagcaaccctttggaacttcttcacaatccaatttagaaatgatctacacgctcaccatctttgatcttgaccgtccacgaagtttgtccacatatgcaccataatagtttcgtatgtgtagtttgcattgctcttgagctgtgcatagctgatgatggagagaatgcaccaatacgatgtttggtattcgccaaaagcacattgaaataagtgtgtttttgtttttaatttataattttctgcacacatcacatggttttactatccttcgaaaaaatacggctaaaccgtctct

SEQ ID NO: 95844 - DNA, 1486 bp, Oryza sativa
attcctgcagccctttcagacttgcaataccatttgaggaattaaggtttttgacatatcgcaatctgtctaaggaattaaggatgtagacattcagttatatgcaagttatatcttgaccttttattttataattgaatcatcgcattggctttttacactgacaactcgaaagacatgaaaatatggaatgaggtgctaggtcagacaaaaattttgttggggacgccatgttcaacagttaaacactccaacagttctgttgattttaattctagactctagactctagagtctagagctcaagaaatgaaaatcagataggatgttaaattgttgctgctgggtttgtttgtttgatctccctctcctattgttgtatggtcagcttaatgtcgagcttttcacttgtcttcctcaagatgaactttcaactttttctaataaccttatcagtagttaatctttttttttcagatgtatgaaatgttaattttctgatctaacatagagctcaatgagcagactggccttcactaatctcaaatgtttgttctggattcttttcactattttttttatttcttgtgtattacgacatgtggcttatgcacatgtgttatgccatcagtgtacacaaggaactggacaaataagtttggctcggtaattttcatagagtattttataatcatcgaaaactattaacttgggtttaaaaatacttctaggattgccagcatactatggcggcgcaatgtgtggtgggaaacctcacaatgctggttattctgcatcctgccacctgctggcataacagccatcaggagtttagtacctggtgactagacagcctgtcaacatggccacatgggcgtttgcaccatgaccccaggtcatgtggaatcacctgtttttatttacatatgtttaagaggacaggaagtgaggaaacttacagatttactgttgcttgggtttatttatggcatcatataaatatttaggctatttctatgaaaatacaatgtccttaaatactggtatataagtttagaacaatctctctctgatctttattggtaattgcgttctttcttatctttttttgtttatgcagttctctgaatactgaattttgtcaggttatttgcgtcgtatcatcctctcagagatttgccattttacaagctctccacaaagaacaccatattctcctcagtaagatcacaacctatatcctcttaaacatattgcgaaaatcgtgatattctgtgagctccatgttttgatgattgagataaacaaaggcttaaaattcatccccacgaaaaattatgggcctctatttattgttcattaccgtctcaagttgtcacaagattgtagcttcatttgtatttcattatatttgaattctgaccaggctgttagattgcaattctcctagatttttgaagattgaaattttggggggaaacatcaa

SEQ ID NO: 95845 - DNA, 3115 bp, Oryza sativa
atacaacacaatctaccaaatctaccaaatatacacagaaatatcacgagcgtagtttcataatttcattcacaaatcataaggcacatttggagtcttggagatggaacaatacctctaactctctgtgaatcgccgcctatgcgctgcaacctcaccgccggccatgcctgtcccctcgccgcacccttgcctgtctcgccggccgccgcaacctcccgcgcctgctttcctgccgcgccctgtgcaccgccgccggcctgccgccctgtgtgccgccgccgccgctaactccgaagggagaggtggagctagagccgccggatgccggaggggagactggagaggaggggaggggagatggtggcttggcggctggcaggcgcaggcgaagccagcgacaccgagatccagaggccagagcgcgcacagccgcctccgcctatttctatctcacgggaggggaggggatgtggggaggagagagactgagactgaggggatgtgcatgggctagggtttagtaacttttttagtgggttgggctttttgggccttctttgatctatattttgaagtttatatgtaccccggggccccgcgggtgaaattagtcccccgtcccctccccgcccaaatgcggggccctgtacctgacgcacccgcgggtcaaaaatcacacccacccctgcccccgtaagggcgggtccctgcaggggacttggccccgcgggggaaattgccatccctacccaacacccactataggtggccaaataggccaagccaccccatgccagccgaggcacgtatgaactgttcatggtcgaggaatgacccagccccgacccgttaggctatgctagcatgtaccacctagccgtgctatgctcggtgtcgatatttcttaatgacattactagaaatataattcctaataatggcgcataaatactcctggtatattatggttacagattttatccgcaagcgcatggatataccattgtagcatttcacccgagagtattccaagggtatcgtatctgtttatcccgtgggaagattataagggagagaaccatactaataatttatatattacttgtaataaccattgtctaagcaggggttaatataagcagagggtagagtgacacacaagcataagactactcactctcatattaaattatctgagctaagtggaaagaaaatagaaaaagaatctattcctatactttctaatatactctctccgtttcatattataagcctttctagcattgcccacattcatatagatgttaataaatccaaacacatataaatgcctagattcattaacatatatatgaatgtgggcaatgctagaaagtcttataatatgaaacggaggaagtacatattatacatacatcctcgctataagattaactctagctaataccctatttccgatgccctcttggtacttcgagaagccacccctgactgccgagtttcttacggcagcccgtcatgaccattcaaccggggctaaatacggaggaataccctccccaggaaattaacttaggattatatactcgcgcggaggaatacccatactgagctgtcactatcagcggcccaccgctcttccacagcatataaccccaaataatgatacccagtaatctagacaccacgcctaaactaccagatactactctaatatcatcgtcatggcatagagtaattgcataagcaaacattataccgcaccattgcatctcccagataagctagcagtataatcaacataacttagatataaagtaaagttggtatttatatactcagaaagtagcacaatactagagttgtatacagaagaatattctaaataaagtacaagtcttacaaaaagaagaaaggagagctgctagagccatatccgaactcttctgaagacttccggactcagacttctattctattcctactccactagcttgagaatattaaactaatcttgagagagtatgagagagcttgcttgaggtgtgtgttgaaatggaggatgagagggctttatatagcttgagaatgacagttatgacggttggaatggtcggtaataccctccaaccgtcattggggagtcatctcaaccgtccatcctagccctggatcaaacggtgccacggcgggttcggccgaaccaggggccagcccaaccagcccaagttttggctggcagcctcctttcttgatctctttcgcagacttgtgaattttgtcccaattcgacatgtcatttctgagttcttggcccattcatgcataagtctaattcccgacatcgtccaattgattgatcgtctgttttgatgttgattctcctccatttgtgttcattctctgcaagaggttagtaatcctagtgctagtgaaatatttattattctaacacaaatatgcattgcaagcataactagttctcctttattttggtagtattgacggtcaaaactgatcgctaacgaccatcaacacttgggccgccaccatggaccacgtgttggcaagatatcgttgtaacaagctgacatggcgcactgggtcgcgtggcatggtagcgagcggtggtggcaggcaccaagaatagagaagaggagacgacatagccttggctgttagtgtaggaatggagggcaggaagctttttggtggtgaccggcgagagtggagatcgtcgacgaggagtaagaggccacgggggcatggagcttacaggaagtggcggctgggcgacacaaccaagatgcccaatgttccacccagtccacagagcttgcttcaagctgccttgcagggcggtgttggcagtagaggatgcggctggtggcgtcagtgacagaggatgtgggcgttggaggcggcaggaaggatataggagttggcagtggtagcggacgatgtgagagttggtggcagtggtagcggactatgtgagagtcggtggcggtggcggaggatacgggaggtggcggcaagcaaaaccctaaccctagttgtatctatgactgaacttttttttagcaatcgtccgagccttatacgagctaat

SEQ ID NO: 95846 - DNA, 696 bp, Oryza sativa
gaattcctgcagcccgtttgaaatgtaagcaaacattttcttttcacaaactagaaagcataacttcatagaaaattatgggaaatgggatttcagaagtaaaaaaaagctttaaagtccagacgaaaattccaaaaagagaaagttggtaattgaagaaatcaaattgaaaatactaagttaaaattcaaggattaaaaaacaaccggtaagtgaggaaccacattaatgttttaaagtccagatagtatatccaaaccattaaagagaagaacgttcaaagataaagaaattcaactcaaacgattaatacaaaagaccttcgaagattattaaatccaactaaaaacataaagtttaaacgattaatacaaaagaccttcgaagattattaaatccaactaaaaacataaagtttaaacgaggacgggaaattaagcgtcgaggggcaaaaaagccgcaaggttgaaatgtgggcaaatgttttctttcagcaaactagtaagcataagttcaaacaaaattatgaaaattgtcatttctgaagtaaaataaagttttaaagtctaaagggaagttccaaaaagagagtttggtaattgaagaaatcaaactaaaaatacctagttgaaactcaaggatcaaaaaataaccggtatctaaggatccaaattccaaatagcagatcaaaaccat

SEQ ID NO: 95847 - DNA, 675 bp, Oryza sativa
agtctgacaccgtgaacgtactgtatagtttttaaaataaagaaagaaagaaagaaaattgctacatagtctgacaccgtgaacggttaaccgcttttgctcaaatctgaaaccgatcgtgcctgtcaagttctattgcgaacgtctttctctccgctcgtttgatcccttcgtgactttaggcctgtttgggaagatttagattatgagaagtttgatcccttcgtgactttaggcctgtttgggaagatttagattatgagaagtagctgtttggtagtttggtagccagcttctgaaaatctaaaaaagctctgaaactcagcttctccagcttctggcttcttagtttggtatcttagtttatttttcagaatctataactacagattctcagaagctgtgaactgtttggggcagcttctagcagaagcagcttttgggaaaaactgtagcggggagaagctccccaaacaaggccttagattctgagaagcagctgtttggtagccagcttttgagaatctggaaaagctctgaaacctaacttctccagcttctggcttcttagttcatttttcagaatctgtaactaccactggtggagaaaccatctttcgtcggtcgggctaattccacaatagtcccggttacaacaaagatctttagtcccgg

SEQ ID NO: 95848 - DNA, 682 bp, Oryza sativa
agtgtcgctgtgaatatcaaataaaattacattcacattttcatgtcgactattaaatgcttttggacatagacagttaaagctacaaatgtctcactgaacacattctgggatgatttacattgcatatcagagggagcaatgtttctttacgattccctgtgcttataaaaatggattggaagtcaatatccctgagtggagtggttttgtaagggaaaaaaccaaactgacccactctgtagcataaatgagtatgcatgtgtgcagatctgatttcttcaggtcatacctgaaaaactaaattaaagacatccataaaacaaatctgcatatgaactgttgcacctcatgtttcgttcgtatatatgctgtgcaccactgaaatatatatgtggtcacacttctattggatcttgactcttatgaaccttacgtgctatcaaacaagggaaaatttttaattatttttaaatcatatctattacaaaatattagtattaaactggggtttagggagtattagtttttcatctaacatatagccttctattctctgttcttttatggcttttagttgagacgaagggatgaactgtaaatccagtgattatttgctactggaatatactaatgtttccgttttgattaatagatgtcaatagaacggtattactagact

SEQ ID NO: 95849 - DNA, 570 bp, Oryza sativa
tttaaaatttaattcagaaatttagtagtacttaaattttcgatagtatattttgaatggaaactttacgtatagaaactctttacgtataaactttatgcacataaatattacatataaaaactttatgtatataaactttatttacgagagtttatatatttagttggaaagtacgatgaaaaatttgaatgtaatttcttttataaaataggaatgtaattttatacatgtacgtataaacagtatgtataaaaattatatatacatatgtatgtatatatatacatatgtatatgtatgtatatatatacatatgcatatatatatatatatacatatgtatatgtatatatatacatatgtatatgtatatatatatatatatatatatatatatatatatatatatatatatatatatatatatacatatgtatgtatatatatacatatgtacatatgtatctatatgtatatatacatatatatacatatagagggtgagactattctataccccctccctccctcccactatccccccttcctctcccgatctctcccgct

SEQ ID NO: 95850 - DNA, 917 bp, Oryza sativa
gggggcgttccagcccaacccagccccgccccgccccgttgtcatccctagtgttggggtggctagactggtgtggctacaggcagctgatctggagatgttgcatgaagagcacagggtttttacgtacccccgtcctcgcccacggtgctggattccccactaggcggacggacacagcaaaactttcatttatgctcatgccgccatcaaaattaacaatcgttgtagtttttctgtgaaaatatgatccagttcatctataaatattcctagattaatagaactaagccctgcaaaaaaaataataaaactaggaaaaatttactacaagacatccaaaaaaaagtgtaataagctaggggacaccataagaacatgtatttgctgtaagacatcgcaaaaatctggtaattagctgctggacacccgcgtcattattttattattttcggaggaataggaaagagaaacaatcattaaagacaagtttgcccttggctcaaatgaatctaatatgggccccacatccagcagcaccttcactgcaagcctcgccgtcgttggctcccgcacagccgccacattcctcgccacgacggcgaccgacgctgcccaaccgtgccggcacaacctctcctccagctctggcgccacctccgttgcatcgtgacggccttggcccttgcgcatgactgtgcagcgccgccccagccgaggtgccgcaccagcccacgctgtcgccggtgctctccctctccctcggtgtcggtgtcatggggccgggggtatcgtgactagaggcttgggtagccgcggtcacccacgtggcctgaccccctcgggggggtcgggcccgagggcgacatggccacccctccctctgtctccccgaggggtcgggccgctcccgtttc

SEQ ID NO: 95851 - DNA, 1135 bp, Oryza sativa
gtcagactatgtagcaattttctttctttctttctttattttaaaaactatacagtacgttcacggtgtcagactctgtagcaattttctttctttctttctttattttaaaaactatacagtagtgcaaatcagcatcagctggagctatcaatcaaagcaaccgataatcccgatttggtcactaatccccaactaccctctcacaacaccacatcttcatgcgagacctacattgggcccaccaacaccacatcacgcaatttgaatcctctgcattagaggagagaatgcagagggagctacagtgctctgcattagggtgtgttgtttgctgttggattcacatccaacggcctaaaacaaatcgctacagtaggtctaaacagcaaatgggaacagtaatcaggcaaacagtagaaagattactgtttacaaattattttgctacagtaccgaaacactgtttggtccattaattcactgtagcagactcagaatactgtagctgcagttcttctctgctgtactgtagaggacctggatcctcacatcacggcatcacgccatttttcacaccacagctgctgcccatgaatgcccattgcaagcgaatcattcatcagacgaccagctacttcctccgtaaaaattttcacaatagttaaggaaagtaaataaagggtggctgtgatgggttaagatgacaagatattaaatggttgtgatcggctgaaataagaaacggtaactactccctccattcctaaatataagaaattttattttggttcaaatttgttgtactaggatacgtcaaattcaaccaaaatcctagacaatcaacatcaacaaagaacagaagcataagaaagtaaaccaggagaggcagtgaaacagatgtacacaaactgaaacaaagaacaaaatgtatgtaaatatattgttcttgcactgtatcagttccacattgaagtgaagattaaaacagagatgccttacaccgatctgaaggcaacagcagagggcactgggcaatgagagagccagcagaataataagatatgatcaagagcagtgcaatgaacaaggctgactagaaactaacctgacaaattcaatgaaaccacctaag

SEQ ID NO: 95852 - DNA, 630 bp, Oryza sativa
ccgggactaaagatcgtaactttagtaccaaccgggactaaagatcccggcgatttttagccccggttcataacaccaaccgggactaaagtcccacccctatatatatgtcttcttcctcctccagcccgagcaagcttcaaaatttcttcaaaaaagaggggaggtcatgccaaaatttctagtgaatttattttggtgattatatacaaatcgaaggtgcctaaaaggttagcaacttcatcctccaatgttttttttttcatattacatttggagctatgttttgcacacttttttgtctccaaaattttgttgttagttgatgagagagaaaatttgtgtggggaaaaaagaatatatagaaatttagtttatttgctaaagaaggttttataaaatagttgagaaggaaaatatagtgaaagataatcttcaataatagaaaacaaactaaaatgaaaaattaaaataagtacaacacattaatattagttttaaactttataaatagtaaatatataattatttggtgtaatatttcataatttttgtatgaataatgatatgtcattattgtgtgactgttgaaagagtttgtaattattttataattattgtatgactgtc

SEQ ID NO: 95853 - DNA, 803 bp, Oryza sativa
tacatattaacctatcatgtcaatttttttgaaaatttttcataactatttagatgacatgtaagaaacggatggacgtctacccgagtgtttaaaacagtttcccctataaatgtctcaaactctcacccatatgattggaggcaaatacagtaagcaaatactaaaatgataaaagaaggttcagatgcacgagtttcacctgccagaagaagaggacaatcttgctgggcaaaactggacccaaccagttcaaacttcaaagcaagattggttttgcgataataagaaaaccggtttcattgtgatgtccagactctagcggttgttcccggcgaacagttcaagtcaataccatcctgattctcgcgcgccgagactttagaatataactccccaggtccagcgcaatacagtatatgtagctaagctgccggctgctgcatgcgaagaattctcactcgccggccattttttcgcaatgcccaatcgtttcctcgcggcggcatctccgcgctcatcgtccgcgtcgcgtcggtctccgcgtgcgtgcaggtgcattccgggcagacgagacgactctgtcctagcctcctcagccgcgagccaaaattcagaaaaatccgcaacaattaggccctgagccatacacgctcgtacgatcgagttaccgccggcggctggcgtgccagacagacggtagtagtatctcatattctcacgtctcacgatcgcaagtgtcaactgtcaaggcagcgaagtcaagcgagacgctgaattattccccggatttgtcagcctgt

SEQ ID NO: 95854 - DNA, 576 bp, Oryza sativa
tatgtcacatccaaccaaaatatcttatatttagggatggagggagtatatccatattagattattccattttggtcacaataccgtactgtcggtcagaaaatccgaatcttcctgagaagccggacatggatgaaccgatcatcgatgaactggtacgactattcagcaggcagcacgggcgaggaatatgcatagtggacaggacggtgacgttgaagcgaacaccgtaatagtagtagcagcccaagtgctcaacgtgctaaacgcttatacgcacggctcgatcgatcacaggagagacgtcgctcgcttccttagttgcccggcctgccgcgcggcacgagattgaattgactgccgcgtcgtagtcgggcgccggccggcccggccgtcggtgtcaccggtcacccacctctccgcgacgaggcgtccgcacgtcgtcgtcttgcttgctctcggtggcggcggctagcggctgtctcgtcgaccagtatccacaactcgcgctgcgcaggcgaggccgtgagggggaattgcccgcagaaactctggtgtttgttgaatcgcacgcgg

SEQ ID NO: 95855 - DNA, 596 bp, Oryza sativa
tccaaacttttaatttaaacacagcctagctagcaccgattggggttagcctgaagtactcactcccaccattttaaattactactcccttcgtaccaaattataagtatttttagaagagtgaagttaaactttttaaatttaactattagtagaaaaaagtaaaaaaaatcaatcatataaatttaatgttgctagatttataattaaataaattattataatatataactctttttacttaaaacatattacttttgtagatattatcggttaaagtagtatcgttttatttaaaaatgatcatattttaggacgggtgttttaagtttatcttaagttaaaatatgtttatctttgctcattaatttttaaaaatccgtgttttttaataacttcatctaggagtaaagccacagcgatgcttcagtcagtgtgagcgtcattggctccaaactttcattcattcaatcaatttacagaatggggtccatcaaggtcgtcaaggaattaaaagataagattgggagcacaacaaacaaagttgggcacatcaatagtggaaatgtggaacgtagaaacctccacagaaaact

SEQ ID NO: 95856 - DNA, 681 bp, Oryza sativa
ttcctgcccccctgggttgtctacgtctagatactagatatacagttttagcttgatgcacactggtagtagcaattctgagagaagtttggagtaattctgagagaagttttgccaggtgctcctgtgaacagtactaattgagagaaactattatagtgtatcatattaccatcgaagaacatgagttaattggtcataaaatcattgtgcatttcgaatactagcaaggttatatatgtcttactccatatccattagcaaggttattccgtcccaaaataagtgcagttttgtattggttatgtttaacatttgatagttcatcttattcaaaaaaaattatgattaattttttattgttattagatgataaaacatgaatagtgattatttttttataaattttataaataagacggacggttaaacgttggatacggatattcatggctgcacttattttggaagggtggtagtagtaatcaaggtgataataatgactagtaattcttgtcgagagatactcaattccaatgtcatcacgccgttcgaaaatttaaattctataaaactactcaagtttcttcgtgcaaaattttttacaatgtttatgtgaaatgttattatcacaagacgataatcttgagaataccaaagtatgaagaacaaaaattgaat

SEQ ID NO: 95857 - DNA, 702 bp, Oryza sativa
ccaacaattatggtttgaaacgtcgaggctttcatggacgtgcctccgcctgatgggacgagtctggtgtagcccgcacgatgccgacatcagctttctgctgttcgaagcagaccgaacggctgacctcatcggtcgtgagttgccaggcggagccagccagtacctgtagtgcgctgcgtaacgcaatcgggccgagtcggtaatgggctgcaggcagaggccgagtgaaaagtgtctttactggttcggtggtagggcagagcgaataacccgagcgctgcagcacgtaatgcatcgcctcctctaccgagggattaaggttggacggtatgctcacatcaattatttgagcgagaagatcacgttgctccgtagtgggctctgtgctcaccagggtatagcgaccataacggatctccgccggatggtttgcttcggccgggctccttgataattgggtccgattgagccactgtcgatctttggattagtcggcaatggggtggaaatttgcgcgctgcaggcactcaaaaaaaacagcaggcagacaggcgtaaaaaaacgctccatgaaaaaacctcatgtcagattcagtacagaacctgacatgaggtgaaggatcgattcagtgagaaatccgatttatggcaggtcgtgttaacgctaaatactttgcactgcatcataggggtgcaggaa

SEQ ID NO: 95858 - DNA, 631 bp, Oryza sativa
tcagctcgtagcgggatagccgacggatattgcgccgatagcgcaacacctcccatgcttgtcgcaggcggatcaggccgaatagggtataggccagcgccgcaaccagcccgatctcgggtgacagggccacagcccagggcgagtacacgcacagtactgcggcagcgatgcaaattgctaccgtgtaaagctccaccgcgggacggagcttggactccatcgcatgctcggccatgaccttactcactgctccaatgatgtggcagtgatcaagacagggtaatgctcaatctgcaggcgggtggcgatgtcgttaccgttgaccggtaggatggtgacactaggagcggctgctcggatccgagccaaggctccggtatcggccacttcgacggcaaggccagccgcgccgatttcctgcagctcagtcgcgcgttgacgcaaccaagccagtgattgggtatcctcacccaccaggaaaaatggccgtaagcccggcatgtttagggcgcgagacgtgatttggccggggctcaagagggagctgcgaacgggtaatatccaggtttcatcggcaaatgtggacaagtccgtatgcatggcgcgaccaggctggagattgttgttt

SEQ ID NO: 95859 - DNA, 575 bp, Oryza sativa
tcctgcagccccaatttatccaaataaacaattcctataaaaaaaatttaaccacccaatgatcaaatttaaccaagctacaccacatctttcgttgttttgttctgtacatatccaagaacatccaaacaacaagtttgaatgtttaacccatataattaaatttgcaaaagtgaaaataaaactatattattgcaattcagtgaagggaagtaaaggagaaatctagccagactggtggaaacaagataattattgctgttcccggcaaagactcaaatagtaatagcttagaacaggttggcaagtggcaatataattaatttcctatattctggaaaaaaacaaaaagtagcacaaagtattgtaaaatgcaaatagagataataaagtaaggaagataagctattccatgccacacaggaaaagagcaatttccagggcaaaagagttgatttatgcgcaactattatataagcgagataggagggcgtatagtcttttaaggaggaaataaacacccaaatttcgagctaaagaggtcccaaacctgggttgggggggggggggggggt

SEQ ID NO: 95860 - DNA, 584 bp, Oryza sativa
gaatcagtttagcgtggagagccggagtcatcaactgctgagaggaggatgcacgggcggcgatgcgcttgatcgatgaagtgaaggtgcattttaatttgatgacgtcaaccattttaatcaccatggcgagtatatttgttcggatttatctcgaattcagcatatgtatagatagataaacaccggtggagaaaccatcttttgtcggtcggccgatttccacaatagtcccggatgcaataaaaaccggggctaaagatgatctttagtcccggttcaaaagggaaacgggtatatttgatctttagtcccggtttgtgttaccaaccgggactaaagatcatctttagtcccggttcgaatgttgtcaggacctgtcaggcccccccgggatctttagtcccggttggtatcttaactttagtcccggttgatattaccaaccgggactaaagatcccggtgatctttagccccggttggtgttaccaaccgggactaaagatcttaactttagtcccggttggtgataccaaccgggactaatgatcccggagatctttagcccctgatggtgctacc

SEQ ID NO: 95861 - DNA, 561 bp, Oryza sativa
ttagtgtttcttatcttacgctagtttccaacgttatttttaaaaccacaatcgacatagattttctaaaagttatatttacaaattgtttcccttcattcatttttaagctgtagctcaaacgagagaaaatttcttctataatgattaaggccccgttattttccacccattagctaatatattacgaacatgttttccaagccactaaacaacatgattcttttagaagaactttccatgtaaaaattacttaaaaatttaaacaaatctatttttaaaatttatgatatcaatacttgattgattatgtgttaattgaatttcttctctggcaagtaggccaaacctttcaaacgaacagagctgcatgtttctctgcatctgcatgtcctgttttcctgattccagaccacacgggcttgctctgtgtttggtaggtcgttgggagctgagttttgctgacaaaatgctacttacatcgttctcatccgatcaagtgcgtgccttgcaagttgcaacaaagcttattactagatccaaccatttcgctgccagcac

SEQ ID NO: 95862 - DNA, 656 bp, Oryza sativa
ttctgctagtacgttcgtctagttacgctaagcgcgggtattatattgctcccctccacactctctcccatctttgtactactatatatagggaaggagggagagtgagtgattcatatatgacctcttcaaaccaaaccaaaccaagccaaagccatgcataaggcatccatatttcattttattaattagtttcttcaccgccctttgcgcgcctatttttgtcatcaataacaaaagttgcagacagttccatggataaggacgtgttctatgattttttttatttgtatttcagagattttctgagactagatgcctatccagaaggaataaaaaaacgtccaaacaaaacttcttccagaacctggctgagagtatcgttatatataacattgcattttttttctcatccgttgggtcgtcttgagatttgtgccatgtgagaaaaaaaaaccactaagcaggtacctcttttttttttgaaaactcaatataatattatagattaaagacagagttcacatgaagtaaatccatgatacatcgtccgaaaataaaagatctcaaaagcaattttccttatgaaaaggaagggaaacttgactacgaaaaacaagcaggtacctgaagctaggatttaaaccctcatcgtc

SEQ ID NO: 95863 - DNA, 659 bp, Oryza sativa
ttgtataacctgatttctgtttctgtttgctgcatttgcaattcgctctgttggacacagaaaaaatgtatcgcacaattagaagaaaaatattttgtgctccaacagcaactactgaaagtatggtgtgctcataagtcaagaggcatgtacctgaggtagacagactatctgctcgaccagtaagtgttctttttgactgatcaatttcaggagcttcttcagcttcatcatctgatatgacaactcgaacacgctttctaccagaatggttgctaaatgatttacttacaacttcttcagggctcccatccatgtcacatgactcatcaacattcttcggactactatgtatcttagatgctttggtcttagatgacttacttttatgaacaagtgaggcaagaacaacatcatcatcaaattcctcagaaatattatttgcaatattcccatcattgtcctctgtattgaggatattatcagatacattgccatcttcactttcagtttctgagcaatagtcactaactgtatcccttgcttcatgttgatcagacattctcttcaggctgtctatttcttgctgcagtttcctgaagttatagaatatattttagaacaggttttaataagtactttctttgtgcagagtatgt

SEQ ID NO: 95864 - DNA, 621 bp, Oryza sativa
cacttacaaaattcatttttggcagggtttttgtgtaagtagaagcactgtgacgaccgacgaagtggctacacatgctttcatgtgggtatgcgtgctagaccacatcttagatcgaaaagatcagtcggcgaatacgtcgaagtttcgttcgtttcctgctgctgttgatcgatgcagcattaaacaatgagcaaaaacagtggcaaattgggctggatttcatactcatactatattcatcgttttgagaaaataaaacatgtacaaattagtattacctccgttctaaaatataacaatctatgactgaaaggatcataccctagtactacacgatcttaagttactgtattttagaatggagagaatactataattgtagagatttgctgcaaacagtgcctactatctctctcttaaaaaagtactattgttgaaaacattactactctctccgttttacaatgtaagattttctagcattgtatacattcatatagatgctaataaatctagacactattatatatatatatatatatatatatatatatatatatatatatatatatatatatatatatatatatatatatatatatatatatatatatatat

SEQ ID NO: 95865 - DNA, 621 bp, Oryza sativa
aaaaaacagttgttatctagaggcgtctataaatcggacgctgcacgaagtagttcggaattgtttaactacgtagattaaaaaaatgtttcaatcgttttaaaagttgaaacacaacaaaatcaccactcatgaaacattttgctgcaacgtatgaatcaatgttttttttttgtcttttttaagttgttttaccatatataaaaataatgtttcatcaaatagcgaaaggatgtttcaattcaccgcaacatttgatctatacataatgaaacatcacgagtataattgctgaaacattgttggtggaacaaaaaatgaaacggattttcttaatagagcgttttcgtaatatgtgggtgatttgttgcaatggcgtatgtggtggggaacgtggtggggacggcacggaggtgcgcgcggaggcgcaagaagcggcgggcgcacgatttttctggcgctgatcgagcgcccaatcgctaacattttccgttatttattgcaaaataaaaaaaattagcccatgcatgtcaattttcataatgtaaaatttctgtgcacaatagtttatacgaagaaccgggcggactttaatattattctttcccttcattttttaat

SEQ ID NO: 95866 - DNA, 710 bp, Oryza sativa
ttttttactttctttatctactttgctttacttaacgatgatctggaaccgtctctacttaacttttgcgcatccccaaacctctttttttttcttctactggagtaaactatttcaaatctgttttttgcgcgcgcctgctcttcactactactgagatctatctatctcgtatattcgatatggtttaactaagaacaagcatatataacctgcaagatctaccgagacatgaaaagtgagatttttttttgaagtgaagtggattataaactctcgaatagtcgagagatatcccctcgttgcttacattacactcaaagagttaacaaaaaaataattctttttgagaagatgtattagcatctgatatatcactccacaaatatgcatcttaaattcaacttctacgtgtcgcaacaaaaaattaaattaaactacaactagttaacacatattcacaggcatattgttttttcggtgtgacatgtaaagtgaattttaagttgcatgtttgtggagtgatatatcacatgttaatacattttcttatttttttaactatttaagtggcatgcaaataatgatggaacatccccttgagagtttagaatagttcccttttttttgttttctcatttctcgcaagtagggttaaacttttcggtttagtcgatttgatcggatgtcaccgaaagggctgcaggaat

SEQ ID NO: 95867 - DNA, 522 bp, Oryza sativa
gtgctggcagcgaaatggttggatctagtaataagctttgttgcaacttgcaaggcacgcacttgatcggatgagaacgatgtaagtagcattttgtcagcaaaactcagctcccaacgacctaccaaacacagagcaagcccgtgtggtctggaatcaggaaaacaggacatgcagatgcagagaaacatgcagctctgttcgtttgaaaggtttggcctacttgccagagaagaaattcaattaacacataatcaatcaagtattgatatcataaattttaaaaatagatttgtttaaatttttaagtaatttttacatggaaagttcttctaaaagaatcatgttgtttagtggcttggaaaacatgttcgtaatatattagctaatgggtggaaaataacggggccttaatcattatagaagaaattttctctcgtttgagctacagcttaaaaatgaatgaagggaaacaatttgtaaatataacttttagaaaatctatgtcgattgtggttttaa

SEQ ID NO: 95868 - DNA, 730 bp, Oryza sativa
gattttttttcacgtcaaaaaaaatccccagagacttttttcacacactaaaatgcagcatccatattttttttaacacgatgagttttaacatttgagattttgtttttaacacactgaagatcagatttttttttaattttaatcatactgaagtctaatatttgagttttttttaaaacacactgaagtttagcaccacccaaaataaattacactgaattttaagatttgagatttttttttctagactctgaaggtcagattttttttatcacacttaagtttactatttgagattttttttaacatactgaaggttagcaccatccaacaaatacacactaaagcttagcacgattcaagaacagaaaaaaaagagatttttcttatcacactgaagtttaatgtttgagaactttttttaacacactgaaggttagcaccataaaaaaaacacactaactaaaaggttggcacgactcaaaaatagaaaacactaatgccttgctcgtttaatccacaaaagagagagattgacaaaaaataattccatgccacgaaaaatatggactaaatcctcttcaaatcccctattagagggattaatgaagaaggcctaaaggttagcacgtttcaaaaacaaaaatgtttgagattttttttatcacactgaagtttaatactcctatttgatatttttttgtaacacgcacatactaaaaaaaaa

SEQ ID NO: 95869 - DNA, 793 bp, Oryza sativa
agctccacatgattttcatttttcaacaagctcactgtaaaacttttcatgtcaagatctgtgcattctcattggacaactatatgaagaaaaacaattgtggattcaaatgtatacttgactcacatgcaaaacaaaagaagcaaagccactataagctattcaaaacagtgataacaactttctcaagtacctttacatagactaaaagtgagactctttatatctttgatcataatgatggtatgctggtttattagcagaataattattttccataaatgaatatatggatacaggcaacctttttttttctcgaaaacgcaggagagctgcatttcatttcattaaggggaagaaaaaacaatacaaaaacacaacacaaagaaaaaaccaaagtaggagtgcccaagccctcctaccaagacccacacacactagacaacccggggagcttagttgcctagattagccgtcccactaaggagcttttgaaggcgagaagctccagcgacaccccaaagatggccctcattttctatcacttacaagaccgtcactactctaggatacaggcaacctgtaattggaatcttaaagcttgtctattattatctcaaataagtcagaaaataccaagttcaaaattgtaaacacaatgcatgttcactctgcaaatttgcatatgattgagagcttatcaggtagtattgcattacttatttttgttttaatctgaattatcatattatagctaattctagattaatagtttatcaacaccaagaggaca

SEQ ID NO: 95870 - DNA, 2261 bp, Oryza sativa
cgacttataatattaaatggagggagtagtattttgtactgccatggatatatggagtaattaattaaactgatgaacaagctggcagtgaaatgatttcgactgtatgtatgcgtatataagtttttctgaattacagtacagggcttaaattcagtttcttgacgcaacatactaccagatgcatctgtttgtatgtgaagaaggcagatagttagctagtcgccttgctgtacagggtgaaaggtcattgtactcttgtttttaacatgacacctagctagctaagctaatatccttccattgcacacacatggcctggatgaatgaatgaatgtaataaaccaagtagctaatgcatgtgatggccagttttcattttaaacataagacgcgtatcgatcaatcgatcacagcaggcataagcagagtagttgcatctaagatccaacttctaaggactcttaataatactcatactggtcatcagttttactttattaattgttgctgctttgactcacgaaaggacgattaaaagaaaatactgatattatagtatggatgcgacgatgacgtagctgctctacgtgttaatgactagcaatttcgtttttcgtcagcgggcgatagatcaacaagtgcagaaatactagaacaatgcaagttgacagtatatacgcagtcatgacagttacaagttaacctattagtaattggagtagcttgcttgatcttcattcttcgcctgcagccttttggatcgctttcagaggtttcagagtttgagactgaatctttgatggtgtaggtgatagatgctgcccggcgacaggttaggcaatcagcattcgacatgcatgtaattatcattgaattgtatagttgaaagtaacacaagctgctagcagtaccagctaatttcagctgattatatgggctcatttacagtctggactatatatactcatttttagtccggatagtgaactctgaacatgcatataaatgaagaaggggggaaaaaatactgactagagttttataccgttctttttctccagaaattaagaccttgctttagtagttctgttgtgtagtattcatatatagttagatccaattactcaagatacgttgagacatcatctataaaagaagagcactgttatttctaatcgtagccgatggatcacttgtatgtttaatcgtagccataataaaaaatatagttgtatgttaaccgttctatattgattgcagattaatatgtatctttaattttatactgttttcaagtgtttttaattagaaggtttataaggtcgggacttagaaggaaactgtccctgtagcgtctttgggtgcagtgctgtttagagagaggatggacaatgttgtttggttcgagatattagccttcagtaataggagtagcaatattagtaggagtaaaaaaaaaaaatactccgatgacttgaacagggacggacctatgatcggcctaaggaccgagccagcccatgaagacttagaccttgtatgctgtttacattaggcctattgggccgaacgagacgacgtatgatcatgttttgggcctcctttttggagaagggaaggcccacatatagatgtggtggtcgtcttgttggtggtgacaggtcctaacctagtaaccctacactgtcacaaaattcacaatcgatcgagggatcccaggcgacggagctccggcgagctccggcgggcgtcggcgtcggcgtcggcggcagttagggcgaggctatctagggcatcagagatccgggatggcggtccaggtccaggagtcgaagcgggtggggaggcagctgccccctcaccggccaccgcgatccgtctccctcgccgcttccatttccttctcctccgcccgcaagcctcccgagccgctccgccgcgccgtcgccgactgcctctctcctcccgctccccacacccacacccatgccccgccacccgccgcttcctctgcccccgccgaggcctccagaaccctccgggtaataataacaactactccccctctctctctctctctctctccacccttcttcttacttttaatcttctgctgttcctgctgccaggattatatcgccaacccatcaaccatcgatatggctacaatgtcctcatcgaccatgctcttgctgaaagagatcgtaggtatgctttcacccttcttcctttccttttttatttaatttaatgcttct

SEQ ID NO: 95871 - DNA, 669 bp, Oryza sativa
atactgatagcatatgccatatgtacacttctagttgtgttgtcattgtcgcattttgttatattttggcaatgtggtagggtaattatttttttaaagaaaatcggatttagacaatttgcaaacatgattatgatctttctaaaacactaatagcatatgccatatggacacttctagttgtgttgtattgatctataaatgtaagaaaatatttaaggaaaatttggtagcattcttattttaaagtcttgaagcaattttaaggccttgatgtataatataaaatcattttttccttctgagtttgcatgttcagtcattccaagtattactgagcagtcaggtagtcaacctgtacataattatgatacattataccaattgtgccttgtagagttcaaattcacaggttgaaaatagacggcgcctcttgcaagcacaggaatctgaacttttggtgagatatcatgctgctatgtatattatatttagatttaacagttaccatcatccactcacggtttcatttcaattcatgattatttatttttcttgtttatatcaattattaccagttacattatgaattttattctgtgtttctgaaatccacattaccatacaaggtctgttgtagattgatattaatggtttattttcctcttg

SEQ ID NO: 95872 - DNA, 500 bp, Oryza sativa
atgctcccgacaacgccaacaagcaaagtctaagcaatcatatgcacgctagctagcggatatctcgcatcatctctttcctcataattttgcagttagtgatcgatccatccagagggaaaaagaagggattaattaatcatataaaacagtttagttaatatatgaaagaactttccggccgattagttgattctttgcagttaatccctcgtgccgacacgtcgacgtctgacaagccatatgatctaaccggcctttcttgtttgggctaaatatgattgttcatgtcgattgccagcctagcagaaacggatcatcatctgggtgattgttaattttttgcattatggattaaagagtagtcgctagctaggtagctagctagtatgctagtgtgacacaaggtttaatcaatttatttaggtaatctggggtcaattaatctccaattcattgcggaagcaggtccatatcatgcataacgttgacgtctgaca

SEQ ID NO: 95873 - DNA, 534 bp, Oryza sativa
acccgtcaaaaaaaataatctcaagctgctagtgcttaatcaagctccacacctagctagcaccaccaacatttcattattattccctcttaaacaaaatcgtcctcctagctagcatgagccggccactataccaatctagctagctctcgtagctagccggctagctacagatacattgcaaactaaataatgcatacaatcaatcaatgacgatgtggtgaccacatgcacatatggatgtctagcgcgccgtatagctctagctagctcccaaatcaagtcccactcccacctcgatcaatcgtgtttcgcacccatgaatctctctgtgacgaccgctcgctcaaacctgcaaaattgctagccgcaccacgacgtgcctacacagaaaccatgaattaatgcagcatatatgcatgcatggttgggtgctccaccggcccacccactctcctcccctctaccccatgctgcaccaccaccaccgccattgatcaccactacttggatgatcacttatcaatcgagtac

SEQ ID NO: 95874 - DNA, 755 bp, Oryza sativa
ggacaaaacaagagtaagaacggaacggagctgcttttgaatctacctgtcgcgcacgaggataggcataacagtgtggaactacagtttgattatctgtagatcgatcaatccaagttgggtccaaactccttgggcgcaatatagtcgcatgccctacccccatcaaatcaccgatagtgtatgccggccaccgcttttaccttcgttgcaaacacgacacgttgagtaatataaatatttaatatttagagttaggttggtcaaacttttgaaattccaatcatcaattttatatcatatataatagattttataaaatataacaagtttatgataacagtatatttcacaaaactacatatattttgatcaaattatcataaaactacagatttaaagtggagtatcgtaaaactatagatttaataacaaaattatcacaaaacaacatattttagagttaaatcctcagcattagtgttatgtttgagttaatcatgcaagttttatgattaaattatcactaaatttgtagttttatgataattatatgataatctgtagtttcacaaaactacagattcagtgataatctaataaataaatagtacgttttatgatactccactttatatttgtagctatgcgagtcatttagtgttaaatctgtagtttgtgataatttagtcaaagtatctataatttggtgaaatttactcttataataagtattctttttatcttactaaccg

SEQ ID NO: 95875 - DNA, 701 bp, Oryza sativa
tttccatcttgattagacatcaagtgcatgcagacggagatgagatctatggccggcgccttattagccgatcattcctactgaattggctgatcgaacggctttttcacaaaacgtagggaaaccttttttttttgaagggtgagacggttgagccactgatcaagtgatcatctcacgatctgtggtagtacgtcgttggtgcagtactactacactgtgcacttgcaataatcaacacaatggatgggaaggatgagataatggtggccaagttaaaggcacggttggcaagctgtgccggctgttgcatgctctgttcatgagataaccatcgttatcatccgtggcttttaatttgttgatatcaatgtgctcgtgcgtgtatagtgtagttgtcctcccatcttcctgttgactgctgagcataatcatttcatatcacaaaagtagttcacataaacgacggcaatctgcacaacgataggctctacgctcttgtaacactaaaatcaacacttacaagatttagatcatatacgtgcgtactatcgtatgtacatcggttgtcccttatatgaatataattacatatatgtggatgtgtttttagttgaatttaagtgaggcgtgatttactgctacttttcatcctttttaacgtcatatcttggagaggaggaggcggatcaggcagaggc

SEQ ID NO: 95876 - DNA, 2439 bp, Oryza sativa
atcgacccaaaatagaactagatgatctttagtcccggttggttccatgtcagaccgtgtcaggcgcctaggatctttagtcccggtctaactttagttccggttggtgttactaaccgggaataaaaatcaacacgtactatataatctctattacttatcctcttctctcgtccacgcaacaaactttatctctttctttctttcttcctctctaactcctgccttatctctttcttctttcctctctttttttttggatcgagcgagatcgagggccggccgggcggcgggcggcggccggtgcggcggcacggagggccgcggggcggcggccggcacggagggccacgcggcggcagcctgcgcggcagcgggtggcggcgcgcagggcggcacggcgccgcgcggcggtggccggctggcgtggagaggaggcgacagcggtcggccgagcggcgcctttgtggtttttttcttttttttttagaatttatgatttattgcatgattctgtgatgtatttgatttgtgtgcgatgtgaacttgtgatgtatttgcgatgaattttgtagaacttgtgatgtaatttgatttgtgtaattttttttaggatttgcgatgtatttgatttatgtgtataagtaacttaaagatttgtgatgtggatttgggatgttaatttgatttgggatttggggatatgcatgccacttgattcaggagaaaataaaaaagagaaaaaaaaggaaagaggaccatctatactgctgttattccctctttagtcccggttggtaactccaaccgggactaaagatcccttcaatgtcttctcgcaatccttctacccattttctgttcaatggtttcaatacaataaaaaaagaaaccatgatactgaactgaatcaatggcatttcccagctttgtttttgaactttggtggtggcgatgaagtgttgtagccttgtagcacccttggatgcactccatgctctttcttatatttattgctcataaatgggcatggccaaacctgagatttccttcccaagactgattttatctttatttatagtcgtacgtagcttcttgttcttactctcaatcgcttgagtcggtctaagaacaaaccactaaatggtgcttgattctccttagtcgcaggttgataaagacgaaagtccacactcgatccttaaccaaacaacaagaagaggtgaatttcacatgtttttagcattattggaaaaagaacctaagggtgcaagagaaggttacaacaaagggtttgatctctatctttagtcccggttggagttaccaaccgggactaaagatcgatctttagtcctggttatttcacccgggactaaagattgcgatctttagtcccggattcgtagtcccggttggataaccgggactaaagggggtttacgaaccgggactaaaaaagcacttctccaccagtgtcttcatcccaaaatataatactccatccgtttcatattataagtcgtttgactcttctaattttgataagtttatagaaaaatatattagtatttttatcccaaaacaaacatatgaaaatatattcaatgctggattaaatgaaactaatttgatattttagatgatcttaatttttttctataaagtcaaataatttataatatgaaaaagatggagtaatttgtaacttaaaaattaatactccctcgatttcataataaatctacttattcttttctattattaaatttgattaaatttattaaaaaattagcaacatctaaaatattaaattagtttcattaaatctaacattaaatatattctaataatacatttattttgcgttgaaaatactactataattttttaataaacttgatcaaacttttaaaaaattaactagcagaaaaaaaatcaaacgactcaatactaccattgacgacgaaggtatagtaccgttgcgctctgcaaatcgcgcgagatggtcgtgagtcgtgacaggtgacgagagtgcggcgtcgcgcgctcatggttgtggtcttgtggatggtggatggtcctaccgcttgtgctccctggccgcgacgcctccggtggacggagccatatgcatgcgtgcgcggtggctggatgagttcactggctctctctcccatggatccaggaggataggaacggctgcgtgccgtgtctcctaacccaatctcgacctaatcattgggctcccgttttgctggcagccgttcgatcggcgatggacacagccacgggttgcgctggaccgtccgatcccgctccaccgtaaatctggatggatcgatatatatgttcgctgccgattcctatatccctccaccgtctcctgacactgatttttttttcttttaacccatacaaattatgggctgcaggaat

SEQ ID NO: 95877 - DNA, 2150 bp, Oryza sativa
attccgtggtcagaatgtgtgtgtcaacatactcaaggaatatatattcaggagactatttgggcctgggcccaaaaccttagaactcctttgaattaaaggaattttgtaaaaaaaatatatggaggaatagaatccacaggaaaaaaaaacaatcctttgagagagcttttgaatagtagtctttgatttctttcatgttttggaggatttctaccaagaggttcaactatatgtttacaattcctttgaaagtttcaatgtactttctctcttcctctctcggtatattctctctcaataaatcaacatataatcttcattttctgtatttttcttgtgagatttacaaacaacaccactttgaataattcatgtgattttgttctcgtaagattcaatgagccacaacattttaaacctgtgttttttctattcccgtgtttttggattcatgcatttcaatgtagccctatgatggtagtatttactagggttttatgggtgaggataggaaatgggtagtgggcggtgagaacggctataaatagaagttgggggtagcggttgatctatggtgggcaatggacatgagcgggtggtgaggcggtgccactgttagagtcaagatagaagtgcaaaaaggttaagtagggaagtggcaaaccatagaagatttggacgattggtgttggtgtgtgggagggggggggggttgatagggggggtcccaacaccgccatctgtgatctcttgatttgggcatgagcacgtcggggagagagagagagaggaggagaagataagatcacaatgcaatgtagttgtatcaattctggatcaatctagatcattttaaaattattgtaattttcaggtgactgagaaattaacaatcccgtgtattaagatcaaatcacaccccaaaattgacatcatgccacaaccatccgtactggaccattgttgcatctagctatagctgacaaaaacaggaggaacacatgcaaacccccttctttttgggatgaagtaagtagtacttcagtaacatgatttgcaaagagagacatccctccaaatatttttttaaaagaaattatgtgtttgttaagtattgaacacatgatcttagattgaaatcacacatcccttatcattgcaccgtcaaggacatctctccagctcccatctctctgctgcgtggaaatgccacggaaccaacagctagccaatcgacatttccctcggtcagatcgaaagatatgatcatggcacatacgtataccgatcggtgtccggttgttctgcgacttggattgatgagtgatatcattgcagaaagaatgatctgatggcaactggatctacgacttcccatatatgcaggctgctgtgccctagcagtattacaacatgatcaaggagtgacaaggaccactttaattgtggaaacacctggtgacaggaaaatattgttacaccaaccaacaaaatctacgtgcatgacgaaatgggatcgatcagtccagcttgtagctgcaagaatgatcttgcaaatgtcaatccaggaccactggatttcgtagcatcgtgttccacttcggtgcatgctctcctgggaaaaatagcaaatacagaattattacatctggctcaccggcatgtggcaatagagtacaactctatcatttgctttggaacttatcagtcatatataaccaaaattaaattctaaaatttagcttttaattttttattgtgatttatttttatattggcttttaagcgacaggaatacatataacatagttttatctataaattactttttgtttttagtaatcattatggcttattatcagttatagggataagacggggactaaaaattttctggatccgcactggcacactacactgacccaaattaagcagagagaatatgatggctactattgttagctacactactacagtaattagtgctgctgtgctggcagcagccaacaaaccagatcgatcgaacacgacgtgcatcctcagtcaatcagttacccgcggccggttgcatcatcgctcgcggtgaccgtgcatcggccgatcatttgatcgagcacatccatgtgcacgagcgcgatgcacgctcc

SEQ ID NO: 95878 - DNA, 677 bp, Oryza sativa
gttccccatctaaccaaatcttattcacaaaagcatcaccaattaacatagaagcatcatagttcgcaattataacatacgaatcacaaattaacattcactatcagaacaaacgccatcgcagtccacgccgtcaccgccggtaaccgccgccgcgaccgccctccgcgccgccggatctaggaagagggaggggagacgccgccgcctccaccctcctcgccgtcatcgccggtagccgccaccgcgaccgccctccgcgccgccccggatctgggaggagggaggagagacaccgccgcctccaccctcctcgctgtcaccactagtagccaccgccgcgaccgccctctgcatccgtgtaagttcaagtgctttaatttggtttcggtgattaatgacaaatctaattatatgagactaacgtttttatgagcctttctttgactagtctcatttggatatggaagtaaaaatgatgagaggtatgtattaaacttcacatattctaacttggtctctcttgtggatccaaaatatagtatgagcttcctatttgatctttattgattatgtgcatatgcgttccttcatatccatatgtatgcacatcttgagggggagcttattctatattttgtttattataaaatttctatcttgagggctgcaggaat

SEQ ID NO: 95879 - DNA, 668 bp, Oryza sativa
ctctcaaaaataatgcacgtcgtcaataaactctttggaccgccggtcagcgtacatccattgccaatccatctacatgacatgaaaaaaaaatcgtacacaaataattattcttacaataatgacagtcatacaataattataaaataattacaaactctttcaacagtcatacaataataacatatcattattcatacaaaaattataaaatattacaccaaataattcttatttactatttctaaagttttaaactaatattaatgtgttgtacttcttttaattttcattttagtttgttttctattatttaagattaactttcactatattttccttctcaactattttataaaaccttctttagcaaataaactaaatttctatatattctttattccccacacaaattttctctctcatcaacttacaactaaattttggagacataaaaatgtgcaaaacatagctccaaatgtaatatgacaaaaaaaaacattggaggatgaagttgctaaccttttaggcacctccgatttgtatataatcaccaaaataaattcactagaaattttggcatgacctcccctcttttttgaagaaattttgaagcttgctcggacagctggaggaggaagaagacatatatatatataggggtggga

SEQ ID NO: 95880 - DNA, 547 bp, Oryza sativa
gggaggaggaggaggggagaggaaggaggagaggggaggtgaggaggaggaggagaaggaaggggaggggaagagacacgtctcgagggagaggaggagacgcagatgactaggcgtgtagatatcgagaagataagaggcggggaggcgcgcgcgtgcgacccgacgcgctttttcggattcttagtcccggttggtagcaccaaccgggactgaagatcaaaaagtttcggtgggtttgttaaccgggactaaaaatgatatttagtcccggtttctattcaaactgtgactaatactgtttttcaccacccagcaaagatcaattttcagaaaagaaattgcaatttttacttgaaaattttacttcaattttctataaaattgaaaaaaagtttccgattcaccaaactagttcttatctatatctgaaggaataaaaaagtactagaattcttaatttttcaaaaattttctcactaaaacaataaaaaaaaagaatagcggtgcatggttagcggtgaggagatggtcgggctgcaggaat

SEQ ID NO: 95881 - DNA, 676 bp, Oryza sativa
tttaccaaagggcttaggcgttcacttgtttcggacttatcgaaacatcacaatagtttgtcaaactcgattcatatgtaccgagatatttcactctaatattttgttacaaattactcttatattttgtgacaaattacatgatcatcacagcagttctcattgggattacctaatttgaattgctccaaattttgacgtactagcattacaatgtccaacagcccaacacatcccattgggtatgtgcatcctgactaacatcatactccactccatttcctccaatagctagcacatcatttgaatgcttaaaccatgcatggtatgcctcaactcagcctcagttattgcagagaggcagtgcccgcttattgcgggctaagccctggtgactatgcggtggaagggttgtaagttcgcagcgttggtggtggtggtggtggtggtcagcagcggtgccaagaggggtaggggaggtggtgctggtagagcaggtcaacgataatggcttggaggcgacggcttgctgacaagataggctatgatggtagctcaacagagtcttccagcgacgacgcctatggcggcaatgactcttcggcaagataagctatgacagtttgacagttgttgtggtttaaaatgacaacgacgtgttaatggcagtcttctg

SEQ ID NO: 95882 - DNA, 706 bp, Oryza sativa
attcctgcagccgcattagcagtgcgtcgcttgtatttgccgttcctcatgtgccacgtagatcaagaatgtgttaagctacatgttccacagtgcaagttgcttgtaccaccggtaccatctttttttacttttcaactctccctctctcctctcttttttttattccccaccggaggaactgaggctgccgggggacgaagacgagtggcgacggaggcacctgatggcccaagtggcgacaccgatgccaagcggccctagcggtgccagcgccggtggcaaatcgagggcagcgcgcggcgcgagtggcgccgggcggcccgagcggcgacgacgatgccgggcggccctagccgtccctacctattctttgctcgcctcagcacctccacactagcgctcctctccgcccgcgctgctcttcctccccttccgtcggtgcccctctaccccggtgcatctccctctcctctctctctcttgcgctcctctctccgatggcggcggagaagaggaggacgatggtgcctcttcggcggcagcggagaggaggaggatgatgtccagcttagatctgggagatgggccgacgagcccagcaccgcggagaggaggaggaggacgagcttgaggaggcccttgccggcaaggcggggtcgagggcagtaggatgagccggtgagcttatccggcccggtggccc

SEQ ID NO: 95883 - DNA, 659 bp, Oryza sativa
aagttttgagaaatattttgttgtacgatcgtagatatacgattctcttgtttgtttttgacgaaaatatgattctcttgtcaatccagaccaaaggttcgaattcatttagacaggtgcaccaagaaataatcgtgttacttatgctatggaaggacagaatgaaaacaagatgcaagcttgtattgtcagtatcaataaaaaagagaatgataatttgttcattatctactttgggtgatgcggtcattggtttttataatttgacatacttcaaatttactgattgatttcattattttgcaaatacatccaagcatgctgtgcttgtgcttgctatattgcctatatatgcaatcttctgcttaaaaaaaaacagttggctactacacttcctgtacgtgggatgttttccttaaaatatttaattgaagcaaatgtcagcttggcagaatttgcgttattaaaaatatggtgatgtttcctatcatgtcttcagtcttatatctacattactagctatttctttgaaaacttcggcaaagaaccagtttactgaagcattctttccagtttacattcctggtcctcttttgttgagaaaatcgccttgatttcctttgtagattcctcttgaccatgtctcttaatatgctgta

SEQ ID NO: 95884 - DNA, 753 bp, Oryza sativa
tgacctttgcttggaaggcagaaaggtgaactatttttttttctcaatacatgatcctacctgaataactgatacttgagtcattgcttgaagtatgtgatatgtactttggtttgctgtattaaatttagtttgttacacaagtttgatgttcgttctgatgtacgttttaactggttcgacaatattattcattgtgaataaaattgttattttgtacttccagttccatacttccatcgctaactattgtgaaaataattaggtacattatggtcatttttcccccttaaaaattcctttgtgcccaatgccacgagcccatgatacatatgagacaggaattaccctgctgtgcacgatcaatttattattaattcttatctcttttagttgcatgatgctataagttttaacttgcacagaaattatttgatttaacaccaaagcattccactgtagagaaacatagggttgactctgcacggggatttaagtagtgttgagattgaattacttttgcacaacttcacatgtttatcccttgattttacctaccagttgatgttatatttagatctgttaccttatgtataatagcccatattcttcaacctcgttgaagttcccgtgcttttctgtaatgcaatatttgaatgtctaataattaaatagttgatacatttggacgatgtgtgtataactggacatttacagatgcaggcatgcacacaagtagttttttacatgctt

SEQ ID NO: 95885 - DNA, 668 bp, Oryza sativa
ttgtcagcttgtagagtttctagtttatttcttaaaagcaaattcaaaatctgaattgctcggggaagatgaagtttttgggagaaactacagctgtacaagatctaatatataggaggcggcagccacaggaggcatacgttacgttgcatgtctcgatcgatcggccggtttaattcgtcagcgaccaaacattcttggcgacgatattatggactattgggccataaagcgcatacgcatgcacgtcgtttccttgctagccaggaggatgaaagccgcaagcgcgcgtaccagtttatcatgcatggactgatcgcttgcaacttgatcaacggatgaccgtttggtatatctatctaatcatcaatagcatattatttgtatgtagaagttatatatgtcgcatatgcatgcatttcatgtcatgtatcttcgttttttaatatatgatagtaccgttgactttttaatcaatatttaaccattcattttatttaaaattttaaataagacgaatgaccaaattaacgtataaaaagataatagcgtcatatattaaaaaataggggagtaattattgaaaagattagcataaatatgtaaaattataataaaattatatgttaagattatagtttatttgataataaaacaagtcacaataa

SEQ ID NO: 95886 - DNA, 723 bp, Oryza sativa
atatagataaaaacgattaattacacaatttgcatggaaatcgcgagacgaatcttttgagcctaattaatctatgattagacagaagtgctacagtaactcacatggactaatgactgattaattatgcttaataaattcgtctcgcagtttccaggcaagttatgaaaatagtttttttagtgaacagctaatttagcccctcaagtttcaccaaaggctcaatttggctttttaggtttcattgtgtccatatagatcctctaaatatttgtttttgcttgaaatcattcttaggcccacttaatataccatatggctatttctagtcaacatttatgctagaaaatgtctcttttacccttaatttgtatataactatatggctatttctagtcaacatttatgctagaaaatgtctcttttatccttaatttgtatataactatatacactagaaaagataaaaccaagatgaataaataacattattgcatatatactttccattatttcaatatgtgcacataaattttaagcctaatagctatggtacaaacttgcaagtacataatttattttcgttttacataaataactatgcattatctattaaaaaaaattcagtgcacgtaattttttctcttatatatgtgaatgaagggggtataactgtcatttatcaagacagttattggttatgcttagccaggctgcaggaat

SEQ ID NO: 95887 - DNA, 708 bp, Oryza sativa
ttcctgcagccccaactgaaaagaactccataggattcagattggcctcatttggaatggaaagaaatgtttttttttgttgagatgagactaaatccaacagaaatcctataaaattcatgaaatatcttttcgtgaataacagttggatgaatgtagcaacctaatacaaagattagacatcacctgtctaatattatactccagtttgctaatggagctctctgcttataacttttctgtgctatgatattccaacgcattatttctgtgaaggaggggctgcgctggccgaagatgcaatgatgcaggagtgcgattaagttgcgtcagcggcaagggattattatccctttctatatccggcggcggcgcgctcccggccggttggaggcggccatggacagcctgctacgccacgaaagcatcattatatctgcccagatgattcatacacatatatgatctcaaaaggcgatcgatgtgcgcacgtacatacaggtcacaactggtcatcctacgatagatatgccgtgcaacatgcgttgctcggagcacttcaattaagatagagggaacaaatgttataagaaagattttcatcggtagtcgactgttgagaaaagatgtgcattctatgtataaacacaagctactgaactgaaagccgagtgccaaaccggttattggtattattcatgatcattc

SEQ ID NO: 95888 - DNA, 705 bp, Oryza sativa
aactatatgttctgtaacagtatatgttcaatagtaagaaactatatttcacagctacgataaagaaatgtgcagttgtatatgttgtgtacaactgagagttacactgttattagttaatagttattatcaacaataaatatgtcacacagttaagaagatgggcagcattgaaaatatcaaaagtaaaaaaaaaaaggcatggtatactgaattttgtaccatttgacgtatgctacctaactctgttttaataatcatatatttccttcctctatctgtttttagctggtgccttgctcctggctaaatgataatgacaaggatgcaacaagttgttgcacatttgggtttcctcaaggaaactgaaattaaaagatgttcggttgcattgatccttttgttgaattggtgctgccaaaaaggcatggttttctatcatcattcggatggttagttctgccaaacagtttaaatttgtagtattgaaaaggttgcaccacacatgatttacttgctcaatcttcaggttcaggtcagcagatgggtcagagggagacgtctgtcctactagcttatttggtcagtatgaaatggcggcttaaagtttcagacacttcagctcaaattcttctgatatggtacatgtgtacaaccagctgttacactgtcttcagagacttgtatttccagggctgcaggaat

SEQ ID NO: 95889 - DNA, 674 bp, Oryza sativa
cagtactattcaaaatctaatgaatgattggaaggaggatgaatactggtacaaatgaagatctacagttagtggatgcttttttatgcaggaaaaactaacggaatagaagtttttgataattacaacatccatttcactacagaatagactcatatttagggggcctagcaagtaatcacattagagcgatgagctatggcatgattagataggccttgccgcccagagcagcatacacaagatcaacaggcatagatgcagccattaaagttcacaaagaatcagttaaggcaagtctagccatagcatcccctataagaacctgtaatcttaggactaacatgaaataaatctacttgacgtgcctgcaaacaattcaatgtaactacaaagaatcacaatatgagcaattgtagcatcttaggttgcatgaactaattaacacatagcagagactaaaaactggggcgcttgcactatatgatagaatcatcaatgtccacttacaaagaaagcagcgcgtcaccaacagtctatgctatcattaatactcacataaacctatacataagaggggtttaagcacaagggtgggggtttaaacatatgggtttaagaagcttcacagctttaccctttttacttgagctttctgatttcaggtcaaaaat

SEQ ID NO: 95890 - DNA, 558 bp, Oryza sativa
acagaatctagctagcaacagatcagatattatctatattggttgaagcagctcttgtctgagagcatgtcactgcgtcacatactcgcatgtattgtcgatcgatcgattgcaagaagccaagaactggtaaaaacggagtagaaatgaatgcctgactacagcctgagtaaccccctatttgtcccagctgtttggtgtgtgatactatatgtgtacttgaaagttctatctttccaagaattaatgaagctgcgaataccactgaccacataacgatctgataattaccttgctgggcactttgcctgttctgttcatgctgcaccataactgaaaagatatcacacaaaagcagcagaagaatgttatgacagtgctgagtgcttgcctcacaaactcgtcacccttacgatcgaaatcatgagctaattaaaacaagtccagcgacaaagcatgttgatctctactattattcttaatttggtactagtacaaaatgtgacgtataattttcctgaaccatatatgtatgcaacaataatctaattaacacgc

SEQ ID NO: 95891 - DNA, 1869 bp, Oryza sativa
atgtttgatcactcatcttatttaaaaaattatgtaattatatttttttattgtgacttaatttatcatcaaatattattttagtatgattaaatatttttatattggcaaaaaattaaataagatgaaagatcaaatattgataaaaagacaatgttatcatatattaaaaaatagatataatatagaggaccagaagaaggaaccatatagaccagcaggatacaaaggcaaattaattaaaaagcagaagaggaaacaaaagctaagtaatctgaactctgcaagaagtatatatcgatttcaaccttgaatcatgaaatcagaatcggatacttgacaacccaaactgctagtttcatattctacaagcaaattacccatgatatgccatgtgatgaaaaactaaaccgttttgtcatatttttaagtagacaattatggttttcgttttcctatttttgtgggttttttttcctaattggttggttttctaggaaaccttcggttctttctagagggatgggggcagcatcggtttcctagcagacatttgggtcgagaaaaagaagggtaacatggaaaggatgactagtagagatatgaaaaaaacattatagtttctatggcgcgacggtgattctaaaatttacatttgggtgaagaaaaagaagcgtagaatggagaggataacgactctccttttaatgtagtagagatatgaaaaaaataacaatacttgctatagtttctaaggcatgatgatgatttcaaaatgcgagttttattggcatctacagtaacatatgtactctacgagatcccctaactttagagtcattaacatataagaccatagctagcaaaatagacccgcatgttagtaacttagtaacttctggagaaggagggagccaagcatgaacattactagctatccttaattgatattgcggccggaggggatggcataactacctttaatcgaaattgtggtcatcaatgatttatttgcaagccttaggaacatgaccatgagcaccaacctagttagtttttttagaaacagcaggcgctcacaacgtgcgcacattcatcctatggtaccgactctatggcttcagcgataatggaattggtatggtcactagcccaataaacaaccaagtcacgtgtcaaaacaactgatatatatgtgtcatggatagatttttggattggggggagctgagggacggtttgaggttgaaatccagaaccttatcttttaggctaaaaagaatctattgctaccaaaacaaattttggagttaatttaagggcatttcaatgtagtttttttctatgttggtttttaagtcgctaacaacatatctgtaaaagtattatgcccatattatttttatagctaagaaattgttttgacatatatatagttagctcttggccaacgatagggctagctgccatactttctacagagttttggaggaggcaataaatatactttccaaaaataatcactacaatctatctagcagatgtgatgatagtggtgttgattaagaactaactgcccatcaatgtcatctggagtagcttttcttggcgggggactaaaatagtaagattttatctgtcctaaaatatttcaaaccgaatacaacttgatatttatataattacgaatatcagaattaattagtaaatcaagaaaaatgtttaaatatgtttatataaaaaataatagttatgtaacgcacagatagtggttaattgaatagtataataaatagcttacacagactttctccgtcccaagatataagcgttattaggttctgacacggtctaccagatgctactttg

SEQ ID NO: 95892 - DNA, 1355 bp, Oryza sativa
ttaaattaatgaacacctgatagatacaaagctgctaatctagctagccgacgtcatatgttaaatcattcacacacacaaataaaaggagacgtgcattccaaaagggtcgcggtctggaacgtgcatgtggggctacttcgtggtgtgacccagtgatgccttctctcccgtcctccataatatcactcacaattttaaggcatgtcaccttcaattcgaacataagaataaattattctcaattcatttataaagtgacttaaattttatagaattattgtaaaatacttatatagatgtgtttttcaattaaaaacctcgttttttttgtcaagaacatttgatgatggtgccgcatctttggcatgaaatatttttgactggaggtagtgattaatttcgggattcatgtaaataggtcaatgcggctagctagtacaattgctagctaataaaaatttgaagtattccatccgtttctaaatataattcgttctaggttgttcagcaaatattaagggtgaggggaaagattttcttttagttatcccattgatcaaattttaaatattgaatattaatattctcctcgtaagcatctcattggttaaaaatgcttgaattcctcaacattaaaatcagtatatcagaattactcatattacatataaaatctaaatcatagaaatgcttaagattggaaggacaataagacaattaaggggatgaggtgaggacggaatcgggcgttgccatcgcaggcgagaggccactatctagctagccttctagtactaaaaagctaagctagaggttgaagctgtgacctgtgagtgcccaccagctgcatgctgagattcccactatctatccaacgccacttcttcttcttcttcttctttctcggcacaaattcatcagttcatctctctccctcacacacagttctcacgttgtacacttgctctgcaacacgcctttctatttgattcgattttatttctcatatatatttgtattatcagcattaggtctgcttaatggaagtagtaaaatttaactcccagtgtgactgatcaaataaattaatagagctatatatatctatcaaataaataaatattggctagctaaatcaagaatatgtccggccagggcccagacggccgcgggaagaagggagactctcaattctggttttggtctcaattctggttttggtcggcatgctggctggtttccaaatctaatcatcattcactactgaacatattgcattgtcccatcatataagggtttttgaagagatatgacacatctaataccataaatataatctagacagataacct

SEQ ID NO: 95893 - DNA, 606 bp, Oryza sativa
tagcctctctcaatggggaggggaggggaagattgcagaagagaggaagcagtgcgcgaggcaataacaaagtgtgtgtgtggagtgtggctggcaagtaattaaaagtgagtatatatggatgcatttgcaagtagtgctatgcctctctcttgtttttttgtttttttttgggtacatctacgactacaagcatgtagtatgttgatggtgcagtacatgtcaacttacaggtccctgtcatcaagcctgacggcgtccaaaggggcctggtaactactacttgtattgcatcaccaacatgattttttttaatttaataatactaacatgggttctattaagtatcaccgtagcattaacaccagcaaattactagtgcatacatcatactacgatataaaattacggaatcccattacatgctcatgttggtaccatgtacttcctccgattactagtacatctctattactaacatactggagtacatatacttcgatataccactagtaacaactatataatgcataataccatctcatctcagttctacatatgactaataatactgagtagtaatcacattcacatgagacaaacttt

SEQ ID NO: 95894 - DNA, 1880 bp, Oryza sativa
atttaatttgacatccctaggtccttttttctgatggattcaccacttcttcagagtgacagagtgtggttcttatgtttcatgcagcgaagtcatgtgaagtgcacatgatggccgacaaggttattgcttattacatggaccaagacaatttgatcaagctattcaaagtaatcagaagagaattcaaatcgtcgtcctctacttttaagaaccctttgttgccaatagatacccacagctgacaaccggagctatatgttgtgagcaaagacatgtttaatctgcacaagttgatgccctgtctttgtttacacttcctcattctcttctcatgctgtaatgacttcacattcaatggcagtatctgctcctcgattatgaatggtggcatgagtgtctggcgccgattcactgacaccaatgacaactacaacgccgccgccaattacatagtgctgacaaagtgtcaattgcctaccacttccagcccaccaatatctttcgacgatatgaaatatggaaaccaaaagcctgttgatcctaccacatagaatctcatattataaattacaggttgtatagagaggcttttatacaggtatacaaagtcgcgcaacgcgcgacaaaggtggctagtaggaaatgaaaaaaataatatttacaatagatagcctaaaaaataataaaataataaaataataataataagaaaacaatagatagcctaaaattgattccccataatgaaaagtgggccctcactttaactaccaatagagaaaattagtttttctgctccctctatgcgcgcactgcgtggccagctcctccttcatctcgcatttttttctccgtgcgcgcacgagagaacgattgggaacaaaaaaaaatcgctcccttgaagtggggaacgagatatctggagttgggaatctggattattaggagacatgttagggattctattggatgcgatttttgaccaaaattttctaaatctgaggatgggaatagaataaagaactattggtcatgctcaagctctaaagtcattcctaacactccatgttatctagtgtctgtagcattaaatacattatcacgtaagaaaaaatatgatgtgacaagagagttaatgagaacggaggtaaaaagatgaaagaaccatttctcatgcaagaaaccatctctacacaagaaccaagaatatgtggataaaagaagagagaaaagaggtgattggatgagaatttaatttgaagacaccattcattggatatatatatatatagtgtctatacatagtgtccaactattcatgttttataagctaataacaataaaaatactaatcataaacaaatttaaataagacgaacgattaaagttggccaaggaaactcatggttgcgtttattttgggacagatagagtaaagaatataatgttgttgcccctgttacatttaaaaattagactgtgataacatcaaatttccttttgaacactacacattgtcacgatatagcgttcaatggttagccccaagtcctaacacacaccaggagggctggacagcacatggctagcaaatgagataactgcagtcagcggttttctggaaaaacaaaaatgatagaacaaaatcattgcctagctctgattcagcattccatgtgttatattaaccgtgtactgctgtttgatctcacaagcatcaattagtcgattgtaacgcactaacaggaaatataatttgtaattgtgaccttcaacaaccctaattgaagaaaagagctagttctttcttcccatcagaaattggtttgattccactcacacaatccagacttatgagctaccagtggtctcaaagg

SEQ ID NO: 95895 - DNA, 567 bp, Oryza sativa
ttcgcactcgcaaaacctccttccctgaattgaaggtacaaccaatttcatgtgttttataattttataatgggaaacctgtttagattgttgagttttcagattatttagaatggggtgcctgtttagattgcagcataggtaaaataataataataaaaaaatactcaattcagttctaaccccttgatgtattatttcagttgaagttcagcttctaaaaacgtatatcacctctctaaacatggtgtgtactaaaactaatgagaaatgcttcctcttgattgagcagatattcattgtgaaacagctctataaaccatgtttcttctatcatcagaacacaaggctgaatgaaaaatgcctgagtgagcattcctctgaatatttctgaatttggcgatatcatttctgggttgttctgagtgaattttcaatataatcattttttttattttagtcatgattgatttgcacactagcgtcgtcatctggcaggagaacaagccacccattcaaaaatcggcgttggccaaccagccgcttctcttcttgggaccccttgct

SEQ ID NO: 95896 - DNA, 582 bp, Oryza sativa
ggaggagggcgaccgaatgccgtctctcactgttgaagctcgccggctcaatggggaaagcgacagagaagaagaggccgtggccgaggacgatccgtggaaggggacaactgatataggttgatccagctcattccatagccgaggagttcgctgatgttgccttgaacagccagcgaggagaggggagatctgatgagccaaggccgaatctagccgccccgccgctgctctgcctggctgcgtgaggaagccaaggtccgcggcgacctccgtgaggacgaacgcgccgctcggctcggctccgcgaggatgagcgcgccacggctcgtcttggctccacaaggaagacgaggtccgcggcaacctctacgaggacgatcgcaccgccgctcagctcggagctccttgtccgccacagcaaggggaaggaggcgtcggttggggtttgcagaggtgcacactactacgaaaaccatttttcatggcggctattttagatttttgctagcgaaatttacggccgccacaaagcaaaggccagtgaagatcaagatcttcgctagcggttattgaccgcca

SEQ ID NO: 95897 - DNA, 1316 bp, Oryza sativa
cattaacatctatatgtatgtgggtaatgctagaaagtcttatattgtgaaacggagggagtagaaaagaagtagtacttcatttttcatgccatctttctttctattttctgtacttttttttattggtcctatccacctcatccccccaaccatactgtgtatgttcctcgaagaaaaagtgtgtgatcatgctaaatccttccaatacaagatacagtctgatccaagcatgggacatgatcaatcaaaaaatgatgaaaaccccccaataaggcccaataatatcaccttttatcaccagaagtcacttcttctgttctcatgttgtttgatagatactctccttttagtagaatacacgaattgtaatctttcaacaacagaaaggtactgccatcatatatacaggcccaattaggagtagtgatcagtagggtttagtttaggaccagctattgtaatgcatctactgcatttggggacaaaataagtactcctagctatcaatagagtgattaatgattgctctaccatatcaatacaaacacaagccctacacttatatgcacccgtgcctgcacaggaaagaaagatgcaaatctgttggttttccagatgcttcagtctagaatcctaactgtccatcctggcaactgaagactatgtgtttgctgggctcataaagatcaatgctcacgatgttcttcattgtgtggaaaatttgctgccttgtgtctcctctattttgccttggtagcaaaagatcagatggtcagtagtgttgcttgtacctaaaaggctgcagctggtcatctcattccataagacaaaaatggaaatagtaactcccatcaacagtgtgaaagaatcatagaactgactagggcaccatttgaaacggcttttaggcttagctacttactcattttctataagcacgtttttatgaattactaaacaatatttttttgcaaaaacctttctatatacaagtttattaaaaaatcatataattttattttacaagtttaaaattattaatagttaattaattatgtgctaatgatatatctcgttttacatgcggagctcagcttagaagttgtttggaaggctgcctaggcatagcatggctctttttgttggaccagctgagtggttcatgcccatcatccaattttagcccaagaaaactgggccagcccatggaataagtttctggctcaaatcgacgaggaatagtgctacatctgatttgcttacattgtaccatttgttgggtagagacgtagagtgatactacatctgtccca

SEQ ID NO: 95898 - DNA, 668 bp, Oryza sativa
gccccatgtacagtgccagctgtggctcttcctgtggttgcatagtgcccctctccactttattccatcttgcaatgatgtgtgtgtgcatgtgtttgtctgtgctacttaccaccaccatgcatgtgcatggagacgccctatagcttagctagggtttaggtgaaacttgaaagctcatcatgcatgcatgcatgcagattaattagtgcattgacacaagtgtacattggatgtgggcttacataattaggttaattaattactcatggtttattgcttggagtatatatttagttatagggatgtgtagccacactgactagtatgattctatgaagaggagaggaggtgtgggctagtggctgcactatataagtagggataggcctcccttctcatcatgcaaacatgcaccatttcacagcattagcacaacaaacacaccatgctctatcctccatgtatccatattcctctctctctcactctcggagcacacgagcacgagccgcggctggtgtgagatggtgagtctaactagggtttgatcgatcccatcccttccccccatccacctatcgccgccggctccgacctcgccatgccccgctccgtcgtcgtctagggttagctcgatcgctagctcgatcacaaccagctacaac

SEQ ID NO: 95899 - DNA, 984 bp, Oryza sativa
ggagcggcatcggtgacgacaggagcagcggaagcggcgataggaggcaggagccgatgcggcagtggtggagggaggcaccgcgcggaaggggaaggaggcggcgatgaaggcggagaaaattgcgtggtggaggttgggaggaaatcacgtgattttgtttctgtatccgagtcgtggtatcccagtgtgggcaaggcgatggtgggaggtgggaccgtgggagtgccgtgggacgctgtgggtggggtatagttgatttgtcaagggttggaatggtgaactcctcctttttttttattagtatagattaaacgagtaatcgaattgtatttgcgtcctggtaataccatctgattgaagtggcaagtgattaattttttttccatcatattttacttgtctgtaaactacggttacaagctaactgttcgatgtcttggtgcatttctgttcaaaatgggaatgtactactacttaaatcactcttgtgtgccttccgctaaaaaaaagatatctttgagctttgaactttgttagaatccatttttcactccgaactacaattgttttgtttgaaatagagataattatcgcaattcataatcttattgtgcatattaaaaacaccatggcatatggtttaggatgttatatatctaattttggtatgaaaccccttctatctctctccccgcgtcgctctcgcgcgggcggctcggggggcgaaaaaaccctagccgcccgcgcctcttctccatccccgctcctcagccgccgctggagctcgccggcggcgaagccggcagcgagcagggaaggcggcggcgaggcctttttctttgtggtgtttacttcctcggtgtgaagtggacgggacgaagacgacgaagtcccccaccggcacggtccgaggcggcggcgaggtggggagaggcggcggatccggcgcccccaaggccggatccggccatcccccacctg

SEQ ID NO: 95900 - DNA, 902 bp, Oryza sativa
ataatcatgtgagatcttgttgtaaaggtttaattattacaaacacaacggtgtaatcggatcgtagattggatgagtagtttaagagaaaattgtatttgaagtatagttagataatatctcttatagatagagtggtagctggtttagacaaccagctaccactagctgtgtagtcacgttcatttagctaagtcgtactatatgagaaatcactagaagctttttggtttttgtttttttgattatctttgctccctctctctttgtaccatgtgtctaagaggaggccctagtaacctctggaaattcctatacatttatcccattgtttttttaatgtatatgtaacttttgattcaatggctattattcaaactctctactcaatggttgatatatttttgatgatttgacgtattctcatataaaaaagattgctgctttcactatataagataagataagaaaagattggatacaatacagtaaccgggctcatgattggatgcaataattataacagtaggtatccctaccaagtaaaaaagttgacaaaaatcaagatgatttttggtataagttcctttttcttaatgttcatcatggtgaccgtgtgtagttacccggctaatcgtggatacaataatccttctcagtgattagactagaagcgtgcatattccaactttctgaggatgaaaaaaagttcgcttttggaacttaacgtcccaatcgaacataacgtgcattttttttttgtcaagtgcaaagtttgtaaacgacggctaatataagcatcactagggttaaacagcagctgttagaaattttttctattggatataaaatggggcttttattaaggtgcaaaaaacgaaaatgactccatcctgccatcg

SEQ ID NO: 95901 - DNA, 515 bp, Oryza sativa
tctctctgtccacgagtatagatatttgcatccgtacgtctatctatttctgcctttcgcttttgagtatcggtagacgtgatgttcgaagcacttctcaaacactagtaaagcaccctgatgaagatggacaaagaatattgctcgattgcgggatcagtatagtacgtgaaacagtcacttactcgtacatgtccttccatttctagctgtgtctcacatgaggagtactcgccaggtttcaagtcactctttttctaccttctccgtgggatctcagggacacacacgtacgcatctcgtcatcgtcggatcgtccccccagtacaccatatccatgtgcatgcctcctagtatctccgaacaaagttccagttctacccaaggcaatgccgcaggcgactgaccggacactagatctgccgatcgaccgatccagcaaggcgcgcatgcagccggaggtgtgcgcgcgcggctgactgcgcctctacgcgattccgcgggaaatcatggtg

SEQ ID NO: 95902 - DNA, 501 bp, Oryza sativa
ctggatgattgaaaagttagactaataggatgaattttcaaatttgtagcttttagcttagtgacttgcaaaagaaaccggccattagttactgaactagtcatgattgctagacagcaaatgcctttttagtgtatgctaattacgcatgatgctccagtcaggtgctatagtgatggtttagcttgagttcataaatatttgcatatttgggacaattgcttatttaaccctattttaaagtctaactaccaatttgaccctactttttctagtttgcttattttgaccttgcttttcaaaaatgaatatcccgtctgaccctgtttccactgcaccgttaaggtttcattttaaataagaaaataaatatatttacttttcataatgaccaaaataccctcaaagaaaccctatccattcagatccggtctcctctcatatcccgtctctcttctggtgagtggcggcggcgacggtggggcccagaggaagggatcc

SEQ ID NO: 95903 - DNA, 631 bp, Oryza sativa
catatcataaaagtaatttatgatttttcatcaaaatataatcatgtgagatcttgttgtaaaggtttaatttattacaaacacaacggtgtaatcggatcgtagattggatgagtagtttaagagaaaattgtatttgaagtatagttagataatatctcttatagatagagtggtagctggtttagacaaaccagctaccactagctgtgtagtcacgttcatttagctaagtcgtactatatgagaaatcactagaagctttttggtttttgtttttttgattatctttgctccctctctctttgtaccatgtgtctaagaggaggccctagtaacctctggaaattcctatacatttatcccattgtttttttaatgtatatgtaacttttgattcaatggctattattcaaactctctactcaatggttgatatatttttgatgatttgacgtattctcatataaaaaagattgctgctttcactatataagataagataagaaaagattggatacaatacagtaaccgggctcatgattggatgcaataattataacagtaggtatccctaccaagtaaaaaagttgacaaaaatcaagatgatttttggtataagttccttttt

SEQ ID NO: 95904 - DNA, 680 bp, Oryza sativa
atgggcattccaaatcgatctcgcaacaagattaagtcatcatggatgcatgccaattgccaggcacaagaagcttaattaggttctttccattctcaatttgatcagtaattaatggccatcacgggagacgatacgagtgatcatctcttgctttttttctctcgctattatgttcacatagtatgacgtaggcgaaacacacgtgccatggcatgcgtgatactgctttaggactatgtacacatttttgaattttttgaattacattccgtatttctccgttttttgaattttttttggctactatgtacacatttgatgggcgcggcttgaagccgcgcgtattcatctagttggcatcagggatacaaatgtgcagcccatatcaagccaaattgtgcaagagaggggcaagactggcatactcaacgtgtatctaagaacagatggattcaatctggaaggcaaacgaattcaagtgaaacgggtatgtagtgttacatgtacatggcaaatcagccctgatgtttctgcattgtttccagttactttccaaacgaatgagcacacatgcacgcacatattgcatatacaattctttccaacaagcaatgattatttggggcaccatgataagccttggtacaccttctacaggatctttccctttcctgtcg

SEQ ID NO: 95905 - DNA, 645 bp, Oryza sativa
atcccccatggtttataattcatcagtcatcacagaacagcaacacacatcagtccatcagtacagtacttagttcaatcacaaaacagctacttgcatttgatgattcgatccatcgtaaatctgcagcacaaaagaaatcaaatcgatttaggctcgtcggctcgtcgctaggctgctgggactgctgaggcgaggcgtcgtcggctcgtcggtgtggctgtggcgtcgtcgtcagtggttgtagcggcggcgaaacagcgggatggcgccgtggctgcgagacggccgcgaaacggcgggacagcgccgcaagatagtggcggtatgagacggcgaaaacggtgggggcgaggtcgcgaggagccgaggacggcagagaagcggtggcgcgggcaccgggcggtgggcgctggcggtgcgcggagcgcgatgctccgccgccggctcacggtctcgcgaagtcgtgtgcctgtctctctcctctctagggttagccactatttgggttgggctggaaacttagggatgagttatagactattgattctatgggtctttttaacttcggaaattccgacaaattttccagaatttttccgaccgattccgagtttcgacggaaactgctattatcatattcaa

SEQ ID NO: 95906 - DNA, 850 bp, Oryza sativa
ttagccaaatggtagtactaggcttgacagcaaggtgtgacatgcatagccattatccagtcaccaatatccccattgtgtttacttatgcttacccttctaagccaaaatttaaattttaaaatttaatttcagagttgattttaagggtttgtcatcgtaatttattttacactatttgcttttgaacgctaacgacaagtatacagaacatttatcataaataagattttcttacctataagcgatatggataagcataagtgaaacaatcgaactgcaaaactactttgcgtgagagatgatcacgagcacttcgatgccaaacttcacaacgctgccgactataaatcatcgtatatcactaactttgtgttcatatatcgaagaaatatctatttctaaaaaagtgcctattttcaaaactatacttaaaaaatttaaaatctaaatcttttcatgtatttggattaggggctaaaattttagtccatgtcacatcggatgtttgacactaattagaagtactaaatagagactaatgataaaacccattccataacctagactaattcacgagacgaatctattgagcctaattaatctagtgatactacagtaaacatgtgctaattataaattaattaggattaaaaaatttgcctcgtgaattagctcttatttatataattagttttattattagtctatatttaatatttttaatatattagtcccgatatccaaacaccacctttaaaaaaaaactacggaggaactgggatagttgatgcgcaccggggcacgcacgcgccgtgcgttgggcgtgtggcgcaaccccacgcaccgg

SEQ ID NO: 95907 - DNA, 1180 bp, Oryza sativa
tttgtagaactagcatagtggctcgcgcagattgcgcggctagtatcattatattttctctcatataatagtatatatgttttctcattatattattcaaatatattaaaatgataacataattttaaattttgcaataactttacaaaactactaatgtgtaatattcatattatattttatatacatgttagttattaattacttttaatatcaaattttagttatttgtaaattatatatattcctatatggactctagactcgtcttttaatatttctttttttttaattctgaattttctgtaaattgtatttctatatagactctatgctcttcttccaatattatttatttttatttttgaatttttattttttctaattgtattcttatgtggactctaaactcatctttcaacattctttaatttttaatttcgaatttcagttacttctaaattgtattcctatattgactttaaactattcttccaatatttttcttaatttagaattttagttatttgtaaattatatgtttatacggactctaaaatctacttttaattttattatgtttattccaaattttagttagttttaaatttcaatatggactctatactcaacttctaatatatatttttaattccgaatttatatgtttttcttaattgtatttctatatggactctagtctcctcttctaatattccttattttttaattccgaatttcaactatttctaaattgtatttctatatggactctagtctccttttctaatattccttatttttttaattccaaatttcagctatttctaaattgtatttctacatggactctgctttttttttctccgattaatgtgagaatttataagccatgagagcgaacgtggaggctcatttttctattcctttaataatataatagatatgatcaacggattagattaatttgtaataccagtatagtgcattgtagtgtggcttaaagaaaatctaaaatgacctgtgtataatggaacctatataacatgttcacttctttttttttcttttttttttgaggagaacgacggcaggagatctgccggaattttattagagggagaaaataaagtgcttacagtccagagaaaatatgagagacttgcaccgaaacaaatta

SEQ ID NO: 95908 - DNA, 672 bp, Oryza sativa
aactagggcggtagccctactcctggtcctaaatattcattgaaatttttttttagaacttcaaaaactagaagataaaggcaaaattatataaattcaactgattgagctttaggtttggaaaattttggctccaccactggataagatgtatcgagtaaaatataccgttcgctttaagggcatagtgtagagaaaaatgagacttaaagacaacgacaactacatcattttcctattcttttgctcatatcatcccatgttattccccgttagctcttagcccctactctcttctctcccatgcgtcagatccatcgtgagtcggtgaaccaatatcgatacattgagtcattgaaggagtgctgacacggtgacacagaatccatccaagttagaacaatgggagaaaataacataaaacactgaagtgaggtaagacgcggtctacaaggagaagcagcaatgtgaaggtattttttgagaggagagactcttaatatttgtgttaggttatctatttgaatttttggattggtgtgaatggaatttgagctttttatgagtcatattaggctacctttcctccttctcctatccatatcctaatcactattagtcacataaattaaggcgttacctcgcttattgtttaattacccctataaggca

SEQ ID NO: 95909 - DNA, 613 bp, Oryza sativa
aggcacttttcacccttttgccaaaccaggctccctttgcttttttttttcttcttccttgatgtgcttttgattttgatccgtcaggctaagtgcgctgtagagtgtggtactacttggtagtagtagtacctagctagctagattccacacatcaacttccaatttgtggaagatttaaagaaaaaagggggattgcattatttggaaagcttataattagctgaaatgtgctaggacagaaaaggataggagtcttgaaagtgtaattagtgtgaagttgagaaggaaaatggcgttcattcttcttttgtaaaacaagtcagaaattaattatggccatcattcttgattccatcagttggctaagattatttcaggtcattccatgctatatgcaatatttgtaatagttgattttccactattttttagaaaaaaagtagagtgaaaaaataatcttagccatccaataagcaaaatggcatataagaaaaaaaacaatataagtaaaacttttatgtatgtgttattcctggtttaaaaaccaatgctaaaaaaatgaattacgatgaaaaaaccaaaatcgactacaacattaaattttaaaatt

SEQ ID NO: 95910 - DNA, 525 bp, Oryza sativa
aggcactgttgtcctctgcatgcccattgcccccacagccgcctcccaatgcccattgcacagagacagcattgttgcccctcatgcaccggcgtgatcgtcatcctgcgcacatacaggccatgataattaatcatggtatgctgctccaaatctgaaatatggtatagcccttctgtcctaagatccttgtctcaccgccgccaccgtggatgaggccaacaccaaacaacacaaggaacctcttggcaccagaagctcagctcctccatttcctaggtccagctgatggaattaatgccatggctcagccagaggagtgtatccatatattgctggatgctagaaaagagggaaataaatcatgcccattaaccttaaccttggtttatcgatgctgcctacactacttgcagatacttttgttgagcggagctaatgcagttatacagaaaagcggaccttcaaaatgatcttttttttttgacagaggaaaatgaatccaggagagagaagggtacataa

SEQ ID NO: 95911 - DNA, 504 bp, Oryza sativa
taataaattataggttttaagtacgtgctcaatctgtcttcacatgtttaaaaagctttgttggatttggttggcaagtattgcatttttatacaatacaatacaatgtctcgtgtacggtttttggcaaagaagacagggtttatgctagacacattgccggctgcctaattgaaataattatgagccatagttaaaaaattatggatgtgggaggtctccagcttggatataaataattttatcccttccattatataattatgtaagtttattactctgattgtatggatgagtttggttcgtacaggtgttcattatataattcttgagttgacatatatgattttttaaggagcaaaaatggcacatttgtcaggctagagtagcccacattttgctatggatttttttttgggtcatatagtgttattttctgacatttttgcgtcttttttcatagttgatttgctcaaacagacgtgctgtaatacaaattttgaa

SEQ ID NO: 95912 - DNA, 1383 bp, Oryza sativa
agatgtcataaaggaaaaaaaaagaagaatgtgtacaagatcagctccatcgagtagttttttctttctttctttgtggctctgagattttcctcaaattgtgcatatgagcagcaaccacccttggcgagtttgtcaaagaattcacgcggccgcagcaccgcttcacgccatctcgctaaattttttgaaagtatttttttactaatgatgtataaggcaatcatgtttccttaaaaaaagcaatcacgagcgcatatataaacgtgtgctcacccatcatataaatacacatacacacacctaccctaaaagaaaaaatatttgtctccaaaaaaaggaaaaagtatgtgcttagtatttgctagaaaaaacatatacacatatcatcgaaaatgccgcatagaaccacattatatctttttaattatgtcattctcatctatataatgttaataattaggacaaataattttgacaatatagattattccatcgtatattacccatgaacatacataggtaaatcagatatataataaaagaaaaaacaaaacaaaaaatatattagtttatatgtttgcgaacgatggtgagagatcagattatatataaccgggacaattcgtaccgttcttattgtttaagggtgtaattcgactttttccttaaaagtcttccacataaggatttataataaaaaattaatcaacactaaacttcctacaaacgctcctaagcctccacgtggcattctataaatgctcctaagccgccacgtggcatcctataaattagagaaattcttaaaaggacacaacgtataaccgttgatttttattaaattttgtggaccattatttgtaaccattagatttattagaaaaaaacatatccttatccctaggcccacctcggcctgttggcaattgcatgtacgtacgtacgtacgtctgctcaacccccccccccctaattctttcacccattttttcacctattttttcttctattttcattcttttagaaaagcaaaaattgtatgccaaacaattaagcaaatgcagcatctaaattataatgctaatatttgatctgcttatgtctttagatattttacattttaaaactcatgtcctctttaattcaactgtaaagagagaaatgtcacattaatttgggctacattttctgacttttgcgtgtcatttaagcaattttaaaactataaaaattaatgatatatatttttgtcatcgtatataacttgataataattaaattatatctaataaaagtaaaatgaacagatctatgagtaatattaaaaaaatagcccccccccccaacattgtaacatagtaaaaagtacgcatcttataa

SEQ ID NO: 95913 - DNA, 2676 bp, Oryza sativa
tcttgattttgattatcttcgtgtgcgtgtgcatgcagcacgtgtggaggtctccccggaggtacatgcgggcggcggtggaggagaagcggggatcgccggcgccggcgccgctgccggacggcgccctggggctgcagcccggcggcgtcgagggtgcggctgcggcggcgaggacgacggaggaagaggccgccggagccggagccgcgatggcgccgttcccggcggccgcggacgtcggcgggaaagatgatggtgattccggcgacggcggcggcagcgatggcgcagcggacgacgccggcgtcgactacgcgccgcccaagacgcatcctccgtctcacaactgaaatctagtcgatcgtctcttcatacgacgaattcgaagatcgatgcatgacgacgataagttcccccatgcaagcagcaataatgcatgtcgtaaagtatatattattcgatctttgtctcagttaattagctagcattatgtcctaatctgttttttctttctttctagttagatttctctttgttctttcgtacgttcttcatgaaatattttgcaagagttgccgtaaacaatctctctccctctatctgtttaatttgtgccatggttcaaaattccggaccgaaattttggaattttttttgttgtattggactcgatattatttgggctgaattttttaaagtttttcgattttttttatttggcaatattttgttcaaatttgaccaaatcccaatacaaacaccgaaaacgaaagattgaatcctgatttgttgatcgtatgcgtattgtgttcttcattgtgtggagtcatatactccatgagaaaaaatgaatttaggcaaaccttagtaagaatgaagagcaaaaaggaaaaaaaagtatataaaattttctctacatcccaaaataaattaacttttggtcgttcgtgtgctgagaagttagcttattttggggcggagaagtaactaagtagtaattgggaaattgggaaagtgtttttacaactaggattgggatgacaataatcttgcagaggtctctgggatggatgaagttgatgaattgactgagaagttgatgatgattggccatgaaaggggctagctagctagtaggatccaggagctaagccaagctaagctagggttttgaaaactagaagccttgggaatgttggagaagacaagcatagctaagctaagctagttttacccccttcattgcgacatgcgtgtttgaatgagctatacaacactactagaaaaagcatttttgcaggcggacaaaactaattttcgcaggcgggagagaggtccgcctgcaccacaatgactgcgaaaatcatccatctttgcagtcggggcaacggcccgcctgcgaaaatagaagaaacgaacaaaaaaaaaaacgccagcctacaccaggagccgccgccggcggcctcccccctccctcctctggccagatctgggagggaggggggaggggagccgccgccgccgcctagcctgggtcgtcgccgctccacgccgtcggcgccgccgccaacctcctcggccgcgccgcctcgcctcctcgccgctgccgccccttgccgccacatgccgccgggagctgccgccggggagagtacaagtgaggggaggggagaggaggagaggggaggggaggggccggtggtgaggagaggtgtggaggggaggactgaggacttagaaaaaattgccgcccgcgtgtatttatattaagtctattttcgcagtcggacttagaaaaatgattttcgcagtcgccccttaagtgctccgcctgcgaagcgccgcttaagtggtatatttcaccccgatttatatttcataggcagtcatttggctctaaggattatgtccgcctgcgaaaatgagaccccccacgtcaggaaaaatgctttttctagtagtgcaaccctctggttagtggttacaatgcattcagagatgcatggcaagttaaattcgttgcagacttccatggactagctagctatagctagtactatactagcttcattccaattttccaattcaccattatattcgtagttatctccactagtaatttttttttcacaaattactggtgaaacagagaggtgtgagagctagctgatgtgaaataaagcagacagcaaggctttatataagcaattccaaaactcttgtttgtgaaggcaattttctgaagaatgtggtatttactttatttttttccctaaactaacttacatactaccaatatatatattctgctttctttaattttcttgaaacaaaaagaaaaaaaaaggtgagttgcagagttagccatgcatgctctgatgagaaaatctcaggctctttgatgcgcaacaaacctgagaggtttagccaagctgataactttcctttagtcatgcccagtgttcaatatttcgttttcagcatttgtatgggagggtgccgatatactgaaatctcggaaattttggttcgaatttttgagcaaaatattgcaaagttcagaaaaaaaataaaaaacctttaaaatttcaattgaaataatatcgtatcgggaggaggggggggggttggttccggtacaaccgaattttgaacccgggtcatgactcatga

SEQ ID NO: 95914 - DNA, 505 bp, Oryza sativa
taaccctttttaaaccttattttacaaataaataccacaaaattctcccaccttccaaaataccacaatgaaaccctattccttccagaaaaaagcacaaatcttaacaaaattgacgcgagggagacaacgctactttccaaagaccaagttgcccctcagcccttttgttcaacctgtcgtatcttccccctttcttctcatacttcaccaattttctcttcgagccttaagtccacatctatggcaatgacgcagggaaaagcaggcacaaatccacctagaggcctcaattttttctcccaaactctagagcttgagctgcataaaaagaaaaaaaaaacagtggctctccctcttcttactcctgtgcagtggttcttgttctttcggtgactcctaaactagtttcttctgcaaggtgatgcttggggatgggtttctagcgccgacccatggatgcttcagtcaatttttagggcttggggatggatttatggtgccg

SEQ ID NO: 95915 - DNA, 607 bp, Oryza sativa
accccagctgtgaagaaaatcaaagaatacttgctgactttcctttttgcatctagatcataatatgccacaccaattgtcatgatgaagtaaccaaacaagggctttgagatcccagatttagctgctgatgatgaccctaatagtatctttgcaatgtcgtctttctgcagcccataccaaagtctaaagaaaggatgtatttcctttctgacctcttgctttggttgcttagagtttagttgttccaatttgttctgttgtccctgctttggagagagctgcctgtcgtacacttcatcaatttcatcttctatgacattatcagaagagctgtttaatcaaccgaaatgtaaaaattagtactaattcttttttgagcgaagtaatcctactggcatatagtattattatattcactaaactttgtgccattgattttatatgttttcattaagttttgtaattctagatctttttaatagtgagacttagctgatgatttcaaaccattcactttcagcttgcacaatctgcaggaaaggatcctttcggtacccaacatgcatgcgctatttttatcaatggtaagcataaactattggtg

SEQ ID NO: 95916 - DNA, 1243 bp, Oryza sativa
tcattttcaccggatatgtccccaatagcttcagctgcagactgcagttccccctgtccctgcacttttacttgatcacagaagaaaagagcagagtggttatcttgtactaggtatcaggacacagtaattgactctcggtgagagtataattatttggagctctttttttggctaaccgtgttttggcgttgataagtaaaagaaaatactgaaagtaggaaaaaaaattgcaatgtggcttctcaattagcagcttctcttagccaagaagggttcaagaagctttccttgtcgtgtttaaggaaaactcaggaggcttacattttcggatacaaggaaaactaattttatcaaagttatatactatctccgtcgaaaaaaaattaagctatcatctaaacatgacaattcttgctatggacatagacatgcataccactttttttttttacacaaaggcatacatataacacatcctatctaaaagtctagaacactatataatgcatggtgtgaaccatgcaaaaacctctaaagtgctgcataaaatggttataatcatacagttgagagttgagacaatattgaactaacaatgaattcgcatttcatgtttagttgtttatatccttcctcccatctcatacgcgcggtaacctctcacatctctctcaaccacaaccccattgccctccccctccccccacacacacacaaccatgggcatcatacttttcccattagcattggcttcatctctttcatgccgatcttatcaacccatcttcccctttgtcatctgttgctctcgatgactttagtctcttgtctagatgactctttcttgggacatggtgtcatggtagccagctttctgatggcctcaatcagctcagtcttactatcactatatctccactgattttatctctcttgatgattcatccaatccacaatcctatttgccagacctatcgttcctataaatttgggccactagatccatatgagttgcagttaatgacacaatgacgaggtttacataaaacgtgagctcatcaacctcacagatatgcaacctctagtcaccacaaacaattctagccatcagagctagatgagtcatggttgaggacgcgagcaccacagtgacatcattgatcataccggtgcagtctctatagccgtagaccggaccaatgttcaatccgtgtcactgcctcacctttgttagcaaggt

SEQ ID NO: 95917 - DNA, 558 bp, Oryza sativa
ccgccgcgtgtggcatgcacgtacgcatgccgtacgtgcagctcgtgcatcgcagccggtgcccgggacggcggcgccggctctggttctgggttacacttgagtcttttcgtaaggccatcaacaaaacagtctcgatagctagttgattatactaccttatttcttttaaataaataaataaataacacagttgattttcgataaatgtttcatcatttatcttattcaaaaaattaatgtaattaccattaattttgtcatgagtggttttatcacaaaagcattttaagcataatttacattttatacattcgcaaaaaaaaattcaataagatgaaaatagtcgaacatgtgttaaaaagttaaatgtatgatgtatcatatattaaaaaaagagagtgagtaagtaacttgtgactaaaaaaaattatatatgcagtcttatattagctacttaaaacccgatgaaaaaataaactatatgaaattcgaattttagctatgactgataagctaaagggtaaacgattgagctaagagtagggctgcaggaat

SEQ ID NO: 95918 - DNA, 750 bp, Oryza sativa
attcctgcagcccttacttgtcgttctagacgatctcaaactaaactagtggttatgccagattacattgctactctgattaattatagcctagtcatcttccaaaacaaacattaaaattcccaaagccaaattacattgctacactctataagtactctcgaaagtgagaacgataagtattttgattaaaattttaaatgctagactgacaagtaaattaaaacggagagagtactaagaagaaaagggggctgctaatagcaacaacaacgtcacaaaacactgcatatttggatgctacccaacaacagaacaaaaaggactgacaacaactaaatgaatgcagaaacttacacgactattgttctaacagctaaacagtgtatcagtgaagaaattatcgtgagcatgtgcgctacacacgttcaagcaaaaaagtaataggaaagaaacaaattattttctgagttgaccaatagagataatatagtttgatataacatgataacaggagagatcacaggcttttgaaagtggaaattttatttactcaattatgttccattgtttaatttaattagatgtatgaatagatgattgagtaatcatgattggttcttgattattgtttataataataaactcagttgacaaactttaagtactattttttgtaaagcttcgttcacaaattctatcgaggaatttgacgagactccttggaaattaggatccgtttgagctgtt

SEQ ID NO: 95919 - DNA, 746 bp, Oryza sativa
tactggaccgtgtgccaccctctgcaaacgtggcatgacacgtcggacatgaagtgcaacaagccagtgccacattgacacatcagcacacgacaaatggtgtttagttgcaggttcaggtgctaatgtccactcaaaagagggagagagagaaggaaagaggggattaatcattatctttgtcatgagggtttagtggatcaatcctcattttgtctgggatcttgggagtttataattagttggtgtagcatgcatggattgatgctccatggccttgcctctgctgtgatatgtcggccttgatgctcactcctgattggttgttgatttgggggctacatttctctctgccacagaacttgctcttcaagggaacaaaccacaatctgaaaagactcattttgcaaatgaaaatgttcactcatgtcaatcatctctaatactatgtaggagtactatatttttgtgggagtatttatgccatattctagtgggttcactttaacaaatttatattggtttacacatccatctccaaaggccttagcccttaggtgtgctgattataaccaagagcagaacaacactttctcatgaaacttgttttctcgtactacatatatgtggtaattatggttcattgagaataatatgatttacttgaaatataaccattgcggaggtcaaaagttattttctattattaaaaaaatgatataggttcgatcaggggctgcaggaat

SEQ ID NO: 95920 - DNA, 645 bp, Oryza sativa
ccatgtaatgtgatagcctatccaacacatttccagataggatgctgactctatgattttctaactgcattattggttactaacttatgtaccattggagttaataataatacctggttcaacggcagtcaaagcttaattgattggtgatctacatcacattcacatgctctctgtagtcatatttgatccaaaaaaaaattgccgcatatcatctgcaccaatcagcactcatatttcccttaaaaatagcatgcatattagaactatatagcttgtagccatcatattataagacataatgacaactggtaccatggcttcctttcttttgcttgaccttatctaatcatcttttattttcttgtaagggtatacgtagattctatcattcatgttattgtcaggtggctgatttaaaactattaactgtatgcactttattatatgtgcatcatgttgtttgttaaaattgttctctgctttttattaaacgaaaggcatttggggctattttattcttggagaaagactagcccaatttaggtaaaaccgtgtttgcattgtaggatttctgcaagaattttgttcaaatctgtcccgtatcggttagtgttacagcatcacaaacagggctgcaggaat

SEQ ID NO: 95921 - DNA, 673 bp, Oryza sativa
aaattttgtacaaatttgtttgtagtaattaatttagcataatagtaagtagctattagtttcgctatttaaatttgtttgtactaattaatttagcataacagtaagtactagttaaatttggaaatctcagagaatttaaatttgttcatacgacatattgttaatatacaatttatttttgtactaattagtttgtactaatttgagtaatttaaaatgtggacgataacacttttttttacattagaggtttgaaacgatggccaatagtactcctaagaggatatgtgaatttgtcaaggattttaaataacatgttggagggtatgttaacatttttttttaaaaaaaagtggaggatatgtttgccttctccattttttttagtcaacatgttgatgaaataaggaagtcaattagtgcactacttgataataacatatcaaattttgtacaaatttgtttgtagtaattaatttagcataatagtaagtagtcattagtttcgctatttaaatttgtttgtactaattaatttagcataacagtaagtactagttaaatttggaaatctcagagaatttaaatttgttcatacgacatattgttaatatacaatttatttttgtactaattagtttgtactaatttgagtaatttaaaatgtgga

SEQ ID NO: 95922 - DNA, 513 bp, Oryza sativa
aattcctgcagcccattatatgagataaaggttcatagggataagtgtgtaaatgtgattatatgagcgcttagggcaagttttataataggggtagttgtcacatttaattttatctatgcaagataagaggtgatatatacaatacaccacattttcactactctagcatactaatctaaataattttattttatttgtttgtctaatctctttttcttttctaaataattttattttatttgtttgtctaatctctttttctttcatctctttttttcttggggtttgtacgaaggttgtcccttgtacgaggggatggctcacattttcttttcttatttatttcttcaccttatcacctattcgagggaaatttaactatttgcaactagtaggtttggcttgttcaaatgctctccttagatttcttagatttctcagtgaacaaggcacaagtgcaaaacttgaaatgcaagaacgatcacattttcagtccaaaagatctgaata

SEQ ID NO: 95923 - DNA, 628 bp, Oryza sativa
atgaaattagaaagaaaaatggaagcagcgtaaagagatatcaatttacatatatgatgctaatttttagataatggatatatggtgctttagtaaagtactccaaaaaaatttatagaaaaattttgcatgaaatgcaccgtttagaagcgtggagagcatgcaaacgaaaaatccaaattccagaaccggaaaagaacagggccaaaggacagatagaaacggcatgttcgtctcttgaaagataaagatagcaaaggtatttttaggacaagtaactaacaatgagcatctcataaaaacaagaaaaaatattttcctaatagaattttattatttgctaatatatttagctacagtgtgagatgttcgataaatcccaaagtatgcgccgaaaagttccaaccctgcatctgctgtcacaactttctaaactgctgttacatcagttttaggtgtcctgaaatccaaacctaactcccggtttggatcactgccaagacaaaacatgtgctgctgatatcttcaaaattgtatgttcttgtcccaatgctttttttaatcatctttcaaagattgttaagcaagctgcattattgagctctcacacactacaatacatatgaat

SEQ ID NO: 95924 - DNA, 947 bp, Oryza sativa
aacttttagttcagataaaaatttagtttatattgtagatagatcctattttaaataatgaactatggtttaaatagtcaactatggtaaaaaaagagagtaaaaggaaccgtatagtaaggtgcggaccataaacggccatgtatacaaacataacaacttccaatctgagaattaacaatccgagaattaagagggaatgatggattttctttttcttgattatatctacgtgttttattttctacttttttcagcgaatagcgagtaccatatgtacttatatttgggtggacggatagtagatacatatacaaaaataacaacttttggctgcgttcacaagtctaggttcccatcctcgtttcgcacacatacacttcccgctactactaaacggtgtatttttttgcaaaaaatattttatagaaaagtagctgtaaaaaattatttgaatccatttttatgtttttaaactaatacttaattaattaatcatgtgctcgttttcttattaggatggaaagacgattattgttttcccaatcttacatacgtgcgtaggtagtatatgtatatatgtttatgaactgcgtacgtatttttcttgacgtacgtacatggatacatattgcctttgatctactgataaaatctttgacaggcacgttagtacagttttgtgctgtgattatagatgaatgatttttgataggtgcacaaattattgtgcagattatgtatcgtgctgagttgttgtatataagatatatattcaaatgatggcaatatgtcagatttgttcttcctcttcctgagagctacgtttctcgtgcacaaacattattagaaaaaaaggaaaagtcccaacacacagaagttgtctcgtaattacatatactgtagattaggaaggagggtttctatcgtgtcgtttagaagggtgg

SEQ ID NO: 95925 - DNA, 675 bp, Oryza sativa
aaaaactaaattttttgaggcgcataaaaaaacagtaagaggaataatggagtaggagatagaaaaacagcagtagtacatatacatagctactaggtgcagaaagaaagaaacaacatccatgcatccacagcagctgctgctgctgcaaatcctttggcatggagcaaaactgtaagagtgatggaatcttgaacagtctgaatttggaagtttgacatgatgggttagatactaacatctgaagtctgaactctcaactacaggtaatacatgactcctgtatctcctgatcacttgcatttccaaattaaacttcttattatctgcttcttctatgatactaatacaagagaatatttacatgtgctaactatgctagattaaggttaattaatagtcactgtgtcccggtctgcaagacaggaaataaagctggattgaaacaggggttacatagtactagcagcagcagtttacagagttaaatcaatgagcttcttcttctgttcacatacgtgtgagtgcaataagcctttttacatgcatgcttaggtttattggtgatcttttcatagacgtgcatgcatactagtacctgtgtagtagctagcatagatctcatgagtggtagtgataacatctctagcccttaggccatcaaagaaggataca

SEQ ID NO: 95926 - DNA, 685 bp, Oryza sativa
ttctcgaaagatgtagatgcacttcctaaaactttatatttgtataagcaatatttaaaaataagctatacagtaaaagagctttcatttacaaattaatctaccaaatataatttttcatactttaaaataccgatattttttattgatgatttaagatttcgagatgtgacgactacatgcaagtattatatgacgtagcatttctttaagaacggaggtttgcattgctgacttgctgtatgtatgatggacaacgcaacgtgattgatacgtagtatatacgaaagcatgacgatgacatatatacgtattgctactcggtctcaccatattccccttattaataatgcataaattaattaatataagaaaaaaatatattccccttatactcccacgcccaatgatgaatttagtatagtatagtaaaaggtaattaaggcgatcacatcgagttgtcgatatccggctgttaattaaattagacaactatttaactaacatgattaaatatatatatatgtcgaaaatcatatgcccttccaggcttccaatcaagagtgattattccctatatggttttcaaacgttaattttcaacaaaaccttttcaaagaattacttccacaaagtctatggtaaatatatataatataatttgtggatgttgtacatttgaaac

SEQ ID NO: 95927 - DNA, 580 bp, Oryza sativa
ctagcattttccatatttatattgatgccaatgaatctagacatatatatctatctaaattcattaacatcaatatgaatgtgggaaatgctagaatgacttacattgtgaaacggaggaagtagcaataagtacatttaaagcagattgcagctactcgcctactccctccatcccaaaatatttttaattttcacccatctcacacgtaccgatacaaaacaaaaggactagaatgcatctactttattgaatctcaatgcaattgttccccattttatctattctcaatacaattatttcatgctttcataaactccgatacaatgattattataaaaataaatttattttggaacaaatgaaaagagctaaaaatggaacttatttggaacagatggagtatgtagaacacatgatcgtggtggatcttatgatatctttttgcgaacacatcctacaatacaattgcatataaatataagtatatttacaaaaatataagcaagggttgtgtattaattataagtcttgttttgaagacctaatttcgtgcataattgcacgtgaaaatccatta

SEQ ID NO: 95928 - DNA, 1186 bp, Oryza sativa
ggagtaagttttagacaacaatgggttttgaggcatactgtacttctatctatgctgtcattttatttaatctgctaatatagcaaaaaaaaaatttcgaaggagtaaaatacatcaatggtccttaaatttgtacttcctccgttccaaaatgttgctacctaggatgagatttgacccgcaatatttttgggaaggaggtagtaagaagtttttttttttgagcaaattttagcgaacgtcacgttttatggttgaagttgcataaaaccccaggcattatgaccaatggcacataggcccagctattgtggttctaaagtatttagttaaaatttcaaaacgtagaatgtatatgaaacttttagttattgatttcttaattaaggttgtcggtttactcttcgctactttgaaaaatattattttagatatgttgaaatcaattgaaattagaataaaggtggggttttatgaaacttttacaccataaaacctgtggttatttgccacaagtcataatacccgtggttttgtgaaactttgaccataaaacatggggtttatgaaatttaactttttttttcttcatcatgttattgtcacatttattccttgttgcttactctgaactcgtgtgggttgtcctatttagttaaagtttgtgtgcaaagttgtgaactataaactcaattttggacgagaatgggttttgaggcattctgtacttctatctatgttgttacatgaaatttggtttattctgctgacacaactcaaaagtatttttggaggaataaaatacaccaatggtccttgaacttgtaaggtgtgacttactgtaggtccatggacttgttaaagcatgccatactatctgaacttctcccggtgttgacgtggcagcagatatggacccagatgtgtctgccatctgtatcctcgaccctctctcatctctctcctttctccctcatcgatcatctctctcatcctttctctcccctccctcatcctccatcatctccctcgttcttaatttcttctgttttctctgccacatcacatgcatagtcttccatatcaagaaccagatcacggtctgaaggggtattgaactgtttcggacctagattacatacttttaacacgtttaggggcttggatctgtattttgcaacgtcta

SEQ ID NO: 95929 - DNA, 568 bp, Oryza sativa
cctaactttgtactatgggcctgatggtgaaggcaataaggaggatggaggcctactctactaatgggcctgaggcccagaacattaactggcttctagcaagcggacgatcgaaagaacgagctgttaggtatatcggcaatctgaatgaatagaaatgtggcattatacatttatacatacatatttgtagacaaacttaaaatgactgtaaaagttcaaagcatggcgtaaataccagattactcacaccggcaattaagcaaaagtctaaagatcaaatcaacgggcgctgacgagctgaacatcccatccaagcatcaactactgtaaaatcaagaacaactcaaatgaactgaacattactagaactgatgtttgagcaacgaagacgagtccttcgaaccagctgaagtggatgtgtcagaagaagtcgagatgtgggttgcgtagccactcaccgttgttgttgatgactgcgtcgcacttgaggatgacatccctgcaggcgacgtgaagagctcatctacagagaccactggaggaatgtacatcggcacgggcatct

SEQ ID NO: 95930 - DNA, 735 bp, Oryza sativa
tggcgccggtggcgcgtggatgcacagctccaccaagaacgggcagtccgtgaccgacctcggcgtggtggtacggtggtgcaggatcaactactgcttctacgtgcgcggcgagatggggcagcagcggagcaccgggtggatgatggccgagtacgagatcaccgacccgcggtgctaccgccgcgccgacgacggcgaggaggacgacttctgggttctctgccatgtcaggaagagctcgaggccccaagccgccaagatctctccagccaagccagcacggcggcgcaagcccgccgccgccgccgccgcggatgtccgggctgcgtgatccggccgacggcggagatcacgaggtttgcctcgcgttgggattcgacttcggttatacttttgctttggaattgtgttcctttgctttattcctcctctagcatctgcccatacattccgtgtgatgaacactgcgaatcaaatgggacgtttaagatgttgttgttgtactgatagcgtgattgaattcatggcctctttctgccaagccgcatatggagttttttttggtgtttcagtttcaagtcgcggttggtgaatccgaaatcacgtgattaaaacagtaattatcgagcacggaaggaatggaatttttttaaaaaaaatgcagaacggagtaatttcttacagatcatcctgtttctgcttgatgcgatagctaatcgctgtcggtgctct

SEQ ID NO: 95931 - DNA, 1321 bp, Oryza sativa
gtgattgtgtcatcagtgaccactaatcactgaccaagaccaaacccgtcaaaggtgagggtttgggcccgtcagagatgacctggtccggcgtagtgtcaacccgtgcttctaagccatcggcatgctcgtgtactacaacgagaccttggatgccggccgtggcatccccgtggacgtcgacgtgtgcgctcaggtcgccggcggcgagctagaggtcgtacaccatacggaggaggtgccgaagctcgtagttgtcggcgcgggtgagcacgccgatgagaaggcggaagtcgggcttccgcgacgccgtgtacgcccccggtgtcgccgggccgcacgagctcatcatgagcgcctggacggtgggaaggaggatcctgccgccatctcgctccacgtcccgccgccctcgccctctctgccgccgctgccatcggagccgaccgagcgctaccccgacgtctagtacgccgcgtcctcggctcctcgcccgccgcccacagccgcctccgcccccgcccaccgccggcctcggctccttgcccgccgctcgcagccgccttctgttcactgagagagagaggggcaaaggaggaggagagagaggggcagagaaggagagaaacaacaagcgctgaaaggtgggccctaccgttgtttttgctgactgtattgctacgagtgtgccacgtaggctgaaaaccagttcgaatcgatttagggttataatttatccagttttgagagtttggggtgttaaatgtctggtattatagtttgggggtaaatcgtactaccgcaatagttcggggggtaattcgtactttccaatatggaaatatctaactatttgccaaactattggtcatcattaattacaatcttaatttggtttttctcataattctaaggaaacataaaattaaattccattaatatattactctgtatgtttcaaaatattactggtcattctcacatttgaaattattattttagatcgcggtattctatcttcacattttatcaatgccatgtataactgttaatcaaagttaatattgcttttgaaaactataatgtagttaataagcatagcagtgtaatttgcacatctcctagtttgatgtgaaattttgctacaatgacaaataatataaaatgagagataggcaaatttaatatatattttgcagatgaaccatattacaggctaaattaggcggcacgtcaacagggcgtgcagatcttctagtatctaataatctaaagctagcgcttcttgtgccaacgggacatttaactatttgtcactatt

SEQ ID NO: 95932 - DNA, 556 bp, Oryza sativa
ttttttagaatcaaacataagtaaccaagcctaccagagaggggtgaatgttagattacgtcaacggaagtcaaataatcgaatcttaatagatcaaaacacatcccacaaaagccaatggaacacacgtttggcggtctatccgacctactagggtcggtctgaccgaagcttgaccggtctgaccgctggtcctctcgcggtctaaccgtcagcctgaaaacaacacgacagcgcttcggtaaaaacacgatttctcttaaaccaaccgttggatcgagttgcaaacttgacactaaacaacctaaagaacaattccaccggagggatttgtaaactaataaacggtttaagagaaaatacccttgaaaatcagctctatcaaaatttcagcaaatctgaacaaaacctaaaacttaagcaaattcaaatctaacaagaacctgtttagggtagaaaaatacgaatatgtccctctatgtttagagagaaaataagtgcggacgtgccagtgtacctaaatacacaaatgtaaaataaacataaaagagacaca

SEQ ID NO: 95933 - DNA, 701 bp, Oryza sativa
aataacttttgtgaaatatgtaaaactatatgtatacataaaagtatatttaacaatgaatcaaatgatagaaaaataattaagaattacttcaattttttaaataactagcaaaaatgcccgtgcgttgcaacgggtaaaaagaatccaatgacaatatacacttttcatgcataaccatattaatgataatgtttatatggatcgttgtagttaccacaattagaaaattggatttttccgccccttgtaccatataatggttttttattatatacggacgacggaaacttttttaactttttaagtaaaattagggattagagattagatctgttcccttttgtgattaggaatttagattgtttatttacttttctagaaataaaaagaaaaaaaagagatcgggagatggggaggagatttttttccacctccgattcgcttttgtttttctgttgccgcgtttttcttttcaggatcgctcttttttttaagttagacggacgacaaaaacatcataaattttttaagtagtaacagaaacgaacggtcaaatatattttaataaatcaacggcgtcaaatatttacctcgccaactgccccgaggcttcctccattgtcacggttcaaatcaatagcagccacaacctttcaatttagcgaatgacgagtgaaacgaccgccaacacgcaatgt

SEQ ID NO: 95934 - DNA, 1156 bp, Oryza sativa
agacaccatgtgtgtttatggtgttaaatatttatattttgacaaacatctatagtttagcgcttggtttattttcaatacttattgttgataatgacatgagacacctttactaattcgaagaatatatttattttttttaaatttattaataataactaatgcgtgggagtatatgggagttttttattttttttgtatgatactatatacgtatattttttttggttctatctttttttgacacgatggctttattcttttaccgtacgtatgtaggttttattgttccttttcaatcttacgtacttactttttttttggcgaacctattctctctcgtatgtataggtggaaagtattagtattagagatatatatctaatctaatgatctaaataacggatccatcaatttaagtgaaaatcaacggtatagatatagatataatctaatggtctaaaataacgggtccaccaatttaaatgaaaatcgacggtgagattaaacagtgccacgtggcggtttaggagcgtttataagaatgccacgtgtcgtcttgagagtgtttgtaggacgtttaatggacttttagtatataatagatagatagatatattttgttccctaccttgcccctctcttgattaacggtacacattattccatctccaggtacctctaagtacctcgcaaacggtgtaaaaagtctcgaaaagtaattgaaagctcatactgtcagtagagagttcactgtctttttcaacacggtgacggtcgtgcgtgtatgctgcaggctggaactcaggacttaattcggtcttcgatcggttgtactagatgacatcaaagctcaaatttgcggagactctttactccacggccaaaggggagtctttaaagtctttctgcgatccggatcgaattcggatcctctgcggtggaggagaaaattcagaggttgctacagtacccagcattaggagtactgtgggccgtccgatcaagaacggacggatcagaccgttcgctacagtaaaacagtgcattgatgcacagtactttcatccctgtagatacagtaaatcatcactgtagcggtactgttctgtgcattgaaacactgtccccctcacatatcactgtggccacagtg

SEQ ID NO: 95935 - DNA, 542 bp, Oryza sativa
ttttgtaatttcccaatatggtcaggttaatttgacagagcggcggtcctactcgtggggcatcggatggatcagccgctatattgatgtgcagaagccaccgaatcgaagccgggttcattgcaagcacaggagcattctgtttgtggacaagcagcatgaaaatggccccaagttcgtggtatcgatgcccgtatggtatcctgtggacactgggctgttcggtgacagcttcttttgatcagtatgtcaaagtgtgggatactaattcgactcaagtatgcattcatctgctttgtggatgcttattttttttttcctcttgcctcctttggtggtggcaacggtgtgatcctgatgttctgatttttgccttggctttcttttcctaggtcgtaatggattttaagatgctgaaagtgtatagcgcagcaatgtccccaattgcaacaacacatatgctgatcgctactggaagtgcggatgttcaggtccatttatgtgacattgcttttggagcctttacccacacgttgtccggt

SEQ ID NO: 95936 - DNA, 1133 bp, Oryza sativa
ggcgctagccagtaaaatatcttcactatattgggtgaggttacaatgccgcacggcggcttacaagagatatatatatatatatatgaggtagaaccctaaaaggtattacgatccgtaccgtaaaaggtggaaccctaaaaggctctgaaccaagcctaccggcgacgggcctccgcttcactacggcagaatctagcctttattaagtgtaaataaatttggatcacaactcaacagtttaagcttctaaaatatgcaaaaccatcatccaaaaccaccttaacggtaatatggatggtatggcaaagttcagggggttggatgttcgattttaaagtgcaatgtgctagacagacttcaatataaagtttagggatgtatatatactttttcatattacatattacatacgtatatacttatttgggcctaatactttattctcggtcttcttttctcaacacatctactcctcccgacactattttgttttgttgtgatgaactttatcggcaataattattgagtgaatagctagccttaaaatcatgagttcattgttgctttgctttactgaaacaaaaaacacttatttgaaaatgaaaattgatatgtttttagtccgggtaactttctcgagactgggataagtattatttgccttttcaaagtggctgtccataaaaacgattgtatcagcaatgtactgtaaaatggataatcacgtcttaagttttgcaactactattttattgcaaggttcaataataactgccaacatttcaggtttaaatgaactgtaatttaaacgtgcgttccaaactactctctcggttttaaaatatttgatgatgttgatttttaaggtgatatttgatcatttatattattaaaaattttaatggaaatgtgcaaaagtatatcatggtccaaatacatttaattattaaaaaaatcacaaccaatataaatgttagttttatttaggaagacgaatgtaatgtggaaatgtcaacaggcttatgtatttaaaaacataggtagtataaattacgtacatagctctgtgaaatgtttcttgtaaatatttttggataattgtgagatcagtcattcgatgcacaaattag

SEQ ID NO: 95937 - DNA, 1852 bp, Oryza sativa
atatagagctggcttactctttcccggtcagatttgtggttggtgcatgcatgtacagagagagagagacagtgacagagggagataattttgactttgtgacgataaagtagaagactgggcaaggacgcagtcatgttcatgtatgctgagctcggtcagggatagggattgggtgcagaccaaagatcaaccccctagtccatgctgcaaaagtatcataaatggcttagcacaatttgacttgaacagcagtacaagtggtcgattggaccttttcctctcacttttgggatttgaccatgttgagagaaaggtattacctgtgttcttatattttatatatgtatgatgatgattgtcaactgtaaagaaatttgatattgaaacagttttcaaagtacctttttatataatttctttcaaattaaatatatatatagtgttgtcaacttttggacataagaccatacatcttattttaaaaactatgtaaatattatttagtttgttctgacttattttactagtcaaggtactttaatttaaggataaattatacttctacttatctgtattaaaatttcgaattagatgaattgtcaaactttatgtcctaaagacaacagtgtcatttatttaaaattgaagtataatcataataactagtaaattaaatctacagtattatggaattaccttttgagcccggtgtgtacacgtagattttgatccattccataaaaatagttcaaaagatcaatatagttaatttgatgcatcatcaaaactatagtccaaatcaaaattttcgtaacttgtttttgtaaatatattagtactatgacattacgattatatttttatgacaacactaggaacatatttcttgatgtataggcaaactttaagcatatcgattatatattcttgaatattaagtttaataacacatgaaaatggtatgagccatagaaactaaactgttgtaaaattaatttactatcattcataatccgaagctctagtcgtcgttttttatgcatcaccactactacttttgatgcttgtatatatgatagatataataatttggatgtagtatggtttaattcggtcaaaaatctatatagatcgttatttgtgacgtcactttctttaaatatgattaatctcctagctcgtgttgacttttgtaatcttgtgttttgactggagatgttatatatgcagcgccgtttacgacagtgcgactcgacgccgttcatgcatggacaattcttgcatgcgaagcagcgaaagcctttcttgcatactcctacggaaaaagtacaccaaagatctctcaacttgtcatcgaattacaaaatcgtctcccccaaccgtaaaaccaaatataaacatcccttaacttacaaaactgtttgttttacatctttcgatggttttgaccattgttttgtccgacgtgacggacgagccagcgtaggacccacatgagccctaaatgttaggacgccacgtcatcaggctctctctttcccctcctctcccttcctcctctctccctctctcgaaaacgctttgcatctgccgtccgacggaacgaaaagtatcggacgcttccgtcctaccgcgccacgcagtcaacgctgaaacatatcggcgtccatccatccaaacttatccatccatgtaataattcctctctcctctagccttctcgtattctcctttttctctttgcttcaactaccaacgctgcgccacttttctcaaataaagatgctattagatggcaggatgaggagctagatggagtaagagtcaggccgggcatggatgccagggg

SEQ ID NO: 95938 - DNA, 664 bp, Oryza sativa
aacaggaacaggaacttgcagtaggagtagtcatgttgaagaacgctccctaaaaaccttattgcccacctacccgtgcaggaactcagacgaacagagtttcggaggcccgactcgtcccaatctcttgtgcatgcaagagatcagagaccggggagaacagaagcagcacaagaacagagaaactggggtggaaggagaagtgcgccgagagagaggaaagaacagaagacactcgatctgttcgtccctttggcagagtgtttctcatgagagtaatgtttgcgcaattaatcctcaaattaacagcgaatgaatcgctctccgttaatacagaatcaattcccatatattttccgcctatccgtgcaggaactcagacggacagagtttcggaggccctactcgtcccaatctcttgtgcgcacaagagatcaaagacccgggaggacggatagagtttcggaggccctactcgtcccaatctcttgtgcgcacaagagatcagagaccggggagaatagaagcactggaaggagaagaagtgcgctgagagaagaaagaacagaagacacccgagcccttttggcagagtgtttctcgtgagagtaacattcgcgcaatcaatcctcgaattaacagtgaatgaatagctctaaattaa

SEQ ID NO: 95939 - DNA, 728 bp, Oryza sativa
acgtgcatgtgcaccccaatatatacatggatatatgatcagttaatttttgatctctacctgatgaccagaattagcaggaccagctagacatcacctaccaattttatataccgaccaactacatatatatatatatactcctttgctaaatgacatatatatataaattcagttgtgtttattaggagtatagtctagtactctagctactagctagtagtgctcttttttgcatatattgcattggtcaattgtatcgatacataagtgcttaatttattagttatgtatattaatttctgattaaacatttcactaacttaaattccccttaatttgcagcagtcacatcggcatttcgcaatcaatcttcggtcagagaatgagttaatttaagagtaacaaggcaagtacaagtggacgtcgctcatcatcggatgcaaagtcaacagagacaaactaattaagattaatctctcttggcactagctagctagctctaattaaaccgaacaatagaacatatgcgcaatatatgatcaatatgtacatacatcaggagcaacccctattaatttaatttataatgattcgaatatgatcgaattaatgtctatacatcatcggacgtatgtacacgtaatcacgtatacaaaattaactaacagacaaatagctttgatgatcatcattagttaatgcagtttgctaatgaaaattagaag

SEQ ID NO: 95940 - DNA, 1172 bp, Oryza sativa
atcatggatatccaaataaacaacccaaaaccgaaaccaacacagagtcggccggtcagaccgcgggctggccggtctgaacgctcgatcaccactggtctgaccggcacacactgcccggtctgaccgaacccaaatcacagacatcagttcctattcacctgcaaatttcaatcatctccaaaaccacttcgtaaataaattccaaatatcaaaactaataatctcatatgcaaattgttcataacagaataacaatcaaaaacactttgattttacagaagtttgattaaaattgaaacgatgtgatgtaaaagttgaaagttgaagaaaaagttgggaactaaaccagggccctgagggtggcgtgcgacaatggcgtggtcactggcactggggaagatgatgttgaggtggcgccatgcaatgatttgtcttgaggtcccaaatttaggcggcagcggctcttcttctattctcacgttcgagaaggctggcgtgctcgaggatgacgttgtcgcttcactggaaggagcgacaagggaggtgcatcaaaaaattggatgggtgcattatgaattttaaatgtttcagtgcatgcatctgcatattttaatagttcgagaaaattgttgtattagctttagcttgtttggttgggacatggatgagcagtagacaacaaagagattcacaaattagttgagaaatacatgtaaattatatagtacacttgttaacaaatatataaatgtaaattcaaacccatgtcaaaataatcacatctattccagatgatcacacgtactttgcaaacacgagagcataacgaacaacacatggtccaggtgataacgcgttcgatccgtcatatccagatgtcaatagatagcaggcaatattaaatgacatggcaggcaatattaatttcgtgaaatcgacagacaattttgcccttctggcatgttgttagcaaccaatcagaaaagggccatgtttttcatatgttagacacatgttgagtgaaagttcagctataaatacccctgctagatagcgtctgcctccacgcatcatccatcttcacgagctaaaaacctcactaccacaacaagcatcttggtttctgctaaaacaaaggtccctctctcgctctctgacacacacacatt

SEQ ID NO: 95941 - DNA, 675 bp, Oryza sativa
cccccccaactggtccatgggcaacgcaactgacgaactgtactcaattgggccgaatcccgcactattgttggcccaataaaccttgttgatttgggctacattatctccctctctcccccgttcgcattaattttcaactacgctaaagcacttaaaaacatgaatgaatatattgaagcctatttgtacgtataaactgaaaatattttggtcatatattagttaagctaaacattctgaatatttcaatatgtgtgtatatctttttaaagaaagcaatttcctcctacgcatgtatgcgtggacttaatttgttctcacacaagtgtcacaacacagctagctaggagagaatcgagatcgagattgtataagttggtttcaaggatcatattacgcagcagcagacaaattagaccgtatacaattaatatactacagtttgacttatacagacagtgtacatgtaaaaaaaaaaagagattttgacctacgggctacggcaattaattaatttataccgatcgatctacctgttcaataatatatgagttggcaattgatagtttaatgtccttgtaaattctcatagatagtttaataaggctagctagacacatttctgcacttttccttaatctgtttatgtctagctacaccccatatggatgc

SEQ ID NO: 95942 - DNA, 645 bp, Oryza sativa
ctactgcctgttcctcccagtcagcggaagtgtactagtggatattacatttgcgagttccttaggatcaataggagataatgtatggtttatggagctgtaagtacaaatcatcaatacgttaattaaattaattgctaacaatattcattgctatgattgtgatgcaccttccaaaatttctcaagagtgaaagggagctggatgatgaagccattcagaacatacaacgagacatgtggtatttcatacaccatgaggcaaacttgttgtcaccagcttgggagaaattttttatataaaggagagtctttgaacttcccaaaaaacgagtgtcttactaactgcagtaagagtataatttcaatttcacatacgcgtcatcggtcgagctataagacattgaagtactcggatatgatcgtccaatatctatgaacatataagtgcttcacaattatgtgggttaattaattaataccttccattaattatcgtgtcttgatttatatattgcgcatgtatattaattgcaagcaataataagaaaacatttatcatcgattgctcgatcgataaatatatcctctaagtgtgattcccaaatatgcgaacaaactaaatagattatcaaattttgcaaaa

SEQ ID NO: 95943 - DNA, 641 bp, Oryza sativa
catcaatatacactaccggagaattgatatttgtccggatgacaaaaatcacattagccccgattcgaataggaaccgagactaaagaatatgtttagtcccggttcaaaagcccaacagaattttttgatatttagttccagttggtaacatcaaacaggactagagatcattttttatgtcccggttcaaaaattgtcaagcctcccactatctttagtcccggttgtctaaaccaaccaggacgaaaaattaaaaaaacagtcgagccacatggggagggagagagcagcgcgcgtcgtcgtccttatttctttctccccctcatccactaaccctttctctttctctctttctatctctccttttcctcctctctccgatctcctacacctcctctccgatcgtagccgggaccgataggcggtggcagagccctctcctccactggatccggcggagggggaggcggcggcggcagcacaaggggggaggcggtgacgatggcacgaggggggaggcggcagcggcggtggcaagagcggggtggtggtggcacaaggggtaggcggcggcactcgccgtcgcggtgcgtgacgacctaggcgcgcggacagtcgtcgctgggatccgcctctgcc

SEQ ID NO: 95944 - DNA, 660 bp, Oryza sativa
tcactcaccgaacttccctggagaggattagcactactggtagtggaggaggacgacgccatcaagtaacgtcgctagattagattggatcaggctctgataccatgtgaaagaatttggcagaaaagccctcaccgtggcgtttacagaagcctacgagatcagcaacaaccacgccatctcaggaggaaaacagcagcgacaacggatgtaacagaaagagataaaatctaatcctatcttatcacaactcagccgatcattatcacatgcatggatagaaatatgctcaaccaacaaggagaagaagatatgctcctggtgccctggcgtggtttatgttctttgttattgttcgtcgataaattgtcaacttcccccaaatccttttcagacgattttttctcttctttttccaggaacttgttcttaatttctgatagcagttcattttgggtcacctggataactgcaactgcaattttcagtgctacgaggtcacaataatcccaacctactgttgtctgatttgctcaatcgtttgggcaagatgtaaatcgaccctgctgaaatttatctaggaaccatgaatgacgatttgacattggcctaatgttcatggttaatattcctttaaaaaaaatgttcatggttaacata

SEQ ID NO: 95945 - DNA, 699 bp, Oryza sativa
gctctgcttccaagctcagttcttcttcagtatcttcctcagcactgtcagatgacgatctgacagaagaagatgagcccgacaatattgttcgtcgtggtggttgccggcaagacgccggccatcgatcgccaccgtgttccctcccccgctgattaatagagtcaatgcgtatactgtttgcagtggcagtagtgtggagacatgatgatgaattttagaagaaaggtaaggtggcccatcaggaaagcacatggatacttccttttccttcttcgttccacacgtgcgacagcctgtgaataactaacaactggacgaacgagtatgcgaaactgtataagggaacatggttaacgattcggttgcgcaggagaaaaaaaaaagaaaaaggagaaaagaattccatgtcatcgtccatgtggcgtgtcacataggcaagaccacggtcaaacgcggctttgaaccgagatgatacagtaaaccaagtttagagatctcgatgtgcacttagcaagttcgtaaacctgagtgaaacctcctaactagtttaagaactgctggtgtattttattttttttatggtgcgcccaaacttctcaaaattgtgactgaaaattaaccattgcctccatgaacattggtttgattaattttctagacttcgaggaatataatgagcctatgctgatgttgatt

SEQ ID NO: 95946 - DNA, 663 bp, Oryza sativa
attattttgaagaaatagtgcctggtggatttggatgataagatgaatgggataaacaaggagagagaggatgagctgctacttgtttaagagacttggacatgagcttaagaggaagagtagattagacaaacaaataaactattataactagttataactatgttgctcatttttccagttctaaaaatgacacatacaaagggattggaacgtagggatataaaccataggaatataaaacgtaggaattactgtaaaatatattggaatgcgagcgttaaacggacgaatgaaaaaacatgaaaaatctagatttttaaagtggtgtctggaatagaggaattctagaatatgtattaattacctagcactaatgatctctgttttacctgtgatgactgtccagtccaattaaacgttatcatgagataattgcttctgaaattatgttttatgtcctgtgttttgcttctgaaatggaggaaaggaaacctttcatctgttttggttttgcttcaattccttcgaaccaaacgcagctacatacattagttttcccttcaaggaactaataaatcctttgaaagcagctgctacggcagtttttcttccttttggagctctgcggtgccggagtgtcggtcagatcgatgaagccgt

SEQ ID NO: 95947 - DNA, 543 bp, Oryza sativa
gcacggatcctcattttacacatgaaggggagtccacaatgccattgcatgcatgtacgagtggggcctactcctctaaacttaatatgcttagtcttgtagtagtccctccaagccagctgaccagatgtgaaagccatgcctaccaactaacaagtggagagatgaatcaaaagtcttcgttccaattgtccacgggctacccataagcgaccgtagccaacaggggtggaacttggggatggttgctgtggacgcgccatgtcgcacgccttgtgttctccggggtaacgtgggcatgcaaggggttgcatgtgctaccacgtctcccaagttgtgtatgagttcacctcacaattaatgtaaagtggtggtttaaatgtgagcatcagacccgagcagctgtccttaatggggtgaacctcttcattgattgaacggagcgtcctcgggccctgagggattaaaagcttgtaaccggttggctgccgtgtgtcgggtcaccccgtgtccatagggtgggcaagtccttggggcacccct

SEQ ID NO: 95948 - DNA, 777 bp, Oryza sativa
agacaccaccggtaggagatcgccggagagcgccgccgcagagcgccatggccaccccaagagctctgtttcttcagaggaagattcgtgatggcagcgagaagaagcaattacctgcagcagcaggcgtcgtcagggtcaaggtcgtcctgacgaggaaacaagcggcgcggctcgtctccctcgccggcgaggggaggaggaggaggaccgccgcgcagcttgtccgcgagctgaggaggatggaggacggcgccggccgtgtcgatggctcgccggcgacggcgacggcgacggcgtggaggccagtgctcgagaccatctccgaggagtggtaataatgtcaaatgtattatgtataaataatgtgtgtttgtgcatgcttgtacagtgtgcatgcctgcatgttagttatgtagtaagattcttttttctttgtatggtttggtcgtcaatttaggttgggttcagaggtgaggtaaacagcacaatatctactatccctcccatatgtatgtacccagattcgtgagacatattacatggtaaattggtcatggacaggtggatataatgttcatcatgctgggagacggaaaaaataagaaacaagaggatatgttgtctacttgtctcgaagaatgaaaacactttcccatcacgctgtggtgctagctacggagtactaactagatactgtatttcccttctttctgtccttgaacttctgatttgttcttcatatgtcatcactactggagaaactatctttgggcg

SEQ ID NO: 95949 - DNA, 682 bp, Oryza sativa
gctttgaaatattgttacttggattattagtatttgtttttacgttttaccaactatagttcatattctatgccatatgttaaagaccaaaattattgtccataaacgaacatgaacaatgaataatgagtttattgtaacacaattcatccttaatgcttaatgaaaaaatatctgtattgtttgcatcctttaaattttgaactaattagtagggatgaaaacggctagaaatggttggaaacaatatcattattttattatatttatgcaaatggtttaaagtagtcatgaaatttctatattcatgaatttaagtaactaatgtcaactataatgtgacaccgacagaaataaaaaaactaaaatttaaaactgtaatggttgataaagatattattattttattagttttttgaaaacggtatcagtatagcctggacattttcactcgtactaattaggattactttagaacaaaagaattaagaaacacataaatatgataaattatacattcacatttcctctccaatcttacagaactgacaaaattaggaaacaattaattttctatggttgaaagaaaaaaaaatagatgatgtaaaaatagagagaaggaaggagataaccttaaggccccttttaaaatgtgtgaagatgataacatatgaatagaaaa

SEQ ID NO: 95950 - DNA, 560 bp, Oryza sativa
ctgcagcccggcgcctgcctgcgtttcgcactggccgcgctggtgctgattccctggatgtactgggtcggcggctttgcccagctgcggcactggagcccccagcgctggctgggcatgctggcagccggtgtcaccggcgtctttggctacgcggcgttctttctatcgggcctgcagcacctgccggccggcaaggcggccctggtgatcaccctgaatccggtcatgaccttgctgatggcggcctggctgttcaaggaacgcctgaaccccacaattgccatcggcatgctgctggccgtggtgggtgcggtggtcgtgatctcgcacgggcagccgctgggcatcctgcaaggcagcatcggcctgggcgagctactgattctgggctgcgtggtgtgctgggtgctgtacaccctgatcggccgctgggtgctgaccggcgtggacgccctgtccaccacggccgtcaccagcaccatcggcgccgccatgctgctggccgccagcctgatcgtcgaaggccccggcagcctgggcctggcctggcacagcga

SEQ ID NO: 95951 - DNA, 501 bp, Oryza sativa
atcatgattatttttgctggcattggtctctttaagcatgtgggatgtatatttgtgggtgtgagtgtggtgagcgtgcgtgtgtcttatcaataatgtaattttaaatttttttatataaactattttataattttttaagtaaatttcatgaaacctcacatgttatgatttaagttgcacaaaatcacaacggctctggtacatggcatataaccatagatattacggtcataagatttcaccaataaaaatagttaacttacctacaatatttaaatgatggattaaaagaattcatatatttcggaacttgtatgcatgtatggtagatcaaagaaaatttagttaatggtgtatataaaactaaatgtcatagtaccagcattacgtgcaagtgtgcaacatgccaaaactccaatagttttatgcaaattggatcataacatcgtggttacgtgaaatttactactatctctgtcttaaaatataacaacttaa

SEQ ID NO: 95952 - DNA, 570 bp, Oryza sativa
tatgtggcggtcaaatggagaaaaaatgataacatatcatactatccaccaaagtaaatgactacaaagatgaaggcaattgtctatagtattgaaaagtgaaaactttaggtacaaaaagtttgtcagaaagaagcattgataaatagcggatagatttatttttttgattatttcaatatagagctagtgttacgaggagaggatggagaaatagaggtttacacaaccagagtaatgatttagcatctctagtgatattaatatagagaaattttatagttaatatatcttgaggtacctaaatttattaaaaaaatttggtactccatatgttgaagtaccaaattttatataaaaaatacgataccttttggtactttctcaaggattgtaaaattacccttaatattaatagcacttggttgtgtgtgtaatgtgatactggctattagatacttcttccgtacttgtaaaggaagtcgttttggacagcgacacggtctccaaaacacaactttgacttctattttctataaaaatatttattgaaaagtgatatatgtatac

SEQ ID NO: 95953 - DNA, 731 bp, Oryza sativa
acttctagaaaaatataaaatagaataagcatgtaccttagggcctatttggcacagctccaactttaactccaggagaggtggagctggagctctgccaaatagtttcagctccaccgaaaatgagaacagagctgggtggagctctctcacaaaatgaactagagaggtggagctgggtttaggcagctccacaactccactccagaccagtggcggacgcaggattaaaataaagatggtgcgaagatgctcgtctcaataagaacaactaaacgcaaaaaataccatatttatgttgtaatcatataaacatatagtacaattaataaattaagacaaactaaaaacaaaaatgatattaaaataaagaaataatttttgcgccatacataattcatcatacataaaaagatactagtaaacatatcaatttacaaatatgagtcaattcataaagcatggttgatagatatcttctaaaaaataaatatatgagaagatatcgcatacctagaataagatgattattattttgcttagaagggagagagagaaaaacattaggcacctaactatagtaggggacgggggtgagcagtgtcgaggaattgactcaagaaagcatcatatacgcaagattaaaattggacactttagctgcttatttatgggccaattgtgaattggatgtggtggtaggcggcccaagaaggatatagagggttggg

SEQ ID NO: 95954 - DNA, 690 bp, Oryza sativa
atgagcaagagagggtcgtattcaacgagctatagtcagccgccgattgttatgatcgatcggaccgactggactgactgatctagctagctttgtatacgacgaagttaattaattacgcacgcaatctcatcactgatcatccaatcgatattagagagttagctagccctactggagaagtgatctttaccgggtcatgcaaaaatcacgttagttccgtttcaaataagaaccgggactaaagatcatttgtagtcccagttaaaaacttcaacgggactttatgatctttaatctcggttggtgttacgatcggtattgataatacattagttttgatataaacatgcgtgagtatacttttcatataaactagttgaatatccatactttactgcatactaaaagaaaatatattataatattatctaaaatacataaaaatatatttcttacgaaatatgtactgcctatctttttgttacggggaatattcgtcttatttaattttacatgcggctatacattaagatttgtttgtttcttgatattaaaaattttaaggaataattaataaaatacaaatgggtaggtaaggtggcacgatgagggtatttgcaaaaaataaattcgtgaccttagtaaacactcttttataagaagatattgatagtggcagtaaatctg

SEQ ID NO: 95955 - DNA, 514 bp, Oryza sativa
cattactgcccaaggtgtggtgagcctaattgttaggccatctgcatgatggatgatagtgggtttatggcaattattcgagggcattatgaataaattgaatgttacaaagttgaaaaggtgtactaaaaagtactccctccatctattttgatagtcatattttcaaatttgaaaaatttatttttgataggcatatttcaattcacacatttaatgcatgactatctattcttccacatatggttggctacatgagtattgagaaatataaatattaatgaatcgtttgtttacgagaaatgactagtagcatgtttaaatagatgataaatagaattatttatccttagtctgtgtgtcaagataaaatatgactattaaaagtagatggagaaagtattatataacaaaaagatgatgaaaaaaatgtttatcgaaaaatcgtaccatttaagagctcgggaaacgtgcacgggataattcataatccatcggccataccgaacttgct

SEQ ID NO: 95956 - DNA, 622 bp, Oryza sativa
cccctctacagcatgttcgccacctacttctttattgtcattgtgattctaaaaatcgaacataactatcgttggaattcattttttattttctagaagtcccgtcaaccgtcggtggctctgcaactatactcttatacaccccgctcgctgcttctcctttttattatcattgagattttaaaaatcgaatacgattatcaatacgatttgtttttttactgtctaagaagttccggcaaccgccttactcgtttgcttcacggcctgcctgacgtccctcctttttaatcgtcagtaggattctatttgatgttttattaacaatttttatatgtcgtatcaaccgccaccactctactcttttataggcctgttacttaatttatttttattccaaattttaattaatctcgtattgggttcttatatgaactcttcttttaatgtttcttatttttaatactgaatttcagttatttttaaattgtattcctacttggactcttatttccttttctaattttggattttattttatttttatttccaattttgattaatctcgtattgggttcttacatggaaacttctttcaatattgattatttttaattccgaa

SEQ ID NO: 95957 - DNA, 1118 bp, Oryza sativa
ctaggtatgcgatatcttctcatatatttattttttagaagatatctatcaaccatgctttatgaattgactcatatttgtaaattgatatgtttactagtatctttttatgtatgatgaattatgtatggcgcaaaaattatttctttattttaatatcatttttgtttttagtttgtcttaatttattaattgtactatatgtttatatgattacaacataaatatggtattttttgcgtttagttgttcttattgagacgagcatcttcgcaccatctttattttaatcctgcgtccgccactggtctggagtggagttgtggagctgcctaaacccagctccacctctctagttcattttgtgagagagctccacccagctctgttctcattttcggtggagctgaaactatttggcagagctccagctccacctctcctggagttaaagttggagctgtgccaaataggccctaaggtacatgcttattctattttatatttttctagaagtaatcagaaaacaaattttaccttcatccataacaaatgattgtggtggggactctgcatcatggaggttgcgtgatgatgatggattttaccatggaagaagccctagaatttgggtattgcgtcgcgatggattcaagacatggtgtatcccgtctagctgcatggcttgcatttcatcaatctagcggtgctttcctctcatttggcgataaactttgcctagctgatcttctacaggtatatatttaagtcttgcctctcatcatgtgtcatacgttgcctacaagctctttggtgaacactttcttttcccctctcactcagtgttgcattttgtcacgttgctctttgaggatctagctttgcttgcctttgtcctggtgtaagtctagcatagcaagccgcttcaaaaaatattttcgtgctaaataaattcattgaataattttaaaattttaattttgaactatatatgtcattagaaaaagaaaactcctggttttaagtcgatactatttgagctttcttcctgttccaaaacttaaaccgatgtaagggtacaatttgtaggattgtatctttttcaaaacaatttatta

SEQ ID NO: 95958 - DNA, 880 bp, Oryza sativa
atcatttactctcatggattgtattgtggcatggactcttatgttaatatgtttggtcttacttttatttctattccaaaatttagttatatagggattttactatataatttgtaatgaaatgaaatatagttgatttttttatttgtttttattacgaataatattattttcatgtcattttacagtattgatattttaaatatttttagtcctataaattctactagtatttataaaatgtattttttaaaatggtctcttcttaatatgtatttgccaaggacacttctttacatatttattaattaatatttttgtttcattgggagttttacctgtcctttaatttcacttagatattcttattgaattaaatgatgattttattttattcttttactctaaaagtggtattgtgttccacatacgttcttattttaatattctatattctatattgtaaattccaaatttcagaatttttatagtgtatctctatgcgaattcgttggtttagtgtagactattataatctgtacccatactacaatcaacggtgtatgatcttccttttctatgattagcgtagtaatttctaaacctccaaagcattactatgaaatggctcatttttcttctatctgaacaatataatctaagcagacactactatcaacgccatatatagagtatagacctttgtctttcgtcatatttttgtactccctccgtttcaaaatgtttgacaccgttgactttttagtacgtgtttgaccattcgtcttattcaaaaaaaattaagtaattatttattcttttcatatcatttgattcattgttaaatatactttcatgtacacatatagttttacatatt

SEQ ID NO: 95959 - DNA, 503 bp, Oryza sativa
aattccttgtatgtccttccctttcttcacatccaccgccgacgtatcttctttggactctatctataaacaacaaaattaccctttttatcagactgaacaaaacaactataattcagaagatgcatgcccaaatcatctaaaaacaacactagctgctggtagagccagaagcaaactaataaagcaaaacctgcattgaattagacaaagatccattcctgcgctgaagtctgcacatacctactctaatatcatgatatccgcatgtcacaactcacaaaagcagttaggagcaactgcgacttgtactagcattttctctattcttttgtgaaaaaatgaaaaggaaaagaacagcactttttttagataatctgtcagatggcgcaagcaactcgtgcagagcttacaggttgtccgtactcgtcggcgtcgaagtcggagtcgcccatcagatcaacctggcggtcttcctgctccgccgcgcgatacccagaccg

SEQ ID NO: 95960 - DNA, 719 bp, Oryza sativa
tagtataattatcttcttatgtacatttgagtttaggaatgccgtactattaagagggatgcaacgtcgaggtgtttgtgtatgtctcggtgctcaaagtgacctatcatagtgctaccttgagagaaacccaagctttaacctatcctttgagtggttttagaccttgtttttcgttgacttgggtagtcctctgagtgagctttccatagagtctaagttcataaaaaaacggactcccgagcgaaaagttatagtcgttttactctgtgcttttcggaaagtccgaaaaattaccggaaactccgataatttttcggacaacttcgaaaatttccggacattccgaaaatggctgcgaatctgagatttgcttctgtaagttttcgaacttgtccgaaaatgcttttcggaaactccgaaaattacagtcttggcctccaacggctagtttttgaggggctcgggtatataaactcctccacccctcctttgagttgctgctgctcttggggagtattagacacatccaaagccaaatagcatccccatttccctacctttgtggtgcctctttgtgagggggatttgagaaggggagagagttggattgagagagtgaggagttgagagctagtgagcttcactccatcctttgtggtgcctctttgtgagaaggatttgagaagggaaaagagttggattggggctgcaggaat

SEQ ID NO: 95961 - DNA, 591 bp, Oryza sativa
  unsure (1)..(591): unsure at all n locations
tattgcaaagaacacggcctaggttcgttggtcagcaaaactaatttggaaccaaacatttagtacaatctagaaactatcaaattggaaattggcaatgccaatgatttggttgcaaaccaaaaccacatgtgcactattcaactactaaaagtattttggtaggacatgttttggcatatcaacaaaataatttagccaattgcaacacacggggacacagacaaccaaacgagatcagaatgcagacgtggtaatttatatcaannaaaattttntttttnncccccaaaaaaaaaaaatttttttnccccaaaatttttgggggnnaaacaaaacttatattaatgtatggacttgcagaattgcacaaacgcaaaaggaaacaaaaaaaggggcaaggaattgtgctttgcttcactgcttggcaaggggcaaggcgacggaatcaatcccggggaccatatgctgaagggccagaaaagagggcacaagatgtcaagcttgttccgacttccgagaggaacttcgtacaacaaaatggaagtatatacgcctatcatgtacacatggatctatgaggtatataca

SEQ ID NO: 95962 - DNA, 1487 bp, Oryza sativa
atgtgacatgggtcctatgtatccatcacatgtaaatttcctttataggcagactgtgggtacaagtagtgtgtacaacaatattcaaatgcaaatagccctaaaaaaccaaacatattatacaaagatcagtataaattcttttttttccaactagaaaggcactagggtatatagtcgcatggagttatggatgcatgactccacacctatcctaggaattaaaattatgtatacgcaaacatgtttcccaaaaaaaagatcataaatttttcactgatccattctctttagtttgtggtccccatcggttggccatgtgctaataatatgtgtgctctacagcgtattagcaaaaacataataatttgtgggtaaaacttttatatatgtatcatcagtgatttaaaagtaaatgttgaaaaataaatttcgatgaaagaactttaaattcaacttttaaaattcaaatgctggcagcagttggttctatacgtatatatagggcaaatgatttggggtgggggagttgtaaatgtgttggtgtgtgcatgtgatgtgctggtatcggcccgagcgtattctacgtatgtgatcatagaaatattataatttccgttaacacacggagtactctcaacgaaatttgggaaaatccaaatgacccctgtacgtcacaaagtctttttacaccccatctacaactcactttgatacaaaatatcccttacaagttcaatttctctttcaagttcatcgtttgctcagattcgcatgccatgtgggcgtccaacatggagaaatggaattgccccatcccatcatgacaagggtgggttcctcaggccttccacaagcgttgcggcagtgatggcaaaccttgacaccctgccttccacgagcaccgcggtggtgatggcaaaccacgatacaaaacacaacatggctatttgaaacatctacaactcagtgtgatccctagttgactaggaggtgcgtaggcttccttgttgtatcgcgcatgaggtaacttcgcctcatcatgctggaagcccagatgacacaagaagttaagctaagagcaggtacaatagcagactattagctagctgcaaacatattttaatgagataaaaaatgagagagaagagcagcgggctacagatctatagccagctgcagcacggactttaagacgcaatgtgtatatgacaggtgggaccatatattaatagtatagtaagcaactattgtatggattgactataaatgaattggagccagtagtgggctatactattaaatttgctctaatagtgatagtacatcgttgaaaggtagagggggatcaggaaattaaaagtggcattgaacttgtagggtgagaccaggaaactaaaagaggcattgaacttgcagggtgtctagtacgaaagtggcttttagggggaagattagaaaggctagtgatttatatagggatattt

SEQ ID NO: 95963 - DNA, 666 bp, Oryza sativa
  unsure (1)..(666): unsure at all n locations
ttaagtaattattaattattttcctatcatttgattcattgttaaatatatttttatgtaggcatataattttacatatttcacaaaagtttttgaacaagacgaatggtcaaacatatgntaaaaagtcgacggtgtcaaacattttgaaacggagggagtagttattttacaattacacttaggctgtgtttagttcacactgaagtttgaaagtttgattgaaattggtacgatgtgatagaaaaattgtgtgtgtatgaaatgtttgatgtgatggaaagttgaaagtttagaaaaaaaaactttagaactaaacagggccttacatgctagatttttggaagaaagttttaagacaaagctagcaactgctcgcgcggcggctgcgggcgggagcccacaccgtggcgcgcatcaaactcgcccgctaggatcttgcgtcggcgcgccgttggacacttggacttggaagactcagctagcagctggccgatggagagctggtcgctggctacttggctagctagccaatctctccctcctacttgcaagctgcctcctccgacatggaattttcctgagcgagaagacgaattgaaagggggaagcttgatacttgatgggcactgggatgggatgttctgccgatcgggctgcaggaat

SEQ ID NO: 95964 - DNA, 667 bp, Oryza sativa
tttagtgctttatgctaaagacggagttaaaagaccaaggtttatacctcagttgcgttttacttgtggagtggaggtgaagttccagtaggatcgtcctttttcactgttgctttgttttttctttatgaggactaagtatttattctgtaagtatttacgtttgaatatgtatattaatttgtcattttgtgtatcctagtttgattcctggacatagatttatacacagaatagtatgagaattggtgaaatttttgggcgcgacaatgaactacgtgccaaaagttgggaaacccggcttttccatattttttaaacctaactacgaaccaaccgttcctccgaattttaagctctccaaaacgggacaaaagtctatttcactatacattagagaaaccaccatgatgctatttttggttcagaagtctcacataggctcggatggtctcacatccttccaccaattgaaattcttagcccaaataatgcaccacctaaaattgaattgaaccccagaaccaaaacaaaggtcccaatgattgggaatggtagggaagatgcaagatccatggtccaatcagaccaagcaaaccatcattgagcaatgttcactgcactgtgtgcgagtggatcccatcaagatctcgctcgttcgctcgtt

SEQ ID NO: 95965 - DNA, 749 bp, Oryza sativa
  unsure (1)..(749): unsure at all n locations
ggttaaattagttcatgcttggggtccttcaaatcccaacagaggaacatgcattcctctcatgctctcatttatgttggtcgttattgggccgcaaatgtcaggccttagcctttcacagctttacagcccgaggcggtagagctgggaattgggagagtttccnnnnnnnnnnnnnnnnnnnnnnnnnnngatatgcagaacaagcagtaacagtctatgatctctccaattgcggcggcttttggccctggaactgaaacaactgttgacgataaattttgtcaactttcaggttagccatatgcctagagaatgtaatagagtacatttaatttctagcacgagcaagatgaaaaaagagggaagaaagtgctaggaatactagcaaatgatttcgcaagatcaaaacaaccatcagaagaagaacacacgctaaagcagaacatatttgttgggtactgtggtgctctacaattatttgaaatgattgcaagtgcatatttgttgggtacttttttgtggtgctgtctgcagcagggccagcagcaaccgaagatccatgggcatattcaactcaaaaaattatgttaagacttaagaaccacccggcctttttaaattgtgttcctcatcatcaataattatcaacgttctaggcctccaaccatttttttttaaaaaataaataggcaggaggatttcattttacatattattaaatagaggagaggaaaaggacagagcag

SEQ ID NO: 95966 - DNA, 606 bp, Oryza sativa
tacaactgaaagaccagatcagcaccaaaatttggtgcaacaagcagcatctggagggtgacactctgacagggaggttcctctgcaacagagctataacatgagaaaagtgcttcttgatcttcagagaatcacacagcagtgagtaataagcattggcatagtcagaggcaacttcaagccttcaagccaagaatatacttgaattccgacaataggtcagggaaattacaatttacaaggataagcacactggcaaaaggtaatagaagtactaaagcttctgacccaatgtgtcacctattgatttacctaactatccaggagtcaagtcaagtctgaacagctaatgagctagtcactctccatttctccagcaaagcatacctataactttcagtgctccccggatggatcttggttcatgcaaaatgctaggaccggctgaaatcttcagactttcagataagctggctaaccaatttcagactacaagcatagcataggggtgatagggtcagagtaatgcgaggtagctttcactgctgaagctgaatgagcaagtcactcttcaacaaagcatacctacaattttcagtactacca

SEQ ID NO: 95967 - DNA, 1230 bp, Oryza sativa
tacctaactattactatcatgtatgttagtgtacttgttagggaagcaaccatgagttaggagacatacgtaatttgttggactgttgggtgtgtgtggtgtatttttgtggctagagttaatttggatttttattattttagttctttaaaaaaattaaaatttctcattgatttttttggcattaagataattttataaaaccatgaaaatagtgaattcattcatctgtctattaccatgttttaacgattggagagcacatattaacatgaatgcattttgcacttagtacctccattgttttttttttgggatcgaaatacatcacgtaataacacctaggaacgtacgcaacatcattttcaacttttaagacccctttctccaataattgaaaaattaaacatgaaccaacctattgaacttctatgtatgtcaccatcatcgcatctcccttttaacctactccctatgtttcacattataaattgttttcggctagtcaaaattattctaatctaattaagtttataggataaaacgtaaaagcatttttaaaacaaagcaaacatataaaaatatagtaaatgatagatttaatgaaaacaaattttgtattataaatgttgctaatttttttataaacttgactaaatgttaaaaagtttgacttaagataaactctaaatggcttatgatgtgaaacctggatagtaagtccatatagataggctctggccatattggtgcatgtcaccctccaaagtaaaatcttcatttatctggccccaacggccgctcaatactttagaccaaccaaatcatttccttccatctcacggtaacaaaatgaatgatgtttttattgtctcttcatctttgcacattaaaaaagtgaaaactttataacatcattactggtaagcattacgcaacatggcactgacttcttgtctgaatgtacacaagcaacagcttgtttttataggacaaaatgacaacatattgccctgttggaacttagatgtacatttgtcatgtaaggataatattaaaatgaaatctgttgataggaaaagtgaaattttctttctaccactacctaatatgtggtcctacctatgtatacgtaagattggcacaagtaaatttggtatggaaaattgtattattatacttttattaatccctccggtttttttagtacgacgtcatgaatgttggata

SEQ ID NO: 95968 - DNA, 3289 bp, Oryza sativa
tggagcaaagaccttcgctagtttcatagtattaaggcatttccaattgataacactaaataagtaagttgctacctagaaaaaaaaatgatgtggcaagtgaataaatgaggaaagaaaaaaaaatcatgtcttgtatgagacatggtttctacacaacatccaagacatcatgtgagagaagtagcattaaattgaagtatggaatagtggtgtttgcattggaagagtagtgtctagtactagtttcttgatgatgtggagtttatggaaaccatgtctattgttatgggttgggactgcccttactaacgagtaacaaaatactccctccatattattttaatatatgacgccgttaactttttaaccaacgtttgaccattcgtcttattcaatttttttatgcaaatacaaaaatacttatgtcatgcttaaataacattcgataataaatcaagtcacaataaaataaattataattacataatttttttgaataagacgaaaggtcaaacgtttgttaaaaagtcaacggcgtcatacattaaaatacggagggagtacttatttgttggatctcataatatggcaagatgaggggaaggttttagatgaagaagataataacccccacataacaaatgtacacaaccaaagaattaaatcatatcatatgaagatttcaaagcgagacaaaaacccttgaagtgcctataaaaagagttggttaagctctaaatttgatataggtgctcgcatttatactaattattcattcagtggtactcgtaaatagcaaattgtctgtgatgacttcgttaatctcaaaatatgttgggctagttttttaaatgtgcttataagggtagggtgtgttcataatgtgagtaaacgctcacgtttgtactgcatttttttttaaaaaaaagagttgtagcttgtacaagtcatagcctgattttcataggaatttaactagttcctgtgagattcgcattcccatggagtcctcaattttgaagtttataacatagtttatacccataccttaagattgtttttttgtttattacgtgaatctagcgcatcatccaaactgtttttttttaaaaaaaaaaactgtgaagggtcagctccaaatgtttggccttcagttaccctcttgccatatgttgtgaaaatgcttttatgttattagttcataagcatcggagtgaaataaacacttgtccaccatacttttaattccctgacctaaaggtcatattaattcgcatgatatagtgagtacacaatttatgtgcttttgtctccacaggaagagcatgaccctgcaggggtaggtgacgtacccaaaaagaatggcccaacacattgtactagtactacacagatcactgtcatgaatgttttaaattggccagtcgagaacttaaaccaacttttcagatttaaaatcgatgtaaaaatgaaacaattcttcagatcaagatgtatccgtgaattctacagtagcacagtttcaggtgtctgaactctgaattgaccccaaaacggcacaaaacaacagaacaaaccatgaacacatcatctgaaagatcccccaaatcacaatgatattgccaaaaacaaaaagggcaatgtattttctaccaaaccatctgtaacattttggagtggattccagtgcaagcatacatgtgggatggagatatcagcaatcggcatcaggacagtgcagagaacatggttgttggcgagtcatcccaacgccaagactcccccagcctttctgtccctggccataatgccaagaacactacattgcaatgcacatagtgacagtacctgattatatgtgggcatgcaacacgccatgatgccaatttgccaatcaagatttgtcatatgtgcctctattatcatcatctcacattctgtgtgattgtgtgcgtgtgaactgtgaagtgttgcagtgaattgttgccatggggggacagagtgagcaaaaatgcaccatataatgcattggatcctattgggtttccaccccacatggagaactctgaactctagaacatctgtacaggagtacaggacagcatgcagacatggaaagctgatcactttgtgtatgtgtcttgatgttaattagcagaacagaaaatactgatgaatcatgtacacatgggagtacatggtagggatcactggcttggtcaagctctgcaaaatcatccaaaaaatgttgcagtttcactaatccacctgatggggagttccttctttaaccagccatctgcatcaccgcaatttaagtagtccccagtagcacaataaatttactactaacttgtttggtaaccaattaggcagtatattaaactgtgaagtagaccaagagaagacaactacgcagcaccaatcatatggaccttctaagctcgctgccaacctggtcttactagcatccaaattctaaacttacaccacctaaacaattgagtaaacaagtaatcaaacaatgactcgatgagcaagattaatgaaattatttaaccatggaagcatcaagcatgcacattttttttcttttctctgcacatacacacactgcaaattccattccatggattgaggcatgtttgtttgtagggtagtagtatgtaggcttgcaagccgcatgtgcccatcatggcataaaatatgcagagaatcagtgacccaagtgtgtgtcaccctctggaaaacttggagattaaacaaaggttagctctggctaacaaaagtccatatcttgtgacatggactgtagtaaaaagtttacattatcttagagtaattaacacttctccatttgtaataaaatccttattttgttcttgtttgcatagtactagtaggagtactggactagctgcagtagtagcaggctacaatcgctttcactgacgagaagaaaacaggggaaatttagagtgcagcgcacggtacacggtgggcccgaaggtaacatggagttaagcctcgagcatgggccactggcccagtgggaccacagggctcgatgtacattgtcgaggcatacaatgcaatactactaccttaattactgcctttccaagaaaaaaaaaatcattcactgcttgcaagtactacaatgtttattggtgatgagtaaatttgctgtaacatttcggtcaccgggtactgcacatttactctgcatatttgtattccctccttgttcattcattcattcacaatatgtaaatagacaaatcta

SEQ ID NO: 95969 - DNA, 1696 bp, Oryza sativa
agagaaatggtgtccagctctctcacaacttcactctcaatctaagaacaattagatcaatagagaagaaagatcaatgcacatcaagaacaagaacacgaacaagaacaacactaactagctagatggatggatgcaagaatgcaatggaggagacgatgattaatttgatcaggaggaggaggaagaagatgcagtgagctaggtgtttggggggttgggtggtggaggtagctgtgtgtggtgcgactgtatataggcgtagtgtgcgcacatgaggcgatggatcgaggtcaatggcgtccactgctagcgaggtatctcccaactgctccgcccgaataatgcaacgcgaagtactaaaaaggcttggggatcgcatcagcttaatcagaagaagcagtagctgtaattttgtaagtttgtgaagtaactagtactaataattaagtattttatatgagttaaagaggacaaactgtcatggagaggctgcccaatagctagctcaggagaggaaaaaagaagagggggagagagaaaccatgcatgcactcattggtgtggtacatttctgacaaagtgtgctcttctttatttgggtttaaatctttcaatttggatgatatatattgtgaagatgatattgtaaatgtattttttttttgtaatttttgtatgactttgagggtgtatttttgggttttgcaatgtgagcaccagtagtacatgatgttgtccctcaaatgcagtagtggggtttgcacattcagtttcagcacaaaaattcctgaaaaaaagaatcaatttatgggtccaaatgctgaacagatttttagcatgaattttatatccaaccaaaatatctctttgacttttgacttctgatttgccatgaaaaaaccattaaatgatgtgatacccacattgtttaccatatctatgcaatgctgccagccgttattgacttatcaataataatactgtttttttaaatgtagtatcgatttgtatgaagctaggacaacatgaatcattaggctttgattaatcgtcattctccaaaaaatattgggatgcatgtgcgatctgatcgaaacaatacaagagatgatctcacgcagagttcgatacacacacaggactcatgcaccaacaaccgagtacatatgactccggtaaatccgaatataccaaacattagaactggtataaaaattgcatgcttgtcatgtgtgccagcaaatggtcagagctaccgagtggcaaaacatgctaccatatacacagcatgttacacagaccaagtctccttcgaaacacatgattttatactttttaccgtaaaaaaaatcgggctataacgtataagactaacgaaaaattatcgtagaatttctgggaccgaaaagcgcgcgaatgagaataagcacaaacaggagggcagccaaagtactgaagattttgaaaatctgttttttcagagtgaactttcaactccaactcatggcaaaagaggaatggggctatctagctccaatatctctctcccaccactactacagtgtggatatctgagtagtaccattttggctagtgatgttgtgtcctactcatatcatactactaccacctgccatgagagctgatcagtctcctctccactttgatcctgctatgattgtcccatctttat

SEQ ID NO: 95970 - DNA, 677 bp, Oryza sativa
aaactcaatcggagcaacacttaattgggctgtccatcaaaatcttttgcacatattttttcgatatgaaactacaaccacaagtgacggtagcttcctcatctttttcttatacttacacttaaatttaaattttcaacattaaatttgtagttaattttagttttttttttatcaaagtttattttgcagtatttaattttagatcgctaagaacatgtacatatcaagagttttattcacaaattatttttcgtttataaatatgccgtttagcttattattacctgaataagcgaaatgttggggccggccatagaggttcccacatatttttcagtccgtcaaaatctgaatttaggatgccatgcgaaatccgtattcattaattaattttcatcagttggtccgcagatttatggagagggtttgcataggcacatcgaagacactgaaggacgtggacactgttacgtctacagtattatcgtggactcctcacagataataatgaccagtaagatcgtcagttactctctttttttttaagaagaaagttcaggattgccagcttaatttatgtgacactgtcagttagtcacaaagtgaagttattgctgacaaattttgggccaaacattcagttaaccacccttgttactaaagttgctggagaa

SEQ ID NO: 95971 - DNA, 937 bp, Oryza sativa
gagtctgtaaattaagataaaacagtgatagcaattgagtgatatccagaataaatgacaaaacaaagtagattgggtagcaaacagtgaaaagtacacccaatagtacaagaaaatggaatgtgcaaaaattatatgatttaggattgcatttgcataacacagagcattatgatcactgattgcagcttctggaagtcgttaaaccctataacttttagtcaaacaaatggataaaaaatatttttcctttagctaaatgccagtaatttgctacagataaaagaaaatgtcataatattacctgaaataaataaactataattttgcatcatatatattatccattttttttatgtagggggtgctcagcttgattatataatggggtaacccatttttataggatttttttgtaatactaatactaaaatttatcaggggacaatttataaaaactgcagtggcaagaggtggggtggcagattcactgctgccaccactagtcaactagagccttttaaaatgaatatagatgaaaggttgacaggcagctaatcttaaagaaagggccatcacagtagcacaaaggtacatagactcccttttaaagctgtgtcagttacaattgagattattatggtcagatgggcttggaccattacaaaaaatatgtgagtcatgctttataaaatagttcaaattcggtattatccacatggacattaaccatgtgcagaagcaggaatgcaggatcccaagaggagacagcactgcatattttggagatactttttttaacaagaaaccaatgtaaattgtttctccatttaaacaaataaaaatatgcactacaacagtgtaaatatttggaaaaaaatagacggctaaatattatgtaagtaaagcatttaattccgtacatcttgaattaagc

SEQ ID NO: 95972 - DNA, 504 bp, Oryza sativa
aaaatacatttatatcaaatcttaagtccaaacttaatttcttttaaaaataaaacaatttttaggtgaatagtgttgtgttactatttatctaaactttgtctttttttactccataataaagttgagtttaaacttaaaatttgatgtgaatgtatttaatgcttacacctatttctaatagctttctcatgaattcacggggtttttacgggtttttaagttttcaccggatgtatccccttaaaatattttacagttagtctcatatgtccccttaaaatatatccacagagaatctaaaaatcaacacatcatccacccacaccaactcccgatgattcttgctcaaggaagactggaagagctcgagaaatattccgtgtactaccatggttaattaattatggctgtgtttagatccaaagtttggatccaaacttcagtcattttccatcatatcaacctgtcacacacaatttttcaatcacatcatctctaatt

SEQ ID NO: 95973 - DNA, 669 bp, Oryza sativa
gtgcaataatagtaataacttgcaacgtccgagctaatttacaattatgggtgaccatgtttcgcatcactaaggctgtgtttagtccataccaaaattgaaagtttggttaaacttggaacgatgtgacgaaaaagttgaaagtttgtgtgtaggaaagttttgatgtgatggaaaagttggaagtttgaagaataaatttgaaactaaacacgtcgtaacctgtatccaccgagcaagttaatgcaccaccaatataatttgctcactattaaagtttgacgtgtagtggtgataatacgtagctgtacaccccgtctccttttatcttgatgagatggtcaagatacaatcttatacgctgcatataagagcgagtataataagataatataagcggatcatatatgtcacattatatttatgcttatgtggaggagagagaaaaaagcaggctacaaatttgtagccagctgcagcacgagctccaataaaccatgtgagagaaatgtgagaaatgcattaatgtgtattatgtacttataattaactattgtatcagtaggctattaagttagctatagatgacgtgttaatttttgaatctggtagttggctatattattaaacttgctctaaatgaaaaagatgatggaattaaagcatgat

SEQ ID NO: 95974 - DNA, 778 bp, Oryza sativa
gaaggagagagggaacctgctgaaagcactgggtactcaggtactgtttgatggtttcatattcataatctccatatgatatacataggcatactattatgtaagatcagtgactgatgtgttatctgttatgcttgaaattcttctgcatttaattaagtagagccggtctgatgcgttatctgctatgcttggaatttttctgcatttgatcaagtagagccagagaatgacacatagattcgattcatgcattgtctccttgattcgtatgtcagttaccatacaacaagacaaaacaccatcttgtaatatgtttttttaaccctgtctatgactcaacgtaatgtgctgtgctcgtaggataacaatatatattatggttatttgtggtaatacatccgtgctcattaatgtatctaggctctagatttgctatttagttattgaaggtgagtgatttgccaggttcagagccttgtcctagttccttttatgctcttaactatttcaaacatgcccccccccacccccaacacacacacacacaaacaaagtagaagatagaaagtggggaaacttactgcatgtactactgttcacgggtgggagaaatgacttgtagcgtctaagatttcaactgtaggctgtagctggttgctagcagcggatggctacctattggcatatgacttcattttgtgatgttatgtctttacagtttttattttgttattaacctagcacctgttaaaaacatgtatcgggctgcaggaat

SEQ ID NO: 95975 - DNA, 564 bp, Oryza sativa
tatagacatgagctcctgattgattaggcacacgagaagctgaactggaatctccatctctaataggatttactgcagagcagctctcaggctttgctgaagcaagagataattgaagcccatcatgagtaatggagtctgctgttgaactccagtgagagccttcctgatgacaagttttaaactcaaattgccttgaagtaccaacagaagtggcaagatctctctcaggttgttgtggagtaggaatgtgtactttctgtgaaccaaaatccatttgggaatttagattttctgcagatcctgctagcgtattacgtttggaatcattctgcaattgcttcttcgtaatacacctgtcaggctgatgctccaaattgctccgactcatgtgaggtgtggttgggctccacataccaccactatcctgactattgttccattcaccaatgttgcctcgagggggccactcatcatgagaaccagctggtctatatgaaaccacagatgacgggatggtacatgaataatcaccctgatgctgtgcctggccatgcaacatct

SEQ ID NO: 95976 - DNA, 725 bp, Oryza sativa
cctattaagaacacagacttagcgagacagtaacttatagtaaacccctaaccttactaaattcctatgaaaaaacgcaattgcgtgtgcataataagcctgctggtgcttccccgcaaagagttaaaactagtcctgttcattcaagtacagacgtgcaggtagtgcctgttttcagttcgaccactcttcttcgtatgctctaaaatgaaaacaaacaacccataaggcaagaacttctgttcatgaatttatgctaaattcagttgcctgttgatcccaggcaaagatctcatatctcctgcaatgtacagctgagcagtataacaaccagacagcgagtaagatatctcatccccttgatctgtttgtgttttgttttttttttcctaagtacctttcgtacctgaaagcatttgttaattgtcctgagaacaataaagtggcgccgtaccattgtccggcaaaagtaaaacacactacgacatttgcggccttctgcccccatctgcattggattagtcaagcaatagcagtttagaatcgagtaaagaacacagcaaacaaaaagtaaattttaagacatcattatcatgatcattgtcaacatcatcatcagatgtttacctgcggctgcttctttggagaaacagtatgcacctaggtagcaccagtgcaaatagtgcatgcaaaatactcaaatatagatggcatggaagaaagtt

SEQ ID NO: 95977 - DNA, 954 bp, Oryza sativa
ctaatagacaattaaagcacgcactaaacatgctactagatcagcaactaatcacgcactatttattcacaaaaggaagccgccttgaacccgtccaaaatttcactgtcaaaacctgccattttgattttgaatggctttctcacgttgagattagcgtaaatatggtggtgatgagagaagtagcagtggttgaaggttgacgcgccaatgaaagcttggaggcgaccaaattatggcggttaattaaatcttcgcaaacacgcctagctaccaaactcttcgagttgaatcaatttgcatggtcaaaattccagccggagccccagttgtttgcagaaaattccggaatttggctgcaatttgggtatactattcggtgacagcaccaacaaggcaacaagcaaaaccttttcctgttcccacttgcctggtgccatacgagacgctcgtgttccttagccaaagaatacccaacgttgctctggatattttggggatttttatggcgttccttttagtgtatttgtggatttctctggtattttttctatatatttttgcgtaaggttttttggaactcaggaatttatatgatttttaaggtgttcaaatcttgcaaaaaaaaaaaactatgatcgatgttgttttatttttggaaaactatgatattcgcttgttccaaaggaggttataatattatgttttttcccaaagaaaaagcaaatattaggaaacgacctaatatcaaataaatagaatggacgaggcttcaaacccagaacggctaacgtaccatctcgtaaagctagccggaagacccttggaaaaaaaaaacatctacgaaacaacatgtcacaaatcaacacttaaaattaaaagattgaaaaatagtatcaactaagaattcccgaaaaaaaatcaactaataaaggaccgtattgaacacattta

SEQ ID NO: 95978 - DNA, 527 bp, Oryza sativa
cttccctctaaatttgccacttccacccatccacctctatgtgttttattggagtttaagtcattgctttcacatgatcgctgctaggggtggatccaccacctagtgacccgggcaattacttgggctcgttaggtggacacgtgatgctaaattttcagctaccgttacactccatcaacgaatggagttaagtttcccaatttaccttttctcgcactaacattttcctaactattaaacggtttgtttttcttaaaagaatatgaaagttgctttaaaaaaatcatgttaatctattttttaaataaatagctagtacttaattaatcataacgctgatgaatcacttcgtttttcatgcgtgaggcattagttcccaacttcaacgtctgaacacagcctagtatgtttgaaacaaattgagtcaaatcatcacgtatggacaaaaagtgatatttcaaaagtttcaagcactttcttatacatgcgccaacttgttgaattcattggttagcgatgaatgg

SEQ ID NO: 95979 - DNA, 630 bp, Oryza sativa
tgtgcgagtcattgaaaaaatcgctaattttggagaagtatgtgttgccctcgttctaacattttcgcgcaagcagagtttgccatcaaaggagagccgatttggctctccttggctagctagatttttcttaccccacaaagccagattattttaccggttgcaaacgcgtagctttgcttggcgaggctaggatgacacttgcccaggatccaaacatgcccgtagctaccatagaggacaagggtattagcgtcagtgtctttgtcgctgagacattaaacctcgtcgccttgaccctgatctgagaaaaagattgcattcttagaataaatttttctagggtctatttgtaaactatttttaaaaaaggctaaaatataaatatccagaaactttatgtatctctttaggtcgagtgccattgtaacttacatgcggggtactcgatataacgtgaatctatttttcacctcaactaaccaacgtaaaaaagaaaaacaaaaaacggagagagaggaaaaaaaaaacctggttatccgtgtctgtctaatgcccaatgtacacccctacggctcatatcaggatcctttgcagttgaagtcacttgactttatcactgacatgtgg

SEQ ID NO: 95980 - DNA, 718 bp, Oryza sativa
ggtcccgcgttttggagctgcggaaccgttgggactgcgacggtcccgcgttttggagctgcgggaccgttgcagtgccacgcggccgaccgcgggactgacggtcccgcgttttgaagctgcgggaccgtcgcggtcccgcatttccatcccgcgggacgagtatatttttgcaaaaaaatttcatgcatgtatataaatgtaaattattgaaaaaagaagtatattcgcaaatttaattccgttaatgaatctatacacatatatgcctagattcgttaacatctatatgaatgtgggtaatggtaaaacgtcttataatatgaaacggacgaagtattacactattttccactgaatccctccctggtttgcttccccttagggatttaacctccaagaaccgaacaagccctgacggggctgagccgaagaggctattctatgaaatctatagaaggaggaggaggaggagggagaaaggtgatgtcagcggaggaggaggatgagcagcagcgtcggcgtcagcggcgagactacttcatcaatcttgcccgccaccgccaccgccgccgcagcagcacagcgtccgccagaaatcctagccctagacatggaagaggaggggagaggggaaggggagaaactcaccggagagaaggtggccaccgtcttggtcgccgtcgcctccgacttgcgcggcaccgcgccggccgcc

SEQ ID NO: 95981 - DNA, 762 bp, Oryza sativa
aactccaagttgagggcgagggatgcacctactccagatagccattaatttcaattcaacagaggatataaaggataataaaaatttattaaaacataataatttgaaactcaaataacttgtacaaaatgttgaaagtttgacagaatatatcaaatcaattgatacggaatagagttaaaacaaaatatatataatctattccaatactctgtgcaactaaggcccgtcatggtgctgatcctacaatttaatacatgagttttagcattgcatgatttaactacaatatacattagaaaatgcacatctaaggcagtttaggttatctatctgaattaaatcaactctacaatttaactttcaacaacaaacagatgtgcaacacaatagaaaaatagaactgaaaaagaaaacgtaccggaacttatgccatagcttcaaacacttgagtatcaccgatgaaggtataaaagcatgtataagaccagtcattcccaccaccttccccttaaggtcaatcactaatcctcccaagccaaactacaacatttaccaaattaactagaacaaatcatgcatgccatacactacacaattcaaaataagaaatggtgtggggtaaaatggagatacctcggggattgcactgctaacgtacatatagtgatgacgatcacataagtatggattagagtacaacactctgccatgacttatacgcggatacaaattttcatctcttccaagcatgaaaatatg

SEQ ID NO: 95982 - DNA, 1299 bp, Oryza sativa
tgtcagcatgatctgcgttatatacaaacaattctgtagagcagatatgtacagatatgtagtgattgaaatgatgaatttatatgagctatgtacacttcaaaagaatgatgcttcatctggtaacatggtcatgaaaaatgaaggagataaataaaagatcaaccctcttgatgagaactttagtgcctaaagcaaaagatggagcaagttactctgcatgttcaggggacaaaagtccttggaatcattcagtagttgcatggtgcagaattaaaagtggcaatcatccaatattaaccacaaattaaatatcagaaaatggacagcgaactttgaacaactcaagtacattctgtagattaatttaaactcttactagctatttgacctacttaagtttttttttcctggaacatggcagagatctgcacgtcatttcattacgagagaagaaaagctaaaatagccaggtacagtgaccttacatgaccatgcacaaccaaaacaacggcctcacagtagcgtatctagaattattttagagcacgagcaaacttcactatagctagtatttactacagaaattctatttcatttttttcttaattacatggaattttagtggattaaccaccgacgagcccgggcagctgcctggggtcaccaggcagtagatctgcccctgcggcctcatgcgaccttacatgaccagaacatcaaccaagcacaaccaaagaaacaactaaaagacgcctcacacaagcaaaacaacaactagacaatgccaaacatgacctttaaccgaccaacacaatgcctagaaacaaacaaacaactccgaccagccataaccagagatgagattcagatcccaccagaaaaggcctcacaaccacgaccgttggctcccacggaggcggtatcaatagctgcttcaaataacatcggatcccacccatccgccatgcaagcattgatcattgaattcatctaccaattaaggtggacctactgaagttaaagaattgcttcattctattaaggcctttggcactaagtcttggcattttatctgagaaaatcaaacataagtttttttctcgatctaagctatgaggtatcctgatcggtgataatttgggtctcgattccatgtccataagatagccaatggttataatcaaagcacttgtagagtaactgaacatgagatacttgaatcaacatcttcacaaaagagtttttgataaggaacctgacctgacaatgctccatctctagctttttgcccaattg

SEQ ID NO: 95983 - DNA, 585 bp, Oryza sativa
cacttcgacatccctttccctgattggtccttctggggctggtaagaattaaaaaatactccctccgttttagattataagacgatttaactttagttaaagttaaactatttcgagtttaacttaaatttataagcaaatataataatatttataatactaaattagttttatcaaattaataattgaatacattttcataataaatttgtcttcggttgaaaatgttacgttttttctacaaacttgatcaaacctgaagcagttagattttgatcaaagttaaaaacgccttataacctgaaacggagggacggagggagtacttactttgtcttattgcttgtcttcttcccagtagtacgacagtagtactattaaaatatttgagtttagaacatgatttagttagaattttagaacttttaacatctacaatttcccaaaaaaaacttagttcatgaatagaaaatatggtatgtttaaattgacctcaaaatgcactttccattatatcataaatttgttacattttatagacatattctaccaatgttatgattagtggccaaaattttaatggtt

SEQ ID NO: 95984 - DNA, 1056 bp, Oryza sativa
tcaaataaaaagatagttgcttattcgttcgagaaaacaggttatcaatttggtacagatttggcttgaattttacattttaatgctagttggtgaaccgtccagtactctgatggccatattaataatttccccataaaaaaacataaactaaattcaacctcggacactcaactttatattgcaaatctgaaataattttactgcattagaaaaatcagaagatggctgcgagtaatattagtgtcagttggtgaactgttgagtactcccatttccatatatattaatcattttcccatcgaaaaatgagaaaccaaatgcaaccactcaactttacattaaaaaactaaagtaattttgcactatatagagcattaaaaaaatcagaaaatgatttcgagtaatgtgagtagtcatcctgcacgagcttgactaatgcttttggaaaaagggagtaattgaggtgaggtgtgagagtgagattccccacctgtgggtacatgacaaaacaaaccaatcttgctgttgaagcgcatgatgtgagataagatcatcaatcagcagcaccaaaaaatatctctccttctattgcgtgcatggtttgttccttacatgattctatcttgagcagtgctcattcttcagtgatcattagctgtttcttgtaacttgtaagaacttgtttgaagcgcaggaatatttttttccttgaagataaatatagcgaaattggaatgctgaattatcaattaccggtgtgtaaatgccctctgatgaaataagaagagtaagtagagcacaaattttacagtaacaaattaagggctcctttgaatcgtaggaatgaaaaaataataggaataggaaaaacacaggattctgacaaaaatacaattgtaaaacagaggattgcaaaacacaggaatgaccgtttgattggaccacaggaaaaacgcaggaatcagatgagagagatagactcagaggaaatgttccaagaggttagacctcttgctaacttttctctaaaatgtgcataggattaccccattt

SEQ ID NO: 95985 - DNA, 694 bp, Oryza sativa
tcctgcagcccatctaagatgactacctgtaaaatctgagatgattacctgtaaaaataagcctatatttctagagatggacatcttaattgagccgcctgtctctgcgatcggtgaagcgagttccccaatccctatggtgtgtattgcagaaaagattgtagcttgtttttttttaatacgtgctccgtgcagcttaaacagctggatcaatcagttatgttcacgtggctgaaagatcgatcctgatgaatttcatgtatgttgtttaatttacttaattcttcaagatgagttctattatcctcttggccgccgccggtttagttaccaagttgaagttttttcaatatacttcaagagaaaaaaaaaagaaaagacaaaaacgttatggttatactataccggcgactaaaggatgataggttgaattggagcgagagaatcaagtgtctgtttagatggatgccaaaataatccttaccaaaattttaacaaattaacaatattgctaaaattttggtacgattggctaataatgttaccagaatttcgtacacgttgtcaatatttgataacaaactaaatgtagccatttaactatcaattttagcaaatagaatgttcgaaaatatcatcgatctaaacaagcgaaaaaaaaccccttcaacgtacgttgtaattgtaggcagag

SEQ ID NO: 95986 - DNA, 676 bp, Oryza sativa
tcttggaccaacagggtcacagtacttcactttgacacttctgataaaatcaacaaaatgcaatactttgacatagtctagcaccacatccacaccaaggacaaggagtgctactattgtcaatttcaaagatctcatgcatcagtccatctcctgattaatcactgtcctgctccataaaaaggactgttgcaagaacaataaatcatctattccatttatacataaaataaatctattataaagggagccctggttagcttgcctggtcaaacaaaccaccagcatagatagtgccttggagccttggaccaattccaggcacatcccaacaaaccaaagtcgttaacaattgtcttcttctataaacattgttgttttttttaaacacctgtaatgaaatcattatcccttttatttgaattatttttctttcagaatatcaaagtagacccaatattcttgtaatcacttcttttggaatgatgctcctttataagctaagctttctaaccatatttaatagttcgtatattcttatatttacatgcctatgaaaactgtattttacttttatgcataagtaaaaaaaagtatttttagagaaaatgaaattcttttattgtatacatacactattcatgaaaggacaacgaattgaacctaggctgtgttt

SEQ ID NO: 95987 - DNA, 645 bp, Oryza sativa
tttcgccagcctctccatcgcacgtgcgccgcacgtgactccctcagagagcgccctctctctctctctctctctctctctctctcggcgtcgcttcccgccgacgctgcccaaaattccggccgccgccttcgattcccgcgcgcccgtgcgcgtggctgaccgcctgggcgccgccatcgccaccctcggttgtcgcctgccccgatgaccaccgtgtccgcgcttgccttcaaaccgtccccgtccttttgcagtcgtcgccggcgtcatcctctcgggcccggcgccccatgccgcatgcatccaaaaccgtgaggcgcggctcgttctcatccctttcctcccaaaacggaaggagcaaagctccctttcctcctcctcctcctttcgctttttcccctcccgggtagcgagctccctgcctccactccttggcttcttgttcaaaaggcagagccgctgacgccgctgcagcgcctcgccgcccccaccttgaccgcacccgctcgccccgcgccaatcctcccgtgctcgcggttcgatttcccaccacacgatccaccgcctccaccaccctttgcatccttgccgtcgctcgttctcgcggcgcccatgaacaccagccgagcgccaagaaaaccg

SEQ ID NO: 95988 - DNA, 2297 bp, Oryza sativa
agttatggtttccgtctctcaacaagctcaccatcggtcattatcatcgtataatgtatttatctattatcgttaatattgctttccagtatattgcgaaatcactgtgcacttactttgataaaatgatgtttcagatcatggaaaatccttcctttagaagaaatgcgagcactcaaggagttggagttaatggacgtgcctgttgttgaagaattgtcagttccttctctggagaagttggtgttgattcaaatgcctagcctgcaacgttgcagtggaataacaacttcatctctaccggtttcgacctcccaaatacatcagaagaaattggtatctagtctccataaacttactatccatgattgccccagtttgatagtgtcgcttcctattccaccttctctgatttctgacttatctgcaaggggatttcagtgttcccaacaattaacttatctcatggaacattcagtattgaatctaatgagttgaatgagttggataacaggatcttaccgttccataatctgaagggcttacggtcgatgtacctacaacattgtccaaacttgagctatgtatccagtgaagttttcagccagctcgttgctttagagcatttgtctatagagcactgccctaatttgttccagccacactccatgtccgagcctgttcatgaaaacagtatacttaacacagatcaccttgtcctcccatctctcaggtttctcaaaatttcctcgtgtggcatagtaggtagatggctaacacaaatgcttccccatctgctgtcccttgaatactttttattatcggactgtccacagataaaattgctgtcaatcaaccaaccaacagaaacagaagcaaccagcagtttggcttcagtagagacagcctcatctagggatgaacagattctgaaaattccatgcaatctccttcgttctctaaagtggttgcgaatttgggaatgtgcagacctggaattttctggagtcaatagaggattttcaggattcacctctcttgtgatgctacaaattagggaatgccccaagctggtatcatcattggtgaccgaaacaaatgatactaatgtattactaccacagtcacttgaacatcttgatatcggtcctcttccagcaaacctgcagtcctactttcctaaaggcctgccctgcctcaagaagttaagcctaaatagcggcgaatatttgaagtctgtacaattgcattcatgttcgggtttggagtatttgcagatctcgcggtgtccacaccttagtgtgttggagggcctgcagcacctcagctcccttcgaagattatgcatccagatgaatcctgagctgtccgctgcatgggatcttaaactgtttcctctgtcacttgtagaacttggggtcagaaaagtcgagggcagcttccattcccgctctctgtcctgcctcccttctatcacaaagttagagatacaggatagtccagaattggtgtctttacagctaggatactgcacctcactggaaaagctagagattacaaattgcaagtcgcttgcttcgatcaagggcatccagtccattagaaaccttaggtacttgaaagtactcttcgcccccagcttacctccatatctgcatggggtctcagggatctggtctcgactggaaactctccagattagtaatgcagctgtgctatccacgcccctatgcaaacagctcacagctctacgtgagcttatgtttttgggtaagcagggggagggatatgacggcgagaccatggtgagtctgacagaggagcaagagagagcgctccagcttctcacctcactccgagtactagctttctcccacttgcagaatctcaagtcacttcctacgaacctacaaagccttgactgcctcgacgagttgtatatcagtgtgtgtccgagcatcctaaggctaccacagatgggcctcccaccttcgctccgttacctatctttgtaccgctgcagcgaggagctctgtgtgcaatgcagaatggcagaaactgctaacctcagggtcggcatttactctgcatcggctattcccaggcctggttatggtacatattcctatgcctgattatgttgcaactgcccttccctaatctagagttgatgctgtctgcatatgcactgagtctgaaacaactacacatgtatctgcatttctgctgtgcaaatgctatgatatagtcaaaatgatacagttaaagcttgtgtgtaactccaatctttgctattg

SEQ ID NO: 95989 - DNA, 725 bp, Oryza sativa
tcctgcagccctactccctccgtcccataatattaaaacctgggactggatgagacgtttcatagtacgattcattgtactatgaaacatcacatccaatcttaggttgtaatattatgggtcggagggagtaggtggagatttataaaatttactcaaattaagaagaaggagaagaaaaagaaatggaaggagagccggtgggagggagtgggcggtggtggcgctgctgccggcgaaccgcgccacggtgcggacgaggatgggggaggtcggcggggggccaaatttccaaccgcatcacgccaccaactcaccattacccgcctatgcgacgtgtgttggtgaaaggtgaaaacccccctctcaaatctctaagtcaacttagccgattagcgattgatatggagtaggtctgatccagctccgcggagtcgattttagtttttcttttttaaggcggagtaccatttgggttcttttattattattattattattattattattattattattattattattattattattattattattattattattattattattattattattattattattattattattattattgcaagtgtaagttggaataatcagtggttggttgtcagttaatttcccctcttgtaccatttcacgcataattccatggctgtgcactgcagaccgcagatcatgtttctttgattcggggtgcagga

SEQ ID NO: 95990 - DNA, 592 bp, Oryza sativa
tagcatacatcaagcaagtaaagtaaaatttgagattaatcgaaattaattggtttaaatatattctcttatggatttgaatacttgaaagatcaatcatatagtgcatttagagttttttttgcaacatatcccgtgtaatataaaaacacaatcatttctttgcctgggaagatattaatgatcctattgtgtgatataagaaagcgaggttgcctttttttctttgttttggattttttttttcattgcttaataattttggatacactatacattctggaattataggagtggtatcaagtaggcgtattatatttaaataaggtaagggaatggaagttcgtgtgattgggaagggaaagatatttttggaaacctctagaatccatatgtgatatttttctctagatttttttctcacatatgattgttaggtttttttcttctctagtataaattcatgatttttcttcaatgtaaggggtgccacatggaccaatcaaaaagctaacaaaagagccagctttagattattagataactctcttgcccttatcttctttctctaacttatccatatccagtaaag

SEQ ID NO: 95991 - DNA, 643 bp, Oryza sativa
ctttaacgcatttttgctgattttggattcatcgatgatattccagatagatatctaacttttccaggtatttaattaaaaggtaaatcattataacccaagaataaaaattgtaaattttcatttgcaaccaacttggcatatttttttagtatatattgttccagacatcaaacataagaattcatgcttctaatttattcttatgacttatttatttttaaatgttttaattatgggttatacttttcatagttcaaagaaatagtaaattgaaaatttatcctacatataaacacttattatgacattctaatgttagaaattaaaatttattttgtatgtacatagaactgctataaaatcggtttggccagaatcggtttttacctgcggctggtcggatcacctgtaagtatacgtgtaaattaatggggatttttatagacggccaatcggaccacgtgccaaaatatattatcgtggtgatcataggcaggcgtcctaacaggtcagcgtgcgaaaatcgttatgacatgcagctgacttaagtgcgctgcatgcaataatgatttttcctatgatggtcgcttgtgataacatttttcaaggcgggctggttaggatggccacctgtgataat

SEQ ID NO: 95992 - DNA, 678 bp, Oryza sativa
agataaacaatattaaattccaggtttatcaacagagtataatatcgagggcccacgtggaaccagctcaattgctcaaactccaaacaattgaaagacaactcgaatccaactttggcattacgcgattataaataaaccggtacaaactgaaaaatggcttccagcaaatacaaagtcggccactgaaagcaacattaaaaaggtccaacacacaacttgaagaaatacacgaatataaacccaaaaaaaaaaaggagagccacacacaactattcctaaatcgtttcaacaatagtgacatcatatttcaagtagtatatgcaatagaaatagtgagaatcttagacctctgacaaagtgacaaggcagagatgattaaaaactgcacaaggaggggagagcttcccgaagcaaaaaaccagggtgccagctcagagcagtacaggttaaccaccagattaccgtgcactaaatcagtactacatctcagcaaaaaaaaaaaaacaatatgaactttgaagaaaaaaaacaactctacgaaaacaaaataagtaaataaataaaaataaaacgatctgaacagaacgggaggtgggaggaaaccatcggattggcagccgcaagaggagagaatgcaatcatgtacaccgcgagaatcgcaggaggtgaaaaatc

SEQ ID NO: 95993 - DNA, 861 bp, Oryza sativa
aaagggaggaggaagaagagtagggggaggggaatgccaagtcaaggggggattataagtaagcagactgcagagctcatggaggaagaggaggagaagaagctgcaaaaaaaaaaaagtctccggtttctttctgcatgtggctggcctatctctgactgaattcagctctcacctttccttccaaatgcaaatttctttacaactttccatgtatttattagagtaatactactacctgtattggcaatttttcattgttaacagtatttttgccctaaaaatatatatgtatgcgaatataagtagggctgtgtttagatggtggaaaagttgggaagttgagagaaagttggtagtttatgtgtgtagaaaaattttcgatgggatatgatgtgatggaaagttgagaatttgggcaaactaaacacagcctaggttcaattcgttgtcctttcatgaatagtgtatgtatacaataaaagaatttcattttctctaaaaatacttttttttacttatgcataaaagtaaaatacagttttcataggcatgtaaatataagaatatacgaactattaaatatggttagaaagcttagcttataaaggagcatcattccaaaagaagtgattacaagaatattgggtctactttgatattctgaaagaaaaataattcaaataaaagggataatgatttcattacaggtgtttaaaaaaaacaacaatgtttatagaagaagacaattgttaacgactttggtttgttgggatgtgcctggaattggtccaaggctccaaggcactatctatgctggtggtttgtttgaccaggcaagctaaccagggctccctttat

SEQ ID NO: 95994 - DNA, 587 bp, Oryza sativa
tccataacctattctattcaatgcctactccctccgtttcaggttataagaagttttgactttagtcaaagtcagactacttcaagtttgaataattttataggcaaatatagtaatatttataataccaaattagtttcattaaatcaataatttaatatattttcataataaatttgtcttgggttgaaaatgttattatttttttctacaaactaagtcaaacctaaagcagtttgactttgaccaaagtcaaaacatcttataacctgaaatagaagtagtactatttatcagcaaaaagttgtgcacaggtgtttatcagctaaaacaattcatatataatttgcaacggaacatattgtagttttgtatatgatggagatatcaacaccatagcgagctaaatgaacctattacagaaggccctagctttctgagatggtattttgatcttggatcccctctttgttccaactaaggacctccaaaaccaggttccagaagcccaaagagagtgagagagaacattagaacaaaggagaagataacctcccaaattcactgcatggatccatttcacaaga

SEQ ID NO: 95995 - DNA, 583 bp, Oryza sativa
gaagagtgcctgtaagatctaggaaaaatatgtatttagtggaaattgcaacctacatggaaaattgtaaattcgatcgtggatcattggatccaaaatgtgcagcctgtatgaagacttgtcagccccgccatccccacgatacattttacaaaatactctcctcatcatgttgtgtacatttttcatatacaccatttacccaacgcccaaagtgtttccaaaacacaatggttccttctttttccctacttttccatatataattacttttccatatataatgctaacaacccattccaagaagaatgttagagggtcatccatacatatggaatctattgatgcaccgaaacaataataaactgcaattaatttcacttattaggaaagtataacaacccaacaaagtacttggattttactagcaaagaaaagaagaaaagaaaacatttcaggttttcttaatgaaaataatatgctttttccccaagcaagaaagtcacaacaaaatggggggctcaaagcaaccaagacatcaacacaaactgatcccatcttgttgtgagagagatggattcat

SEQ ID NO: 95996 - DNA, 1603 bp, Oryza sativa
gttggtaacaccaaccgattggtaggttttttagtttttttcattgtttttaattccttgcatattaatttcactccattcccaaatcatgcacaacaaattaatcatccataattcacatgcccatccacaaaatcatccacaatctacaagtcattcacaaaatcatccacaaaatctaaaataaactacaacaaagtttacaaatcattccaaacatctaaaaagatcacaaaatcatgacggccgccgccgccagccacgcgccgcttccaggccgtcgccaccccgccgcgcgccgcctctcggccgccgccactaggcttcccctcccgccggatctggcggaggggaggccgcccggccgtgcgccgccgcctatcccaccattgtttcctccgcggcggcttccgtcgggtcgcctccggccgccacctgccgtcgccgtcgtcggaggaggggagaaggggaggagatgggaaggggaggaaggggaggagatggccgggaggtggaggagagaaaatgagaggggaggaggaggagaggatgagaagggaggaggagagaatcggataaggacgagtaagcactactggagataatggcacgcggggctcggggctagattttcgcgattttttttagtttcgatcccggttggtataaacaaccgttccagttggtaatttcaaccggggctaaagataatgagggtttgacatgtttttgaaccgggactaaaaatggttaccaaccgaaactaaatatcaaagaagtacatgtaggcttttaaaccgggactaaatatatttttagtaccggttcttattcaaaccgggactaatgtgatttttatgtgactcagtaaagatcatttttctagtagtgacacatcacccaatttgtgtgcataccgcatgtacgtggtacatatagttagtataattattgtctacgatgtctacttcaacattaagtagtgcatgattaagcgcactttgtttcaattcgctccaaatgtttgatccattacagctccacatatattgtgaaatcatttatgctccgaataaaatatatgttggcctgaaacctacgtacgtcgaacatctatctggcccaactggatggggaaagggtcagcgaattggtacgtacccttgtacgtgttgacgccatttgaagccttccatttgacgccagaaaccctttgtgttgatcacaccgcaggagctagcagaaatataatgccacaacacaatgttatacacgtacgagtgggaaacactaccttatgttgtttctttctagtgaacgtgaatcctatagctaccatgcatgaaacattaatttctgctaggtttggtcatgatatgatcagtccattctgaatgcaaagggatcggatcgatcattctcgtggcttatacttggaatctcttttctttttctttgctggaatgactgactccattaattcatccaaactgtacagctagcttaatttacctattgacacttgtgttagctaggcttgaccggcgcgcgcggtggcgatggatctgaccatcactagtctcgtggcggcatgtctgagcat

SEQ ID NO: 95997 - DNA, 675 bp, Oryza sativa
gagggagtacactctgttttaaaaggccatgcctactccacctagatggtgcctaggcggtaggtggagcatcactgcctcgcttagcaactactcactctattctataaaaacccaatctaatattggatgtaaaatattttaatgtatgacgctatttattttttataccattcgtcttgttcaattttttttttgtaaaatataaaaatatttatgtaattcttaaagaacatttaatgataaatcaagtcaaaataaaataaataataattacataaattttttgaataagatgaatggtcaaatgttggctaaaaaggtgtgtcatattcagttctagattctgttttttttttatggagggagtaagcattttgtgtataggcgtgtttttctcacctggagcattttaaggtttggtttatacataaaagttggagaatattaaagatggaatatgatgaattatggtcatagaactcatggatggcctataatgttaaattctttgtttcagcgtgtcaaattcttccatttaacatgacataactctacccatcaagaaaataaattgtctaggcgtcgtctacgcacgctggcattaggcgaagcgtcaccgcgtgcctagcacctagcgctagaaaaataccttaaagttcttcaccattattt

SEQ ID NO: 95998 - DNA, 1150 bp, Oryza sativa
ttagccaactaaacatattcccctatccatgattaatctgcatgtttctccatgattagttttgcatgttaaatgattcttttattatatgttataaaatatcattttcttgatttcctatactccgtaattattttcaattggtctgtacacttatactgccctctaatccactcagtttcttttagattttctttaagatttataggtggcaagaagtaaacctaaatctcacaaattattttccttgatgtttaggaaatgtttcttcaaaatcaagcttatgatctgatcctgtaatcctgtatgctgtaattttatcttacttttacttattcatcattactctcttttttttcacttaaaatgcactatatatacactattcaaggtatttgtaagttttaaaataccaatttaacaataatttgatatatacccaactattatttattcaacttcatgtacccaatttcaactttggtatgaagtaacctgaacctgataaagtagacaccagggatgggatgttaggttccatccttcccttctccagtattgagcaacaaaacataacatgggaagattctcagggcaaggcaaggctgggaaaatgccacccaattgacccatttgcaacatgcaacgcaatgtaacctcaccaattgttcatcggaatttatttctttatcttcgttacgttaggtccggtggatctgccggcctggagcttatgaatggtatgataggagagatagacgacaagaggggatagaaagtaagcaaggttaaggaattcttctacttgttctttgtttgtgattttttttcctatgctaggacaggggtcgtgcatgttagctttatttgtactgtagaagactctgtcactcaagttgagataaaccgctaaagacagtgacatctcaatggtagacattgtttattgtcatcttgtcggttaaacaacaagttgacgtgtctgtcaaaattattccatctagttgtagatagcagtgcacgtagttgccctaacggtgcagcttacctgaagttcttttagcaggataggtagtaacacgacatggcaacttatcgtaatctgaacactgaagctatgctgcatgccattagttcagcaagataagct

SEQ ID NO: 95999 - DNA, 709 bp, Oryza sativa
ttcaattattaattacatctaaattaatactgtgaattgatttcttatggagagtactaaaaataatctataatctatagaaattcatccatttatattttcattaatcctatacttaagagttagtattttaggtatttaattagtaaaatttcatctaactacacttttattaaccctataattaaattctaaaatttgtaaatattttaaatttccctcttaatttttctttctctttttctttccctttttcctctcctctcttttcttttctttttctttctctccctttcttttcttttctctcctggcttcctcctcccttcctctccttctctttctcggctctccctctctttctctcggctctctctctttcccacccgagcggtggcggcggcggactcgagggaaacggagggcgactcaccggcggcggcagcggcgatgacggcggcagcgacggcggcgcacggtggcgcgagaacggcggtgcgggcacggaaacggtcggcgcggcagcacaacggcggcggtgcggcggcactacgatggcggcgcggcggcactacgatggcggcgcgacggcgtggaggagtgggtggtggagacggggagaaggggggggaatagtgaggcctttataaggggagggagagagataagggggaaggaggaggacggaagagggaagaggggaaaaggg

SEQ ID NO: 96000 - DNA, 709 bp, Oryza sativa
aacatcctcgactcctgctctctttattccatactcgcgtacactttagtattagtcgtaccctacatccctaaatacagtggtcgggcataacctgacgacaaccctatatttagtacaccgacatgcatcatccatatgcttgattgacaatatgtcaacggatgaatttactaagggatttgtggcagcatggtgcctacaattgatctccatctctataccagctatccacgctaaccagcattaccaccaacttagacaagttagctatgagattggccttcataccacatcgaatatgaacctatcatttgctgcctagctatatatggtctctatatggatagggatcatgaataggggattagagagagagagagagagagactataacatgctgaacccgtgtggatagggtcatgaatggcttggtgagagataggacacaaacccatggtaaataggcgcatttcttccttctctctcctaactttgtggcaacttttattttaatgttccacgcaaatgaccacaaaactttgacgccctatgaaaaaggttggcattgggaatatgaagtaacagatgatttttctaggggaggggggatatgtcacaccctgaaaattcaaaatatataaattgctgtttaattggaatttttagaaataattttaaaagtcttgataagaaatataagtttaat

SEQ ID NO: 96001 - DNA, 710 bp, Oryza sativa
acaggagcggaaggcagagtgtcacaagaagcgcgaagcatcgggttgggtgcaattatgttttggaataagttcactacaagtctcttaatttatcgccgagtctaaaattcatttctaaaccaaaatacgagatacaacacatcctcaactttcaaaaccgtcacaaataaggtctccatgtggtttggaggatggttatagctgacgtggcgcctacgtagatggtttgtatagcacgtcagctgaaaccgccacccaaaccgccttaggaccttatttgtagtagttttgagagttgacggacatgctatatctgctatttcgatttagggatgaatttcaaactcggcgacaaattaagggaccagaagtgaacttattacttacgtttttgcacgtcgttagcgctaggctgggccaccaggaaaccgaggagtgccaaataaggaataagttcacttagtgaccctcaaaagtaaacgaaatctaatccgtgaccctaaaacacgaaaccggatattcaaccccaaactcttaaccggtacaatttgacacttggagggcggttttgctgacgtggcggtattgaccgggtctcctttacacgtggcgttgaggtggcatttagaatttaaaaatatatgtgggacccatttgtcagtgacacataaaaaaaaattgtgggacccacgtgtcctttctctttc

SEQ ID NO: 96002 - DNA, 534 bp, Oryza sativa
agagttttctctatcttctctgcttccattgactcttgttcataaaactcaacctggagcaaatgttatgaacatcatggttgtattctgccacagttttaaagtcctgtaggcataaatgtacccactcataattagccttaagccaaatgagttccttttgctgatcataacgctctttaagagctttccaaaggttgagagggctcgtctctaacatgtattcatgtttgagatccttgtaaatgtagagtctcaaaagaaaaaggttgtattgagcttcctgggctcaattgccggatccccatcattgggttcctcaattgtatttaaaatcccccgagaggcaaaattgattttgatatcggaagcccagatgggatagttagtcccatcaagggcgagttcgtcgaactcttttgttgacatgtccctacaatcatggttaacattatcaatttacagaggtaaattaataaaacatgatattaaggttgtaatctcaatgcgtaatgtaaaacttcatattttgta

SEQ ID NO: 96003 - DNA, 555 bp, Oryza sativa
aaaattcctcaatctcgcgtataccctggtactaacggtccctatacaatgcaaataccgtagtcgtgatctacaacatcgacatatacgaactcgacactataggttcttaaagttttttacttataatttatactttaaaacacatatcctatgaaagtgacataaataaacatttctaacatgataaataataaatcaagtagttgtaaattacaatatactccctccatattttaatgtatgacgctgtcggtgacatgggatcgggagtatcatgactagaggtttgaggcagacacaatcgcccacgtggcctggcaccctcgggggacgtcgggcccaagatgtgttcgccctcctcttagtccccccgagggggtcgagccgcacccgcctcggccccgagggccgaggcgccccgacccctcgtgggttttcgctccgcgtgtatgggttaggtgggcacagtggggctcacctaaccacatttattgcggtttggctgagcgtgtcacgccgcatgtaacgcggtgcagtgcactcatttatccg

SEQ ID NO: 96004 - DNA, 704 bp, Oryza sativa
acagacaatgcactaagatttggttgtgtagtgcgcgggtctgtaaatactgacatgtaatgttggaaatgccggttttataagctaatactagcatttttgtaattgcttacatggcggaggcagaaccagatattttggtgagggaacacttcagaatgaggaattctgaacctattaattctttggatgtttctcatctaaatactagttaacttcctagatctcatcacagaaatgtgatggcttagacaggacggtatagaaaattaacaatatcgaccaacaattttcttgtaatatattttgagaaaaaaaatctaacgatatttatgctacgaaaaatctttcccaacacttatacatacatatttcatatggattgtccaaaagttcattaaaatcagaataattttgttgctagctagcatgccactttttcaccagagggattgatctgcaatctgcaccataaaaatacaggaggtagtacaagtgggctttctattttcttacaagattataggaaagcgggaagtcagacaagtagggagcacttccctttgagtggaaaaattgagccacatatatacaaatttgcagtcagaagacttagcaacaaagtactgcaagtaggcgtagttaaatcaaatgagtgctgtgctgtccacatccatagtctggacataactaatggcattgag

SEQ ID NO: 96005 - DNA, 559 bp, Oryza sativa
agacaacgcagcggcagcgggcacggggtagtggcacaaccatgctcagagtggcgcgagacggggagagatggagttttgcctcgtgggcttcatgggcggcaggggagctcgcgcgccgctcctccgcttgccgcccctccaccgcctcgtcgcccggtgccgacgccctcctctcccgcctcgcactgtcgccctcgcagcgacttctccaccccggctcgcagcgcccgcctcgccgccagcaagctcgccgtaacgcgtgtctcctcctcctgatccgcccccatcctgtgcctaccgccgcggccgccattcgcgatcggccgccaccgtggacgccattcgcaaccggccaccgccgccatcaccgcctcgtgggccccgtgggtggtgggcggcggccagtaggggagcccgcgcgccgctcctccctcgctcccgcgcattactccgccgccgcccctcccccgccgctcttccacccaccaccatcgcgtcgcccgttgccgccatcaccgccgccgcgcagcccgtcgccggccgccgacgccctcct

SEQ ID NO: 96006 - DNA, 845 bp, Oryza sativa
aacatcgatccctattcgttttgcatcactctctacgtactactcttccattaacttttcgcatgatgtctgactatttatcttatttaaaatttagtataaatatgtaaaagtataaattgatattagaatttatttgatagtaaaaaaaagtcacaacaaaataaataatatttatataattattataataaaaaaatagtcaaatattatatgaaaaatcaacagcgtcatatattttgagacataggagtataaattaattaaagcttatcgctactactgttgctagctgctactacgactgttaattgcattattgccatttgcaaagttctattctgatctttgatgcaaaaggaatttgtacgcaacacgtgccgtcgagatggcgatgcatatatatgtgatcaacagatcgatcaggccacgagacttccatgagtcgatttatgcgtctgtttgatcctttgatgccattttaattcctcccttgaaaattcagaggttaataattttggaatcgtaatagtagtacatattcccatgtgttgatcaacaccatattcccacagatattaacttttttaattacacggtacaacgcagacacccataacacacacctataagcatcttcgaagactgggccggtaaatcctggagattgacgatgtcggtgatatgggcccgggggtatcatgtttagagggaggaggccgccctcaaacccacgtggcgtccccagaggagggtggcgcccgggaggagcggcggccgccctctcagcttagggtaccgaatttggagcgaggaggctgccccctaacccacgtggcactccc

SEQ ID NO: 96007 - DNA, 749 bp, Oryza sativa
cctgcccactcctctactctagataacttactttaagtacagatccccctggttgattaatttaagaaatggactaattttagttaggcatctattaaattcaaacccactttaccacttttctcctggtatatttatctttcggttgcccacagaatattttgtcatgcatccgggtaatgcagcaaatgtttagcatagatgcattgcataccggccaaaccgctgttgctgtctagctagtatagaaggaatgtttgaatgtgttgtctgatttattgtacttgtcacctaataatgtttaatacacttagagtccatttcacctcaatttgaaactctctgtgatttgtgtaaattttactttcatttaatcttccattgttctcccatgccaatacccatggtggcatggttgatcatatatatatatatatatatatatatatatatacatctaattggttgctacttagaattaaaactctaaatccactattcatttgtccttgaatcttctttggtccaatgtatagttgtatgtatactacctctgtcctatatttattttgtccaagtaactatatgactaaaaaaacccttagggcttattcgtttcaaaggaattgcaaaggaaaagcataggaataggaatgggttttaaactaccattcgttttataggaatgcaccatagaaaaactataggaaagttttccattcctccatttataaaggaaaagcatagga

SEQ ID NO: 96008 - DNA, 701 bp, Oryza sativa
cttccacatatcattttgcatctatgtatagatggactgtttcatgacagaccattctttaatttttatttgacatattagattttgccatgtcaataattacaatcctaatgttttgttatttatatgtatgtttgtaaagatagattggttggtagttgctaatggtggtcagtgctcagtaggccatccacagatactgaagaacaaaattaataggataaatatatttgaagttacaaacataaagagaatagggagtttgtgtagattgcatagatagatagatggcatggtgatgcccaccagatcttgtacttgtgatcttcacttgcttctattggcccaaatgcagctgtggacaagccaccacctgcacccccattcaacagaacagatcacaccctctcctcatataatatctgaatcactttacaaaccatttaattattaaactattgtatgattagctagccctgtcctgtgctacgtacacatgcatacacagaggcatgaatcatcatcatcctgcaaatgccaactaaagtggcatgcactcagggcacaggtacatacatatggatctagttttcacatatattgtggccaatctcatctggacatcatttaattaagcctcatgagtacatactaaggagcaacacaacatatatttaattaattgatcaagtgtattagct

SEQ ID NO: 96009 - DNA, 1266 bp, Oryza sativa
aaaaaaaatatgagtttttttggtaaaaagatctttctatgcggctggcttaacagcccgcatggaaagatctttttcgcatgcggccggcttaacagcccgcatggaaagatctttttcgcatgcggccggcttaacagcccgcatggaaagatctttttcgcatgtggccggcttatgtcgaccgcatggaaagatatttttccatgcggtcccttaagccgcccgcatgcgatgatctgcgcctatatatagggagcgcggggagccaaaattttctaagtcccggctcccgcgaaaccctagccgccaggctgccaaaatttcccaagtcgccgtcgccgtcgtccccgccaccgccggctcctccccaaagtcgccccgccccacgccgtcgccgccgccgccgtcaggacctctcccccctcgccgttgccgtcgccgccgccaggacctctcccccctcgccgtcgccgtcgccgccgccaggtcgccgtcgccaccgcacggaactctcccccctcgccgttgccatcgccgccgccaggtcgtccccgccgccaagtcgtccccgctaccgccaggctcctccccgaagtcgccccgcccctcgccgtcgccgacgccactgccaggacctctcccccctcgccgtcgccgtcgccgccgccaggtcgccgtcgccgccgcacggacctctcccccctcgccgttgccatcgctgccgccaggtcgtcgccgccgccaggtcgtccccgccgtcgctcggtaacatttacttttaaaaaaagaaatgtgaaatgtgcaattgtggattgtggattgtttaattgtgcatcgtggattgtgatatgtgcaattgtggattgtttaattttgagaaggtttaattgtggattgttaaatggagatttatgtttaaattgggacttatgtttaaattgggacttatgttaaattgggatttatgtataattgggacctttgttaaattgagatttatgtataattgggacttttgttaaattggcacctatgttaaattgtgacttatgtttaagttgagacttatgttatattgggatttatgtataattgtgatttttgttaaactgagatttatgtataattgggacttatgttaaattggcacctatggcaaatggagatttctgtttaattgtgacttatgctaaattgggacctatgttaaattgggacttttgtgaaattaagttattgggacttatgtgaaaataagttaaa

SEQ ID NO: 96010 - DNA, 599 bp, Oryza sativa
tctagcaattggtatattagtttaaagaatcaatcttctaatatatcaatattgaactcatgttttacacggcggcagcaactcagagccatgtcgatccttgagagcctggaaacacaaatttccccatggaagatgccaattgttcaatgatttgatgtcacgactaaggttttgaatataggcaaggattcataggcttcatatgaccatcgagacaaaagacttttctacaggtttaaaccctctcaaggtaatagccatacatcctatttgtctttgtatacatgtctatttgtctttgtatacatgtagatgtgtacatattacaacatgtggagggcaaactatagtctagacactaccaaaaagaaaaacttgtagagacatttatctaatattacagaggtatttgtctaatgccttcacaatactgtagaggcattttgaaaatgcctaataagtgacttttggtgaattgtctctacaaacaaagtggcattttacaaaacatctctatgcctagcgacaattttctacatgtatttttatgtctactagaaaaaatgcacgtgcgttgcaacgagtgaagtctattt

SEQ ID NO: 96011 - DNA, 1131 bp, Oryza sativa
acttttttttcttcaaacttttaacttttctgttatatcgaactttcctacacacacaaactttcaatttttccgtcacattattctaatttcttcaaacttccaattttgacgtggaactaaacacagccttaatttggtttgtacgagtaaagtaatattacctttgtttcataaaaaactaatctatattgacacatcctaatactacgaatgtaacgagattcatagtattaagatgtgtcaacatctactactagattgatttttttacggagtagtactcccttcgttaaagtgtgtgtttttcactcttttaccgtactaatacaaacaaaaatattcttactttatcagattttaatataattatttcttctttacttattttaagtgtatttatctttacttttataaacttgggtacaatgatgatggttaaaaataaatttattttagaagagaccgaacgaggaaaaaaaatggagtaacatatattgggtgatggcgacgttgcaccagctccgggcggtcactacgtggccatcgacgaaccacagaaacgcaatcaagaccgatcatcgataaattcatataccatggattaaatagagtgttgttgtttcgacatacaaatcctcatcgataagaataatttacaaataacactcaaaagcaactactctaaagctagctattttcagagggagttgttacttttatattttttcttaaaagaaacttcaaacgatagcagatttgctggatatgttaggaggaataaaaacataaagtcttacagagatcttttgagaaaggaacacatctaaacaatcaaagtgattagacttagatcaaatcaggtcagtggatcgactatctgtcggcaatcttccccaagtcgagccgactacaaggttgaagcgaaactgccctttcctctcccacggccgaaactttcctctccccatatctagatccgccctgccatcgcagagctgaccggcggtctacgcggcggataggatggcagcggcggggagacagacagcggagaagttgcggtggcggtcggacggccagactcgtgcctggccgcgtgggttggcggcggcaacggaggtggccggg

SEQ ID NO: 96012 - DNA, 1042 bp, Oryza sativa
cccccccgggctgttttcaccgtggtttttgccacgtcggatgccacatcggatgccacgtcagccctagccacatcagcgcaaaacattaacatgggccaagcccatattctctccccctctctctccctccccctcccctgttcattatcttctctcacggccgttggcgggcggcggcggcggcggcgcagagctacgagggcggtggcggcgcggagctgcgaaatcgacgactacggcggcagcggctgcgtggagctgtaagggcggcggctgcggcggcggcgtggagctgcgagggcagtggcggcggggagctggtgcgagggcggcagctgcggcatcggcggcgcggagctgcgaaatcgacagctacggcggcagcgtagagctgcgagggcggctgcggttgcgtggagctgcgagggcggcggctgcggtggcggcgtggagccgcgagggcggtggcggcggggagttggtgcgagggcggcgacgctgcgaatcacgagcttgttgcctcgctcagaagtggccgacctcgccggagccatacgcgcggggaggagtcatccctatgcgctcgcgccgccaccgcttggtcgaggacgaggtcgagctcaagctctacatccgccgccgcctcgtcgagcttgagttcctcatccccaagcagctcgagttccaccggcgagctcgaacatggagaagatggagttatggagctcctggagccggcagaagaggtagacctttgagctcgtgctcgccggcggtcggcacgaagggaaggctggggatgtgcttgagctccgtcgccgcaacgagtcccctgctccacggccaccgatctcctgctcagctccaccgctgctctctgtctgggaggaagaaggatagagaaagaaagggaagaggagatgggggaagaagtggccactaacgtgtggctctaatttttatttttagttttatttgctgagtagacttccacatcattgccacatagatgaaaaccagctgaaaaaccacttgaggg

SEQ ID NO: 96013 - DNA, 710 bp, Oryza sativa
aaagtacggcaaagctagaaataaacctagcaaaagttcgatcgcacaactcatcaatcgattgaaaataaaatgctagatataccgtctttgttccatttctttgcgccatcaattttaatccgcagtgatcgtccatggcatgtacaacgtgtggttctaactaaaaaatatcgctcaattaaaatagttagttcataattattgcttgtcattaataaccaaaattaacaacaggggcctagatggttcacatagacccacccacccaaacctcgccacgcatgtgaataattcatgagtcggtctattttcatcgacatgaacctgcaaaagattatatcaataggccatacttggtttcaggtgcatcctattcgagcccagccatcggtatagttgttgatgcaaaaatctgcaccaacacacgaaggcctaggagatctgcttagcttcagtgcaggttctaaatccagcaactaacaacataggtagacagattgtataagatcaaagagccgatcaaccaataagccgatgtgatgtattgaggtcagccgatgtcgttaaggtttttatcaaatggctttagatccaatgtaaattcaactaatcagataactaataattgtcgataggatttaacttataactgatgactgaaactgatagctgatagtgactattgatggttaaagcatacatcggct

SEQ ID NO: 96014 - DNA, 586 bp, Oryza sativa
aatggttggatggatgggttctcttcctctgctttgtgggccccatttttttagcttaaattaattaatatactctataattgttagtagtaactactaataacagattaacagattgattaattgcagacattatggatgtcagagattaattagtttttggtgggggttattggattgggatttttgttaattgcggtatctattaattgttggagatagagatatatcgagagttatatcagatggatgtggtggatgatgggtgcaagtactggagagatgatgttgctctgttttaaatgatgcgaatgcaatgtcctatcttgtagatatgttgggtgtcggcttggaattttcattcctaatttttcagatatataataactaagaagataatatcgaagcaattctgcctaatggttaattacaccgttattcgtttcctagttttttaacggatattaaacccaacatttacttcaattaaagctaaccacttgcacatcatgaaaaatcgaatttacaaaaaaattggcaaggttgatccactacaaaatcaatcatgaattttgtgtttgcatgg

SEQ ID NO: 96015 - DNA, 703 bp, Oryza sativa
ccccatcatcaaatataataaaaaattttaaatatgcatctagatgcataataactaaaactaaacttgctataagacagaggtagtagctcctttggtctccatctccctggcaactatgcaaacggggacattaccaacttgggtgcttgaagaaaagtttttctccttacgatcgaggaatgtttactttattgtcggttacttctccggacctgattactttggtacaaataatctcaggacatattcgaaggggctgcatataggtagctacatgactaaagacgtgtttctaactgcatgattgaatagataatattgatagagaaaaataactcatatggatgaattgaatatcataaactaacaaatatattagaaaaagatatcttagaaaatattacacttcaaaaagcatggtacgaataatccatgcacccactagttggctccccacgtctttgccatgggttttatagttttattgtcaaagttttaaatggttaggtgcaactctatgtttatacaaaatatatgataatgtagatttatatatgtcttatgttattgaaatataattcatgctttatttttccaagagtaattgcgtattgttataatatatgaatattattttcatgcgcaatatgggtattgttatagtaagacaatttgcatctctctatttcactcaagttta

SEQ ID NO: 96016 - DNA, 542 bp, Oryza sativa
atcgaggatggtggtggcgggtcccgagtcctcccaccacggatggggttgaagacgacagtagcaacggtagtggctctcgaggcctctcctgccgcggaggtggtcgatgatggcggctgcaacggtggttgtcaacgatggtggtggggagagagaacagaggggagggaggtgaagacggaactgacagttaggtcccacatgcagttggggataacagagattttttttaggaaaacgtgatagagtggcactggtccaatttccccaaattccagtggtacatagccgatattgtgaatagtagtggtatttatctaaaatgttatatttgtagtggtatggatccaactatatattcttacatgtaaaataataagcacttacacttatctcaatagttcaaatatccatatcatttgcatgctatccaaacaaccttagaaatttctaaaaatcttagtatatattatgaaatcaaatatactactttacaaatattcaaagctaaattaatccacatatgtgcaaacaaacca

SEQ ID NO: 96017 - DNA, 739 bp, Oryza sativa
tagagacatgatatcttacacttctcaaaggaatttttttttgaacggaaacttctcaaaggaattcaaatcatgaggtttgagctcatccttaaaaccctccaaaaagtgaagaaaaataatgattcttatggagtttttccaaccaaagcctatagaccagagggctacatagaaaataatcctacaggatttgaatcctttgaaaatcctataaaaatttcatttcataggaacccttaattttcgtatgagcagggtgaaaaaaaagcatctcatgattttagtggagtacttaaatattagaaataaactaggggtaaatttggcgtatagaatgggtttactgtccaatctctctagacggtatgtggccagatgtttaatccatagaaatattgtgacggttcaaaagctaatttcgatgatgtaaactaaaataagaatggattcatacatgttgtcaaacaagaaatcaaaggtcatggtcgtgaatagtttctcaaatttatgtacaatgtttcgccatggaaaaatcatgttgagttatcgttccttagacccttaccatcggttgtgctattagtgggcgctaaaccgtgttctaccaattcgtggtttatcacggacaactaatgatatagtctttgctgatagaattttttttcaaggatgtacaataccaccgcgaatttagggtgctcatcaggcctaacatcctctctttatggcctaacaa

SEQ ID NO: 96018 - DNA, 681 bp, Oryza sativa
tgacaataccccttgcacaacacaatccattacagcgcacctttcctggatcataatcacccccttataaacaaggcatggactccctagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcacgaccatcaaaaccatatgctcacaacccaccattatcaggttttagttggcacattaattaattaaccaatcacgattgaccaacgtgaactatcattaagccatcattaaataatagtaaatcttaagttatcccaatagtgtgctaatgtttctaagcagggctaagcaattatatctaatatctagctgaaccaatatataaagctcaactagtcaagttataataacccaaggtatcaaggaataaagtaatcaagaacaaaagggctttagcaaacaataggttaattccacccaatgacattcgaaaataaatgcaatagttgaatagaaacgatagctttaaacgggatcaacatgctcaaagggttgtttgggatctgtgtgacttgccttgctggccttggaactcttcaaactcttctcctg

SEQ ID NO: 96019 - DNA, 669 bp, Oryza sativa
taggaattgcagcagtagttcacttgctgtctgaaagataactttcatggtgtctcggataaacacacgagtgcgttgctgcgctataatactgtactaacaataattgtccacaaactatacgcaagaccagaccaacactacaaacatggtccagtgacagaaaaggtgattaaaaccttattaaggaccacttagctaaactataggaggagaagtgaactgaggaagaagccgagcaaccgcaagccgccttccaacctcctccctcccgacacatagccacctgcacatctccacactacgtgcaccccattttcccatgagaatttcaacgaatcaacacagtactatcccaaagtcctattttagcgaatgcggtatcccaaagtcctaaagaaatacaacaatcaggctggcaagaaagaacactgtgccaagctaattcactgtccaagctgataatacttatcattttgaaaaaaacacagtctttaaaaaataattttgaccatttttttattataatataaaaatatcaataaatatcctattccagtgaagcatttttaacacttgttcaaaacaacaactagtattatcaacccgcatgaagtagcaagaatcctatgatcaatactaaataatattccttcgttctaaaatata

SEQ ID NO: 96020 - DNA, 2280 bp, Oryza sativa
tagaattttgattttgacagctggaggcagctatacatagaaaatcaaagtactaaactataatcccagaaaaaaagaagtaataaattataatacgacaacaagctaaaacacatttacgcagcgttcgagatggtgagagtgagtttgtttgtttcgttttccgcgcgcacgtttcccaaactactaaacggtgcgtttttttaaaaaaatttctataggaaagttgctttaaaaatcatattaatccatttttgaaatttaaaatagttaatactcaattaatcatgagctaatagctcacctcgttttgcgtatcttcccaatctcctcaatccccttctcctcaaacacacccttattcaacaaaagcacgtatttccgcctctagataaaaattatattaatttacacccaccatataagtttatgcatcgtggatgcaaattactctttctttaatccaaagagcccctatggttaatcacatagggtaaggatagaggtaaaataaatgattactctctattaattgttctgtttggtaagaggtggacggagggttttgaagatggggagtattttggaaatttccttgctataaacaccctgtgggtactctagaagcaactatatttttttaacaaaatttaaatgctagaagtaattatattttgggacggagggaataataaactattgctcctatttgtcatccgtccatagtttagaacggctttgtaaagcgttttctcgtgctgacagagtgattatgtgcaagcaaagatgcttatattcatattaccataatattatttattttagatttaccattagtaatggccggctctcccactgattcggttcaagtcaaatatccctcatttgcgatttattcgcacaaaaatgaaaggagtaaataagagcacctaattccagagcgtaagcaaaaggggaaaaaaggagagaaaaatctcaccacgcgcatttctactaatttcccataatatttattttaagataacggaagtgacgaacaattccctaacatcggagatgagctagatactccacataacacttccaagaacgtaaaaacacgaggcatcaatctcaaatacaataatcggggtaattaaagatagggtggatctgctctcaccagagcgtttcacgtgacttcggcatggcgtgtttgctcccgctattatccacgtcgtccggtttctccttcgggtcactggggtgtggatcaacacaaaactttttacgacggcaatcgactgctctgtgccgcttgaccccgtggctgacgagtgggcctaattcttctcaatcgacctttctttgatgggtataggcgcgggcctgaaaagaacggctgctatgccggcccctcgtgcctataaaaagctgctttggtgccttcttatttggttcgatgggcctggtctagggtgcatagagaataagtgggcaagaaaataatatgctctctatggaccgggagcacacatagcgatgtgcctgtttacccgcatactccttgccccaccgtccgagctgttggagccactgtgtatttgataaagagcgttaccactgatatttgggctctcctattggtatggtcccaccgatcagccagtaattgccgttgcccattgggtggatttaccctatgtgttttgcgcgcccaatgggaaatcgacaatagtttctccgtttccccatagtgctctggaacccatcaatgccaccgaatgcccttctctccttttcccctttcttcagttcttttctccttttcagtgtgtgaagtgttcagagtgctacaagcattatccatttcactctttggttcctatgaagatggctaggtaaatttctccatgcgcgtgatgttctcagcattcttgtgcaatgtgtgagtgtcctcagcttatgcgtgtttttctatcgacgtgtcttctgcattcgtcgtcaccttcatataggaatcaggcttgacgtcacctacagatcgcccgtaaagcaaaaggtagggcctggttggttccttgcattcatccgtgagctttgatggtaggcttactcctcttcatggcgccccggcgcagtgatcgaggcagcgaagccgtgcctcgatccccaagacatcgtccgaagccgtgcctccgacaacaacacctcaagcgcttgaggtcaatgccggttatcagcgctcggcgcttttagttattttctcatgtgagtaacaacctctcctctattgtcagt

SEQ ID NO: 96021 - DNA, 1391 bp, Oryza sativa
atggagattcaccaatagactagaataatattctccttgtcatgtttggttttcttttattttggtttggtgtgtttcactttattttggactacactattttagagtgatagattgtaataattggctgcagctcttttgagcaaaggccgggatgtttcattccattttctaaaaaaaccaatatagctcctagccgctacgagtctatagccataccaccatcatctctctacatatctacactttattgtagtcgccatggttacattgtggttctaggcgggctggagaatggtgtgatggcgtcaaggccgaggggggaggatcggatcaagctgcctctgtcctcgcgtcgcgatcccgcctggcccaaatacccgatctcctcctgcctccataccggactcagcttcggtgacttagggagcgttcggcaggaggagtttgtgagttagtttgtttcgttttccgcgcgcacgcttcccgaactactaaacggtgtattttttgtaaaaattttctatatgaaagttgctttaaaaaatcatatcaatccatttttaaaatttaaaatagtttatacttaattaatcatgtactaatggctcacctcgttttccgtatcttcttaatattctattttcccctcctctcaaactcacccttagtgtaggcaagtcacaacataacattccatgcatctcgggcgtccagaatgaatccaatggagatggcgcttgggcccgcacacaggcaaaaaaaatctccgtttcagcctaacagaaggcccgcacgcgcacaagacgcgcttagcctcgccctcatctgcgtatgccggcgcagcctgagatagactcaacttctcctcgccctcaggtccgcgtacgccggcgcttcacctcgccctcgtccggccgccgccgcgagtcagctgggaggcgcgccgccgcaaccggagaggtgctaggccgtcctgccctaccgccgcgaccgggttcgcgtggaggcggccggccgccgggcctaacgacgcggtggtgcaggtgggtggctgcgcagcccgagcccggcgtgtggaggagaccgcgctgctcctgccacgccacacgtcccgatttcggcagcctcgactccacgatggatttcggcgtccgagcccgcatccagagcccgtacaggtcggctgcccacttcgtcgccggcgagaggtgacaccgccgcccggcttcgtccagggtaggagttattggcggttgagtttgtggagaacaccacaccttttcccatgcccgcgaggtgtttgtggaaatgccctgccacctgggatgatgcagagtcctaattggaagtgaattgttattgtttggctttgtgagattgggaaaatt

SEQ ID NO: 96022 - DNA, 1139 bp, Oryza sativa
ctttcctttcgccttgtaaccttctcctttacgaccttcttcggtggcattcgctctcagtggtttcgctcggaggtccacacggtcggcaccagctgttgtcgaaacgacaactgcatacgtcgaaagatgtggttactcaacagtggttgagaaaaagtaaagtgtattgattagagaatttttcttgggatccccccatacctggccctatgggactatttatagcccctattacaggttattactattagggttttggttatacaggggaatttacatggttacccttatgaaaggacatttacatgagtacatagtgtaatagaggttcatggactcctgatgggccgttaggcgatcgtcggcccaatggcccctaggcttgatgggccggaaaaggcttctttggccctcgcggggggagcttgctttggcgaagtcgtctcccttcggcatatactcttcgccctgcgtccttcgcccaagaggcctccggcttggcagagtacccacacgatccttcgcctctcgctgtacttgttccatagtgttcgccatgggggagggggcttcgccccgactaactttagcgtctcgggcttggattcccactcctcacatagcctttggcagattttggtcgaagggcctcataccataccgccaacagggagtaaggaaacaatcaagcctcatagtttgccctacaaaacaaatgaacaagagccaaaatttaaatttaaaacttaatcttgaagttaattctacggtatgttaacgcaatttcttcttgatatataaaaagctttaaacataaatttttttttctaataagccgtttttacttagaatcagctcgtagccaaccaatgatgccaaaaaaaatcaataaagacatgcaactacaaaattttagagcatgttttctcaggcttattttacctacttctatgtaagaaaaatgggggcctttgtactgtaacatgcagtcatcaaaacaaacagtgcaaatagtgaaacaggtttgtgataaactgataagagtagttaattttgattaagtgtgattttttggcaggaagggggctgccgacgtgtcaccggagcacggtggaccgggtctaatcaagttaatg

SEQ ID NO: 96023 - DNA, 676 bp, Oryza sativa
ctaagtttttatattttaagacggagagagtatcacactactagtatactactatgtcctaaaagaattaaaccctgagtctgaatctatatacacatttctattttaagatatgtgtctgatttaaatccaggtttaatttttttaaggacagataggtatgcttgtgctccatatacgtacacagtgcgttttggtcttgttggtagtgagtgtaaaatacgaagtgctcgtgagggaacaacggaagaacaggacgaaacggcactagtacccggagttgctataaatatagcgtcatatgctatagtcgatttttttttcagccacttacatagtagttacacctcatttacaccccacttacatatgtaattagtatgtaattttcgaatttacatatgtaattttagtacttacatatgtaattttgagacttacattgtaaatatattaaaattacatatgtaatttagtgacttacaatataaatacatgccgactattttttgataaaaaatatggcgtcataaatatagctacccctagtaccagcgtcgatctctgtaacttgggagatgattcgatcatgcgtctgtcgcgtggaccatggacaaattacgcgactattcgatcaggatcattttgcaaatcgcattgatcgcatggtcccaat

SEQ ID NO: 96024 - DNA, 740 bp, Oryza sativa
gccatgagagcgaacgtggagcattctttttctattcctttaataatataatagatgtctagtattcaacattaacaattaacgagtttcatttcatcaatataatttcacacattggttctcttctttataaattagaactcgatctatgctaaatcgtgcacgtggttatatgaatttaattttagttcttctcgattattaggtttgcccaagcttagaaaaattcctagatccgccactggccacccttcacacgccggcccgccttccacgcacagtgacagggcgccatcgaggcttggccttgccgtcgccatcccggatggccgcacggtgctccggtgacgcgctccggcggtggcgctaggtttctcctgagtcgcccgcgcgtggtcaccgggcctatgcccgcccgagccatttgtattgcactaggcagttattttagttttcttttcttcttcttcttctttttctttttttttgaggggattacgtgtgcttacgtcaagtcttcgtcacgaaatacacaaacggctcaatcattgagctttccgctcccctgtgacgacgcgccacgcatccttgcaagaaacgaaaagaaaagaagaaaaaaaatggaaagttcagaaatacactagatacgagtccaaaaactactagtaactggagcctctcaacgaactccccttaaatcttaattaagcagatcaatacccagctgcaaacattttccc

SEQ ID NO: 96025 - DNA, 543 bp, Oryza sativa
tttgtacttattggcatgaaccgattcaaaatggccgtagtcttccatctgtaggcgtgctgctggcagagtggccaggttaacatggactgtaattttgttttatgtccataaagctacatatctgatgaacgccaatgcaaacttgcaattgtcagattatgaactacatttatgctgaagacatgtaacatttttgctgaactgacattagtgcctggaccaagattgattttttttcatcagcatatatttttaatttcaatcactagtgagatataaaatacaacaaaaggatgtttcattgtcctccagaaaaagatatttaccgatataatttcctttgttttcttttccatattatacacaaatttttacgtgcactgatagttttttcccctttcttgcatgaataacaacggccgttgattacccttgatggtactgaagacggaggtatttcccatgttgtattacttgttaatctttaagttttgttaatgaaggtttattcaatttacttgttgatcttctagggtgaca

SEQ ID NO: 96026 - DNA, 688 bp, Oryza sativa
cttccggtcatgacaaaatatattggcgtgttgtaatattcaaggtatgaaaatttgagtatcagcatcttttaaaatattttgttcatagttgggtaatctgctcattatgagcttaatttgacatcatccgtaatctgtcacgctattccattattgctttctacccctttgtagaattataatagctgaacaaaaataccgttctctttaattaattttataaaacctatattttggccctatttttggtatggaggatttttcagagttgaatgtacctaccttatctttgaaacaacttaaatgtatctacctgcatagctgaccacccttaacatcctatgcaatacttcgcaaataattaaaaatgtgcttctttcaactaatatgtcaattttccaggcaaagataaatcaatatcccaatttcctgcttgaattaatgcaactatgcaaaagtaatgataataaaaaagaagaaacaaaaattcaagaaataccattgataatcacttaatttcaagaaatatcatcgacaagtacaggttctatgaaatgccattgtacaaacaattttgtttcagaaataccaccaatgtcaaggtttcaattcgttactagtcttccgttaagtgatataagatgaacagtgcatttaacgacacatgatcaatagaaccctaaca

SEQ ID NO: 96027 - DNA, 511 bp, Oryza sativa
gattggacctaccacgcgtacaccacgtaggacaaaactgctttggcttgagtcgagaggttcagggtgagcgatgtctggtttttcgggttcggggggggggggtaattcggtcaaccacgatagttcggggtggaggtaattcgtacttttttcctttttattatcatatatatactctctagagcaacacatgacttcatatggtcactataggctaatttggagattgggcaagttcttttttcttgttattagtcccccttatgcatggctacacacagcaaagaacatgttgctattttccagatacgaattcttcctgaatagtaaaagaacaagtacgatttaccccctgaactatcacggtcgatcgaattacccccccccccaaaccacaaaaccagatattttacaccctcaagtatttataccggataaataacccccctgagcattgttcttagaggtttacacttgaacttgtacacgtggcgccaacgtggcaatc

SEQ ID NO: 96028 - DNA, 793 bp, Oryza sativa
tcaacaagaaatagaagcaaagaaaccgcaattaaatctataaatgatagccgatcggctaggtgccaatgacacatcatttatctttgagctgatgtcatatgaatcgatcaacgattataaataaatagtaaggaactaaatctattcgatcggctgtagatattaacgatatatagttcttatattaatatatacttaaatcaagtgattgggataggtcggtcatcatgccgagacagtataaattacttagatcgaaatatatattaataacagcattatatatgtctatagcataaccgatcagatagatctagcgtgtatcggctaatactccgatactactctacatcaagatattaaaacatgtataatgtattaaacagaagcttaatatatttagattgcaacgatatcttgacacagagggcggatttaacatgtcagtgaaacatatagagcgaatatggttaaatcagataagatcggctgaaactccgatactaccctaatcggcaaccaaagtacaggctagagattgatattctaagcatgacttaatagatcaaactcaactgatgcagcattaagtatgaaaagaagaacaatatctagacaatcaagccgctggaagtttcatagtggtagatatcttatataatctaggtcaacgtcgctatttaaccaaatcggctgccttctgttaacagatgttagccgattgtaggttagatgacaatattgtcgaatattatgtaagatatatgataacttgacgaattacatagac

SEQ ID NO: 96029 - DNA, 524 bp, Oryza sativa
gtttctgcgagcctttcgacactacgaccgaacagaactgctgggaaatccatgacttgcaatgtggtgggtcttttttctgaaagcttatcgtatttattgtggaaattctgaaaactcttcatgtgaaattcctcacttggatggggtatgagatcaagtgtccctggcatgtaggtccaagccaagtatgcagaagaggtcactgtcggatggggtgaggagtggggaatgtttaatttaggtgttttttttctttttttgcagggttttttttctttttataaagactctcatttattgcctatatttactaataagataaaacggtttattagaaaaaaaaatagtttgtagttaacacttttatattcttaacgacttaaaagccataaaaggaataaatatttttaaaaacaacttctaagtttgaaaatttaatcttagtttcggatttggtttattagggtaaccgataaccaaaaaattctagattctgctataaagaattacatatgaaatgt

SEQ ID NO: 96030 - DNA, 577 bp, Oryza sativa
ccatgcatgtattcaaacattcgatgtgatggaattgttgaaagtttgaagggaactaaacactgccctaatggttaaaaatattgggtccaccagattgaatgaaaatcaatggttagatgtttttttctcagaatttttaataatttctttaatttatcatagtgccacgtggcatcttcggagcatttacagggtacacgtggcattatcatggtggtatgtttgtttagctatatttttttaaaataatgtcaataattaacctcactcattttcaaaagagagtattatatctatatcataaaaatttaagtagtaatgatcaacaccataaacaaactatgtctaaaaaactattttgatcacttccattttctctttatccttccctaaagggcatcaatcatggagcatatggctaagttaagttgaccccactggaggccatcatcgctaatagttatgtcatcatatgaattaacatgttggatctgttctattctatttggaccatacggggattatttagaccaaatatggctaacataattaaagtatcactcctatttaccac

SEQ ID NO: 96031 - DNA, 1330 bp, Oryza sativa
ttcatggttgactggatttagcggtgatctcgtatataactcataatcattctatgctgttctttttctatataaatacatgcgaggaaaattatgcattttacatccacatgccacggttgactctatcaacatggaagggggtgtgaaacaaactaccgtctgtaaagtttacatcaagataacataacatcatgtacggtgacagctattcttcagttaacaagttcctgatgggacaacatgcttgttaattaaattgatggagagatggtaaatataaataacaaggctattcctgatcaatcatgcacatcaccgtgccacaaattatgccattttcccttcatctgttccttttttcttctttcttgcttatgatacatgatagatgtgcttgcgtaagaaacaaaaaggtaaagtatcaaagagaactcattcgccaacatactaaaggattgccctttaaccaacgccatgcacacctcaacctgtattgcaactcatacagccttccatggctacaaagtactctagtctggtgctttttttttggcccaatttttaatacttgtggcaattaaatttcaactttagtagcaaaataagtttagtatatactaatcatgtaaatatgtaatgccatataggagtagttgcttttggcacaatctttatacttttttccctgagaaaatgagaatcatatacaatttttcaagtttaaaaatgatcatacatatatatctttgaatccattgcaatgcatgggtatttggctatttttgtgtagaatccgagaatccatacactaggtgttatgtaacacggtgctcataaaaacattttgtttatatgacattttggaaataagtatttactgccgcagatactcgtttgcgaacttttcacttaatgaaatgggtacaagtacaacacagtacctaatgtaataatctgtattgactaactctttgttttttcccctcgattatctgttattactatgctgtaaaagcaaacggctataattcaaatgaaatttacaatatttagaagcattttttttcaatttcataaagcagtgatacctattgaagtacattgccacaaacctgcaggatttccaggaaatctttttctataagaccttaagcttaaaggtcatagtctcattcctgatgtgttgctgaaagcaatagtaattgctaaaatattctgcagcatatcatattgtcctaaataagaacagctctgtcttgatataatctccgtgcagttgagggcatactttgttatgtgatccctcttttgcggttgaaattattca

SEQ ID NO: 96032 - DNA, 612 bp, Oryza sativa
tttttagaagttccgaacctttaaaaattggaccttgtagtttttagagtttattgtcttgttgggtttcattttttatagtttcagaagtcccgtcaaacgatgccactatacacctctatgacccttccgccgcctattctttattttcattgggattctaaaatcaaacataactatcgttggaatttattttttattttctaaaagtccgctaaccgtcggcggctctgcaactatactcctatacaccccgcacgctgcttctcctttttattctcattgagattttaaaaatcgaatatgtttatcaattggggttttttttactttttagaagccccggcaaccgtcttgctcatccctccttttaatcatcattaggattttatttggtgttttactaacaatttttatatatcgtattaactgccaccactattcctacttgaaatattttatttctttttctaatttattttttaattaataccgtatagtgttttttaatacttttattttttttattttttgaatttcagttgaactctcttttatttttttactaattttgaatattttttattctgaattttaattaatctcatattg

SEQ ID NO: 96033 - DNA, 684 bp, Oryza sativa
aaacaaatatgcatgttttgctaattacatggggtcagggttttacctatctgctcgcttgtgccatgtttacttgatatctgttctttgtcaaccttgggtaatgaatcgactagctcatgttacttatgtgacctagctagaactatatgcttagccatgcttaattaccactagctcagttgatgggataactgcagtattagacctttttagtatcagagtgagctgcgtgctcgagacacctggccatgcttcatggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacgggaacgtgtcgtggggctgtgtcttgtgggt

SEQ ID NO: 96034 - DNA, 872 bp, Oryza sativa
aaatggaatctggcatttataaatcatttaccctatgtccgcttcgactggtcccaattcaaataacaagtaattccaggaaaacctgcttgacctgtctttcgtctgaactgcaaccatcctcgatgctacttctctaagctgaactgttgacctggcctcaagggtgtacattagaattgaacctgttgacttgagattgggagactctgctagtggctcgcaacggactcctttaattactaaccaaattgctgcactgggttgaacattcaagtgaaatgccgacgaggtaaaccaaaactcatctctgagacctacccccttacagtgggtagtcttactttcgcctgactgagaacctttgaactgttgtccttgaaaaaaatgaccaacatttctcggatttacagatgccctgactttgaagactgaaacttcatcggtccatcaaattgaagcaatggcgatgcactttcatcccgacaagatttggaacttaagccttagttgatgataggaaattccacataaaagtgactctcatttagctcatggacacactgactcttgactgcaacacactactgctggagttctttccgctacacttgaccttgcatcgagctttgcatctcccgcatcaatacatccatcatctaatcttggacaccaaatgttgatcacgagcagggttcttctggcactgggataccttgtagctttcaactgaaccattgattggtgactttaattgatcttatctctgacactgaccatccgctgccaggacggaagagaggtggaagagaggggttgctaaagataaggtactaaaccacttgcctactgatatgttgtgagtagacttt

SEQ ID NO: 96035 - DNA, 1337 bp, Oryza sativa
ttctttttttccgcatgtagaaataaaatcccaaggcctataaaaatcactttttatagttattcacggaatgaattttaatttctcaagtggatatcctctcatttacctttttctttcaagttcaatgcaaatatttagttgtgaaaaattctgggaaaaaaatgtacttctattaaaatttattggtccaccaaaaatcaagctaggttaaattcgacctatatattagggaaaaaataaattcaggtataaacattacacaattattcatacgttgaatttgacattttgttatctcgatgtatgagttgatcagtttggatataagctctataaatgtgttggatgagtgttgtcaaagttttttagaatttcataaccgtttgaacagttttaaaacgtacaaacggacatccctcaagtgaatcaaaatagttttccagttatccacatgattgcacgattgtgctaacacatgcctcacttgctcgatccaattatcctcactgtacgtactagtgggcaacctgctagtccgtataaattaaaagcccacatgctatgctcactatactagtagaagaatacataagtatagctaaacaactgtgattaaacaggctttaaaacctagtagcttgtaccacaatgtactgctgatacattataatattttgcatgctttccatgtgcctttaatttgcaatttcgtgccaaccatatatatatatggccgttccaggcttccagcgacggtcctcctaggattatgggttctttgaaattatgtcaccgtcgtcgcttctcaaagaattatcacagcaaatcaagtaatataaaccacatggtatgaggtgatgaggtggaagatagaagttaagagagaatgatccacccctcgtgcaagggggatcgatgaggatccggcctataccataataatgacactaccaatacaatcactaatatatgggtcttatcatatgtcctattgccccacgtgtcagtacctataatgatagtataattatggtataggatgtgaattcatgtagggcaacatccacacaatctccaagaaaaatgaagatggtgtgggagtgaactaatatttgagtttgtgtattgcatatgatatattgtactttttatctcttaattaatttttagatgacatgcatggttttaaattagaggtggcattcaccttcactataaaacttgctctcagataagttggcatgagtcgcatgacataagcagcaggtgtgcagcaaattaactccaataacttactatcgatctcagaaaagtagaatatggttactttgtga

SEQ ID NO: 96036 - DNA, 1413 bp, Oryza sativa
cgcgccacccctcaaatacgcagtcctcgtcacaccacgcgcgagcagccggcggatggggacggcggcggcagcggtggaagcaacaacaacaatgggaagttgaaggggaaggagaaggtggtgccggagtacggcaagaaccggcacggcatgcctgtcggtttctacttcgtccccatggacctagagcttttcgccatcctcatgtgcaagctcgtccgaggtgaggtccccggcgccctcaataacgtctttgagcatatcaggatacttgaattccaccccgccctcctccgtggtacgcccgcttcgccgccaccgtcactctacccctctcttgttgtttccttcgtcattagtattttaaatagtgggataagacatttagcggttgggtttctcaaacagcaatacctatagtgggttaaatggagttattacagttaaattatacataaaagcaaatagttggacccttcttttaacatttataaccgaagaatagcagcagctataactgaggatttaaaaccatgttcatcattgtcttcttcttctccggcgatggcgtgtgcagagacgtatatcgagaacatggaggacagatgcatctacttctttagcaggaggctattcgcagcgaaggctaggaacaagaggcagccgatgagggtggcaaacggtgggacgtggaaggcatctggtgggagcaagacggtgaggagcaagaaggttggcggcatcgatgttggtcagaagctcccatggtgttctacgagcgtaggttcgagggcgaccaaaaccctgtcaagaccaactgggccatgcacgagtacaccaagatcattcctagctccaaaaaccaggtagtacttggtaatttatatttaaattcaaatcagtccgcaaatacattacattacgatctatatctaaatagggtgtagctatatttatggcgtcatactttttataaaaaaatagtcggcatgtatttatattgtaagttcataaattacatatgtaattttagtgtatttacaatgtaagtctcaaaattacatatgtaagtactaaaattacatatgtaaattcgaaaattacatactaattgcatatgtaagtggggtgtaaatgaggtgtaactactgtgtaagtggctgaaaaaaatcgactatatttctagcaactccgtctaaatattgtgttttgtcttgtaattaacattccattatacggcctccattacatattataagtcgatttgactttttcatagttaaacttcaagtttatagacaaatataataacatctaaaacatcaaactagtttcattaaatctaacattaaatatattttgataatatatatatttttgaaatactaccatattttttctataaattta

SEQ ID NO: 96037 - DNA, 653 bp, Oryza sativa
tatcctcctctgcggctttcataaaacttaatacgccatctctatactccttgtactaacgcctcaagccagtcgtgtacatccaacttcgatccatcgctgaacaatgaacaaaatattagttaacatctcataacataagtactactaaattaataggaaatgtttagtgcccttttacttacttttatgattttcctgtttttgtttgcaaaaaaattacaaaaattcgcccccttcaacctcccaccaaaatagtgaacagtgggataaactacagacaatggactgctggagtatatatagtgtgcaaagtatatctcaatcgggccaaaaaaatatcatctctaacggacgcacactaatctctaacgggcacaaatagaagcccgacacctataagagtcatcggtgatgggcattaaggccatctcaatcgggccttctttggagcccgtcacctatgacactcatctgtgacgggctcagtatttaggcctgattgagatagtggaggtcatctcaatcgggcctaacttcgagcccgtcacagatgaatgtcatcggtgacgggctataggaatatgcaccccgacgagtacatctacaacggcaaaatttaggcctgattgagatgacttcgttctgacggc

SEQ ID NO: 96038 - DNA, 920 bp, Oryza sativa
agcgcctttgaccataaatgctactcggtaccgtttttactagtttttttttatttaatctgctatcatgttttctatagtatggtttccaatctattaagcgatatgttttgtgcggaaactttcttatatagattttttcaaaaaaaataatcaaataaattcatcttctaagttagttaatatctttccgacaaaaaaccgttggttaatcactcgctaataatccgtctcattttacactctcctataagttcttcgcattttgtttgttcaacaaattagaaactagagggactttttcaaaacaacgtatttatcatagtagcaaatatcataatagcaaacaaaaaggcaaaaggacacaaaaatgatggtcttgttatattttatctagtttgggccatcaacatgctccgtattgttttgtgccgaggttaagcgaggttaagcgctacatgccaaaacccatattgttttgtgcaactttacagcacaatacctagggtctgtttgtgggagttttaatattctgagaagcagctggttggtagccgacagcttctgagaatttggaaaagctaatttctggttggtagccgccagcttccgagaatttagaaaagctaggtttcccagcttatgttttatagttcattttttagaatttacacctacatcttcttaaaacgtggaacaaaactgaactgtttggggagcttctgattttaggagaagctaacctggaacaaaagataaactgattggggagcttctgattttaggagaagctacagtagctagaagctataggcctctatgctacctacctttggaggtggaggttaggagcttcacctccctaatccgagaagctgcaatagctagaagctataggtctacctttggaggtggaggtt

SEQ ID NO: 96039 - DNA, 936 bp, Oryza sativa
gtcctccttggtcaaagcgtaaaggtccaggatgagaaaacagcagatcctctgaagtcattgacatgtgagtcccactttactatggtccacatatcagtgacttaactgcacagcagttaaatcagaggatcccttagaaaacaggaaaaaggagaggagaggatcagtttgcatgtagacaaccgtacttactttatattaaatcgctttcacttttttactacgtcaaagtttattaaccaaacctatagaaaaagttaacaacatttaaaatattaaattgattttattaaatctagtattgagtatattttgataacatgtttattttatgtttaaagtactactatatttttgaataaatttaataaagctgaaacaaatttagcgacatgtaatacaggtatacagagcacggagcagtaggagctggtggcatccatcagcgacggaggcagtgcagcaaacacgccgacaaccgtgcaggggggcatcaccacgtgccaagatccaaaatgtagcgagacgatcaaccgaaccatcgtgaataagcgaaactttatatttacaaataaaaagtaatttatgaataaaacttttatataattgtttttagctatctaaaaacaaaagctaaaaaataaagtttgataaaaaaaactttaaaatcagcttcaaatttaaaagtttaaattttaaattttagctgataagtccacgaaactctcttcggcgggacctccgtcaccactcaccagcaaaagcaggggacgcgccgtagcatatcaatctgcacttccgcatgcaggctgttataggatgtatgcgttcttgagcaaatggtaagttgtgaatacagaaatcgttaaaggagaggccccatcggttgcccactttttattataagccataacggcttattagcgattaaaa

SEQ ID NO: 96040 - DNA, 673 bp, Oryza sativa
ttcctgcagcccctgtagcaaattttgcctttgttttttcctttcatcttattcaccaagtagatcgaaaataatttaatcttttaaaaggctggaacacagtcaaattatcctataaaatattttgctacaacgtataaaacaacggttccgaatatattgaaacatgaaacaaatccgagtacatcagaaaaagtctatatgagattttgaagccaagaaaatcaaaaaagtttcaatctttttaaaagttgaaatacaatcaacaccttatgaaatattttgctaccacgtataaaacaacggttccaaatatattgaaacatgaaacaaatccgagtacatttagaaaaagtctatatgagattttgaagccaatcggatgctgtttcaccaagaaaatcgaaaaagtttcaatctttttaaaagttgaaatacaatcaacacctcatgaaatattttgctaccacgtataaaacaacggttctgaatatattgaaacatgaatgatgtagctatcaaaaatcattcgatagccatttagccttcccgttacaaatttgcctattcacataaatgtcattacctccttccttttttatcttcttccttctcactccccatcttcttcttgtcttgaccacgctgcccgacacgtggatgcgagcaaaga

SEQ ID NO: 96041 - DNA, 1448 bp, Oryza sativa
tgcagtttcgcgactcggtaaggagcataatagcaccctttcaaaccaaattcttgtggcaatgattaagagaataccttcaaaccacgggtaaagccaaagttctgcgttttgctctgaaatttatgtgtggcccccgatatatgttccaatcaggttgtgtgactatcacctgaacttttttgttgtactattaggagtcccccttttttttttttgaaaacttattaggagtctgacctctgttagcgtcaggcttcctcactggattgtactgtaatgttttgtttctccaccaactctggattagtttgttttccactacctaacatgaaaattgttcataggaattttggcatgaactttccactttccatctcacccttaaaaggcttgcaatagcatccttcttatgcgcgttctaaatagattattctcggatggaagctgatgaattatctacttaactgtatggaagaggcaaatcatcacggcaataatccagtggataaccaaccataaaagataagggctgaaaatgatttacatctagcatctcaagcttacattgcccctctgaaagttcaccttgcaatgttcaaatttggccgtttgaagagtacaataatgctactgcttttctaacagatcgtgcagttttcttctggtccttgtccgtcctgtagaaatgtgccgtccccggctaaactgacatttcaaatgcaatacttaatcaaagcatctcaatccaactatccaatacaagaccggcatctcagtttccccaagatattggagataagcatctctgactctagtaatctatcaagatcacaagaataacgaaaacatgtactctttataccattgctgggagattgaggagaaaacacttcgttttccgcgcgcatgcttcccaaactactaaatgatgtgttttctataggaaagttattttaaaaaatcatattaatccatttttaaaattaaaatagttaatacttaactaattatacgctaatggctcacctcgttttatatatctcttcaatctcagctgttacaagctgtttgggtcccgtgagaaacaaaaccacatggattgctcaaaacaaagtggttgaataaatatagtaaatttttatgtattgctttagacatagagaaaagataaaacatacatcagaacatccagaggatttagatcacctgtcagaattctaccaaaatatagaaaaaaaatttctctaccataaaatttcaccatcttacactcgtaaagcctcgcgtagtgatttttgttttttgataatgaatatgattatgccacttttcataataaactttcaagaagccttttaacaagtgtatatttagacaaacgattcaattaacttgggtgaaggataccaggagctgatctaagcatcaagctaaaaagatgggtt

SEQ ID NO: 96042 - DNA, 2402 bp, Oryza sativa
ggcaatggagcggttcgcgtcggagatggagaagctgtacacgcggcccaactaatccatccttaagtgggcctggcccatttaggaccacaaggaattcggatcgccaattggcccataatagttcagacatgggtccacgaagcaagagagttttgtacaccttaagtaccgacgaagcacctagtatgtacgaggttcaaatagttgtatacaaattccacaaaatttgagaagctatatagattgtaatgatacaagtcaatccacaaacaagcaaatataaattcatcgacacaatggagaagctgtacactcggcccaactaggcccatctggttctcgcgaagagggcctggcacagaaaggttgagatttggactttcaactaggagaaagctgttcaacctgctgttgctccttgcaatatttgaaggtattgtgtctatgaattacctgtacctaaaagcatccttgtgcttcatttagttaaatctgggatctgatcacttaatacctagtaattgaaggtgaggtggtacaccttttttttttcttttttttacttttgggtatcaatggttcctgcttgtcataccaattcagtcttttccaggaataatgagttaacgacaattaacaatgatttatatctcgtttcccattataacctcggtgtgaagcattgtttactgagtcatcctatggaattcgtcctacaagaatcctttgctatgaattattctgaaatgttgcagcaagatcctgagataaatttgctaatcaagtggtaaagatgataaaagcaaatatgcgactataacaaggatgatgcctttgaggttgatttcaataactactccctctgtccctaaatatttacgacgttgactattttaaacatgtttgactgttcgtcttattcaaaaaatttaagtaattattaattcttttcctatcatttgatttattgttaaatatacttttatgtatacatatagttttacatatttcacaacatgtttaaaaaagtcaacggcttcaaatatttagggacgaagggagtacatcatagaagcatttgttttttaaaaaatgtataatacagtgatgaatattgtttttggaatgaacttaaatactgtaacatacatcaatacatttttttcaatcacataattaagttttttttgggtatatattcatggtatttcttctttgacataagttgcagttactacttcctcatcggagcagctaacacaggcatatgcacttgagcggctgtgccaatcgaggaagaagatcggtgtccgcctattgaatttcacatcactatttcacaatacctctgctggatgtctttggttcttaaaagagcccacagtcagaaacatccagggatcttccggctagctttacaaggtggtagggtagatgacctgggtaccccttctaattatttgatactagtttattccctaatattcgtgttttttaaaagagccctacaattttggagatatccgtgagattgacattcacgatttagtttttttttttcataattgagtgcactcttgaaatctagtctcatattagggactagaatgcattgcgcaatagatcacccacataggattgacagaacatgcaggccagaagatttggagttatcagtaagaaaaatctgaacatgagactctggcattatacttctgtatgattactgctgatgcagcccaaaataaccgaattttctgttcctcctacttatttgatctttgtatattttttctgttactactatggcaagattgtaatgttgcaggtagacattatcttttgccatgttgtgtatgatgcaattgagataaatagatattcaaattgcgttaacaattttgtctgcataggaatttgcacggtgcacggtcccaaaagaacacaaagggtagcatttttctcaatttcatagaaattttaggggcaattattttcttctctttaaagccaaaggcaaaaatgttcccttcttccgatggtgaaaccgggaatgcgtaatgtattctttccctactaattattactaaaattttatcattttgtttgaaatcttttttttacctctaagtgaagaaaagtttttagttgggcttgtatcctgatgatctaataactgttattttagtttttccgttgtaacgcatgggtatcctcctagtaatttctaaaaatacttgtcttagaaatatggagatcatatgtataggttagtattaagaaaaatgtttgagcgtaccaatcatatagtagaaaatagtggttaaagttattttttgaagagtgcatctttatccaaaacaataattgttatcaaactggaggagtatatgccgtta

SEQ ID NO: 96043 - DNA, 696 bp, Oryza sativa
agcatggtacgagattaatatatgaattcgcttagtcgagatgaaatggtttttagatctcgtgacaatgttgtgttatgtccgttcaggcatatttatatgcaaattcaatggttttagaaacttaaggtgttcaagaaaaagaaagagagacttaacatctgtcgataatccaactcatgtcaaaagttaattacaaaatcacatactaagataacgaaatgaagcacgagtacatctataaatctatatctgaaccccctccccgcatcccctggcacaaaaattaaaaagcgagaaaagtaattgcaagaaaaatgttaaagaaagaagaaagaacacatcggtaaaataatattattctcagccagtactgtgtttgattgaatctaaatatcaaatccttaaacacaaatcatttgcaaattaatagtgtcatatgagattatgacaatgctattattacaagtaatcaccaatggctataatgttcactcaaggaaacaggtgagatctgcaatagctctaagggcatgagtattgtagtattaagcagtcgataagcaataaatactttttttctatccaacggtaaccattgtgatagcatgtaacaacaactaccaagcatttatgctaccgtccgtaggaaggaattaaaatacattatttatacagtgttttcagacacatgca

SEQ ID NO: 96044 - DNA, 1611 bp, Oryza sativa
tcatattaatctattttaaaatttttgtaattaatacctaattaattaaacataaataaacaccgtgttttcggcggagttctaaactccacctccaaacatagcgttaagctgtgctcagaaagaggggttgggaaccctcctctccagctcgcattagcacatgattaattaaacattaattaaaataaacttaaaagatggatcaatatgaattttaaaacaacttttttatagaaaacttttataaaacacacctccagtagtttggaaaatgtgtgcgtgaaaaacgagaaatatgagttaggaaagaggggaagaacacagcctaaattaagaaagatgagttgggaaaaggaattatattttacttcccccaaattctttggatcatgtaacacctaaattatttttttactcgttgtacttcctaaactattaaaattgattcattttactgcttacttttttttctctttatactggtcgtattttaagctaaaattttgtagatccatagatgacactattattccaaaatatttttcatgattatttgcttaaaatttaaaatctcgatgttaaattagtctcatggtttccaacctactaccttcgtctcatatttacacgtcattttgactttttttctaagttaaaattttctttagttttgatcaaattttagaataatatatatagcaatatttttcaacataaaaaaactatcaaaatatattcaatgctatatttaaccgaactaatttggtgcaataaatattgctatatttttttataaacttggtcaaaagtttgactttgaaaaagtcaaagcaacttataatatgaaacggcgggagtatgtaaatagtgatagaacaatttaaaagtgttgagagataaataatgcatctatcaatcctacccaaatccattgcaaggtacacaattccagagcaagatacaatctatagagagaaaaagaaaagagaaatgccattagagagtaagcttaccccttttttttaataattcaaggtttaaaatgagacaagagatagtttaagggttcaagtgctatgcaacttccttcgttaagtacaattattttttaaataatttttttacaaataaatattgaactggggaatttccaacaaagagctggagtagctcagttggttagagcgtgtggctgttaaccacaaggtcggaggttcaagccctccctctagcgcatttatttgatttgaattttttcttccgccacttatttgccacttgagttgaatttgatatgaaccgttttttcttccgccacttatttgccacttgtttttcttccgccactttatttgccacttgagttgaatttgatatgaaccgccacttatttgatagaatttttttcctgccacttgagttgaatttgatatgaactttttcttccgcttatttgatagaattttattttcctgacacttgagttgaatttgatatgaactttttcttccgccacttatttgatagaattcttttttcctgccacttgagttgaatttgatatttttctcctgtcacttgagttaaatttgatcttttttttcctcg

SEQ ID NO: 96045 - DNA, 1194 bp, Oryza sativa
ggcgccagcatggctggcgcgcccctcctctgtgggccgacccttaaaccccgtgggccccaccacctttctcctccccactcccattttcgccaagtcccagcccgagcagcagcgcaggagttcttcccctctctctccccctcacctctccacctcaaatccactcaatttgaagccgtttttcgcaggattttttgtggaaatcgaagagaaaggtagactccttcattcccccctcttttttttcgtttttattggttgaatttgtagatcggtgggtaaccctagaaccccttttttacccaaatttatgatttttagcatttgttcttaggattggcttgttgtagtgctacatgtttgcaatgtactcattggtgtcatgatttttttaaccatatatgtggtaatgttaatttttggatggtttggttggatggatggatgaaaaattatggttgaggcatgacggaggtttgggttgtatgacggagtatttgtaatatttcgatgtgtaatgcactagtaaacttattgatagttgtaggtggattaaatatttttttggagtagtagctttgggacaatttaagttatgcattggttataatatgtcggtttggacttcgtttaggaatgaagatttaatttttgttgcaaagttacatttgattttttggtgtagatggatagacttgttcatgtttactacggtggtagagtggtggaaccttatgttggtgcacatgttgagtttgaggatatgtcattgaagaccattttgtttcccacccacccaactctagatgaactaaggtcacgagtgaaagaagttcttggatggaccgaggataatgtggagattcgtttttatgggagatacgatgttggtcaagggcataagtatatattaaatgtgataggtcagttggaatgggaagtttactttgatttggtaaaagagtctcagtttagatctctagaggtgtttgcatcaaagttagttcgtaccgtagaaaatttggatctaaacaaatctccttcttatcattacgttgagaagaattttgtgacatattattctcgtcgtggagggagtgcaagtaagactgagttggtacgggaagacttggagggggaaggagagaagaagagacctttgcttggaaatgatttatgggaggcaggacc

SEQ ID NO: 96046 - DNA, 2263 bp, Oryza sativa
  unsure (1)..(2263): unsure at all n locations
acgacattctagatgaaagggagagggtttagataccgaccggttgaggagttcgtggaggaagaggcgccggacatcgtcgttttcgtcgcggcttgacgtggatgcggcgccggtgaggtcgacggtgatgacggctgcggcagtggtggtcgtagacgtcccggcgatgaggcgtggcgcggaggtggcgtttcccgtcactggctgcgccccctctcgatcggattagggttttgtggggtggagtnngcngnngaagnnaacttcgtacgttgtgccgtgccggcctccacccctcttttatatggcgcagtgtgacgatggcccaccagccattgggctgggcgcccccgatcagggcgcggtcaaggcccccttgagccattgggctcaaggggagggagatctatctaacagtgggaattaagcacctgcctgcacagttgacaaaattgtaaaccttttgtattggctcggtgacatggtgcaagttcagttaagcaaagttgagaatctctatggagcattcgtgaaatttcggtattcaaaactcccaagactttgtgcctggaaattttttttggatctatttgaatttagttaaaaatcattaaacccattaagaaaccgctcaagatcgaatccaataaaatattgaatttgttggtctatataaactttatttttacgaaatgcaattatatacgctagaccctagttaggtcatgttcttcgatgcatcttcccatctctacttcctcgtttttcgcgcgcaaaaagttgttttaaaatgacatattaatccattttttttaaaaaaagtataatatacttaattactcatacgagtcgctctgttttacgtgcagagatgaattcttatcgctggagccgaacacaactttagtgcggaaacaatctttgtctgcgacttacaccacatactcgaaaagtgagaaggttccttatctctattgacgaagattgtgggggaggagttttcacgttgggaaagcgagagcagatgacatggttcttcctcgatcgtcggatggttttggcatcatgatccaacggtcaaatctcttgatgtgtgtgaattgtgatgaatgagcattggcgacaaatggacacatgcatggtagaaccatccatccatgaagttggataattgctacttgaaagagaggaaatattcggcgtattcaaattaattttaagtcaataatatcaaacttagtctctttatcccaaactagggcctatctgaaacatgttattgtagaggattatctagctaattgatcgtaggggtcattatccaaaaaaatgatcatagctaggggtaaattaagtaagtttttttaaaaaagaaacttagcaaataccttacaatgagtggtctaaacaatgtggtaaagaaatgtttccaagaaaacatatttctacttattataaaaattaaagatgttttgcctggtattttggtaaatcatccgtgtttgagtcggtttttaattaatatcatccgcttttagaaatacaaattcatatttgaattggattttaagctcgtttgcttttggaaatacaaaaggagtcgtacaagaaatctcttttaaaaaactccgcatgctaacttgagatgaaaatcgaactcctaattgcaccttatgattttctaaaaaaaaatccaagcggattctcactatgaattttaccctagttaaaccgtacatactaacaataataagattaaaataacgttcacccattgcaacacacggatatttttccagtttacatagacgtgaagcaaataatctaggataataattcagtgaagtacgttagtacatcaccaacagggaagggcattgccgttggcaaagaccgtcaaactgagtgcaaaagctaccatgtcatctcgccatctaattctaggctacataatgttaaatttattttattaaaaatatttagtttatcactataatcgagcggataatccacgacaataatccggtcaataatctgaaccaagctgggcaaaattatttctccgttattgaatccttctagtttaagtcagttaataacaacagaagatttttcagaaggtccagatcagcacggtgaagataagggtgactagctagctagctagttggctgcaacaatcaacaaaggcagcaggaagaagctagctagctgcttcaaaagtccaaaagagtttttgctgaaatccctagattcccat

SEQ ID NO: 96047 - DNA, 1638 bp, Oryza sativa
gcgcgagaccgcacggtatcgcgtgatcatagcacgataccgtgcggtctcgcacgacgaaaaaacgataccgaacgacgaaatcgaggacgtactacgtggtggcggcatcagaccacgcggtctcgcgcggccaaaccgcgagaccgagcagtctggctcagtcagtgagcgatagcgactgcctctaccgattgaataaggttaattagtgattaattaatcgataattagaataattaatcactaattattattaattaatcattaattaggataattaatgactaattaagtagctccgttggacatgacattcggtctcgctgattccttacgcgagactgttcggtcttgctgcttcatcacgcgataccgcgtggtctcccgctcctaccgcgcgacaccggtatattttcgctaaaaagtgtatatcacgaatattttcacgaaaaaaccaaatcaatagtatatttttaaatttaattcgctctttttatcactagctaatagccaggattacacaagaggcatgtggcataaaagtgcacttgaccagcaaaaatgtagtgttcaaaactaaaaaaaatcatgtgtacttattggcagattaattttttttactatgtatatatatagatcaaagcgctctctcctataatattattggcaataacatattttgacaaagtattgatgataaaagcctttggggaaatttgcaagatagatttgcatgcatggtatatatatacctgtgacaacgttataaaagtaagaaattattcttgcattctagaaaaaacaatgtgtacacattaggaacttgacggcagtagtttatattattattgcagtatatatgccaatcaatgcaacatgccatcttttatgaccagaggaaccaagccaggaaataaaagcatagctagtggatacccgcagctttgctatgggattttataaatctttctaatcaaaacaactaaaaacaacattgaactaaaggcgataaaatactcaatatatgcatgttaagccacaactaatatagaacaattagcatacgtaataaatttatagttatgcttaagcatagaaataatctaacgaccgtgattaagaatgatagtgatccagcggtccttttttttttgttgacgacgtgactcaccgcatgttaagcgtaattgggtctaactatataactagtagacatgggcatttttatgtcatcttccggaggtagctcggtgacgtcacatattattttctattatgtggaagcaagaaacgcgagaaggttagtgggcgaacattcacccactacctatctcgcgaatcggtcggaacgaagaggatgaaagatgtgccacggaggagaagggggaactcatgggggagcgatattgttcttccctttccaattttcggttttcctctttttatgtggtcctttatctttttctttttttcactacctttttctttttcagatttctttttttaactcttttcattgtttctttaacataaacatttttatatgaattatttcatgaaaacttaattcctagatatacatatagattttatgtatgtaaagtttctatatgtagactttatgtatataaactt

SEQ ID NO: 96048 - DNA, 539 bp, Oryza sativa
  unsure (1)..(539): unsure at all n locations
atggattactagtagcttgaaaattgtttacttgcccgttcgatagtaaacaattttttgcgcaacttacagccttattatatcaaaatattttcatctttctgtcaaaataatatatatttcatctgagatgttggtggcctgattgaacttatttctacaattccactcgactacgattctaaaaaacgttaacttttctttttagaccaatactatactacgggttggtttggtttgtggcctaaatagaccttaccaaattttgtcaatgccaaatttaggcannntnacgtagagaggaggtggaaaannnncnncncnnccccccccntcccttcctctctcaaacttcctcctaccttcacttctcaccacacctcatcacttcctttacaatctttcattctcaaaatcaatacatatgcagttacagaagttaataggaccaaatggtaggtcctatataaggataacgttcaaaatattataagcccttgcgtaccatgtcataatatcaattgaaactttgaaaagga

SEQ ID NO: 96049 - DNA, 1286 bp, Oryza sativa
gaatccgcatccggcgagatcagagacaacactatatctctcctgacagtagccataggcaccgtaggggagtagccatgcctatctctaaagtcgatatccggcgtcttgtcttggcgtatgttcgcttgtatgttgtggcttctgttgttccgtgtcccttctcctcctagggggccttgtatttatacccataggtatccccttgtccaagtagaattagagaaaccaatatggatacaatccgagtagtccttttcgtttctacgtagaactctattcatccttccttatgcggaactcctcctatatccgaaggttgttttcgtataagacatggtatgtggtgggtcctaccgagatttagtcaactactattaggtatgtggtatccataaccctgacaaataggacaataggttttcatcaaagtctcgcttgggaaacatattagttttttttattgattttagacaattatattaagtgatactctttctgtctcaaaataagtacaattttgtactattcatattcaacgtttgaccgttcatcttatttgatttttttataattagtatttttttgttattagatgttaaaatatgaatagtactttattgctattagatgataaaatgtaagattttaataagaatataagtgcaacgtaagtactccatccgtcctaaaatataaaaactttttaccttctagaatttgactcaaaatataacttctcttcccaaagaatcataaccttccatcattcaatttttccacctatcttcaatttcaaactatataattataactttttcttatttaattctacctattttcttaatacccgtgtctacattcttgtatttagagatggaggtagtagaagattataaatataagaaaacgtaagaatgattgtttgaatataccacgggagaaaaatgttgaaatcggttgagcgagatagactcaataaaattttgcaagaggttgaatctcgtactaacttttctctaaaatatctatattgtccattcaataagaattacaaaataaaaagatataattcaatcatttatttcaaaagccatcctagtatttttcttcttatagaattgaaatgccccaagttttctatatgtttcttacaaattgtgtgtgtgtggggggggggggggcattatttcctactccagatcgtactatatccatacctaagctgtcggcaacgatggttgctaatgccggctgtcggaggattttaattgtctagaaaaggg

SEQ ID NO: 96050 - DNA, 677 bp, Oryza sativa
tcggccctagagaaaactaagaatctatatttatgtgagaattgggtgtgaaacaccggtggagttaattcaggtgtatatataagaaggtgttcataatctcaatgtatcggaattttggttttttgggggtccactgctactggcctagtaatataatctccgcagcacacacagtctgtacgtagtatggcgtcgcacctcatggcaccgcgagtctctgttggcatccatgttacttcctcgcagcaaagctcacagatgattaaattgttggtaagttatgggatccgagggtctcgagcatgagcaaattctctcggcgcgcacatggacacatcacacatggttggtgtcctctacagaaagacccattttgtcttctatcgaaagacccattttcactttatgtctgtattgggtagaatctcccacttgttagggcgaagctaccatgaagctaagagctagcagaacgaagaaactgactatgttggtcatctaggcatatgacttcaacactcataaaaaagtgctcacatgtactccatccgtcccataatataagagattttggtgggatgtgacacattttagtactacgaatctggacagagagcttgttcagattcttaatactaggatatgtccacaaaaatcccttatattataggaca

SEQ ID NO: 96051 - DNA, 764 bp, Oryza sativa
ttctcgggctccataggtgcgccggcggaagatgcgggagtgattccgaacgactccgacggagaaaaaaagggaaaagagggggaaacgggagagggaatcacggggagtgattcgcccctctttatggcgcgcggggaaagcgggatgcggcggattcggcggcggcggcggcgctagggcacgggcggcggcgggcgcggcgcggggttggggatgacaggtgggccccacccgtcagcgagggcggcgggcgggcccgcctgtcagcggcgcgcgcgcggggagtagccgatgggacgcgggggaagagagagagagggagggactgggccgaggggaaggggcccaagaggagggagagaaggagggggagagaaagagagggaggagagggagactttgggctgggcttggcccaaaggaggaagaggatttatttttttaggttttcctttttagtaaactttgataattgtttttgttgcttaataattatttccggtgctctgaaaattcaagtaaaatttgagggctccttttagaccaaggagaatttaacaaaaattctccgggccacattcgaatttttcttatacgtactttagtgtttgccaatttcttttcgaattttaattaattctattattccttttagaaaatgaattttattttggaatgaatttatcaggacgtgacaaatccaccccccttacaggaatctcgtccccgagattcgaggaggctagcaagaagataggttg

SEQ ID NO: 96052 - DNA, 698 bp, Oryza sativa
ctcgatccaatggtaatttctaagtttccactatatatgtggtttgtactatatattttcccaatcaaccccttggtcctcaccgcgaaacctctgtaaaaaaatacaactagtattttgttcaactcgcctgtgtaaacacatagtactacctctgtcaaaaaaaaaaacaccaatctagatggaagtgtgataccacctgagattatccggttcattataggtgatgtcacatttttatttagatttgttttttatcggaacggaggaagtagtaacatttacaactatgctaagctttatgattaccactaatgatgatatgatgtatctacctatttatattttctataataaagttatagtccgctaaatttacaactcaacgcgcaacaataacacatcatcactcactatcaataattacatatttaacataatgcaagcatacttcatctacaatttatttaattctataaatcaacatgtaaccatatccaattggggatccattacatcgatctgcacagtatgcaaacaaacctatgtatcatttttataatatttaaattatacttatcaatatgtttcacattaaagtgcgggtatcatttgtttgttgcatgataagtactgataaaccagaatttcattttttttcattgtaactcctatatgcattgtctcaaaatatatat

SEQ ID NO: 96053 - DNA, 512 bp, Oryza sativa
tcctgctatcccagtaagtttcttttatcataacaagcattcaaatcggcaataatcgttaaacctctaatctgcttctaaattgtcactgcaagtgttagctgatcttttctcttttgacatcagagactatcttgatgaagaagaagaagataccacaagcaaagccttggctcctttatctgatgatgtgaaaaaaactctaggaagcattttagatcggctagaagcatcatcgctagacagcttggtggttgattgtggctcaattagggctcggctacacaagattcaggctttaatcccagatgagttagccgatatccttactccagccgtttaccttgagcaacaccaattcaaactgcagaaagccaagttaagactagccgaacggcgagaacgtaaggacattgaggccactatccaagctagccgacaacttgtacatgaagagaagtccaagcttgatcaattatataaagggcccaatcaagtctaacattgatcgg

SEQ ID NO: 96054 - DNA, 1069 bp, Oryza sativa
cgcattggtggaggcgcaaagaatgtgcttttaggacatgtatagctccagcatttgctttctgcaatgattggcactttttcttcaatggctatctattagtcttcatttatcaatgttttccaagttctgcaacaaggaaaataaagaattttatgtttgcaaagattagcactctcttttcaatggctttgtggcaatcctcatttcccacagttgccatgccattcaacaaggaaaataaaggcgcattcatgaccttcactactcatttggttctcaaactgtaaaatttcctttacatatctattactccatgtatttcaagctttgcttgagcatatgtccattatgaacgctaaatatcacaaagggatatgattaatattagctactgataaatatgtactaacacaaaaaaatatcaaactgggtatattctaatttcatttattttgggtggttaacatggatattctgtaaccaaatgtcaactagttcgcttaggactcacaaattttactaaaaatgttgtaccgaaacagcatcctattctcgagttccatttatgttccaagattaacaggcatcacgggttgtaaattgcattgcggtcaatctatggacacgactgatcatgcgctggtacactagcatatgcaaataaaaccttacgaatggcaaagtatccaaataaatgatcaaaatgttgctttgagaatattgaacgacacagcatgacagtttaaaaactgtcatgctaataaacagaacaattcaaggtgaaagaggtacaagcaagagaaactgaccttagtccaccctctgtgctgttccaattctcaatcggaagatgtctgctatacgtaacagacaccataaaaggttgaaaagatcaacaaccttgatgtgcttacgttgaggtctgcaattgaaacttctcaacagttcatgggtcatgaattcctttgtccatggtgacaaaacaccaactctacatcagcatctcacctgaagaactcatagattttcttttgatcatatacattacatcactaatttcttttat

SEQ ID NO: 96055 - DNA, 550 bp, Oryza sativa
taattttttgcaggcaaccaacgtaagaggtccacctgcaaaaataaagtggtccgcctgcgaaaattgattttttgcatgcagatagcgcgtttcaccagtttacatttttatatgcggccatttggctccgatgaccaaacttgcctgtgaaaaatatactcaacatcggtaaaaatgttttttctagtagtgaattataatgtttacatagctagtatagaatatagaatcaaccaaaaatcaaacatgcccagttagctagcttcacacactctcgcctgtcacccgagttggtggttcgaagccccctcagagccaaaaaaaaaaattctcatgcccttgcaagaatctcactacaatccgatggttcacaaattgaaagttctagagtcaacattattttttagcaaatctggttttcaaatggccgcaattcataatctcttctcccaaaagaaaaggtattgataatatctcatctatctttttttagaagatcaatctctcataagtcatcctttttggggggcgatttgtcatctattaa

SEQ ID NO: 96056 - DNA, 517 bp, Oryza sativa
tttgttgatttgtatgtgaatttgttgatttgcaggtgatgtctgtggatcaataaatttgtagaagcctgggcggtgttggtgaagctggtgcgctgacctcgtggggcgattcaagatacatcgccgcgccatgtactgcctctatccctttctgtccccttaggctccctcttcccgatctcatcagcattcggctgtagtgtctccctaatctctcttctcggttcaaagagcaaggcatggcggtgcctctttggtggtgaaggaagaagatggcaccgttgctctaacctacacacggcgttgacttgccctggcaggagctcactggtaggcgtctgcaataaggcggctgtcggtacatcttggcacctagcgcctaccactccgatgctgcgggcgtcccgtgccatgaccacaaatgtgatgccacaaccacagggacattaggcccaagctccccgcacgacatgctttctcctccctctcccgggccaggccatcctcccctctt

SEQ ID NO: 96057 - DNA, 616 bp, Oryza sativa
cggcatcatacattaaaatagtcatacattaaaatacgcaaggagtacaaaactaactacaaaaagtgtaggaagtacttaattatagatgagaaattaagtacacacaaaaactttgtagtgttgaatgcgacgacagcataatatattatggtgatcgaaaaggtctctatcaaaccccatttcctcccatcttccttaatttcatacaaaatgatgggagtcagtattgcccttgataaaatatattaagttgaacagctgtgaagaagtgcctgtcactgttaattatcttacaatgcttatggcagttttaagctaacttttaagctcggccttttcaacaactctatatagcctattcctttcacatttggtcaactaaaatgttcttgtgcgtcattgcctcaactaacactctatctaggttacatcaacaatgagagatgcacaaatttctttaggaatcaaacatgaaagcgtgggactaattctacttgaattggttgatcggaaaaggagaatatttaagctaaacatgttcttagaaaatccatattcatattttgtgtagttactatatataggagttacgatcgaaccgtcagtcattcgt

SEQ ID NO: 96058 - DNA, 682 bp, Oryza sativa
tccgccacgatgtgcggcgggatgaactcccgccggcaaaccttctgcaccaccacgccatggatgcccgaccattaagaatgcacacacccagggatgatagaaattccggtgatttcggaacccggcaagcaactatctcatccgtaattttaggatttttcaagtttgtttttataaaagaattggtcaaattttgtttaaattcaatcaaaatttgttaaaattttgaataatttcgtaaaaaagtaacaaaattcacgaaatttcgatcttctgttaaaaaataattttgcaaaaaagtaccgatattaacgaaatttcagtttttttctgaaagtgtcaaccctcgtgttccaaagaagaccatgtatatgtagaacaattggagtaattcttacaaggcaaaaagtagtggaaattgggtaccttgatgaccatgctatttggtctcgatgtgctaggaagaggaggattggggatcgacgtgcaaatcccttctttaaattctccaccatgtatagcctagagtaaagaacacaaaatcagacaccattttttgacaaaccaaaaaaaggttttaatttcaagatttaagaagctatatagctagctagatcatgcttataggtacctggtcctccatgtggaggtgaaacccatgctccatctctccacacat

SEQ ID NO: 96059 - DNA, 3583 bp, Oryza sativa
gcataataattcactaatatattagcgtaccactgatgtcttgctattccgtcctgatcctttttctttgtcccctgccagaatggacaagcatttcaagcatggtggcctggtgggtgcagtgcaagtgcaaccgtagggaacatttctgctgaaaattgttttctaggtttgaaaaaatgctctgattttgatgttaggtttcaattggtttgatcattggcagcactctatattttctaatagcctttctaggttgaatatgtcatggtttttagacaatacagcctacattacacgacaacatatttatacaatattaattggccgttttgttaggagcttcggcttcatcttagatccctcgctctagtcaggcctatgtattaagttgcttatgtataaaaacttattggcttgtcctggactataagcctggcttgtatgttgccatccttggtttttcatggatgactagctagcttattgttgaaaaatctctagatattctgaggttctatgggctactttgtgtggaagtacatgtgtagggatgaaaacggttggaatggaaacgatatgcctagtattcttattatttttattgaaacggtattgatacggttattttttttcatatttatgaatttaccttcttagtggcaactttaataaggtgcagatagcaattagaaatactaaatttttacagttagaagcaattggaaacaatttttttttattttctttacggaaatgatagcagtatggttggaaaatttctgtcatgttttcatccctacatgtatgtctgtctgggattacatacaaagtgtttcaaaacttgaatgatgttatagttttctttttggaattttgtacatcgtttttaaatttccatacaactttgtgattttgatctttttatgtacatggacagtccgagaccaaataaaactttgaagtgaacgaacagaaattaaaagacacggctgtagacattttgtttttaccctaagtgccaaatgaatgctataaaagtatatggttttatggaacattttagagttgctacctattttctttgaaataaattgcaaaaccagatattttgtatcatggatgctctaaaacttagtttttttttaaataaagtttactcttttgagaattaagtgagctccctgaaaaataaaacaactgatgtccaaacctacattaaaaaaaaacctttgaaaggcaggaacgataaaacataaggataagaaatacacatgattttgttctgaatgtatatacgggatattggatcttaaaacataagaaaaaaataagcataatgtaaggaaaccatggaattagatgagagaaagagactcgagggaaaatttcaaaagattggattcaatgctaactttcctccaacgtttccattacattaattagtcaatccaaaggaagtttatacaattttgtagatacaatctcctgtttcaaggactaaataggaaacatttttttcctaggatttaaattctgcaagttcacttcataaaccatttgttccaaaggagacgaaaaaaagaatttgtatggattggcttgcagtggcaaggcggcttttaatctttgccaaaaggcaagttgagaaagcatgcttaattcttaaaaaaagaaactcaaaaatgtttgttgcttttatgctgagtcttgagccattgtttgctggtccaaaagacattgagaatgagcatagagcggttgagtataacaattcttttagtgagatcattcatttacatggacatactaattccttttgttagaacttgacttttgtaaaaccatccctaacaatcagggccgagtcagccgagagccatgaaaattgactacgcgtaatgctgaactcaagctctctgttatgtcttcaatgtttcatagacttattacataatttgaaagggtttaaggagaccagatctaattaccctatgcttatctctgccactgtcaacaaatggaatagtatatggaccgtcacttcgtgccaacggttcttatgagaacgaaaaagtactcactccgtcccaaaatataactacatttagctctaaggatttatcccaaaatataacttctttaccaatattctcttcccaaccaatcataaccgttgaccattcacttttcccacttaccttcactaatctaatcataatcctacacctttcacttctacatactttcttagtaaccatgtctaactctaaaacttattatattatggaacggagggagtaccattttttattacaaaatgcctgttagaatatacctgtaaaaactctaaacctacaaaatcacttcctaatataaaattgtgtacatttatatgtggaggtagcggttgtgcacaacagtggggaattgatcacagttgaccccttgcatggatgccaaaggtttccatcagctaatgtaagttgcatgtcttgaggtcaacattatcagtagcggacaaatttaaccaagttggagcagcaacttacagtgctgtaacagggttgtcgactctgatgtgcttcacctcttttgtggttctcatccatgtatctttagctgtataaaggtaatatcataatcatattagcaaaaagaaaaaaaaataatttcattatctttcatgtggcaataccgcacttctaacatcggccaattattggcacgtaatgactggactatcggcaactagtagggtaaattgaaagcgcataacttatctgtcccttctctaattataaatatttgatatctatgatagtattcactcaaagttttaaaactctgaccatcaattttataaattcactaaagtttataatattatattataacaataaaataaaaaaatattgaaaaaccaacttttaactcaaaaagggtgccaaaaagttttttttaaaaaaacatgagaactatgattcaacctcactctagctagctattaattccaccacttctagttgggggttctatgtgacagcatactctgttctgcccacagctcaagcagcctggtatcctcttgtcagttgtcatgatgctcccttatgtgtacaacctcatcattttattaccatatggccatagcccacattgttgtaatcacctttctctcaaatcctccaaggaccctctacataattaagcagcaacctatagaaaacatgctgtgtcaaccatgaaatagcagcagttaattactaattaatgtttaattacatataagatacgcacatgcatccttcaactaaacaatacagtgtgttgatatgaaaattggtcatttaggtcatctgtagtacccaatatccatttttctatttcaaaactgaatgaaatgacaaggttaaataaaatcaagaggcgacttagtcgataagaaatcatggataacttacagtcggtgcggtatctgctacgatctacctttaaaaagtaagaaaaagacttgcatacatatataccaaaagtaaattttacttccaaagcaaataacactagagaaatatactacgca

SEQ ID NO: 96060 - DNA, 1017 bp, Oryza sativa
aaatcttacatagaaaacatgcatatttggttgatgaatacataaggtagccatggtcatatccgagctagtcatcattgtccctttcttgattggaaatcatcatcggtttcaccttgtcattaagactgatgaacatatctttatctatcacaatataaggcgaggtggacttcttgatggacatggtgattcaaatatagcaaataatttcttctataaacagttaagtgaataaagatcattaaattgaatatagtccaagtatttaaataacatagcggtctaagctaagtttttcatcaaattgaatttattcaagatagtgctcgttaacaagcttaacccagtacaaactaaatttggctattaattcattaatattaacaagcatatgtgtgtcaagtcgagtcttaaggaacaaccctagctactatcacccatgtaacactactacaaaatggatttttccggacgagacccctttagattgcaggaggaccataactgctcacacctgcaaaaattgatcccccatgcgcaattcagggaccacgtacaaaaatctattttcacaagctggtctcttaacaggcctgtgtgcgaaaataccacccctctctctctctcttctcaattttttttctcccctcctctctatctcccactacatcctctcactactagagaactgatctttgctgggtcgacccaaaaccacaatagtcctggttccaaaatgaaccgagacaaaaaatgatctttagccctggttgaaaaccccacagccattctacggtgtttactctcggttcatcccttgtcagtggcctgtcagggtgccaaggatcttcagagatcatcactttagtcccggttggtagactaaagatgatctagatctttagtcctgattgatataatatccctcgcacttatcctctcctccacaatcgcagccacttcctcacatatccccttcctcctcccctcctcctcctccctctcctccccctc

SEQ ID NO: 96061 - DNA, 683 bp, Oryza sativa
atgagaactttctgctgcacgatgtcatgatacattgtggaatcgacttcgcttgtgtcccgatgatgacggactatgtaaaccatcgtttgtctgatcaaggatctgcacattattgtcatttgggagcctggatagaatcgaatgtccaagattcacaactgacattgctttttctgctagaaagggctttaacgaatgccacctacctactgcaaaactctaatggaggagctgtaacaaaaaccataatgtgctggcactgaaagaaaaaagcaacggcctactgacaacacaagcatctctataagaagcatggatgggaacgatgatacagcgaactcaaacttatctatactgcacactgctgcaatgacatgacaaacctcaggctcttatcatcctatgtcatttcatatttgcaagccaactctgactaccaaattatgatgcttctacagaaacatattcctaccatatgccttgctacgagtaagccctgacggaacatttggaagactaatggacaaattctgtgactgactaaggtttctaggaaaatatcaggtgtcgaacactacagactcatccaaacgttcatgagtggaggagatccagacatgttagctgacattctactaatatgaattgtacaagcgagagtgcgaatacatatactagtg

SEQ ID NO: 96062 - DNA, 516 bp, Oryza sativa
ctaagttcaatttcacatgcaaatgtcataaatcttgtgggttttgctgacacagagagtactatgctctagtttatgaaagggctaaacaggacctcgaaggattcagacgtaaataaattttactgctctttttttattttagggtttccaatctaatcttattttgattggtattgattttgctactaacagcatccaataaaggtgagttggatgctatcttgcttggagtggcatctggactggaagctattcattctgcaggctttgtccattgggacattcagttgaggaatattcttttgatgaaggtgaaattcttgttgtatttacgaataatttagagtaaatttcaaaaaaatatatatatatactttgaccaaactatcagaaaattacagccttaagtcaatgtactacgataatacagatttagtaacaaaagtatcataaaactacagatttagcaccaatttaatcacaaagactacaatgtttatagctcaaacatat

SEQ ID NO: 96063 - DNA, 577 bp, Oryza sativa
tggtgcccatccaggacgacgaaccgcccgactacctcgcgccgactcttcgcgacgacgacggcgggcggggctgttactaccagccgcaacacctggagatcagcggcggcgagcagcctgcggctgcctcctgcgtattccggccatgcaaggcggccggcggcggatgcaggggcatgggctgcgtgtacgcgggtagctgctgcaggagggtgctgtgccgggagtgcaacctcccgtgcgtcgagcacaccgacggcttccacaccgcgatactgcccttcctgccgcggcgctccgcgacggcgaccgagatggccgaggatttgctgctgggtttgcctctcgagcacccgtgcgtgccggggcccgagtactgctactactactcggagggggaccaggtggagaaaggcgtggggcggcacgtgttcgtgtcgctcagggatctcgcgcgcaccaggcagccgcgccgtctcatcgagtgtgggtacaggatggatatgatttacattttggtccttttaaaaaacttatttcgcaaatagacccctggaaaaacttatcccaaaaa

SEQ ID NO: 96064 - DNA, 577 bp, Oryza sativa
aattcttatgcactaaccaaattcagtgacaaccatttctcttccctcctatatggctagtactagtagtacttaaatttcagacaggaaactgaagtaagctacaagtctgttagtaaaatgtgtgatgctaatataaaagtaggactttgagctgtcatgaactctttgacagtgagacaaactgagtgaatctcaagtaaaatacaaacaaccaaacaggtaaaaatcgttaagctcctcaactctatatattatccaagctagctgtctgcatcttgtcctatggactcttgtcctcggttccttcgcctccatgtccaagcttgcaacctttcattcttttctgcttctagaacggaagatatgattggccaaatggtcattccaatgaggttacagccatttttcagaatctgttccccgtttttccaacacacacatgacaacagagagtatacgcaattaattatgcatgtgtatacgatatgtaagtacgtcgtccttgcatatagctaacgttgtcatgagtcaaaacatctctgtcgagcctggatgaaaagtccaaccattggtg

SEQ ID NO: 96065 - DNA, 689 bp, Oryza sativa
ggtcttggtttggtccccaatcaacttcttcaatcatccatgcattccttacgcttggtctcttttctttcgcccaagcaagtacctctgcgaacgaaaacacacgaaactcattgtgtagcaacgtttgttcaaatatataacaagtaaatctaatatagaatatatgcacctttggttgattaatacgcaaggtagtcatggttatattcgagctagttgtgtcctcatcattctccccttcttgatttgaaaccgtcctcagttttaccttgtcatagagcgtattgaacttatcattatctgtctcaacatccggtgaggaacatttttcgatggccatatggttggatcctgaaatcttggtagtcgaaaaaccaccacactccccttcttgcagactaacatgtaactcatttaaacagctagaggaactagatagagaattacttatacgcatgtggtcctctagacaacacatttcatcatcaaaaggaggtatagtcaaattcgaacaaatatatactcgatgcacattatattctcctttactatcataattgccaataatatgaaaaatcacatcagaagggcatggcagttgagtggacaaagataatcaaattaaatataaccccaagtatttaaagaagatagcatttaagctcttcattctcgctagcaatgtg

SEQ ID NO: 96066 - DNA, 573 bp, Oryza sativa
ggtcgactctagaggatcccctcctaaaatattctgcagtaactgcatgtttgttttatatgaaaaatgttatacataaagggcgattccatcctccaacctctgcttaagcccgaagtgtgctgcctgattgagtttccgaaaaagtagagttattcaatttaagtggagcatttggtatacatgggacgaacgggttcagtttgtgtagtcgcacaaataattgctgagctatgcacccgttagcacacacttgtttagcatgaaagatgctatttttgttgcaatgatccacccataaatctgttgtggataggatatcaggcagacaggcaccaaacaatcacactgtattcttgctaaaaaaaatgacttgccttttgaatgaaaaaaggaaaaggggcattttgatcatgtgactactgaatttagactgaagcatagactgggtacataatctggagtgagatttcatgctgcttgaaacgatttagaacgtttttcaatactaaggttaaacatcaaaaaaggggtagatcgcaaaaataggtaggccatcactcaaacagtccc

SEQ ID NO: 96067 - DNA, 616 bp, Oryza sativa
cctggtggagaaaggggctttactcccggttttcaaaccgggactaccaatccgggactaaagatcactatctttagttccgggtgaaaaaaccgggagtaaaaatacatctgttaccaaccgggactaaagatagagctagcctagctagctagatccggttgctctattatttttttttcttcattatgtttttaatatattgattttactatatccccatcccaaaatcccaaataaattatccccaatcctcaaattcccaaatcggccatattcaaatagatcacaaaatcttaaaacaaaattacatcacaacttctacaaaattcatcataaatacatcacatattcacggacatcatacacaaatcaaatacacagatccgaatcacaaattcttaaaaaaaaaaagaaaaaaaacacaggctgtcgactgctgccgcgccggccgccggcgcgccacccgccacgaggccccgcggtccaccgccgcgccgctgcgccgcccactgctgcgaggcctccgccccgccgtgccgccgcaaggctgcccgggcctccgccggccgccgcgaggccgccggccgccgatgggatgatggggagggaagga

SEQ ID NO: 96068 - DNA, 709 bp, Oryza sativa
gggggggggggagtggctgtgtagggtgtagccagaagcgccaaagcaaagcactcatcagccacgtttttctcggcagaaaagttaccactaaaccgcaccactaatcaacactcaagagagagcaaatcaccactccaaagcatcgaagggagaaaggtgaaaatcaccgatcgatgcatccggtgcagtttaaccccagtgggggcagtgcaatgcaattgggcttaagagggatcggatgcttcctttcacattctgtaggtagtagtgtatgtttgtctcggatgttgacggagctcgtggcccctcaccgggagactgcgcaagcccccctttgccggttcgaccaggggcttagggtgcaatcccaagctctctctctctctgtatgtggaaggatcacccgcccgcaagacacacgagacacggcgacgtatacaggttcgggccgctgtgaagcgtaataccctactcctgtgtttttgtggatttgtgtatggacaagttacaaaggattaactccctttcccctccgccttcccaaagggaaaaaaagtcctcctctaaatgggcaaggtcctccttttatatctcaaggggataccacatgcacctttctctttccaaactggactgttctttttctctttaatgggcggagatcggtacggtttccatccgggagcccttctgatgggacagccca

SEQ ID NO: 96069 - DNA, 538 bp, Oryza sativa
gacttttttgacacggaccaaaataaggccttactggcctttttctggcgaaaaagcaataaccggcctctgctctctggcccagtttggcgagcccaacaagttctacgtgaagaaacatttgctgggacaatttttattttatttttttctacttgtgttttggattttgtttgttttttttcgtgtacggtgttctgacctgagaaagaccatgcggcgtgttggacactactaaggagctgtttggttgggccgtttttggcccgtatcagatcccaccgtgaatagattgcattacacatgtttgtttcagatggatcgtaatcggatagcccgcaaacgaattccggcccaatacaaagctgattacactcataggcgggcggaaaacgataccgatacggagcgtaacctaactctcctcacgcgcctcgtccagatcgagcgccgccgcagcttctcctccacatcgcgcgcgtcgccatcgccgccccctctccctgtgcgcgtcgccggcgcctactcctcaccctgt

SEQ ID NO: 96070 - DNA, 512 bp, Oryza sativa
catccttatatgagttcacagaaacttgaatcatctcaaaatgagttatatttgattttatatggatttttacaagttttaggtacttttcttatataatctcagattttgtttctaggggtccgctaacagtcatacggcaatatgcaaaaaagcccttgagatttctagaaaccaacccgcagtcttaggcccatatgtcagtgtttagtatgttttcatattgaaccttatgtttgtttaaattctcaacacgaagtcctgcgacctggacagaacagagcgccatggccgagctcgatctcgagctcgccggcgacaaacgatggctcgtttgggggtgcgaccaatacacaaaatgaagatcatgttattgcgatttcattcctatacatttctcagatagcggacattgaagcagcgccagcggtgagtccgagcagaggatgttttcgggtggtggtgcatgtcgtgctatcgactggatgtgttagtgatatgccctagaggca

SEQ ID NO: 96071 - DNA, 515 bp, Oryza sativa
tactgctagctcccaattaacataagcggcggaatcatacttaccatcaaaaactggcaatttagattctaccattgcaagatcattatcatgtacctcatatgcaatgcgtgaagaagtcgctatatctcgttgatggtgaagaagtcgaggttgagcatgaccatctcgtttccccttgtgtaatcctgccatggttagtagcaaacaagaaacatacacaagaatatgcacgctcctatcaactactaggtagtggcagctgaaatattacacatactcaagcttttcaccaagctcttataagttcttaccaaagcaagcggaatgataatgtacactgactcaaccaagcaccccaatggagtttggatgtatcgatgccttggcaaacacttgctgtacggctgcaatcaaatctgtggagctctgggtaggcttaaatatgtagcaaagcaatagcaaatgctcaaatcagagaatacaaagttgaataattgttcaaagtcaagtac

SEQ ID NO: 96072 - DNA, 735 bp, Oryza sativa
  unsure (1)..(735): unsure at all n locations
tgcctgtgnttttgatgtcgtattcgactcactctanggcgaattgggtaccgggccccccctcgagnnnncccctttttttggatttttttttttttttttttttttttttttaccagggattcattgggtatttaacaacataggcatgcaatctggcaaatttgaaaaacttttaacatacaccccaaatccctgcccaaatttaaaaactaggggggacacagggcgtttttccatgtcgcattttttgggatggggctaccatacctgggagcaaaaaatggggagggtggagcgcatgccaaatgaggatctattagcaatgggacggggcctccactttagcatctccaccctgcttcttttaaaggaccgcctttcattgcattcagctgggatggtagcacaaacaccagtgcaccagggaccaagagagcaggagccttgtgctcttttttgatatgaagcaagaagaacagggttcggagcagtttgatagagggcatttattatggaaggccttgcttccaccttggcttttgctggacatgggcatttgccttggggatcaacaaaataatctaaacaaggttctttttgtacactttggatgttcaagtgggtggcggttttaaaagaggattttttcttttggggtgcatttaataggttaggatggggggggttttcctttttgaaggcctccaggttggtggccccacctggggaatg

SEQ ID NO: 96073 - DNA, 621 bp, Oryza sativa
tgtcatgtcttaaagatctttagaatgaaaaaacaacaattcataggttctcacttagattgtttacaaagattttgtttttaaaaaaaatgtaccctccagctccctctccaatcatatgcacataacactattgcactacaaaccctttctcatatctgattcgagttctacgctattcgtttctctcctgtctcctccctattttcagcttctaaactaaagattgaaacaaatattaaaaagaccataattttaagctacacttataattttattttatatatcatagatgatggtttcttttttatataaagtcaccacctgttaccccataaatcctcctgggccttttaaaccgataaacccattatttccaaccattagatctatctcatcttaaaagacaagcgtgtatcataatgcatcatcttccaaaataatatattgcacaactatatttcttcatccaatattattcgcgctaggttgcatggagtctcccacacactctacatggaacgttcacatatggattatctctcaaattaaacaataatattaggctatataaacccatgcatttagtggagcctcatatcccacccaattcatctgtca

SEQ ID NO: 96074 - DNA, 903 bp, Oryza sativa
aaaacaaatctaaccatcaattttcaattaaattggcggacttataatttcatcaattttcatttaaaacagtggagttataattttaacaattggatttaaagacataaataattcaaacagatgaacgtattaaatctacctcataaaaacaaaatctccttaccaaataacaacaagacattgaaaaacatgatatatatattcttgaatcgttttacacagtaaagatcgattaaacgtgctctatagcactcttaagtcaccacttatgatattgtaaaactttgaaaaaaaattgaaattcaaagagaaaataatcatctctttccacttaatttgatgacccattatttttaactattagattgcctctctttataaaaaaacttaagccaccacatgtcatgtcttaaagatctttagaatgaaaaaacaacaattcataggttctcacttagattgtttacaaagattttgtttttaaaaaaaatgtaccctccagctccctctccaatcatatgcacataacactattgcactacaaaccctttctcatatctgattcgagttctacgctattcgtttctctcctgtctcctccctattttcagcttctaaactaaagattgaaacaaatattaaaaagaccataattttaagctacacttataattttattttatatatcatagatgatggtttcttttttatataaagtcaccacctgttaccccataaatcctcctgggccttttaaaccgataaacccattatttccaaccattagatctatctcatcttaaaagacaagcgtgtatcataatgcatcatcttccaaaataatatattgcacaactatatttcttcatccaatattattcgcgctaggttgcatggagt

SEQ ID NO: 96075 - DNA, 1013 bp, Oryza sativa
  unsure (1)..(1013): unsure at all n locations
ctacagttggtctctgcgactttctgctgtggatgatatatcttgccagggatatgatcatgcatgtgtccatggcatttacttttgacttatgccaacctgacttatcctaattaatcaatgtataaagaggagatgaaattgttatttgggaatgattggtaagttgatcggggctggctccaatggcctgtatgcatgcatggacatgcagagtcaacgcatgtggctatcatctctgctcctctctgatcatccatgctcagcaaatatctctctgctcagcgatatcaagacagtgtcaggttgatgatttcgtgatccaagcgactccagttcggtctcagccatggccatgaaagaaagcacggaaagatgcagagatattgtcaggccatctccaaatctccaatgcaggtgcttatcaaaagataactattttgtcttaaagccacgtagagcaagaggtgctctaattaatcctaaagcagtgatatgcttgatgaaacactatgcttaagaggttctaaagtagtaatgtttatttatctcatttattcgattgggaaagttgagtatttttgtattttttgcaacttaagtgcacatgctagtgagttccagcaaaggctgccaattttgcaccctgatcactatacctgtatggctgtatgtatgtgtatacgctttaaattcatccaagaaagtgacactgcttgaagtatcatggactagcagtgaaagcaaatgcaactctgcaactgcaaagtcggtttttacgcataccggacacttttttcgccggccaatgcacatgcttctggtctaacaaaaactgcttgatggggtgggtaggaacaccaccctctttttcacagttgagaggcacacactgcatgatcagctagtacaattnaagagattatgacacatgatcataggaattcaaccgcccactaatcctcagttagaaccaagaggaattagctatatagaaaatttgacagatgtga

SEQ ID NO: 96076 - DNA, 635 bp, Oryza sativa
  unsure (1)..(635): unsure at all n locations
taatatgcacgtgttaaacacgtatataaaggttatatacgtgtctataaagattatatatgggcaagttttatattacacatatataccaacatatataaaggtggtgtatttcgtatatatacataaacaaattttgtctattaaaaatatatgcctattaaaaaaatataaatatatgcgatatgtatacataatatatactttatatacatacgtataccaaggttatacgtgtatatataaaagatatatgtatgtatacatatagtagagaggagagatgagaaggtcaaaaactgaccgtgttccacgcggggggcacgactgatcgcccatataggcccctggctgacatgtactgaccccgctcgttaagacgtatcgggccggctgactgctctcggtcgagggcctaatcatgtatagtgcagaccagaccgggcaaactatctagccatctataacaactggtctncttccagtatctcataagaaccggatactcttacgtgaactgctccctgacatgatcactgacaggtaagctcgcgagcattgggacccacgtttcaattaccacgtctcttttgactcacgtgagatgttcccatctaacccatgcatgcattctt

SEQ ID NO: 96077 - DNA, 564 bp, Oryza sativa
cataacaatacatgcgtaaatttgagtcacctagggggctaatgagttgtttttttatcaagtcgaccaacaactaatgctaaaatagttattttggcactgatgatatttattttcccaatggtcttcatagttgatttggtactttgcaaatatagagagcgtaaaattggtgccaagaaacatgccaatcatcgaggcatgggtgaccgtattgagaatggattacaatagatcgtaggtgttgtggattgtagtgaagagtgtgatgaccgtattgagaatggataacaatagatcgtatgtgttgtggatcgtgatgaagagtgggagctaccgcatgcttatgtaatacttgcttctgctttggctgactgccatgcgcatgtgcctaatgtgacaagcctgcctctgggatggattgccatatgcatgtaaccatgcgatcaatccttacgagaataggaggcaccagatgcatgtaaacgtactgatggttgagttatagatgtaggaggagatcgatattttgtggcacctttccaaactcttacgagaaatgca

SEQ ID NO: 96078 - DNA, 693 bp, Oryza sativa
ctagtggatccccctctaaactcttgaggggatatttcctgattgcttacatgttatttatatagttatttttttaaaaaaaatcaacaggatagattaatatatgataaatcactccacaaacatgcaaagccaaatttaacttctactagttgccatacaaaaacaaattaaactatagctagctaatatctattcacagtcaaatttgtttttttcattgcgacttatagaagctaaattataagttatatgcttgggaagtgatctatccactactacaggaaacacaaataggtgccggtttatccaatcggcaccacagaggcagcactaatatgaaaagaaataggtgccggcttaagaacaaacacctttgaagttccctgaataaaaaaaaatctcgctcgatgacgagcctatgcattgagccgagcagttccttcttccacatgcatccacaccacagcaagaacgagcatattatcatctattcatcacatatgccatccacagatggactcatccacatatcaatccattcatccacaacacaaaatttgacacttaaattcatactggatcttcgcaataaaaaaaaaaccatagatggattcatccacatatcaatctattcatccacaacacaagatttgatacttcaaattcatgccagatccttgcacataaaaa

SEQ ID NO: 96079 - DNA, 504 bp, Oryza sativa
atcaattaatatgttgccagccattgaaagaaattcaatggaaatttagtgcctgtcttcttgagcatagatggaggtatcaaggtatatcatgctggaattccatgttatttgattaagttctaacttccaagtgctaaactaattagccgattcactgatgagctgattatccttagggtttggaattacgatttaggactaatacacaaaacatttttattcagataataacatgaaaatctatttgaaaccatgaactggcctaaatccattcagatttataagcacaatggaagattaagatcatatcaacccaaagatgtaacaatattcaaatccttaccaaactaaaaaaaaaagcttgggtttgtttggcaaatttatatagttagtcagatatttaagatgccgcttgtgacagaataaaacaagagaagaaaacaatcaatcaccttgctttacaacctgatacacgatgcatcatacgtgtgaagagtaaaa

SEQ ID NO: 96080 - DNA, 700 bp, Oryza sativa
tattaaagcaaataaaatatatcgaacagaagcctaatatactttgttgtagtaagatcttaacataaaaggcagatctagcatatcaattaagcatgtaagatataaagctaaattaggtaaggtcggctgaaaccccgatgctaccctaatcggcaactaaaagcaggctagagattgagattctaagcacgacttaatagatcaaacttaactgatacagcattaagtatagaaagaaggacaatatctagacaatcaagttgttggatgtttcatagagtggtggataccctatataatctaaatcaacattggtatttaacctgatcggctgcctcctagtggtagatgttagctgattgaaggttagataacaatattgccaaagattatatagaatatatgataactcgacgaattacataaacaagattagagtatcataaagatgaaagcactaatcccgagaacgcaagccgccataacaagttttacctcaaattgaagatcgaaaccgatgcagctcaacccgaaagcaagaactcatcgaaagtaaacgaaagtaaaaagggtggcgatgggccgagattgtatcgaacgtctgttgttattttacatagggctcagggtttatttatacccgagattacaaaatatgtccatgtcggacacaactcgtatctctaacaaactctaa

SEQ ID NO: 96081 - DNA, 1000 bp, Oryza sativa
gtagcacaatggcacatagtggaaaattatacaggcaattgaattgtccagggcaaatttaaggaaggcaaagcaaaagcatgttccagatatatgatcgaaagaaacatctagattggttgacagctgctcaaagtagcaaaagtgatctcctatgtatatacaaaaaatacaacttctcctgtagactaagttaaacaatctatgcatataacacaatttccaaataagtaatagcacagcagtatgttaatcttctccaaatggtaatatggaaaaatggattcagaccaagtaatctggttttctgaatatctcatttggcaaggcatgggaaaaaaacaaaacctagaaaacacaatcttataaatgttcttccagacaaaatcataggttgtagttttgtacaagcagttaagcgctacagacatgcaagtatatgcatgttatgtcaacttgtgaagtgtaagccttcaacagcagcctaatcttactttttttttctgcaattaaatttactattcctaattaaatcaatcactcctttgtattttaggatagaattccgggctattttaggatagaattgactcacaatggatccgtggtccctaaaagtattgaaaacataggttgatgggtatatatatttattctgaaccatatagaaaaagattttacgggtgtgtttactccatactaaaattggaagtttgtttgaaattagaacgatgtgacggaaaagttggaagtttgtgagtgtaggaaagttttgatgtgatggaaaagttagaagtttgaagaaaaagtttggaactaaacaagggccatttcgtttgactcactagatgtctggtctgctaccgatggggcatccgtatttgaataaactgtggaaaatcacacaccatgctccaacataatccaatactctccaatatagaaaacgcaagtcggtttcttctttataattatcatccttacaacctctctccccaaa

SEQ ID NO: 96082 - DNA, 582 bp, Oryza sativa
tattttgatctagttacatagacacatctaacaccatttaaaattttcaacagtgtcataacgtgcttggggtttctgagccagtgtaacagaatctttttgatgcttgatcttatggctaataccgctaatgttgatctacccaaacttgcttgggactagaggctgatattgttgttggtggtgttgttagtgctgattttaggctacaagatttcatgcttcaatgagatagtgccacaggatatatttccaggaaattctgtttcctcaagacctaagctgtacgagcataacatccccttcagattctgcatggcacacgctatccattcttttcttcttttttttttttttgtgaaacttactcatcttgacaatttaatgtactattctgtaccagggaaaggaaaactgaactctcattgtgtaccagagaatcgtagtagaagcaaattatgatcgggattcaggctgttgtcaaaggttacccatcagtcggtatatatcgcattgtgtcttctttgagcgtataccctcttactcatttttaatctctagatgtataaaacaatggtcatc

SEQ ID NO: 96083 - DNA, 884 bp, Oryza sativa
tcgaggaagcgattcaatcagttgaaatatattatagggaaattattttatatggtacttaggtttgatatctaggtgtatgcatgaagtttaaacagttatataaaaattcataagatttgttaagatatattataacaatataagatatttacacacatgcatgcaaatctaaattcgatctatacataaagaaaaaaaatatttgtgtgctatgtgtactattcaccgtctgaatttattgtttctgttttgctagatctagatgctttgcatgtttgtttatagttttatatgatcccaattgatgttacttattttttatttgttataactatttaatggtgggtgtaaaaaaaattgtgtccatatatcatagtacaaagaatattatattaggatatatttcatcctccgaattatatcctttcctctcttgatgggttattaattgattctctcctgattttattctataaatactccctctattttataaaaaatcaaccaagttctagatgtgacatatttttaatactggctatattcggctgtcattattttcactgtggtgcagccaacaaacacagtatattgtttctcggctgtgacagtgcggcggtacaaaacagccgacccactatgaatctggatatatctttatccagattcgttgtaagattagatagacatcgagccgatgcgctcgtgttccgtgattaatctgattatatatcgtattgagctatacacgctttcaatgcacactcaccgaagtcaacgaccttcgctgcttaaaggcaccgcaaatgcacataccatttccgtccattcatcacacacaaccagactccgatcgacctcgtctcgtcgagcgccaagtc

SEQ ID NO: 96084 - DNA, 555 bp, Oryza sativa
cagcagatgaaagaacaaaaacaggggaagcagggcgtggcagagtagtgtcaggggaataaattgaacctcccaccatagcctcatgcagcataggatctaggtgccttttaagcatgagcaacgccccttgctcctgtgacacaggcaatatgtcaggtgagagaggttcgagaggaggagaagcaactgcagagcaatgcccattttcagggctgctatctcttgaatggctgaaaggtttgcagggggaggaaaccttgtctgctggagcagggtcagagagatgcggaggtgtcgccgattgacgcctgattcttgtttctccaggtttgaccgacctggacagatgtcggcttctacttctattgatgtcagcagctcgttctctctgtcttccccttgtctcttgattgtatgaactccggttgtcaagaccaggctctctgcttttgcttgacgaacgaccgcctaagcggttccaaagagagcgacttctatgcctccttcttgaacgctgctcgtggtcgtcttcatcatcagaccttctctccg

SEQ ID NO: 96085 - DNA, 830 bp, Oryza sativa
ttcaaaattgctctgattgatgtgattattcttttaaaatgaaaactagtcaattttgaatgaaatgtgtttttattttggctcggctcattaacaagaaattatagaaaaataattttgaagaaagctcgataaaaagctgaccaagctttttcccatccctttattgttgtgctgtttgcagtctggctacatgcctacatcgccctcactacttctgccggtaccgtggatcatgattcatgaaagaggcaaggagaaagcatatgggagaaaatgttctgggattcttctaacagagagatttatcttggatgatcaatagaaaaagacttgctgtcctcaagttcaaggccactagtatcactgtatcaggattcgtatacatgcagtgatgctgtagatggactcaaagctagcagcagcgtagaagatggtgtagatacgtgcctatatgatttatgaattgttcctgttttggattctattgtgccgtctatttagttttattgcccattgatttgcactcgttctgctgtattgtctgtcaatgaaaagttgccggatgttatagaacgtattttctgaagttttagaaaagcttcaactctatagtatatttctaccaggctgtgctgatgcagtgatgcttctgcgagctgagtagctgactgctgttgattgctgatgatttattcggtgctttgagacgatcggcctcatctttcgcttatgcttatactccctccgtattttaatgtatgacgccgttgactttttgacaaacatttgatctttcgtcttattcaaaaaatttatgtaattataat

SEQ ID NO: 96086 - DNA, 563 bp, Oryza sativa
atgggtcctattcctcagccacatattggttaccttatgccattgataacttgggtatcaaaatgactagatgttggcttaggaaatgcttagccatgcttagttcaactaggacacaaatggggatcacattattacatagactctgactattggcataactttagattggtgccaccgcaagggtgtcagttaattaaaatattctgaatggcgggctgtgagtgtatggttttgctggtcgcacccatggcagttaaggaccggttcacgggaaaccctgggagacttaccgtgcttaccacaagcgggagtaggtaactgcttgatctgaagtatagctcgaccctttcctaggcaccggtggcgagggtaggcgtgatggagttgggtcggccgaggtgttcggttgtccagctgccggattcaccgcggcgcaagaggggaccgcccactgccttttgaggggtgggggtgaaatcttagcgtggtgtggatggttaggggagggttatgtggagggtcttgtcacgatttccccctttgcagtatcatggtgatac

SEQ ID NO: 96087 - DNA, 575 bp, Oryza sativa
tccagtatctagtgtagcaggtaaagagaattaaatgtttctaaatgaaaacataatcatcattcacttttactgtttataacttcatggttaacggctattatcaggtgaaaaacgctgaccatatatcagacagcaagcatgtcgatgcatgcgaatatgaagagtactgaactgaaaatttgtagttacaaacaaagaggcaagagggagtgaaaacagaacagggacgaaacagtgttccgccttcaacttatgaatcatagccaaatttaaattttagaattaatttagatgtttcatcattttctattttctggccttaatttttgtggaagtacaaaaactttaccctaaaatcaattttggttgcttcatttatttttctcagcttataagccgtagcccaaacaattagaatattttccagagaaaggccaaaagcatagctgtattattggtctcttgtgcatttgccaaaaaaacaaacaaacaaaacaaaacagagacaatcatctatttatgtgcagtacagactacaaataaacagttcactcttgctcatggcagctaca

SEQ ID NO: 96088 - DNA, 521 bp, Oryza sativa
agagatgcaattggcttattggctccctttcaactgatcttcctctcacttcatgtcatcctttttcagatgagaacagtaactacacatcgacctaaagcaaatgacggtactagtatccttctgggttcttgacaagcacaacatcgaaatataaaagatcacccagagtttaagtacaagaccagtacattttatgttaggaacggagaagctagtcattggtacaacatactattagcaagccattagctgcatccagaaacaacactagataatggataatcggatctacaaagctcatgagcatattatgcaatttttgcttttgagaaagggccttcttcccttttgggccacaatatagcagaacatcagaacatcaggccatggaaatcctgcagtcattcaaatagaacaacaacatggtgtcttcaatcctatcaaatgttatgttatatacgctagtatatattataattattagtgtgttatactatacaagctaatttttaggctat

SEQ ID NO: 96089 - DNA, 511 bp, Oryza sativa
actatatggcgaattcgagctcggtaccctgtaactaattcacctccaacttcgctggagggagaatcacctaactggagagtgaatcaaatgacaagacacattattacaataagtagaatcaacaagagtttggtctaatcttaacacatatgccttaaggcaatgcatatcttgaatagagcaatagcctgactgaaaactttggtataagatgcatacctaacagttagctcataagctagcagcactcagaaattcagaacggaatgagaaaacatgcgggcacaacataatcttaaaaatcaataattgtaatgtgatgtttcagttaccatttccttgtcgctatatttctttgaaaatcagtacctgacaaaagctgaagaaaaacttacttgtcgaagttctaatctcagaataaaacagcaatggaggacagattatatcatgtactagtgcaccaaacaatgtgtacaaactttttgtttcaaatgcagacagcacgaaa

SEQ ID NO: 96090 - DNA, 514 bp, Oryza sativa
ttcctccggattcattcggccttggatttattccttttcgtcggattaatccgtgaaagtttgtttccaaaaagatttatctgaaccccacgccctacgtaggttctcctatgtgattctgtttaatttgaaattttaattacctgtccatggtcattttcttttcttattttctcaataaaatactgaaaacaatgtctgttgctttatagtatgtgagatttccctgtgcttgttcaccatgtttccttagaagcttcctttgtcttctttattttgcgcagtgtggaaacatttccacacggtttaaatacgttgtccgtgggaatcagtgtttttcttcactgaagtgcctgccctgtgaagatttattttcttgtcacctaattattgattaggaattgaaattctaactaacaaggatatgtatggatatatggtttaattggtgtcttaagaaatggtttagttgctgttggtgggtgtttgtctgcatgttttcagaaagaggtgc

SEQ ID NO: 96091 - DNA, 593 bp, Oryza sativa
tgctcgtgcggtgaaaacaggtgggattcgggagttgcccgaagaaggtgtatttgatcccgcgggggcaagaaggtgtggggcccacggcccgctggcccgttgaacccaccgaagttatgcgacgtatccggccctcttgattgtatggacccggtccatggacccccaaaagtaaaattcagtgtgcaaaaacacaccgtttgatcaccgattgctttcggttttgtcgaaatttggggttttgcgtatctagatcgtgctagtcatgactgagatttgcgtaaatctcttgttttctttaacagatttggatatcttcctgatcacaatagcatgatcgttcgtttagtctaaattgattgttcaatcacaagttcacaactaggcatatattcttccacatggatacatgtgctgaccaaaatgtgcaaagagtgtggcacgcattcctgaagcacacgctctttgtaccatcggtgagactctgtaattacctcctccacgcctagttcacactaaagtttgaaaatttggttgaaattggtacgatgtgatagaaaagttatgtgtatgaaagatttgatgtgatg

SEQ ID NO: 96092 - DNA, 510 bp, Oryza sativa
attacgcgtaaattcgtttttttttagttatttgttgaactctagtctagactagatgtgcccgtgtgcaaagcttggatctttactttaccttgtgtggtcgctttgcttgcatttagtggaagcaaagttgcatctgtaggaataaaatcaatcagcagatttggtgcacttatggtaccatgaagtattttgaaacctcaaggatggctattggtagtatattcagagataaattagttgctgtatccataatgggagttgcaattgatctttattgtgacaaacacagggatccaaagtttgtggatagcagaatgccaagtgtggaagggtcttttcaatttttttttttttggaattcctgtaaagaacaactactagctgcaaggtttaagcactttagcccataagtggtcactgaccagtaaccagtctactcaaagcagttagagattattgcggttaggcaatttgcatctgtccggcaactagatcacaatatcacat

SEQ ID NO: 96093 - DNA, 516 bp, Oryza sativa
atagtaatatggtttatatgatgaattaatctttgtaggcattaaagtgatgtcaagagaaacacttgattataagccagaaggaggcctaatcatgttcttatttgaggttcaatctttcatccatatcattttcattgtcttgatttggttatttgtcacacattgtatattggtcttgtgttgtaggctggagttgtggatgaactgcatgctagtgccatcagagaccctattggtatatatttgaaggacaaaaatgagacaatgtgcattggctccataaccaaggcgcaacccagggcacggctctggttgatgctatcagaagaaatgaagctatttcacattctgagaggaggtcggtgtacttcaatggatatgagttttatcctatgtataagcgcttgcatccattggagacatacagaaaactatggggtacattctacacatatcttattttctgacctttctttaatatttagaagtttgttaaattttcatctaccactt

SEQ ID NO: 96094 - DNA, 587 bp, Oryza sativa
ttcctgcagccctgctgcacggagatgaacagcagggcgcagaagaaggcagcagcagcggccatgggcaagagaaagagagagaagcaggggcagggctgctggttggttggttcgaactggattgtgtttttgtgcagagaaatccgtgtgatccagttggggaagacgataagacgtcctcagcaactggcacgcccaagttgggactaccagcgcatgttcacgtcgtcctgacgagtgaacaaccgactcgctgaggcagacgagcattcattctgcccctctgttctctatgtcgggggcagtggcacggacgccgatcgagctgccgttcgggttcggcagcgaaacctggtttcgtttcgagtttcagtgaaaaactcagagatttgcgcaatccgatcgtgcttactactactagtactgatttgctgtgactaaatgctttggtaaatcctcctttgaaaaaaaatgctttttaaaatttagggcacttaccatgtaagccactcctagcaatatcctcatgtgggtcatatgggctaaggcacccaatgaaaagtactccaaccagccctaccaaa

SEQ ID NO: 96095 - DNA, 663 bp, Oryza sativa
ctgccgcccaatcgcaagtgcatcaattgcaacagtgtggtaataatctcctccgcctcctgcttgcgtttgttgctgagaagcttgattggtggttcatttcgttcccggatcgttgcatggtagagcgtggaattggtctgctgggttgtagtgttctgcagttagcgcagatttatgaaatccatttgtctctggtgtgaacttttggttcgtccgtatgtttaagcttcaatgttggttggatgatgatagggcggctcgttcgtttctgatacagggatgacatctgagaatagtgaatccgttgctattagctgtggttagtttggttttatatgttatatgattggttaatcaatagggaaggtagttcttggctcctgagttttattggctcgtgaatttcattacttcatgcacagttgtttgtatttgatatctagtcgctaagttggctgaaatatgagccgctgaacttttaatactctactccctccatcccacaaaatttcaaaccctagcattccaagatgaaattaaggaggaaggcaaaataccaaaatgtccctaattaataggaaagttgtattgatggatgggtaggtgaggggtatttaaaggcataaaatttcttgatttgcgaactggtcgtaggtaaga

SEQ ID NO: 96096 - DNA, 618 bp, Oryza sativa
ttctcacatgaatagcaaatatttaccttgtttcaactccttagattaaacatatatttccaccctatcttcatgccatcagaaatgaatggccacatcgttacggtatatttacaaacgaaaaataatttataaatatattttttatatacgtgttcttagcgatttaaaagtaaaagctgaaaaaataaacttcgatgtaaaaccccaaaatcaactctaaatataaagttaaaaatttaaattttggctgatacttataaacataagaaaaggacgagggacaaactcttccatgctagtagtaactgttcgtgctgttgtcaaacagtagtctcgcgctactgtttgtattcttttcgaaaaaaaaatgaactagctatactgcttttttatatgtgctaatggaatcctagctactccgtatttgaattgacaaaattaaagcagcatgtcatgcattctgcagttctctgcagagagaaattggatctgcgcacagcagggtcggtttagttgtcacatcgaatgtttaaccgtatgtgggaagggtttttgaaacacgaacgaaaaaactaatcttataactcacatgtaaaactgcgagacgaatctttt

SEQ ID NO: 96097 - DNA, 1315 bp, Oryza sativa
cagctaccccacctgttggggcttgctgacctaaccagtgaaccacaaatccacaactctataaaggtggataattggctgataacctgtgcaattgcaacttcactgccaccctagaatcgtgcaacttcaaggtgaccagcatgagcatcttgtcttctctactccctccatcccaaaataaatcaacttttatacatgaaatctaaacataggctatgtctagattcgtgtacaaaagttgacttagtttgggacagaggagtaccctcctatagccaataagggctcacacacttcatccttactgtcagcagtttcaggtttggacatcactccctttctctgctctcttggacctgtgacatctccacaaccacaacctgcacactgacgtgtgagaatatcggctccattttctatcagcgtgccttgcccccatctctttactgattggggaatccttctttagcttgatctgcctttttttctaggaaatgttaactttgcgtaacaaaaagaaaaggttttaacaagtagtgtactccccagtccccactctaaaagaatcatcaaccaacaaaaaactaaagtggtagatgaaaatttaacaaacttctaaatattaaagaaaggtcagaaaataagatatgtgtagaatgtaccccatagttttctgtatgtctccaatggatgcaagcgcttatacataggataaaactcatatccattgaagtacaccgacctcctctcagaattgtgaaatagcttcatttcttctgatagcatcaaccagagccgtgccctgggttgcgccttggttatggagccaatgcacattgtctcatttttgtccttcaaatatataccaatagggtctctgatggcactagcatgcagttcatccacaactccagcctacaacacaagaccaatatacaatgtgtgacaaataaccaaatcaagacaatgaaaatgatatggatgaaagattgaacctcaaataagaacatgattcggcctccttctggcttataatcaagtgtttctcctgacatcactttaatgcctacaaagattaattcatcatataaaccatattactatatagatgcgttagcgttcccacaactcctataccacgtgatagtcaagctgcaggtttgtcccttagttaggttgtgcttctataagtattttataggtcaatgcttgtatataagttagctagtttgatttagattaatccattctacagcagccaagatactgtttatataagtattaccagtcaatattgaacgtggggctgcag

SEQ ID NO: 96098 - DNA, 513 bp, Oryza sativa
gtgtgtgcactttttaatattcgtttacctttgcagagtgaaagaaatcttaaaaaggatagattacatggaatgatggaaacaggaaacgtggttgaactaacttggcaatatactattgactgtatgccaaaatgattttaggaagacctgtatgttgaaaatagcttccaatctttcataaacaaagggcgatagttagttgatatactgtagccagctaatattcgttatgttgaaaactgcctaatttgaaatatgcacacatggtttactgaaataaacaacaaatgtaatactaaaagttcacactttttactaagactgtctctgtcatatgtacggcacaagcattgagtataatatgctattgttgaagaaattggaagtgtttttactgtctgcatttgttttctgtatcatgttcaaatttgcttgtgataaagcctatcttgagtgtttcatgatatttggtgctgtgccttaccctgatgaaggggtcatgctgattcg

SEQ ID NO: 96099 - DNA, 1129 bp, Oryza sativa
ctttttataggttggttggtaattaatttggcatatattgttttgtgtaaaacctcaaaaaatattttgcattttgcatgtcggattttctcttagggcaattgcgatagtcgtaagtcgtacgttccttgcaatatctgcacaatcttaaagctctgagtggctttgcctgcacacataaggctctagtgagttcaaagacatagctgcttggtaaacgtcttgctgaacatatcgacaaaccaaaatagtatgaggatgttttcaaaaaaaaaaaaatagtatgaggattctaaggtttttcggctataagtatatggtaattatttataccaaagttttggatatgtcaattagaggattaaaaaacaaggttgcttgttcgaagcatatgtagcatttcacaaataataagaagacaatgaaaaacaattggcaagatataatggagcagcccattccaatactcaagtaaaatttcatcaccttcggttgacccgtagaaaatgaaaactgacttattgatcatcctatggaaattcaggaccgagcatgatcaaaagtagtattagttttaattttaatctccccagcaaatctcatcatctactaggttttagtttcttcaccgaaccctatgaaattgttctgaatgatccaactgttgtttcttatgacacaaaatagaataaagtaatcactaaaacaggaagcaggccttttagatagtagcagttggctgctgatagtacactaaatagatgtagcttgctagttgctacttcattttttcacaccaagagaagtacatatcctattccaaaaaaagaaaaagaaaaagagaagtacatatggccagtttccttgaacagttaaaattcttaataatctaggtgaatgataaaaatgagaatagaaaactcacattcttcttgtagttctcattctcagttttcaactcattgttctcctttttcaggacctcgatctcctagttcttccactcaaccgtttgcactgcatgctcaagatccttggccttgaatttgagttcccacctcagattctcattttttgagagagccgtcagcttccttagccaagtcactcagatactgagctgaacaca

SEQ ID NO: 96100 - DNA, 675 bp, Oryza sativa
tcatatgtgatccgaacccatcttgattctctttcttatatcatctatgaattaatggaaatggaagtcatcaggaaccaaagcataacaccgttgctatccatgccaaccagaaattctctccagtggagccatcatctaggacgccgccgaaacaccgggccacttttcacggtcgacaagtcaggctgctacggtgatcagcgttggaggaggttaatctggtttacgatcatgctgtcgtcgctaattctctcctgtagcactactacagaaagcgtttttgcatacgggcggaatcaattttcacatgcggttggccggcccgcatgcgtgaaatggtctgcaaagatcaccatttgcgtatgcggccgtcgcagccgcatgcgaagatcgatcttcgcatgcggtcacttaagacggccgcgcacgcggtgagcgttgcagaccgtttcacgcatgcgggcgggccaaccgcatgtgaaaattgattccgcccgtatgcaaaaacgctctctgtagtagtgcttcaggagagaattagcgacgacagcatgatcgtaaaccagattaacctcctccaacgctgatcaccgtagcagcctgacttgtcgaccgtgaaaagtggcccggtgtttcggcggcgtcctagatgatggctccactggagagaat

SEQ ID NO: 96101 - DNA, 1119 bp, Oryza sativa
taggaatcctccgttccaaatgaggaacagaagatagtttctcacccacttcaccaccacttaccaataaaaattaccacgtttatttaagttgagactgtcaaattttttactacaccatagcaaatctaaggaaatcttgttgtactttttttgaggagtaaagtgcattggcagtccttaaatttatagggctgtgtcatataggtccctaaactctcaaaatgcatatctaggtcctagaacttgtcaaagcgtatcatctatgtcccaaatcggcatatcccctctagaatcctaagtggtactgatgtggtataccacatggatatgacgtgtcattttcttttttcttcttcttttctttttctttttctttttcattttcttctcattcttctttttttcctttcttctgctcgggtcacagagaaagaagaagaaagggaaaaaaagagaagaaaaaagaaaaaggaaaaaagttaaatgggtcccatttgtcaatcaacattatgccacgtcatgtccatgtggcatgccacaccagcgccacgtaggattctgaaggggttgtggcgatttgagacctagatgacacactatgacaagttctaggatttggatatgcattttgagagtttagggatctagatgacacacctctacaagtttaaggatcgcctgtacactttactcttgaagagttattgatgtatgagacccaatttctattatcctttaaggcactagtggtggcggcggtgaatttgccactaccaaaacccaccacttctttcatagtttttataaattagcttatgatattcattaattttatggaatactctaatatttgtttcaaataagtgaataccatatatttaaataagcaaacaagtgatgctaacatatctgataaaaaatatattttgtgtatgatatattataatatattttcttttacccatagtgaattatgggtattttgctagtattgggaaaaaaatcttgttacaactgcagctacaaacgaacaactatcaagtttatcaaacttatctaatcgtgcacgtgataaattgtaactagcaaccaaacatcccctatggaacatccttt

SEQ ID NO: 96102 - DNA, 654 bp, Oryza sativa
cgattcccgataactctagggggttaggtgcaaaatgccgcttcgagtggcctcgcgtcgtcgtccacagctggacagtgctgtcctctgctttttatgatggcatgtttgtctcactgacatgtggggcccacgtaaggcgcggtgtgcggtgggctccacctggcagtgagtggggcccgctgctcctttgttgtttttgctaatgctgtgtggctggatctcgcatgcatatatggtatggagaattggagatggagattggagagagcatctgttgctctttgactttctgtggccatgaatccactccaaaaactacaaatactcgaaaattcgattgtttgttcaatgctgtggagtaatcagatgttcgatctggagattaagaaacaaattagctgcaatttgtgttacaagttggtggcagatcaaattaatcaaaccaccaaatcatatttttacagctgaagcgttggatactcctccaaatttcagcacaaatgcgtgcctagccagtgcattcatgatagagagaaaaagatatccagtgctacaggtcatagacaagatggatttcatttattatgggggtttttttatatataatttacatcttagaacagctattaaaatactggaaactattgagat

SEQ ID NO: 96103 - DNA, 640 bp, Oryza sativa
aaatatatgattttattaaagtatttttaagactaatctatacatgtttgaaagataaatattttaaaaatgatttaaatcaaatattctaaaatttaatctcacccttatctaaaacgataagtattatcagcccggagatgggaagagcatttgttctccaacgattgtgctgaagagagactgatttgtacaagtgtgaatgccgcacgtgtgtctatgtaatggacttgagtaattagtcttaagcatccctaattcgtggacaagaaacttaaatcaagcgatccaagacgaagacagccgatcccgggacaggagggcatgtctgacacagcaactctctctctcacacacacaggacagtatggcacaccatgaccaccgatgacgcagccgcgagatcagtttggggagatgcagcgcagctagctaggagtagcgatgttcggtagcagaacagacagaaggcaaccgtgggcaaccaaccagcagagcccgcgtttgcggatgaccatccagctgcactgcatgtacgaccgattcgcgccgcggaattataaaccggatccgatcctagtccattcattcacaacacacgtgtgttcttgatcttggataggggtagtacctgggttca

SEQ ID NO: 96104 - DNA, 533 bp, Oryza sativa
cacatgcggcggcccgcccgcatgcgtgagacggtctgcaacgcccaccgcgtgcgcgtccgtcttaagtgaccgcatgcgaagatcgatcttcgcatgcggctgcgacggccgcatacgcaaatggtgatctttgcagaccatttcacgcatgcgggccggccaaccgcatgtgaaaattgattccgcccgtatgcaaaaacgctttctgtagtagtgctacaggagagaattagcgacgacagcatgatcgtaaaccagattaacctcctccaacgctgatcaccgtagcagcctgacttgtcgaccgtgaaaagtggcccggtgtttcggcggcgtcctagatgatggctccactggagagaatttctggttggcatggatagcaacggtgttatgctttggttcctgatgacttccatttccattaattcatagatgatataagaaagagaatcaagatgggttcggatcacatatgatgatttatcgcagttgttaacttgatatacgatggaggctgcaagatgcat

SEQ ID NO: 96105 - DNA, 1698 bp, Oryza sativa
ttacaaagattaattaagaaagcatagatgaatatagtatatatagcctggtcgaacatatcctatatacttagttcatccacactaagtgtagctaatgctatttctctctattttcattaagctacatcaccttggaaatcagtgatgataaagtgatacaagagttgcagtataaaggtgaagccaggaaagagtttggaccttcatgctccctcaaacagaaaatgaacacctctaaaactcatcgcctccatcaaatatacattgtaggcttgggaggcactggaaatactgttggcgagtggtgtcgtattacctgcccttataggacatgatgcatcatgcatgcattatggctgggagcatgatatgatacctctagtatgtaaactaataattagtagcaggttatcttgagtgaaaagtcatggttaaattggactaaattagagaagtacatcagaattggtgtatctgattatatatgcaacttgtttttttctggtaaaaatccagcatgattgaaacaagtgcatacaaaatacctaaattctatagtagctgattcgcccataacataggtgatgaagtactgaatgtgcagtaggttggatcatatccttggcctctttctattggtctttcatctcttcagatatcaagggatagggattacggattatcatatttggaaccgtttttcagtctgcccacccaacttgaaatatttgacacacacacactctctctctttttttgtgaaaacatagttgtgttttcaatgaccatatgtggacatagcaagataaaccatgctagcaactgattacaaatttaaacaatgctagtatatttcactttcttttgccgctagcaactgattacaaatttaaacaatgctagtatatttcactttcttttgccgaatcatatgttgtcttttgcaccagaatattgtggctcgcaaattgttagctcatatcttgtacgacgcgcaaaattttagcattgtatagggggaggtgtggcatatatatatgacaatgaaggctacatggtgtcaagggaagaaacattcctctttaatttcagttatatatgtggatcattgcaatgtttgatgaattgaaggtgcttaactgcaaaactcaatttagcacagggcattgagttatgtggcattttattatgtctttatacagtttactaaaatcaaaaggagatgcgaataagcactataaactatagaggaggtggaagagaccattgcagatgatgcttggtcgagctggcaaatgtcactaatgctccacaggtttgagaatgggtggcctctgcaaaacatcttggacagagatcttgatcagttgcctggtctcactgccccactgcaaatctacaacacctttttgttaaattattgataaatgaggtcgacaatactgtaggatattgcaatattagcatagcatcgtggttactagaatacctgtgtaagggtgcaagtagatcagccgacagacctagttataagcaaataagtgggtaaccgcaggtcaacccacttaattagcaatctattaataggtttgcatgtcgatccacttgtacccttacgcctgtcatctaacatcaacattggatccttgccatgttcttattcattggagaaatgacataatctgtgatcgagca

SEQ ID NO: 96106 - DNA, 589 bp, Oryza sativa
tttttttcaactttttttgcatttttttttgcaatttttttcagatctagagctgaaaactagccaaacacttctcaacgagtctcggagctagctcccactggagtaggagtttggagccctaccaaacgggtcctaaacagccagtatgttaaaaattgagataaccgccaacatcaggtatcaaagggaacctctctgatcttggttaaacttcaaaattgggcaaaaaaaaatgaaaacaattgatgcattcctctcaacaaggcacaaacttgtctacacagatatcgcatccaaaacaaacctgaggtaagattgagaaacagaaagggcaccacatgattaataattaagataatacataatctcagcaacaaattaatgacatcgcatcctctttggtttaatatccatactaaactcatttatatagctaaactactatcatgcaatagcttttctttcaaagacagaggccacgggccaccggaaaaatcggaaaagttcagataacacatgaccgaatctccgacagcacattctttgtaacatcattactcccagaaattcactttgcacagcaatg

SEQ ID NO: 96107 - DNA, 674 bp, Oryza sativa
gggattgctccgttttcaatgttattttcgggttggaaaccagcatatacggacacaccctaagttattatacaatagttattttcagctattttatcggatggttggcttatttactccacatctatacaaagtatgttttttttttcaaaatttcttctaatacagtgcttagcccactaattctaaactatttgttaggtttatttgttaaaacatttaatttattgtaataataaaaaagatattatacgacaataatacgattaatatgttttgaacatgtcataaagatggcatgaaattacattgaatgatttctatgtattatgtgagatttcagagtacttgacaaatctccaattaaatgcactgtagctggtacaatactctattaagtttcagatcaaatacttatacgaatagtcctgcatttttgcagttaattttcactgatatttgtacatgaaagatatattttttttcaagtacatctgaaatctgaagagtagcgatgaagaaacaaaacaggtcaaaccatgtgagaccagcaaagatacaaaacagcacgtcatgcatattgacaaggaggaggaaaagaaaagagatagagaggaaaggaaaaaaagagtagtactagtatagtagagctacatacataaatgtcccttttt

SEQ ID NO: 96108 - DNA, 966 bp, Oryza sativa
cctctattttaaagaagttatagcgatatatttttcttagataatgaaacttattccgacttttgtttcaaagaagttatacccagttatcacaaaagttacaggacgaatgaatgcggaatatatattcacggcttgattacaacgacaaaactactgaagagactatttctcgtaaaaatattgtttcatattcggaaaagttccatattatatcgctcaataatgatcttggtctagttttcgtcttaacgtgaaaatcgtctcaatttgatgatttgtcactcactacggagatttgatgatctgtcattctgattttgatgtcgttcactcgaggatcctacgtgttattgtcaggggatggcatgtagtagtagcaaagagacacgaatcatcaaatttgactttctaacttgttaacggaagatcaaacggcaagttttgcaacttatcaaggcattgtagatactattggaggtagtgacatgacttgcatgaagaagtttacgttaccagctggccataagtcaattggtatgaaattcaacgtaggatactgttgtagggtagacaagaaaatactaaaataattacatgtgtaatttattttccaaatttccaaatctttttaaccaatgtcggtgtgcatgagtttgtcgacaaatccaactcgtttgtagctttgctgcttggttttcgactatacgtctactatccaggatctaataattgactttgtattacgaattgtgatgccagttcacgtgttgaatattaacttgtactgatttgaaataaaattgaaatatcttgtgataaatactagcatatagccggttagtagcgaattagtgtctagttagcggattgcggatagcgggcactaaattccaatagcggatttttttcaaataactataaatttacattgtacatcaagtttaactaaaaatttataattta

SEQ ID NO: 96109 - DNA, 655 bp, Oryza sativa
acaaaatcaaaactctaaaaatacggattttcaaaaactttttaaattaattgcatcatgccgatcttattcgtctattttatctggatttgatctcgaagattattaatcgtgagtaaagaatagttaattaggaataaaccttaaaaacaaattggtaaaataaatacaaattaaaataaagattaggtgtggatagaaataaataaaatattatcgcgaccatatttggatcaattaaatttaaatacgatggaataagaattaaccctaattaaaactcaaataaattatataaaaataaaatatgagtaatattaatctagggtgaattcattagttaagataacacaaatattgagtaaaatgcatatatgtaaaattaggaattgtggaatcaaatttatatggaaaatacactaaaatcgggataaataggaaaagtcactgttcattgcctcataggtgttcgatttcggtccctagccctagacccttctctgtcacgcgcccagccatgccccgagccccgcgccgccgctgccgcgccgtcgccgtcaccatcccgtcgcgccgtcgcctgccgccgcgccgacgtcgccatcgccgcctgttgccgtcgccatcgctgccgcgccgccctagccggccttgc

SEQ ID NO: 96110 - DNA, 543 bp, Oryza sativa
tatgccccaagttccaaccatacagtaagaactaaaattatataaacatgtattttgataatccaaagtatatacacctgaagactttggctctttcaacacatgcactacaacatctctatgtacatgaaacaattgttcccccgtgcacacaggaccacggcacagcagacttcagttggtgattggtccacggtgaaccataactattataagtttgagatggtaaaattatactggctatgtcaggcacactattcttttgaacaaatattcggtactgcttttaagttcagttatatccacatagctccaaagaagaaatattattgtcttagggcctgtttggatcatccatgccccttagtgcaattaaactttaaccacagaaaagaacagctagaacatactatgaatatagcttttgatcagtcaaattaatatgcaataataaagacagtcaaacagggatgaaaactttgaactttgccagaccaaaggcacgcactactctatctctaatagtaccttctgcacatgggc

SEQ ID NO: 96111 - DNA, 1041 bp, Oryza sativa
ccgtatcgaatactaccgtactgtatacggtggggggaatataatactggttgtatttcatacagggcagagctttttttttcaaagaaaaatacagcagactggttagtggagagatgccgactgaaataatgtcaaacagtgttatacagtgatttgatgggttggttgtgcatgtcgatgtggttgaaacttaatctcctgaaaacatactacctccgtcctataaaaaaacgaatctagaccggatataatatattctaatacgataaatcatacgtatatctaaattcgcaatactagaatgtgtcacatctgatactacgttgatttttatgggacgaatggagtattagatataaagtacaataaatctagatagaatgttagtcaagattcgttatactatgaaatgtcttatccagtattagattattgtattatgagcggagggtggatgaaaattttgtactagtacacaaaaatctataatttttaaccaatcagaggctttcgaagaaatctaaacattttgaatctaacactaatgtggctaaaagaacttttcctttgaactaaaaacgtacaagtgcaaaataatattagtatttgttttattttttggacaaatggaaggactgtatatgaacttatagtacaaaatgattggataatattgcgcatgatggtggcatgtgtaattgtttttttgcatacgtgatatgtgttatgctttgtattaccaggtacttcctccgtttcacaatgtaagtcattttagcattttccacattcatattaatgttaataaatctagatatattgtgaaacgaagggagtacttctttggttagtactattttgtattgacatcttgcaaatgccataatcggtattgccatttacactcgagattcatagagctttaggttggaataaaacaaagtataatcagaaactcacaatccgacaatattagctcaaaagtactattgcatatcccagacacaccatcagtccatcgccgtttacaaaggccaa

SEQ ID NO: 96112 - DNA, 655 bp, Oryza sativa
acccccgtttttataacaggaatcattcgtgtaaacagtaccatttccctggatcaagtagtctggtacacacgagtttatagctgaaataccaaaagcacatacacgagagtctaatgctaattattacatcataagcccgcaggcattgtcttaaatcatcggaccgagcggtccggaatacatccaaaagcagaaatagataaggcagcggaattcaggcagcggcatgccattgccacaggcaacgaccgtactaagacctactgagcgccatcgtcttcatctccctcctggtagtaggcatagggatcctccgaagcttcatctcccgcttctgattaattttatatttgcaaagggtgagtaccaaccgtactcagcaagtcaacacagcaacaatgcatatgaaaggggtatttcaaaggatggctatggctcttttgcgctaagccagttttgtaattcttttcacaaacctaagacctagcattgactgatcaaattttagtaccagtgtttgtatttaaacaacgacggttctgtccaccatccattgtgatcccaaggatagcttcccgccattgagtcgttatggttttctgaggacgcccaccttcccccttctcaggaagtggctccaacagcataaaaa

SEQ ID NO: 96113 - DNA, 659 bp, Oryza sativa
aaaatgtaataagcatttgccaccttttgatcagatgatcatcacttgttcatcctaatgggctcatggcggtgcacgcttaagctagcaacggcttttttctccatgcattctactttaattttatcatatttaagaaagtattaggaggtatatttttttatgtaaaccttggttactaccccatccgtttcagattagaagtcgttttgactttagtcaaagttaagctgttttaaatttgaccaaatttataaaaaaaatagttatattttatcttaagacaaatatattatgaaaatatatttaattatagatttaataaacttaatttggtgttgtaaatattattatatttgtctacaaaattagtcaaacttatagtttgactttgacaagagtcaaatcgacttataattaaaatgaacggagcaaatagcttgaggtattttcttaagccataaatttatcttcttctccttatttaaatacatatagtcgggtaaataaatccctctaaaacttgtctgacgacgttgatatgctctcctatataaagtaaaataaaggacaatttgcttagcaagttggttaatacttttaactaattaatttatacggcagtattgtttattatttagataaggcttaacctgaaa

SEQ ID NO: 96114 - DNA, 503 bp, Oryza sativa
cagtgtaaattaacaatgacaatgcaagttgccatcaagaactaacagactgtaaaactgaagtggaaattttgcttaagctatgcatacacgaacgaaacggtgatcgaccagaagatcttagaaatttaatttcattaagtcaaaaggccgcgagaaaggaacgtgtaaccacaagatctcttggacaacttattttttacataataatatacttatcacaaagcaaagcatcctgcaaaatgagcaaattaattaattaatttacagggctgcaaaatgagcagattaattaattaatttacagggctgtgacctaatttatcctgctcttatatatacgtgttgatcatggaatggtagctatggtctgaagctgtcccagcagcgcacaggtgtattttataaaaagaaatggatagaaatccagcgtctagatctatatgtggatataaaacagctaaaggttgtagcaaacacttagacttaaccgaggaataaca

SEQ ID NO: 96115 - DNA, 574 bp, Oryza sativa
taaaaattttatacgtgtgctatagagcttaaaaactggtgttgaaaaactatttatgacgaaataacaatcaaaattaactctaaaataagttttaaaatttaagctttggtcgtggctaaaaagcaaaggatggagctgccacaaaatcaagggaaaattgcagaaaacaaaaggacaacaaaaaaaacacacatcagaagtcacttgaaatttaacatttcaccgcataaatcattttgttgcaaatatcaacctccctatcagttttgttgtaaaaaaacactttaatgcactcatgcttaattgaatcgatcccttatagctgaatagcgaatctcaacgcgataacatttaagctctcatcaccatttctatttgtggaatctccgaaaaagtatccagattatactttaaaagtatttaatttggtaaacaccacattgatggcttataatttatgaaaacatgttgattcagttaaacacatacgcactaaggtggattttacaacggaactgagtagaggtgggcaattacaacaaaataacttatgggatggaatatcaacttt

SEQ ID NO: 96116 - DNA, 502 bp, Oryza sativa
tttaactagtttaaattatttataagtcatggtcaggttgatcgtacatagtttcttattcaccttttcttttttttctcctgaggctaatcaatctattcgaacagggatatggatacttggcttgcattgtgacaaattaacaacaatcttatcgcccacatgcataccaattaactaattaattaatcaattaagtgtgtccatcattagtctgtgagattgttggaacttcttgttttgcatcactcatatttgtaactggatataaaataaggagatgcatccggggtcctaggacaccgatggccggagctaaattccacttgatggggacaggtagtggtatgtgcatatgagtaggagaggaggtgcatgcgatttatttttctaacttttataaataatggaacttaaaactgatgatgatagctttcattttgttcagaatttataagattatttctgatttttaggacatgacacatgggtaccgagctcg

SEQ ID NO: 96117 - DNA, 577 bp, Oryza sativa
aaaatatctagtatttttagaggctaactcaaacgaccgtgatagtttaatggggtaattcggaccttttcatttcctttataacaagaagcagtactcctaacccatatataagagttgacaaaaattaatgggggtcaatagttaaaatgcataatcatgttctcgtgtgtgagattgtagttaagaccaaccagaacattttgaaagatgggatatcttccatgcatgtagaccaacgagctagcaacaaaatctatcttctctctcaaaaaaaaaaagggagctcgaacaccttgtaaacgaactaacttcacttttgaactataaatggctcgagatactctttacaggagttttaaattcgaccgatgcaattaggacagattagctgacctcaagcctcgttgttttcagattattcactggattatttaaaattaattatttgagttatgctttgaaaaatatgttttctcaaaacaaaaattcttctacactgcattgtttcgaacagttattctaagctatctggtaaatttatttcctaaaatatttaatttatttctatattatg

SEQ ID NO: 96118 - DNA, 882 bp, Oryza sativa
ccaggacctctcccccctcgccgtcgccgtcgccgccggcaggtcgccgtcgccaccgcacggaactctcccccctcgccgttgccatcgccgccgccaggtcgtccccgccgccaagtcgtccccgctaccgccggctcctccccgaagtcgccccgcccctcgccgtcgccgacgccactgccaggacctctcccccctcgccgtcgccgtcgccgccgccaggtcgccgtcgccgccgcacggacctctcccccctcgccgttgccatcgccgccgccaggtcgtcgccgccgccaggtcgtccccgccgtcgctcggtaacatttacttttaaaaaaagaaatgtgaaatgtgcaattgtggattgtggattgtttaattgtgcatcgtggattgtgatatgtgcaattgtggattgtttaattttgagaatgtttaattgtggattgttaaatggagatttatgtttaaattgggacttatgtttaaattgggacttatgttaaattgggatttatgtataattgggactttgttaaattgagatttatgtataattgggacttttgttaaattggcagctatgttaaaatgtgacttatgtttaagttgagacttatgttatattgggatttatgtataattgtgatttttgttaaactgagatttatgtataattgtgacttatgttaaattggcacctatgtcaaatggagatttctgtttaattgtgacttatgctaaattgggacctatgttaatttgagatttatgtataattgggacttatgttaaattgagatttatgtataattcggacttatgtcaaattgggacttatgtcaaattgagacttatgtgaaattgcgttaaattggg

SEQ ID NO: 96119 - DNA, 526 bp, Oryza sativa
aattgtagaagttaagcaaaagtcgatggcatattgtagaacatgataaagtcagtggcaaatcgtagacgtgtgataaagtcagtggtaaataatggattctctcatagaaatttgggatcaacgcccgataaacggattcatcggtcgtcgtaggatttgtttgtgagcgctttgcacgaacgaatgacactaaagcaaaaggggtcttagggacgactcgtggcatacaaatccaatcatcgcggtaggaataaaatcggagatattcgaatcaacgtacgataaataaatacctctatcgtttgtagatattcgagggaattatcgagttcgaaacgatagagcggttttaaaataaccgtaggataagaatttgagagagcgataatatcgcgataggaggtgagagcttcggtctgtgcactactacagaaagcgtttttgcatacgggcggaatcaatcttcacatgcggttggccggcccgcatgcgcgaaatggtctgcaaagatcaccatttgcgc

SEQ ID NO: 96120 - DNA, 572 bp, Oryza sativa
cagtgcaacctccattggtgttcgagagatgattctactcactcgctggttctcgaaccagtacgtagcaatctctcgcaccgcaaaactccattggtgttcgatagatgattctactcgctcgctggttgtcgaaccagtatgtagcaatcacccgcaccgcaacgtccattggtgttcgagagatgattctactcgctcgctgtttctcgaaccagtacgtagcaatctcctgcaccgcaaccttcattggtgttggagagatgattctactcgctcgctggttctcgaaccaatacgtagcaatctcccgcaccgcaacctccattggtgttcgagagatgattgtactcgctcgctggttctcgaaccagtacgtagcaatctcccacaccgcaacttccattggtgttcgagagatgattctactcgctcgctggttctcgaaccagtacatagcaatctctcgcaccgcaacctccattggtgttcgagagatgattctacacgttcgctggtcctcgaaccagtacgtagccattctctcgcaccgcaaccttaaatggtcgagg

SEQ ID NO: 96121 - DNA, 710 bp, Oryza sativa
agtagtccatcatgtatgaaaaactgaaaatgaattaggtttacaaacgcaatgttttgtatatgagcatctactcttttaccgacttcgatcagtcaatttgtttagttatacactctccctagcccccacccttgtcgtcgtagaatcgttctcggaggataaggctcttggacctttgacctacctcgttgaacaagcactgatcctaccccccagccgtgaggttggaaaatccatttccgataacacggcttggttaatacgcacggcaagaactcttacacgaccagatcttacatggtctttcgtctagctgctggtttctcgagttgaaagtttttcaaggtgaagtcgaaagctcatgttttcttgagctaaaaggttttggaatcaacctgaaagctcatgattttcttgagatgaaaaatttcaaatcgtaaggtcgggatttcttgttttttttgtaagattatatcatagagctaaaaataaaaagcctgcaaacagcatatctctaaaaatgttccttggatacattataactttttcatttcttctggcagaagactttctcatcggttggcacaagacaacaaaagatccttgtttgcaggcaagggaaggttaggtgcagccccccaaatgctttttttttgaaaaagtggtgtcggctgcaacccttgttggaaaggaaacccaagaatcca

SEQ ID NO: 96122 - DNA, 752 bp, Oryza sativa
actatatttttccttttctgtttgtctcgtaatattatcttcaaacgatatactttatttgcaacttttttcttgaatttgaaaaaaaatattaaagtggtatattatatggcaaatgggaacttaaaccgaaatttcaaatcaaatttaaaataaaacaaattatagaaatttaaaggagcatatacttctttcatattggcactcaaaatcaaactcaaaataaaaaaaatttacaaatgaaacaatcattttgtaaagaataaaagtgagtagtcaagagaaaagaaacttattttgtcttactctcataatattatatagattttaatagatagtaatctaaatactatataatttaacttttcaaatatgcgatgtaaattgaaaattaaaataaatttataagtagaacattttaatttgaaaagaatggtaggaaggtatgctaggaggaagtttgtcttactcttgttcgtgaattggtgaatcatcagcattgaaaattatttttgtttgaatagttactgcttcagtatacctatttttcataatggagatttcattaagcttcagtatttctatgtacacatttaatagtaacatatagcttcttttgatatctttcttttgaatgcagccttctgtaaactattgtagaatttagaattgatttcttcctgctggaggctgccgaggtggaattggacgaggaagaatgtaagcagtggccttagtgggtggggtgggca

SEQ ID NO: 96123 - DNA, 575 bp, Oryza sativa
aaatgcttattggtatttgttacgatcacaaataaatccgcaagcgcacggataacgctgtaacacttcacctcaaagtattccaagggtatcgaatcacaaggaacatgtgtataacatcaagaaatcaagttcatccaacaacaacaaaatggtaggcggagagtagggagggtttctatgggttaaaattcttcaattaagttaaggtaaaactctatcacttgcttcaggcaccgactttcccctggtctgccaagcgaattcagcctacagcccaatgacgtaccggaatgtggaggactacaaaagacgatcaaggctgttaccatttgtcgcctacctctatagcccatgaaacacacaacaaataaatgtaacctataacctaaacactacgtttgcattatcaattactactctagccttggccaagaacttcattttttatccaaagtattagtactagagtacttaacataaatattaagcgatgaacctgcaatgataagcatatattttacttatacaagaagagtaaatacccaaaagaaagcatgaacacttacttttat

SEQ ID NO: 96124 - DNA, 516 bp, Oryza sativa
ttcgcgtgggcatgtatcgtgggctgcgttgagaacggatcatattaatcagatagcctctgccatctttcggaagtacgtttcctcgacaaatattcttcatcaacatcactttgataatttctctaagttatatactatataatatttaattcatcagtataaccaaatatctataatctttatcattatataaaaaatagtagacttagtttgtttagaacatgtttaacaaattaagtgcatattaaaatcaaggtggtttttattttcattagttttggggggttggtgaaaatgtaagacctagctaaactcattgttccttttcccctaccatacggttttctcacagctcctagtcattgtgtcctacaactgagatgtggtcgttgcacctatgaaggtttccttgtgattcatcgtgattcatcgtactggtgatctcatttttgtcaagcttagttagtccactttccatgtttttggtatagcctaaaatctaaatggactcca

SEQ ID NO: 96125 - DNA, 597 bp, Oryza sativa
  unsure (1)..(597): unsure at all n locations
caaagttaaaataatggacattgaaatgaagataattatatcaaatagtcccatattgattgtgaaaagacaagggacctaatatataagtggggtccttatctcgttggataacttttaggatgaaatgtcatttacgattatacaattagtatcacagccacgtccagtggctactcaagatcgattggataactttctcatcccaaaagcatccaaaaaatgatagcccccacttatataaataggtcacttacccttctaaatatgatcctacaatcagtattagagtcaccttttacttctctttggaatttgatcaaattttgcatcttgaaactgcgcattgaaactgnnnnnnnnnnnnnnnnnnnncaatactctccgtggcctcaagcaacgcctgcacatgaacaacaacaaaaacatatccaagtacaagttcacaccatcttgtggagatagtgcgagaggagaagtgggagtgatatgggacgttggatttgagtgaaacaatcctgaccgatcaatgaagtgtgaagtatgtagaatgtaggactgttgttggtgaattatagggtagaagattgtaccgat

SEQ ID NO: 96126 - DNA, 817 bp, Oryza sativa
tccaaatatggtcgcgacaatattttatttacttctatccacacctaatctttattttaatttatatttattttaccaatttatttttaaggtttatttctaattaactattctttactcacgattaataaacttcgagatcaaatccaaaaataggcgaataagatcagcatgatgcaattgatttaaaaagtttttgaaaatccgtatttttagagttttggttttatcggtcgaattttcagggtgttacaacatcttataagggaacctgtatggctcgggcgcccgatcatttcgagaaattcggtgacgtcagcgcccgatttacgtgcaaaaactcctttcaactgttttttctcttaaattacttatccaaattatgatccaattgcaccattaaattcattgcaattaaatcttcaaaacaagaccacacatggatatattccgacgaaaaatttttttagcttatttttgaattatttttaaatgttacacgatgttccacctggtatatcgaaattatttcactaagtagatcgaaaatgtttcactcgtttaaatcgagtgttgtttcaccttatataaaaacaatgtttcagcaaatagcgaaagattgtttcagttcactgcaacatttaatctatatatagtgaaacattataagtacaataggtgaaatatttttcggtggaacaaaaaataaaacgaattcccttaataggggtttccaaaatatgtaggtttttttgttgcaatgaaagatttcagttcactgcaacattagatctatacatagtgaaacattgtgagt

SEQ ID NO: 96127 - DNA, 618 bp, Oryza sativa
tttggtaccgtgaggtaccggtacctcgagatattttttttgttggtccggagcaaatgtctctcccagaaggttgttgttgcacttgatagtttttgatcttcaagtcacggttctaaaaattactcactctgttttgaaatttgaacatagatccttcaggcacttactaagctggttcttggattttatttttccacatagatcgtagggctcacaaagttatactttttgggtcccaataggtgtaccttgagaaaaaaaaaagatactaatttgtttaaatttagcaaaaggtttattagttttggcaaaaaaaacatgttcaaatttcaataaaaatgaagtttctaaacatcacagagtttcggcgttatcctaatattttttttcattacaaatacagtaaaatactgatccacctaaacttttctattaatcaatatctttttaaaatcaaaataagtcatcaaaatccataacaaattgaacaagtcgaaccacccatctcttgcgccactgccaaccctagttaaccaaacctttcatttttaccactatttgattaaattgcactattgctaatagtatggcctatacaatattgtaccagtgtat

SEQ ID NO: 96128 - DNA, 1135 bp, Oryza sativa
atcctcttgtataccatatggatttcttcatcaccacatgcattgtcctctagcctttagtatcccgcatgatctcttaatccctggacatcaacttctcccaatttgactccgatctatcaccggtaacactctcccgaggtctcaagcaacaactgcacatgcaacaaccaagaaaccatattccgagcccaagttagtcccaacttgactcacattagtataacaacaatattcatatgcatagaaaccatttagaagccaaatccccgaaggaaacatccaaatccaacaaaacaacccgaaaccgaacatgatcaggatcctgccggtcagaccgtcgggccggccggtctgaccgccgcaacacctgtggtctgaccggcggcacacgaccggtctgaccgccaaggtcaaccgaaactgcacacttcataaaatcaatcgtcttataaaatctctaaattaacattagcaaaccatcaatattttcttcacaaaatctaaattaactcctttattttatagtggtgtcctcgatgcatatgtgtctcgtccaggcacgcggttgacgcgcaccatcggtggtgccggggctctcaacgcacgccggaaaagacggagccatctcccgaaacgagcgtcgcgccagggcacgtcaattcgcgcgccaatccatctctcgaaccgaccgttgtgccaaggttccccggtgccgcatcacgtgcgccgtgcgttagggccccacctgccgtcgatggtgagggcaaagatagcagccgccgccgtccctcagactaggacaccccactaatccaaaggaaaccctaaaaaatccctcaatgtcgagctggaccacaaatgaattagatgggcctcaccatcacgcggtgactggtggctgtgtgtgagatggtttgggctctgtttaatcagactatgttgtgtttcattatcagctcggaataagtacacttgagatcccttaacttatcaacaaatccgattttcgtccttcaaccgaaaaaccagatacaacgggtccctcaactatcaaaaccggtgcaaagcaggtccctcagcggttttgatagtggttttggccgatgtggcatctacgtgtcctgtttgcgtc

SEQ ID NO: 96129 - DNA, 1802 bp, Oryza sativa
aaagtgtaacacaatggtcagtcttatggttattcacattgagaaggaatcaaggaaagtcaagagaagagcaattagactttaggagtcataatctaatcatgtaatcaacaatgtatgcatagataaaagtgattccaggtcctttttagagattaaagataaatgaaaaagactgtgatggccatcattaaataaggtatagttggatttaagattgggtgaaaattaaataagtgatccgatggggaaaataacaatataaaattccttatatttgtggataaattatgagccccaaaatccgttatgttggtggatagagagagtacttattagcctcgatgtcatacttatgaagaggctattagtataaatactttttcacgtacagatagtgttcatatttacatgtgttcccacttattttatttggtccatgacaccatgatatatgccaataaagaaattctgggtccattaataagagatggttaagtgcacttaataagaagatgctttattaacttcatgttgacctcacccttcttcttatccagatatcatattctcttagcatctctcatagctaggactgattgaagaaacacaacaaagtcgtggaatgagaaatatcaatgacattatgctgcaaatcatgtgaagttaattaatatcatttaatccacataagtataaagtataggcagcagtttatctgaaacttcagcatgtgcatagttgaaacaatgcaaatcacactatatttggagtgacgagaaggggaaattggaaaataattttttattcactagaaagtgtattgtttcatctaattactgacaggaataaacatatgtagagcatactatcatgatcgctaaatattaaattacaataaataaaatataattagtaatatttaatttttagttcatttggatgtttagcatcttctttgtcaaaagattcatcatcatgaaaatgtacaacacgttgttggataattattatttttaatatttatactaaaatattttatttcaattatatttattaattaacacattactacagaaggttacaacttagatgcgattcttaccttttgattacaatatcaaaataatacaccattcaaaatacttaaattttaaaaattaagaatggtgcaatgaattctatgattaaaaaaattaattcacgcaggaaacaaattataaatgtaaaataattaaccaattaaaattgtatatgattaaaattattatataaaattccccgtgcaacgcacgagttgacatctaaaataaatgtattttaataattatattgaatcaaatgtgtgaaagaataaaataagttataatactgcagaacagatgtcacaaaataggagagcactgcatgaaattactcaatttatatacgaatctaaaaacgaggtatttatgagtttctttctttctgctgtgcttgtaagtctgatatacgaatctgtgagagaggtcgaattgattaaggtactaatgtatgtactgatatactgacagagtcatataagtcttcttatgttgctacaaatatatgttccattccatttctttcataattatttaccttgagattgattggattggtacactaatgataataaattcaattaattaatgttcattgatcgcactacataaatatacaatgaattcactaattaaaaaaataattcatatataaattgccacactcggctcccaattttgcatttctttcactcaactcagaaaatcaaaccaaaaatc

SEQ ID NO: 96130 - DNA, 555 bp, Oryza sativa
attttcatgcacctgtccacctcacttgaattgttcgaaatttccattagagtcaggcttaatcttattaacccacttaaatggccgaatattttgactcattcagaaacttctactaaattctttattttgttcatcaatctcaattattcttatatggtgcgaaaaccatttagatgaacactttaatgtcttattttgttcacccatctcaatttattcttacatggttcgaaaaccatttggatgagcgcttatttttaatgtcttataaggtgaacaaactttatttagtatttaccaccataatccgatctcataacttcatttgattttagcataagtgtcttaaatttcttaaaggaaatcggaggtcgcttatgggtaaacctagccttaaatgatcatttgttggctaatttcttgacttagtgaaattttaacttaaagctaacaacgccattaaaatctaaggaaaagaatatctctatctcatgagacgttccaaactcccctagttatgtgacataagcgacaatgacacactcccaatgg

SEQ ID NO: 96131 - DNA, 557 bp, Oryza sativa
ctttgttatgctgtcaagagtatggcagtgtcgcagacacgctgatcggcgggatgtatcatacgcgccagaagatgaatcaggcgtctacaagtggtgaagatcaagttgtgtcacagtttgtttggctaaagataaatcacgcttgagataatttggagtttgctagaggttagttattgtcagagtaatcttggtcgtgacaagttaactgcatgtttaaattagtctttgcactattttttgtaatagcatattagctttggattcctagttgcatgcgctggctgaatgtagtttttcagtcagagtttgttattcagtttctctgttttttcagagtagatgagatcgagctgggatcggatcgtgggatggcacggtcagttggcacggtcagtcgttgatccggcaaggttgcgcatgtaacagactccctcatggaggtgaataaaaggaaagaaaaaaacccagaaaagctgcagtcagttcgcaccaccaaaaactctgtttttcgtttcagttcttcagttactgttcacgtctggaaaatattc

SEQ ID NO: 96132 - DNA, 775 bp, Oryza sativa
aaccatgcatgcagatcgatcacatgacctacatgttgggatacgggtaggctacgatagcataaatcaaaattttctatcgcgtaaaccaagaaccatgcaagtattagatcatagatcgttaccactcgatgcgctgcgcagcggaagaaaacgctgagaagtcgaaggaactctcgcgaagtagcgcgcgtcgatgcagaggaagtagtcgatcgcaccggctcgaccttctccttctcgtgcgttcacctcgtcgtactcccacgccgatcagcaccacaaaccagcggcgcctttaccggtatccacacgtaaaaggacggaacaccacgtgcagatgtactagcacccgcgcgcggctaggattttgctcggggagggaagtgacggctagggtttctcacgtgatgcaatgcctacgccggtcacacccctcatgaatatatagaattcatcactcgggcctccaaggcccgtaggacttctattccgatccctatccgaattaagctcatattggatctctatccaatccccttatttcgacccattaagcgtgcgaccctgtaggttcatatatactcggctgtaacccgaaaactccttttcggtccacgcatcaacagcggcccctagcagaacgtattgacccaccgaacatacataaagatcatatcggctgaacctctagtgtatacttgtatggacccatttgcctcacgatatggattaagctcaaggctagatatgtgccatcctctaatagctcaat

SEQ ID NO: 96133 - DNA, 630 bp, Oryza sativa
cttgtagtgtagctttcctctagccgacgcatctaggcaagggtgggcgtggtggagttcggatgggccctgcgacggcctatgcggcttccggattcacctaggcacgagaggggactgcccgctgccttgcgaggagtgggggtgaaacctgaggtgtggtgtgcttggttagaggggggttatgcgaagggtcctgtcacggcctctttctggtatgtcgtggtggcatgtcggcgcacgggaacgtgtcgtggggctgtgtcttgtgggtacagttgtacacctttgatcagagtaaaactattcgaattgccgtgcccgcggttatgggcggtcaaccagattcaccgtgattagtctcaccctagtgtaatcttttgaatttggatagtttaggtggatggttgggcctgtcgcaacgtgggatagcgttggacagtggatagttaatattaattaattacttctaccgtttaaatctttcacttactgtttataaatgctcattttatgcaaatgaaccactctagctctcctttgataattccctgcatcatacccctattccggtatgacttgctaagtacaatgggtagtactcagtcttgctctatttttcccaacccc

SEQ ID NO: 96134 - DNA, 502 bp, Oryza sativa
gggctaaaccaccggtttacttatcctaacaagaaacaaactaagagataaatctgttttgtgtgatcggtacaaaatagactcgaattttagattgagatagacccccgagccccaccagtgtcacctataaaaggaaagagaaggagggaggcaggtgacgacttatctcactctaacctcaaaccctaaattaatcgcccgatcgatcaaggcactggaaggggttcatgaggtatctcacaacagaagaaacaatgaagaagaaagaagaagagcaatggcttcatctcagatcagttagatcaattaattttcgcataagcagaaggtgaccatgtttaggctaagactcaattatttaattggaataaattccaacattgtggtatcagagcctaatcttagccttcttgataacagtgaaatttggtaagcccggagtagtcatcgacttagagtcagcatcggcttcgaagtcttgagattagccgatgagagt

SEQ ID NO: 96135 - DNA, 850 bp, Oryza sativa
aaaaataattaaggaaattactatcttaatgaaatattttttctttctaaataaacattctgttggttccattaatctagaaatatttaccaagtattgcaactgatcttaaataataaacattgccaattgcatataattaattcaccttggcttagtcaatcatatgcaaaataaacttagaatttcatagtcaaaacaccattggtcataaataattatgaataatcttaaaatttattccttaattatatcaccatttggtagaaaataactaaggaataaaaaaattataattgacatgcaattataaaaacgtgggttaaatataacttcagatcttaatgctttctactcgaatttctcgttggttccattcgactataaataattaagttactaaggcactgaccatcataatgatgttgacatgaaatcataaatactttctagttaaatttctattcaactaggaataaattaagtggcttaaggaaataataatcttaataaatattgacatgaaatcatattaacattggtcaaatataatatcatatcattaatttctttctagctaaacttcctgttggttccatttaactagaaataattttctgagtgatcaaataattgaccataattttccagcaatttttaatggctaagaaaggtcataaataaatttctggaaatacataaaacataaatggcgggcttaaaataataatacggctcatcacttcctaagccggcccataaaaaaaaggctaaaatcgggctaaaatttagctaataaagatataacacattctgaggaattaaaatcatgggcttaataaataaaaaa

SEQ ID NO: 96136 - DNA, 515 bp, Oryza sativa
cgctggcagtccgtgacctcccaccccccgattttttacgctggctggtttttctcgtagccgccataaaaaatatttttcaaacgccataaaaaatcatttttctagaaacgccaagagttttccatgaagtactcatgggcctagaacggagcacgcatgcatatttgacaaccatttgaagcacctgataactcaaatgcctaaaattaattaatttatattccaaaagctttgtgaaatttatatgaaatcaaagatagccttgctgcactactactacgtggaatcaaagtgataagccagctgtaaggtgagagatcaaacaaagagatggaagttgcttgcattgcttatattgatacagcagtcggtagaactgctccatatatcgatgaaggattttcttgagctgattgtttgcttacgaaatatattaaaaactatagtaattattttgaactcatcgaaccgttgatttcttgataaaaaaatgattgcatagaaataggaaa

SEQ ID NO: 96137 - DNA, 752 bp, Oryza sativa
ctcacgtttactttgagctcttgctgtttgccaatggagaaattagcctggtaatctgatcttctttctgttctctctcttcattgttttgcggccgctgcttcccggttaacacattttcttcgtgatcgaacgacagagctgatcgctggagtagacggtcaggggtggcaccgtgcgtgagctggtccctggagttgccactcggggggcagttcgctttgtccgctcgctctgttcttgcttactgctgcttcggtgtcttctgaggtaatgcctggttttgctttctgttctgctttgcatgttctttctcatgctgtggcttgaaatggccttgcctctttctttctttgctgatgttgttcttccgcttcgccgtttgtgcgcatggcaatcctctacagtgcccataaaaaatcggctctcctttattttaagaaacaggcagactaaaaaagataggccccatgtagacattggcagttgagctggttgaccgtgttgaccggttgctgtacatttactctttacatgtttggtccgcctccttctttagctcttgtcagttgtagtctttctcctctcacgctaatacgcttcgcgctgcagcctcctgacagtatgccatccctcggtgtgtcttccatcggtgtgtcctctgtgtcgctgttgaacgctgtggctagccattgccagctgccgttggttcatacctgtgggaaatggggagtgatggtgttcttcttgct

SEQ ID NO: 96138 - DNA, 652 bp, Oryza sativa
tttcctgagaggtagatttcccctgcaaaaaagtatgggtgcgtggcgctataggatagcatgtagcaagatgcacaagaacttcctaagaaaaatcatcaggacatgcttacttttgaatcctttcaccaacgtgccgacaatatcacaatttgttgttctgactgacccctagagaagaccgaccacttctgcaggaaactcagtagcgcggtctccccaaagcgaaacacgaatagtggcattgctaatgaagtaaagtgatattacatgtttaaaatattttgtggttaatgggggttaaaaaatggttgtggaaatttctgtgtgcatgtcacattaggcaaacaaatgtaagaaaaaaaatagtcaaatgaaaagcataaggatgtctaactttgcatgcggatgaacacattgcgctttaggctgtcgccatcccttgtacgtgatcgaacaaaagtaatagatgaaacctcaatgatgactccgatagtatctatatcaggaaaaaatttgagttttgagttgtctgtgataaaaaatgattagcaataaccaatgaaatgtaaccatgtgtaaaattggcataatttattttaccggtgaatgaatctttgctgtcaagaagcgcactgagctggttgaaaga

SEQ ID NO: 96139 - DNA, 719 bp, Oryza sativa
caacacatgcatacacaacattctctttgtttagaacaattttagattacgaaaagccgatgacagcttttcttgaagaaggggaggatgatgaggatctacctacaaattgtacttgtcctttgcatgcggatcagaaaataaggttaactcgtttctctataagtctatgtgtgaaatatatgagaatttgatgctacataatatttgtcactttattactttcagacatgagatatatgaaccattggcatgcataaacaacatgtgggtccagcgggaggtagcgtcacatcattcagagttttctatcaccaacaattgcaagttgaaggcatgttgcgcaagcagaccggttgatgcacgagcagtggtattgatgatgaacatgggccttgcacgacatgcttggatggagttctactatcctaaggcccatcttgggtagggatggagtccatctacaaattttcccacgaattgaagccttccaaaacaaggaatttgaagataagaaagaaaatattcaattcggattcggtttgggtcagcctggacatacctcgactaaaacatttgtttttctctcgtccagagtccattttggacgtgtaagcacttgctggaaagctaacttcatggcccatgtgatggagtggcccacgaaaacaaaatccttctagttccactgcaagagccaaaacaaactgatggtgctg

SEQ ID NO: 96140 - DNA, 597 bp, Oryza sativa
cagatgactcattacgtttaaacgctctgcccaactagtcatagccaccaagcactgggagtcggcctaagcacttcccaaacatgcatatgagtgacatgagttcgtcattaatggaacaaagtttcacggatcggagtttactactcgggtacttttgcaattattaagagcagaaaataaatttatctcatctctatgcttttgatttattccgaataatacttagcaccttgcgttactcgatccatccaacgagcccccgggtgctaggaatcggcccaaaggcaaccattcattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaggacacca

SEQ ID NO: 96141 - DNA, 582 bp, Oryza sativa
ttcctcccagatccggccgaaggtggaaggggggaggccggcagggccgacagcggcggctcccctccccccttcctcccagatcttgccgaagaaggaaggggggagggcgtcggggaaggcgccggcgactacgacggcacggggcggcggcgacgacgatgacgcccggcgcggctccggtagggggaggccgacggcgacggcgcccgcgatttttttttttgctttttcattgcattttcgcaggcgggccattgcctcgactgcgaaaatcttcgcagtcgttgggctgcaggcggtcctcccctccgcctgaaaaagtcacttttggccgcctgcaaaaatactttttctagtagtgttagttccttgtcgaaacaagatttcggcaatactaaaagggggtggctatcaagcggaaaagtggatgggtttagagacaaggaattttatacaggttcaggccttcttaatcaagaagtaataccctactcctgtccggggattgatccgtcgagtgtatttttgatcgtatgatctgggaagaaaatcgtacctcaagaggcacccggacccctc

SEQ ID NO: 96142 - DNA, 605 bp, Oryza sativa
aaacaaaagtatgtggcatataaatgaaaggtgatatctaaatctaacctcttccttggtgccttggaagcgctatgctttgtggctgggctaggacatttcagcgtggcaagtgtcgcattgtcatcatcctagatgcattattattgttggttggtgataatgtagtttttcttagataataaaccaactggcatagttagagagagacgtacctcatcctctgatcgcacaggaatcccagttggtgtctttgatgagcattcctgatctactgctttgccttgcataggtgtcacaggagggctattgaagccaagagaagttgtagcagtcaagctttgctgggcaatagacattccttcagaagcacttggtgacatagtcaagagagggactgaagacaccgcctgagatgatgatggtgactgaagcagtaggggaggttgtgaaccatttccaataatgttgttaacttggaaggaaatgctcccaattgatatagttgtatcagtcatactaacattccaggtgaactgtttttctagcaaatcagtgatctgtttaggaatatatgcttcatcggccgggtgctgatccagtaa

SEQ ID NO: 96143 - DNA, 942 bp, Oryza sativa
ttctatttctaaacttcaacttcaacttcctcgttttctgttaacacgcttttcaaattattaaatgatgtgttttttgtaaacaattactatatagaagttatttttaaaaattaaataaatccaattttcaagttttgtgtgtgtcaaaaatctttctcaaaacaggaagatcgaacgcagcctaagggcaagttttataaaggagatgaatgctacatctaattttgaccacatcatcaactaataaatgtagaggtaacatgtacaatatatcatatcaatcaatacttctaaagctggttggtctttgctacatctaattttgaccacatcatcaacttatagatgtagaggtaacatgcacaatatatcatatcaatcaatacttctaaagctggctggagaccagccagctaattggtctacttggcgcatctagcttccatgataaatgagagactcctttgtgaagaaaagaacaataatggagcaagaaaagatgccacagtgctcaagctttcttgcagcttgtagtctctcttgagacttctatgctaattctcaataaattaaaccggtaacatcaccttctgaaaattgcaaaagaaaaattaggaaacaaaataaagaagatataataaaataggaaataagtaatgacatattggaatgaaaaatcaatattgtctatatgccaagcatgtctctaaaatcagagctcaaataaaacaaagagagatacacttaagcttaaaatgtaaaagaaaatagaaaaaatgacgccatcgtcgaggctacgccataactggtcaatcaatgcagtaaaaatagaaaatctaagtgctcttaaacaaaagtttctaattactgaaaagctacacacattttcattttttttactaaacatgcatttctctactatatatagttaaaaggcaa

SEQ ID NO: 96144 - DNA, 659 bp, Oryza sativa
gtacgggcaagtctgaaaactaaagaagggcaaaaccgtcttttctcccgctagttaacaccgtcaagtataaaaactaacggaagtgctacatagggaaggaaaattttagaagtgactagatagggaacttttgaagttttggtgctatagagggaagagcaacttttttttatgctagatagggaattttctcaatttattattggactgtctgaaatatcttgctttgttccaagcttcatataatttatctttgtcacatttgttcttcttttccattcatgaaaacaagtatttgttttctcttggtcttaaaaaaatgcccatagacactacgatcgacttatatatatgcatgtatgcaactttaggatcacagattagagtattttaatttcaataactataacttctgcttatttatctagataagaaataaaaaaaagttcctttctactcactgtgccattataattgcaggaaagtgatgatgaacacatggatcgtcattaaagaagcgttctgtttgatgacttctctgtttaaagctatcttttgctatatgaattatatagacagcattaacttctggcatatgcatgcatggacaaaagcagcgttcagtacctagactcatccattagagcacccgcaat

SEQ ID NO: 96145 - DNA, 1357 bp, Oryza sativa
tttgtttctagcggaaaacctttttaccgctctcattcttgccgccaaaacatgagacggtccacattccttaatattagttggtattactatcgtcaaacatgtcaaaccagccacatattgcaatacttagattgaatgaaagacaccaacaaaaatagagacgacttgcagtgcgattcattctccattagatggcaaggaagttcatctcatcaacaatattctgttccagttgttacatctagcaggtaagcaatataattctttcacacgatcaacagcatttgttccatgtgaagaagttttctatgttctattttctacagagaagaactgcagcatgattcagtctgatgggcagcaagaagattcttctcttcaatctccctgtcctgtttctacatctaacaagtaagcaatacaattgttagtttatatgagaccatatgtcccaaccctttctgtcggcaacataaaaacattttcaatgctatattttctacagagaaaacaccttacctaattgggtaccacaaagtagcagacatttagtagcttcgttgaggctcaaaagttttggaaccattatgggggtcaaattggttttgatgttagaaaacgatgtgagaatactagcaaacttgggctgtgttcttaggtaagggttagggttgggaacctcacctccgacatggaaaacggagcaatggattaatgcgtaattaattaattattagtttttaaaaaacttcaaaaatggatttttctatagaaaacttcaaacattaatatgattttttgaagcaacttttctatagaaaatttttgcaaaacacacaccgtttagcagttttaaaagcgtgcgcgcggtaaacgagagagtaaggttgggaacatggacataagagcaggtacaatagcaggctataagctagctgcaaaaatattttaaggagataaatgaagagagataagggcagcgggctacagatttgtagccagctgtagcacggactccaagacacagtgtgcgtatgacaggcgggaccaagtactactagtgtaatagtgtagtatgtaactattgtataaatgagctgttagattggctacagataaattggagctagtagttggctatactattaaacttgctctaaggggcctgtttgggggggggggttgtttggttaggtgccacacattgccacaccacatgttaggcatgccataaattattagtttagcgtttggttgcttgtttcagttgtggcaagccacactttcttgttctatgggcctacatgtcatatactcattttttagccaaacaatgccacacttctggccaaca

SEQ ID NO: 96146 - DNA, 604 bp, Oryza sativa
ttggatttataacaagggtcagtctctaattcatccataaaattttttatataattatatattggtcaatattataaatctttatagcattctagattatgtttaataaaaatatctttccacttattaaaaaactagtcaggtaccttatataaatataataatattaataaagataataattattgtttacacatgtaaaaacatagataattgttaacgaccaaatttggtaaggccatgggctgggttcaaagctagagtcaaagccagatttggaggaattctgtttaaggaagggagagtgcgtatcggctatgagcatcatcggctgccgtatgaatcggctacaggcggcatcgcctgtcgtatgtatcggctgacgctaaatccgatgaagacaacccgatgacgcttttctttagagatatttttggtaagagtccgcctaagggacttgttcatattttaaattgtaatagagataagagtcgtgtccagcaaggacatgttatgtacctcgggtataaatatgaccccacaccttggaatcatgggacgacagttcaataatacttccgcgcatcgacaccttttttctatt

SEQ ID NO: 96147 - DNA, 524 bp, Oryza sativa
atccataaccttgacagtagcccccgacttcgatgcaaatgaacgagttcatattctcaaccgcagacttcggaggaactgttatcgagctcacgtgaccgttctcagtgagtttagagataacgttagacttcctttatcagcctcgtgcgggcaccgaaagggtttgtctaagtcaatctctgatgtcgaccgagaaagtacagagcgtacgactaagtctctcgtcttgctgtaatcgagaatttggattgaagtcaagaaattttatctcggcgggtacaccatttcttcattccgtattccttgtcgagatccagcaaccgttctcaagcgatcgagaaggcgtagagtctgcgacggagctttgtcgacatttgtcgaactcgccttagtcgatcttggtgtagaaccatagagacatggagtcttcatcaatgtcgaatagaattttcctgaaatcaatactcagaaaagaatatcaaatagaaatagcccccgagcgaatgctcaaagggtgacat

SEQ ID NO: 96148 - DNA, 684 bp, Oryza sativa
cgtatttgagtcagtttttaaagttcgtttattttttaaaatatagaaggagtcgtataagaaatctatttaaaaaaattacatgctagcttgagacgatcggattcctaattgcagctcatgattttctaaaaaaaatatgtccaatcgaattcctatggcgaatttcaccttaactaaaccgtataataatattattattaaaataatcttcacccgttgcaacgcacaaatatttttttctagttatcaaataaataaaaggagttagactttgaaactagaccggctagcctatcatcttatggagctagctataaaacccctgaccgttccgcggattttctcaaactagaaaaacgttgctacgtactgttgtcgcacctagtgctagtcacgtgtagtacgttgcttagctggatttgtataaatgagggtattggcagttaacacctggcgggggatgcgagaatattagcagcgtacttcttatattaactttgggggcttagatgcttagtgatcacgatgttctatgcacaaagactagctacagtcttagttaattgaggctaagattgttgatgcagattggatggagtattcaaaaaataatccattagttgatgcagatcgatctgaccattaatcgaggctagctacagtcttagttaattgatcact

SEQ ID NO: 96149 - DNA, 568 bp, Oryza sativa
cccaatttaactcaattaaaatctcaagagcccataagtaatgttagagacaacaatactgtcttgcaaatctaggtggaagaatctcaacttaaatagggtgatattagagattccttgttgaccggttgaggtgatggttgtactgccacacgcgcgcgcgcgccgattcggcctcggccgtgggcatggcgaggcgaggcggccgactgaagctgagcctgcttgctgctctttcgttatgtaacagacgagaataaagtcaccattaacaaatgagagattcattgtgatgtaaccttcacgacaaatgagatttattttgtggtaaccttcacaacaaatgagatttatttgtgtggtaatggagatctttctctatatataatgcaaggcaaaggctctcaaagaacatgtcttcctcctgctattgttccttggtgatactctccttctgttcctgcgatgtctctctatttccccagttctgttcatcccgcgcgcacgggtgatcgaaacgagcaggtgcctccgaaactccgtccgcttgagaacctgcacgggtagg

SEQ ID NO: 96150 - DNA, 607 bp, Oryza sativa
ctccttgggcacattcgagcgctgcttaaattattggactgaccaattacaccccctttggaaaatgccagaatacattctctacagcaagttgatctctaaaaatatgttacagtacagctgagaggttgagtatactcctatttgacaagaaacaatgatcccaacatgtaataagaactcaaagatgcaataaaatcgcttctccatatcaaccacgtgttgattggacggcttacgttgcggccataagtagttcacacgattatctactaaccattagcattacaataaaagttttttaaaaaaaataaaaagaaaacaaagctttatagccttataggcagtgatccacttagcacatttcgcggaatggaggcgtcaaaagctattctagctaagcatgcagcctccggatccggatatttgcttcatcgccctccatccctttcaaagcaaagaatattctaaacttaatttttttcagagtttcaattcaataaaataatattcagaatttcaaaaggacttatatattcttcataatttctgtacacttcaaattttactagaaacatacgacattctactactatttgctaattaa

SEQ ID NO: 96151 - DNA, 628 bp, Oryza sativa
ggcggtggcgacgaaggcgagcttgggcggcggttgcgctgacgcgccatgcgcgggagggtggtgccactcgtacggcgacggcgccgccgccgccgccgtcgctggcgccggcgacggtgacggtgccggcaagaagaacggtggcggaagacgggtgatggtggtggcgaacgggcgcgcggagacggccggcgcgctgcagtgggcgctgtcgcaggccgtcaggcgcaacgacgcagtcctcctgctcgccgtcgtcaggccggcggcgaacgcgtcgtcagacggcggcggcggcggcggcgagtcgtcctgcgtgaacatatcgaggacgaggtgctaccagcagctggacgccatgaggagcatgtgtgaatcagccagaccagaggtaattaattaacaaacacatcaacttcttagttaacttgtgtaatttaaatctccttgggttcattcgtgctatgcttaaatgatttgactgttcaattagaccccctttttaaaatgccagaatacattttctacagtaagttgtcctctaaaaatatgttacagcaaagtttgagaggttgagtatactcctatttgacaagaaacagtgatcccaacatgtaattagaag

SEQ ID NO: 96152 - DNA, 546 bp, Oryza sativa
gcagaaatcgtgacaaaaccctccatataaccacacctaaccagcacacccacctccggtttcaccccatccctataaggcgatgggcagtccctacttgtgcctaggtaaatccggaagcagcatagatcacctcccggtccatccatactccatcatgcctacccttgccattggtgtgctagctaaaaaagattatacttaagattcagcctggagcccatctgacttgtggttagtacgagtatatcttccagggattcccgagaaccggtccttaattgttatgggcacgaccaccaaataaatcatgcatgtacccacgacccaccaataaagcatatttaattaattaaccatatgccaagatggcataacatcatcataaaattaaggactatattatagtaaatcccattgtgagctagttgatctaagcatgtctaagcattcctaaaccaatcatctagtcaaattattatcccaggctatcaatgaatcagggtaaataaagactgagtacggtaaaatacatcccgcatgaca

SEQ ID NO: 96153 - DNA, 598 bp, Oryza sativa
catccctataaccctagtgtggtaaagccattagcaagtccttgctagctatcattataagaaagagaaggtgcacactagagtttatcggggtacaaatttgagggtaaacacaacactagaatgcttattcacgcatatgcaccatgggcacacacttctggccacaccggcccaaccctggagaccgatgaccgaaccattgttgtcttctcgagttctcgctctttcccaacttcctctcattcgactcctcgtcgccttcacaccttgttgcggtcatcgttcctgttgcgctgctagtgcctggagtcggtgcccagccatggtctccatccctctcattctccctcatcctttctattttatccgcccttagctcatctaggggtggcattttccctcatcctttctatttcatccgcccttagctcatctaggggtggcatttgccctgttggggccggggatccggcgaggacctgcccctatgggaccaagagtgggggagaattttcacccacgggtgagtaggggcggggccccgacttcgtgcgtggctagggccgagtcagcttcttcacccgctggtcataca

SEQ ID NO: 96154 - DNA, 643 bp, Oryza sativa
tatgttttaaaccgttaaaagtgaatgtttcatacattacagctatatgtttccctgtgtttttagcgtgttttaaagtttacgtaacaacgtctttcacactctctctctcttgtcttgtactatttgcacactctctctttccattttagatctttaaaatattttttcttctaaactacttatccaatatgtgatccaatcacaccattatatttgttgtagttaaatctttacaataagatatcacatgactatattctaatgaacgaaatacatatgttttataccgttaagacttattgtttcatacatgacagcagcatgtttcaatgtgtgttttcactataggcttggtttagttccaaactttttcttcgaacttccaacttttccatcacatcaaaactttcctacacacacaactttcaacttttccatcacatcgttccaatttcaactaaacttctaattttagcgtgaactaaacacacccgtactttaaaaaaagtcaatgtttcagctactaattttttttcaccatgtataacttaatgtttcacctaatggtaagtgaagtatttaaccacctgatttaaagggaatcgacgtgccgattggagttcactcctcagacttttag

SEQ ID NO: 96155 - DNA, 617 bp, Oryza sativa
tcctcatgtttttaactccatcacaacattccagttgccacaagtggaaaggcgctcacgtctaggctattgtcgggcaacatctccttcttgtcaaagctaatagctagggcgccgacttttgtcgggcgagatatcgcctggcaggggcttgagtcccaaggacaccaccaagctggaacttgaggacgggaggcgggtcctcaccaaggtgtgttctcgaatgtgagtgcgatggcatgagggagggggagagagaggcgtgagggagagactgacatgtgaagtctacccttgcgtgggatccacatattatgaccaagtccacaagcatcagcgtggtatgccacgttggcgcacagagcaggttgagatctatttggacttgtgacggtgtccaggactgtcacacctggagttttcccttcccttaggttccaaatcactaataaatggcttcaagaatttgctttggttaaccaagagaaaaccccagttaacaatacattaaataatcggaattgtcctggagaattttttttaattctctttgctatgaaaatcactaacatgacttaaagagtcaagctaataatttcttcctttgcctttggtca

SEQ ID NO: 96156 - DNA, 714 bp, Oryza sativa
attttgtgtatatgaggtttgtacggagttcaagattctttgttttatgcacccaggcgttgcaagtggttcccaactccccctttcgttttccacgtgcacgcttttcaaactgctaaacggtgcatttttacaaaaagtttctatacgaaagtgcttaaataaaccatattgattcatttttttaaaaaaaatagctaatacttaattaatcacacgctaatggaccgctccattttccttgcgggagggattagtttccatcctcctaaaacgaacacagccctggagttctataaatttactctttactaccttagagcatccccaggagatccttcatccggtcctccatccgatatatggtgtacgcgagatgaaaatggacctccagcagatacggcatccagtccgccaaatatggacgatgcgccaaagcgagcagatttcggccaaatatagcgattctctctcctcacgccatatctcaatgcccacatctcctgcccacattcggacttccgtcgcgacctcgcctccgtcgtcgccgttgctggccgcaagttgctgatgccaagtcgtcgcaagccgcaagctgccgccgcctcttaccagcctgtcgaccgcctgcgctgctcgccgtggagtgtggagaggagggtgtaggcatggagagggagagtaccaaatctagaaggagccgtgcggccgccg

SEQ ID NO: 96157 - DNA, 723 bp, Oryza sativa
tacagtagttatcattttctcacataatagcatttttttcatattttatttttaaaatatattaaaatggtaataggattttaaattactagcaacatgtatgtgcgttgcaacggatgaaactaatattaatataaacaacaaataaatactaaaattaaaatttaagtgtcacaacataacgttacggaagaatttaattttttggctaaatttcttattggccacatttggacaaaaaaaaatcaaagtgcaaaaatattcctaaatggtaactccgttgggccaagaaaataaaggaaataattctgcgagcctgacctgaaggcctacgaacattttaattggtcgatcacggttgacagggggagcaggttggtttttctttggagttcatgtctagggttttccctgcgaaattttttatatttttttagatatttttatgttttaattttattaatagaccattctaaaaaatatttttaaatctggaccttttggcccgcacgtggccaaataactctgtcacgccgcgtgcagcgggcatgacaattttatcctaccacgccagcgagagcggcatggccagataacactgtcaagccaacgacgccggcgtggccaaataacgctatcactccagcgggagcggcatgtcacgcccagaaattcactagtaatttccaaacttatttgtgcattaaatcctcatccagaaat

SEQ ID NO: 96158 - DNA, 751 bp, Oryza sativa
  unsure (1)..(751): unsure at all n locations
cgcgcgcngggttgcctgactaacagatggcacacnacctnatnaccgggtacccgggtacgtacaaatcagggtgcatgaacgacatatcataggcaggactaacaaaaacggtaggcaaatatatatatatatatatatatgtgtgtatatatatatatatatgcacgcacccatatacattcagatcgctcgcgcggtataacgcgcgtgtacgtatgcccacaaacaaccctgcctgtcactaacaatatctctttgtccgccatcgctacacacttatagaaacatagaaatattgagagcacacaccccaaccaccgccggccaacccacccatacccacccacgaatatgctcatatatatctccccgagacatcgatccagccggccactgactatctaataaaattgttcgaaccctcccagacacactggaccaagttcgtccaagcccataataacaaatacccaccattaaaacattcactcagcctcaatcaaaacaacattgaataaattctcgccacaatattctacgcgagccgaaaacaccaccgccttcttattaaaaccgaaacttcccctccaaaaaaaaaaaacgtgtaaccacatttaaccaaacgagtccccgtgttctactcaacccacgctcccacctcaatgcacggcgtcaccccggccagccatatatgactagctcgacgaatattcggtccctgcaccacccctccaaacacaatagaaac

SEQ ID NO: 96159 - DNA, 820 bp, Oryza sativa
  unsure (1)..(820): unsure at all n locations
agagagagatgaaaaaagttggttgcctntgngcgggtagtggtggactgggaagaggagaggattattaatattcccacccagaggcatgatgtgactgctgtaacaacncaccnannnnnaaaaanaaacccggaggcgcaacacaccancccaccgaacnncccaaaaaaagaaggattttttttaccatgcaagccaacgcccggggggggggcggaggaggaggagggggaggaataagaaaagaagatttattcgacgagatgctgtgcacggtgagggggggggggggggagataggatacggaaagagcgtatgggaacgcatgggaggcgcggtaggaggaggaggaggagcatttgatgaggagtacggggcggagttagaagaatgggcgatactggagtacggggttggacagcatcagatcgacggtggaggggaaaaggcgattatggtgcaagtgagagaccttcaaggttattacgggataggcggcggggatgacagaggaggggctgacgggatactaaaagtggggatggtagatgaaaggggggaggaagaaaatgacggggggttaaaggggggaaaaggggttggacgatttttatattggtatgggtgggtatagaggtgaaggagtacagattgaagggggaatggaagattaggtgtacttgggggatatgtggagggtatgtgggggagtttgttgggagagaggtgaccaatgggtggggaaagggggtgggggcgtgagggaaagaatgggggaggggggaatgaagaggtcgtggttaggggaaggacggg

SEQ ID NO: 96160 - DNA, 638 bp, Oryza sativa
tgtgctcccagtcgagatagcaggacccaagcatggattttccaactttttcctccacacgtttcccttctctcaagtctcagctctatggcccatacgaatgcgaatatttgactctcgatattgagaaatccagatcctctgcagtactgggaggaccctcgctcaatattgagatcaagtgtggttattttttttgagtgcataaaagctttgtactttaatactctatctgtttctaaatatttacccagttgacttttttaaatatgtttgaccgttcgtcttattaaaaaatttaagtaattatttttttcctatcatttgatttattgttaaatatacttatatgtatacatatagttttacatatttcataaaagtttttgaataagacgaacggtgatgtgctaaaaagtcaacggtgtcaaatatttagaaacggagggagtatattattaggaaaaaaaatctacaaggaacaagctagaaaagactgttataaataacaggaactaccacagtacatctctcgatttacatcaaatgcagttataaggactgtcatataatctgagtctccatattttgatcttaatggtccatatgagttgctacaagattatactccactataa

SEQ ID NO: 96161 - DNA, 711 bp, Oryza sativa
gagttgtttttggtttggtttggtgtgcgcttgggttttggggggttttgcggggttttttacgtggtttcttgccggaatcgtcctaactaacgagacgtctcacacgttattttacggtggatggtggtggtggggtggaccgggcctcgagagggagcaatgctgcagtgggcagcggcgcagtttttgtgtgggcactccaccaccatcaccgggatcgaagtccaagcgggtggtgactgactggtaaacgggttaggtacttggaggacccgctacacagtgctccaggaaaaggtttcaggcttttgcttggtgctggggtaataatatcttggatatgttaatgtttggtaaactgtttttattgtaagctctgtctccgaagataatattgttatgcttcaaacatatatttactattgtaaaaattaaagatatttttatcgatactttgttacgtcatccgtatttgagtcggcttttaagttcattcacttttgaaaatacagatccgtatttaggtcggttttttaagttctttcgcttttagaaatatagttagagtcgtataagaaatctcctttaaaaaactcgcatgttaatatgagataattggactcctaattgtagcttctgattttgtaaaaaaaaaaatatccaagcaaatttccatagtgaatttcaccttagctaaaccgtataaca

SEQ ID NO: 96162 - DNA, 1236 bp, Oryza sativa
  unsure (1)..(1236): unsure at all n locations
attcaattacctttaagaatttttttgttttcttcaccttctcaattatcaactgaaatataataatttcttaatccagtttaattgactttcagttattagttattaggataaaaatataaatatatttatatagatccatgctagtatattgtcaaaataagtacttaaaaatttgaatttatataaaaaatgctctaaataattaagttgtcacataacttcttaatttattgtatcaaaatcctacctaccttacaagttgttgcatttatacgatcacttataaagttattatactaaattgcaccttcctaccaagatgttgcattagaacgttcatttttcaagttattgcaccaaattacacccatctgccaagttgttgcaccgtaagtgcaatttactcattattttttcttttaacagaggagtatatgtctctcatcgctttcttctgacctctatggcaccacatcaaacccttcacgggcatcacccttttttgcgcgtaaaaggagagatatttttttatgtgactaatacatctataattacataatttctgcttcccaaagtaagtcaaccttgtactttgatgtgacatatcataatacgataatacgatgaattagataagaactatatcagattctcgtcctagcatgagattaatttattttaggatggatgaagtatgctactgatttattctttccaaagttgtgtaaaccaagtgggctgcagcaaatcaattacgtatgctactggggtttgatgcaaaagaagcgcacatgtacaatggggcaatgcgcgtgaagatttgattagcataactagcaacgatcattagtaaaacagttggaaatggtcagacacgatatcattattttattatttcgtggaaacggtcataacattttcatatttatgaatttaaactatctagtgttaaatttaaagagacactgacagaaatttaaaaaactaaattttatatatcataatagtcggtaaaaatattattattattatattaattttgtggaaacggtatctgtccattcaggtaatttacgtatcgttttcacccccagccagattattacattgtttgtaacatacccaaatttcaaaattttacttcaatgaagcgtcaaaatacattttcattctaaaattttgttttcctttttcataaaaactcanaatgaggtttaactagccaagttatcc

SEQ ID NO: 96163 - DNA, 2973 bp, Oryza sativa
ctaggatcgtgtttacaaaatagctttgagcaactaagtgtcttttaaatgctctttactgcaaaacctaaccctattattattactccttgtacccccttgcattaagcatgcatctcctggtgtgacttgctgagtactgtggttgtactcattcttgctctatctttccccccttcagtaagagaagctttggagaagaagtcctacgtggagtcctggcttataccccatttgagcgcctgtgaagatggagccgtaggcccgctagtccgatgctgtttattttttattgttagaccttaagtgcctttgtaataatgtaaatattatcgatataataaagatgtgtcttttgtatcatgtttgtgtggtgtaccccggcttttcttgggacggagattaatacactagcgttcgggaaaagacaatttttctcggcgtgacagggatggcctatgagtatgtcgaaatcagagatgtcgaacacatgaaaatctaggatgacctcaatgctattgtgccgtataggcactccagagataatccctaaaccttcagtagtagagtttgcggaaattcggaaggttttgacggttggttccaacggtctgtcccctaagcaatcgaatgcaaaggttatggacataatattggcaccaacagagggattatagagagcacggaccaattttcctccaatgaaacatgtaacagttgaggaggggcatcggatctgaattgcttcagatgagagctctccttccctcaaccattcgttactcatgatggtggtcaacttcttcaccgtctctttaagcatagctttatcgagaggatcattagaattgaccttggtcggtggtctcttgtcgcaggaataattcaaggtgttcgcataatcttcaaaaagatcctcctcgaattagaatggaatttccggaggataaatttctttttccttcggctcctgcgactgggatgaggattcggtagttgagtcggcttccgactccacatgtagagattcctcatggataatctcgacctccgggacggcttcgcttcggccgaaagaatcattctctaagatcagatctaagagttctcttccttcggcagttgtcttgtgtgcaaatgatcctccggcggaaatatcgagattttcggcagactccttgtctaacccgtaccgaaaatgttgtaacaacacatggttgggtaaagacaagtctaggccagactgagttaacagtgagaacctggcctaggctgcaccgagagattccttctcgttctgtcggaaagagaggatgtctaatcgaagattgattacacgggttaatggaaagaaagaaaggcaaaaattgcacttaagctcctcccattcaccgtggaatttcttgataaataaagtgtaccattacttcacttcttctctaagaaaaaaaggaaacaacttccactttagagtttcatgtgtcatgcctacaatggataggcacgaacacactagctcaaagtcccgaagatggaggtatgggttttcaccggtacaaccagagaaggttttctctcgaaccatggctataaagccaggactgatttcgtagccatctgaaaggattggttttgaagaacaggacggctcacaaatatcaacccgaggagcagaaaggttttgaatcatgggttgctccatcaaggaaaggaaatccgcaagcgcacggaataccgctgtagcacttcaccttcgggtgaccccaaaaggatatcgaactcagggaacgtgtgcaatctatctaaggctaagacggtccaaggacaacaactgtaggtaggcaggctagagaggactttctatgtgttttaattatcttcgctaaataagttaattccctatctgttgctttgggcaccgacccctgcaggtctgccagcgtggttcccgctatagctctatgatgtatccaaacatggaggattactgggacggaattcagggctgtcaccacctgctgcctacctctgacaaatccgtgggatacacaacaaacaaaggtaatctctaacctagacaccacgcctaagttattaattactactctaatacttgcgcaggaacttctttctctatccagagtcctagtactagagcacttagtataaatactaaacaatgaacccgaaaagatggaaatttatcttacttagacaaagtaattaaataacataagaaaggaacacaaatgcttactttatagaagttctccgaacccggagcagagtgtaccgatagctccggtactcctccagaattcctcctaggaagctacactcgtcgaggtagaagtcggataagcgccaaacttccgggcactcctccagagctttccctcattctataccttattctaatgtacaaaacatacaatagagcctcttgtaattcagctcaaagttgtgtgttgtgaatgaaagagaggagctctatttatagcctccatatgatggttacaggtatgggaaacgaccaaactagcccgcaaccatcattgggatgaaatcaggaccgtccatgtgaaagatggcgatgaacagccaccagagtggttcggccgaacccgggatggctccgttcggcccgtttttcatcgtggacattaattttgaggccctcagcccattggcatgatagttgggcccatttggagttatttaattgacttatgggacctccaatccgtgtaaatgtgtcctgcatgcatggaggtgcagtttgtcgcttcatggatgtgcacggaggtgcagtttgtcaccttgatgaagtcatcgacaaacttttgaaggctttggaagagatagagaaagagaagaagagggtggccaaggcgtacaataaaagggtgaaagcaaagttgtttcaagttggagacttggtttggaagacgattttgcctttgggtactcgat

SEQ ID NO: 96164 - DNA, 701 bp, Oryza sativa
gtataccatatcaatacacgacgtatatccaagggtagagggtataccttatccgtaaccctgacacatactgtcaaagatcaatagtgcaaagacaggaggtagtatctcaatgtcttatgagggaaataaaataaagaaggtgaatgaggagaaaaaggaggagtcgggtacctacgcactactacaggatagattttcctggacgcccctcctttttgtttccatgcggttcgtaagtggaactgcatggaaaaatagaggacaggctccaggatgtcgcccgcacgggataacgcatcccgtgcgggcgggttaagccaaccgcacacccgcgtggtccaccgcatttaacctagccgcccacctccctccgcctgctcaccctcgatctctcccactccactcctccctccccactctcctctcctctcctctctctcttcctcagtgcacaacgcgcccctccctctctcccttagtgcgcggcggcgggtgaagagggcggcggatccggcgacacccgccccctcccctccttccccttgcagatccgggggagggggcagcgggtccggccgcgcacggcggcgagcgaagggggcggcggcggatccggcggtggtggcgggaggagagcatgcggcagcggtgcacagtggcggcggcggcgcgcgccccctctcctccctccccgtgca

SEQ ID NO: 96165 - DNA, 718 bp, Oryza sativa
agcccccacgctttttccgccactgggtgagccgtaggctaggagagggatgagtggatcttcgtcctcaactcctctttgtgaggatgacagggagctcgcgtcgacgatcttaagtggagttagttttgggagggcgttgccaccaccttgtaggtcttgcgacgatcggtcacttagcagcagctggctcagtgcccgttcctttacctgggttgtgtgaggagctgctagtaggtggtgatgttggtgtttcttttttttttctggctagggttgtaaccttttaatttttcccgctatataaatatgaaacttcacactatctcgttttgaaagaaaaaagagtgcacacttgacccgtttgaccaaatgattttttttcaatcaccttaccacagaaaagctcatctggatttatccatttttctttaaccctttttatggtagatgggagtgcatacaggtgtaagcattaacactaactagggaggaagcccgcgcagatgcatggtcaatttatttattctttactaaaagaatgttaaaaagatgttatcttaccatattttatttaaaaaccatagattatcttatctctaccctcaaattgaccatagactttgatacactaaattaaattgtaagaatgtctctcatattaaaaaaaaaattgttgtgtcctggttatatataaaatttttatcacaaatactta

SEQ ID NO: 96166 - DNA, 890 bp, Oryza sativa
ttggccatagctgctaaggctttattctctaatgccttgaaatatgggtcccgcatcgacgtagccatgcccctcaagactagcgtcgatcacaattttaacacctattattgtctacacacttataaaaagaatgtattagtaagtaggctagttgagttctactatcaagagtgaaatgaatcatagagggctcgatggactcatcatatgggtaggtacaaacataataaagttatagttttaaatttgaggattaggacggaaagattaatacttcctccgtttcatattataagactttctagtattgcccacattcacatatatgttaataaatttagacatatatgtgtgcgtagattcattaacatctatatatatatgaatatggacaatgctagaaagtcttataacctgaaacagaggtattattttttaatcatacgtgcgtacgtatgtttttccaggtgttttttttggatgaatagtacttacttttctttggtacgtacacgggggattaatatggaggaattattttaacacatctaatctaatgtttaaaaataatgggtcacgtgacggcttagaagcgtttctatcatgttcagtggccttttagtatataataatattcttaccttaatgattggtggatagcagtgcatacatataattttaagtgtaacatagaattgacacataaagcaagacatatatgagtcgagtacactggaccttatacactatatactcagattaacctaagcttaaactccaaagattgaagaggaaaagatcaacatatgcacctcctattactcttaattaagacatattggtctggttcatttaatcatttttttatagtcatttaaatactaaag

SEQ ID NO: 96167 - DNA, 880 bp, Oryza sativa
tcactcccacttctagtcacccgccaccggctattggggcatcgtcggcccactccacccccttccctagctccgccatgtaagactacctcagccacccctctgccttcaccaaaagctatcgggactccatccccttcgctcgaggtgatattcttattctcaccaaagccatatgattgatcatattgataaaccttatatatatgctacttgacattacattgagttttatcaaattatgtgaccttagtgagatacttttcttgcctatttgatcaagattcacgcgcacccaccatatatgcttgacctctgcactgtaagttagcaaaaacatgtcatccatccgccaaataaacactccacaaaagtgcctctcccaaaagctttgcaaaatgtctctacaagcatatgagaaaaagagaaaagatgcatactcacaaaaggaggtgcaatcattctcaaagacttaatgttgaaagaaatagcctgtctccaaacaaaagcaaaatgagagagcaacaaaattagagtgccacttaccaccacatatccatacactatgcacatcttgatcaagtttgtatgtcttgttttctccatggattgactctttgattttgcaatactaattgataccacgcgctttgctgtggaatatgtggatgaatgcatgttatacattataaaaatgatcgagtatatgtttaaataatgtgaaaatgatgtgaagatggtgatttgacattgcttgcatgctgagttctaaacatacaacaaaattacaaatgatatgtcatgttagcatgagatctaaatactctagataataattgttagtcggtgatgatgtggcacacttgcatgttgagcttta

SEQ ID NO: 96168 - DNA, 1079 bp, Oryza sativa
aaataaatggtctaatggtatatggtagaagaaattgatgaattccgtagtaaagcggtatatcatgggaagggagaaagtctatggtaaattattgaactagtgcaaactcgaaaacaaggaggagattctctcttagttctttatccaacaagggaaatctatctattatctatctattatatactaaaagtccattaaacttcttacaaacgctctcaagccaccacgtgagactcctacaaacgcttctaagctgccatgtggcactctaataaatcggtaggcccacttttcatctattagatttccttttagaagacccattattttcatctatgagatttatttttagaaaaaaaacataatcctcctccctcctaaaagtccattaaactttctacaaacactctaaagccgccatgtgggactcctacaaatgctcctaagctgccatatggctctctaataaatcggtagcccactattttcatctattagatttccttttcgaagacccactattttcatttatgagatttatttttagagaaaaaaaaccataatcctcctccctcccctctccccaacaacccaccctcttcctatatggtatgtacgtacatacttatacctccccctcctatccaatctcctcatctctttctttctttaaagttttttacaattaaaaataatgtttttaaataatttccatatagagaaataatcaaaacctttatattgcacataagtctattttatcattcttcattatcgtattcatggtgcttgattaaccattcaaataccaataaaagctactaatttttttaactcataagaaattaaatatgatagatatgacaaaaataaaaacacttaaatcatgagtaacattccaaaataatttcctctattattttaaatcatatccgaacctttcgcatgctatcccaataataaaagaaatattgtgtagaacatagataatgtagatcatatcaacatatatcacttcacaatcatgcataattagattagctctataatatcacacaataaaatataataattag

SEQ ID NO: 96169 - DNA, 547 bp, Oryza sativa
agccgatgacatatcatttattcttgagccgatgtcatatgtgaatcgatcggcagttacaaataagcaaggtaagactaaatctactcgatcgagtacatatattaacgctatacaatctttctgtcgatgtatatttaaatcaagtgattgggatagatcagtcgccatgccgagacagtacaaaccacttaggtcgaaatatacattaacatgaagattataaacgcttatatcatagccgatcagatagatctagcatgtatcggctaatactccgataccactctacattaagatattaaaacagatatactatatcaaacaaaagcctaatataatttattgtgataagatcttaacgcaaagggcagacttagcatatcaattaaacatataaaacataaagctaaatcaggtaagatcagctgaaaccccgatactatctctcttgataatcataaaacaagctagatatcacaattataaataacacataatagatcgaactcaaccgatacagcattaagcataaaggcgagtatga

SEQ ID NO: 96170 - DNA, 592 bp, Oryza sativa
ataccttggtgaagaattatacacattgagtgatccgagacaaacaattaaggaataaagtagagttatgtttttatgagcaaaacgaaaaacccaatgtactcatcaggaggagtggaggtaacttgaatcaagaccgttccgttcttcaatcacccaagatgacgtggtagatacttcaagattcacaagtacaagtatggcttggaataattattatgcaggtatcattacaaagagaatcatatctttgttgtgatccatgatctttactcagtgacgagtaaaagctaagtgtgggggtgttgttaacagtccttaagtaccagatctgattgtgaattcatgcataaaagcaaatgaaagaatataaaatagatatcaaacttagaggtagtggttattactaaccatttccataagtcttggtgaatatttgtataaaggtgaattatgaacaaaaaccacccaccatgcgaagaaacatacctctggccaattagaagcgagtacatggattgaagggttcacaaaccatagcaaaactgacatatttgaggataaccatcgtgcactgtcatgagggcccact

SEQ ID NO: 96171 - DNA, 735 bp, Oryza sativa
  unsure (1)..(735): unsure at all n locations
agatgtaaacngtgactnagcttgatcctgcgcccatgaagtcgtcacaaatggccccacttggtgaaaatcggctgatacatgacatgatacccatctcgtccattttcgctaaccccatacgtagttgaaatgcatctgatacctgataggtttcacatcgaacaaggattctgttacatgatgcccggtacaaatcgcatgatacctgatacgtgttacgtgatacccacaagtatcacctgaaacgccaccctaaccttactatgcctgacaggtatcacacctgattaccatttgatatcattctgcagtgtagaattgcctgatacctgataggtatcatgctcgagtcctactgcatatcattcctgtagaaaactggatccctgtatatagcagcactgttagtgaaccatatttaagccatgagcacagagaaggctctggattgatgcgctccgcgtacaacagtgtacgtgtgcgctctaacagagctgcgtgttgaaatgagtccaagagtctattgtgcggcttggacctagcttacagaccagtgctttcttcacattcttcgctttgtgtcagctttgatatcgaatgggctgatactcactctattacgatgctccttgtccgctcttccgtaaattactcttatcatactcgcgtgacacacacgttcaagcattattatgaaaatggtgtctgacatatggtacgacccctctcgac

SEQ ID NO: 96172 - DNA, 547 bp, Oryza sativa
gtacccctatcgttggcggtgacaaggtccacctcttttccgctggcaatgtgcgctcctcctctattaggatgtgtccttcgagatggttgtgttcaatgtccccgcctctcaccgtgactacatccgcgccggcatggtgtcccttgccaaccacaacaacttcgtcgcaggatcctacgaccacaacatcaaattgggggatgcccgcattgggaaaaccttgatgttgtcttctctcgtggcaaattggtggagaatgtgttgtttcggcagttcaacaggatgctagcaatcgttgggctcgtgcgaatcttggcccatcgtattgataccagggagttaaattacaccacttttaataatttaaaggtgaaaatatccatttttacggtggaaaggtaccttggatctttatatgaaaaagtcaaagtggacttactccaaagaatggtcagaatccccagaacccaaccagaaaaccttggaggccattatcggagaaagggattttaaggcttactttacccttaactggaattggtta

SEQ ID NO: 96173 - DNA, 641 bp, Oryza sativa
attcctgcaccccttgatttaacggctattattcattagatgatgtggcacattcttgttctgttttgggattgtcttttcaagaattaaaataagactttgaaagaattatttatgggacactggtattgcctatataatcacaatttaacataatgcccaacccaaataagaataaatcacatattttacataaatggtctggatcacataagctaccttccagttactacttgggagccatcgtttcttttattcgtggaataagcggaatggcaaatttacaaacgaaaagtgatttataaataaaacttttatataagtgttcttaattaatgatctaaaagcaaacgctgaaaaataaacttcgatgagaaaacctcaaaatcagctctaaatttaatgttgaaaattcaaattttggttgataaatataagcataagcgaaaagatgaggccccatgattacaccgaaaaaaaaacctctcgattaaccatgcgtcatgtccaaaaagaaaaaaaaaaaaagaaatttttaaaaaattttttcccttttggcccaaaggaaaaaaaaagcttgcagttcttgagaatgaggaggctgatggagttgtacaaggacgaggtgacgagcatcaccg

SEQ ID NO: 96174 - DNA, 2356 bp, Oryza sativa
aaaagcccggactcagcttcggtaacttagctaaggcaagtcacagcatgacatatatgaatctcggccgtcaaaaacgaatccaacggagatggcgcttaggcctgcacgcaggcaaaaaaaaaaaatctccgtttcagcctaacatgaagcccgcacacgcacaggacgcgcttagcctcgccctcgtccgcgtacaccggcgcagcctgagacggactcaacttcgcctcgccctcaggtcagcgtacgccggcgcttcacctcgccctcgtccggccgccgccgcgagccagctgggaggtgcgccgccgcgaccggagatgtgccaggccgccctgccctttcgccgtgaccgggggcacgtggaggcggccggccgccgggcctgacggcgcggtggtgcaggcgggcggccgcacagcccgagctcagcccgtggaggaggccgcgctgctcctgccgcgccgcacgtcccgatttcggcggcctcgactccacaatggatttcagcgtccgagcccgcatccagagcccgcactggtcagccgcccacttcatcgccggcgagaggtgacaccgtcgcccagcttcgtccagtgtaggagtcactggtggtagattttttggagaacgccacaccttttcctgtgcccgtgaggtgtttgtgtaaatgccctgccgtctgggatgatgctgagtcctaattgaaagtgaattgttattgtttggctttgtgagattggaagcaaattgattatgtaatcttgattgagattgatttggttatatgactcatatatgctgtaatttgaatgaatgaatgaatcagtaacttctgatgatattttctaaaaaaatttgagatgtttgagatgttgcccaggtctatgatttgttcaggtttaaagtttggaatggacttatggtattgtctggtttatactggacatgagttgtgctgccatttcctccttttcgctatctctgctgtaaatttttagttcatgctaggtgggaggtttcatgtcttgttatgatcagttgtcctatgcagcaatgttgctctgaatctctctctaatgatgctgaatggagtgccgtcgttgctatagtgctatcgtgaaatttcatggtcagtagttcctgcgcatggttgccctgatcaatagtgggtaggacatctttggagctatttttatgcgagattcctgcaaaattcctagtacaaattcatgcgttgcaaaaaagcccgtatgtctccttcgtttcttgatacgacagggatggattgtgttttggttggcaaaatccaaaaagagcaattttgtgcatgaaatgagaatgacagaatgccgggctagggttgcgcggccgcccgcctgcaccaccgcgccgtcaggcctagcagccggccgcctccacgcggtcccggttgcggcggcagggcagggcggcctagcgcctctccggtcgcggcgacgcgcctcccagctggctcgcggcggcggccggacaagggcgaggtgaagcgccggcatacgcagaccttagggcagtggcaaagccaggatttagagatgggcgggtgccatctacgagacgtggtaactcacttaaggttcggtgaacagtgatattgtagcgttgatgtatgatcgctaactcgacatcatatatgttataacaattagctagaagagagaatgagaacccatagatcataatttgccaatttaaacagtttgttccatgattttaattggagtcttgcaatcatttttaaaatgataaatcagttaactaagtcatttcgtaagtcctatatatatagctaggcagttatcctatatagttagtctcatctgcaactaatgatgtaattaatggctagattataagggctaattatcctttggagaagagatgggaggggaggtcacataggggttaggggggtgttggccgtccctggcccctacggtggcttcgccactgccttagggagaggcgaagttgagtccgtttcaggctacgccggtgtacgcagacgagagcgaggctaagcgcgtcctgtgcgcatgtgggcttcctgttaggctgaaacggagattttttttgcctgcgtgtgggcccaaacgccatctccattggattcgttttggacagccgagatgcatggtatgtcacgctatgacttgccttagctaagtcaccgaagctgagtcccaaaagcccatgggctttcttgttcggctcacgcgcccaacccgcgtgtgagtgtgagtacgcgttctgtgcaggcccatatgcggtgcaactgcaacacccacccatttagaccttgttcggtttg

SEQ ID NO: 96175 - DNA, 500 bp, Oryza sativa
ctatctataggcccattattatctatctgtgttatgttttagaacaagctggaaatgctggttgagctcgagcagtagtagatagggatgaaaacagtccggaaagtttccgaattcccgacgtgtttttggaaacgggaagtgtcggtcagaattttttcgaaaaatttggaaacggaaacgaattccgaattccgaattttttttctcggaaacggaaacaaacatgataaggctgctattcgttggaaaccgtaatccgacggaaattttcaagaaatgaattcaaaaacagaaatgaattcgttggaaaccgtaatccggctgtgggagaacttcacggcgctgcaggaggaccccgcgctctcgccttgctacgccgaccagctgcgcctcgtgtacgaccccgtcgccggcgactaccgcaacgtgcccggcgtcgacacccgcgtcgtctccttcggctccacccgcggcttccgctccgacgatcctgctcg

SEQ ID NO: 96176 - DNA, 572 bp, Oryza sativa
cgaatgatcaaacattgacaaacgaaaactcaaaaagacaagtaatatgggacggaggtagtaataataaaaagaaatactcctaatatatcaaatcccaatgcaattcatctctttatctactcctaatctattatattattaaaacagctttgaaaggaggccccacgttcgctgtgggagctagaaaatcacacattaatcggagaaaaagaaaaaagaaaaaggagagtctaagtagaagtacaatttaaaaatagctgaaattcagaattaaaaataagcaatattgaaagaggagtccatataggaacccaatatgagattaatcaaaattcgaaataaagataaaataaaatccaaaattagaaaaggacatgagagttcaagtagaaatacaatttaaaaatagctgaaattcggaattaaaaataaggaatattgaaataagtttccatataagaacccaatacgagattaatcaaaattcgaaataaaaataaaataaaatccaaaattagaaaaagaaatgagagtccaagtaggaatacaatttaaaaatagctgaaatt

SEQ ID NO: 96177 - DNA, 779 bp, Oryza sativa
tttgctcagtctgatctgatctgctaagagcaagttcaatagtatagccaactactagctccaattcatctatggccaatctaataactcattcatacaatagttacgtactacactattaatacctagtcctacctgtcatagacacactgcgtcttggggtccgtgctatagctggctacaaatctatagcccgctgctcttttctctcctgatttatcttcttaaaatatgtttgcagctggcttatagcctgctattgtacctgctctaatagcttgttctcagcagacggagaggacctgtgaaatttgttgacgaggccaaagcaagaactactcctttctttacatgaaaaatcaacccaaaatgtgacgatatttcttcgtataataaatttgaacatactccctccgtctcaaaaatatccattcctagcatcctaaggtggaattagggcatgttcagatccatttgaaatggcaaatggcaaataacaaaagttttggtagcaaaagatttaacattgcaaaagtactaattggtgtttatatgcatcttaaaattttgctattttagcactaaagagagagggtgtggtcccggagcactttttggcaaaatttgctaccatggactagcaaatgccaaatgccaaattgccaacttttgctactagtgtttagatctaaaatggcaaaaagtgcttcaaaatgacaaaacttttaccattttggaagatccaaacagacccttagtataggtggagaattattaaa

SEQ ID NO: 96178 - DNA, 1076 bp, Oryza sativa
tgtttacaggttttggtgtagaagttttccctgggacaggttttcctgcttgttcaggtattgactttgtagttgaagattcctgagcaaggtctgttctaagtgaggcaataagtgctttgatataatcagcggacaagatttttaaaccatcctgtccagcgatactcatgaaattctgcttgcttaaacagttcagtatagcgtccctcctttctagtgataatacactggtccctccatcaatgtcaggagaggtgtccttaatgtcttgcccagacattctacggagaattgccatacatggttgtagttgaagtggcgtctaacatcttcaagagttctcttgtccaatccacacttgacccatgcatgttctacctgtatgaaatgtaattaacagtcactctaatcagtacgaatgttttttcttttaaaaaaaaggatatacccaacatttgtagtcatatccaacaaaaggcaacattcaccagttaggaattaaacagccattgatgccacaaaatgttaggttctactagttggatcgaaaataattatattcactactagtcacattcctctctccgagtcttcatttgtcatgtcataacaaggaggaatctagcacctgctgttaaaggagagaggaggccaggagggggaggggagagaaggaggcaagccaaatttaacagtttgattctgttaagccagtgtttaaatcacaacaccatcacaatcaatgcaatggtgcacacctatcagactggtttggatgtagaggctgccattttctaaaaaaacaaacagactacctcagccataaaacacaagaagaaaatgattcaaaactctgttcacagaaaggttaaccttatgtgatctgtcatccaaagccaaaaaaaaaaaaaaaaaaaactataagacacaacacaaataaaatcatggttgcctttgggaatcacctacagacttcagcaaccttattcgtctgtctttcatgcaatttgggaaacacgagactacaagagtacaagaatactctgcatgtcccacaacaaataagtaaatgt

SEQ ID NO: 96179 - DNA, 901 bp, Oryza sativa
aaacggcttagctgggctattgcctgaccattagctgggctattgcctgaccaactagctgcaggagaaacggcttaacggcaggagagatgaatggaagaaaaataaaatcttgtcagagtaattgggttattgtctgaccaacaaaatgatgcatacttggtatagattcaaaaaagaaattatgtacttcctccgtttcataagtaattttgttgagttttgtctaaagtcaaacttgaccttttttaatataaaaatgtagcaatatctacgacatcaaattagtttcattcagttcaccattgaatacatttagtatatttccttttcttttgaaaattgttctccatgcaacaagcatttcaggagagttcacgcaggataggaacacatgatgtttcagtttaaaggttacatttgcccgttttgccagttcatgtggtgctttttctatctctgtctaatgtctatacatcttcctttctgtggttgtacaaatgtgtaaaagaaaaaaaagtgtcagactatcagtcagccggttatccctgccctaacatagaactaggaggtcagtttccttccatttcctgctaaattttactttccatagcatcccttccaattatgtgtagcctcagttttgtgcaactcttttgcttgatagaatcagaaattcaaaagtgaagaatgcagggtcggaacagataacaacccaacgatagaagatcgattcagttttaacctgttttggcgttatcatttcctgatgaatttttctcactgagtgtgcacggtaaaacataggtatgttgatctaactttcatcatcagaacttgagctagagctatctgccctcaggtgttgaatcgccggaaaaagattaacccgtggatcacg

SEQ ID NO: 96180 - DNA, 583 bp, Oryza sativa
tcctcaacaagaggtaaaacttgttatgacggcttgcgttctcgggattagtgcttccatctttatgatactctaatcttgtctatgtaattcgtcaagttatcatatatcttacataatctctggcattatcgctatttaacctattatcggctaacatctgtcggtagagggcagttatagttaaacatcgatgttgacttagattatataggatatctaccactctatgaaacttccagcggcttgattgtctagatattgttctttttttcatacttaatgcggcatcagttgagtttgatctattaagtcgtgcttagaatatcaatctctagcctgccttctggttgccaattagaatagtatcggggtttcagccgatcttacctgatttaactatattcaccctatatgcttcattgatatgttaaatctgccctttatattaagatcttgttgcatttaagtatattaggcctttgtttgatatattctacttgctttaacatcttagtatagagcggtatcggagtattagccgatacatgctagatctatctgattggctatgctatgaaca

SEQ ID NO: 96181 - DNA, 577 bp, Oryza sativa
gctctgctttcatttcttctctggtgtttgattgattgggtgtgttgatgatttctcatcgtttcaagatccagatgtggtgcacctacagatgcagtctagttgcaaaccctagctgctaggctgtgtttagttcacgtcaaaattgaaagtttggttgaaattggaacgatgtgacgggaaagttgtaagtctatgtgtgtaggaaagttttgatgtgatcgaaaaagttgagattttaaagaaaaattttgaaactaaacacagccctagtatcagatcgttagtgtttaatactactactatttcttctcgcccggcggttttatttttttgctttcatttggttgctcagttggaccgatggatttgccgattcatattcaacattattataagtactactccaagcatggcaacaatcagtctgattggttggtcggctggattgattgagcttgggtctggggattattattatcattatcctatttttacttggaacctatatttcccctggtttacatacacagccagtgcgcttttagcagtatgttttacatgctttactttacat

SEQ ID NO: 96182 - DNA, 585 bp, Oryza sativa
tggtttgctaattgtaagttagaaaattctaaatcgttatgagtcattcatgctaaaatgcattttcaatcatgtgatataaattaaataacatgatatggttagaggtaatgacaagcacaacatgtctatagatgagaagcccatgtatcagatgctaacattccatggcaacatttaacaatatcatcgacaagcaaaataggacctatagagagaaccatgattctagatcaaactgcactgaaaggaaattctgccattataagtacccgactaacggaatcagcccaccatttggggaattttcttttactaattagtttattaagaggcaagtattcgataagcaaaataggacttagagagagaaccatgattctagatcaacctgcactgaaaggaaattctacaattataagtacccgactaacggaatgagcccaccatttggggaattttgttttactaattagtttattaagaggccagtactaattgtaaacagattttcatttcatccactattatcttgtcaaaagttgaatactaaagacaatcctaggcacctggcaagtcttgtaa

SEQ ID NO: 96183 - DNA, 624 bp, Oryza sativa
tgttttagtttatctgcagctgggtagtaaaaggctagtggtagctaagcagcctagcagaagtgcagagaacaaattaactagagggtgccccgcgcggtgcggcgggaaagctggaaaggacggcataaaattgaagccaaaaaaaactgtatatatactgaacataatgtagcaatttaacaaccatgaatatacacaacatataaattccgtatatcggttgagattacataataaaataaccaacttagttttagttggatcccaaacaccacatgcaacaatgcaaaaataacataacaatagcacagaactgtagcaaatttaattatattctttccagataacatatgtaacatattgtgaaccacagacatgatgcaatctaatgcattttagttgagaagagtcatgcaaaaggcatatcaattatatgttccaaaggggccaacaatagtaatactggaatagaccaatcattgcttaagcaaatgtggttgaaaaacaataagcatgcatctttatttgtatccccatccactggaaacaacgtcatagtattttcttttcttttttttttagaattacccctataaacacacgcacgcaaaccctacccct

SEQ ID NO: 96184 - DNA, 614 bp, Oryza sativa
ccacctcgctctggcgctgtcgagcgccgccgccgcagcacccgtcctccgctgccgttgccatcgccgagcgcccctgctgggtccttcgccgccatcgccgacggccgctgctccgtcctccgttgccgctgccatcgaagatacgacgttggtgacggagccggcatcaatgaaggcggtggcacagcgagaagaggagaaccgtatgtcaccaggctctcgagctcgccccagatcagtgccctctgtccttctgctcgtcgtgaggacccgccaaccatgacgacgcctcattcctcctttcttctgtgctcagccacggcaacaccaccaccatcgtcgttcctgtcgttgcagcccggtgagcgttgatgggaccggcgacgttgagtagagaggagaataagggtggaggtggtggcggcggcgacgacgacgtcttggatgtcggtgccggtgggggcgggtgcggcgtccgttgtgggcggcgttggagcggcgctggcctgacacagcggagagtgccacggggcttcggttcctgtaacctgagggggagatgatgggggagtatgggtgccgacgcaggcgaccgtggtcttcgtcgtctc

SEQ ID NO: 96185 - DNA, 571 bp, Oryza sativa
aagagggtctaaaaagcatgtgcaaatctaagaggggcatttgataattgtcaaacataatagtgacaaatagttaaatgtcccgttggcacaagaagcgctagctttagattattagatactagaagatctgcacgccctgttgacgtgccgcctaatttagcctgtaatatggttcatctgcaaaatatatattaaatttgcctatctctcattttatattatttgtcattgtagcaaaatttcacatcaaactaggagatgtgcaaattacactgctatgcttattaactacattatagttttcaaaagcaatattaactttgattaacagttatacatggcattgataaaatgtgaagatagaataccgcgatctaaaataataatttcaaatgtgagaatgaccagtaatattttgaaacatacagagtaatatattaatggaatttaattttatgtttccttagaattatgagaaaaaccaaattaagattgtaattaatgatgaccaatagtttggcaaatagttagatatttccatattggaaagtacgaattaccccccgaa

SEQ ID NO: 96186 - DNA, 652 bp, Oryza sativa
ggtaggtttaggtagtataaggtttagttgtttgctagtcgttgctagagttgggtagcataacgacttgatttggtatcttctttagccggtgtcaacagacagcatgacggttagaggaataggaagtttagcggtgtggaagtgttactccgacaaccgtgagtggcggcggagtggttaggatcacacagagctcaagaactaactgtgcggcgtgctgtaaaggtcgagggaatagtgagctccgaccgttgtacgcatcgaggcgtggagtgtcgagagcagcacttcgaccttgggtttgggttttgccgggctttacaaccaacggttcaacgtcggggatagtaaaccgcgaacgtccccatggaaggcgtaaagattcaaccggcggctttttagtggcttaaggggtagtttgggataaaagaaaatatttgaaagacaaatataaattcaaaaaaaccggggggtatttgaataaattcaaataaaatagcaaattgcgtttcaaaatgaagcatttgaaattagatgaatttatgtccaagttttactggaatcggatctactggttaggagatatgggcttctaaagaatatgatttgaaataaatctaaaaatgtgaaaatgcactgtgtataggcc

SEQ ID NO: 96187 - DNA, 1112 bp, Oryza sativa
  unsure (1)..(1112): unsure at all n locations
cgaggcctaccaaaccgatctcgacttacccctcccccccaggcgcctttctcttgaagctaataagtggcaaggtgccctagcccctgttgttcttcgttgtcttagcaacataaagttcatgccgtggagacgtctctgcctcctaaccttttgtagatatgatgcccctgctactacccttctccaaactcatggcttcactttgttgtctacttgtgtccaccacgtcctaggccatcctctaaagccacccttgttacttnncctaccttcatcacctcctaaccctcgaaacccaaacatataggttgaaacatgtgaatatttaaggtgacggaaaatccagtaatctccttttgcattgttcacattatctagccactgtcttttaaaaacatacgaggtaaaattgactagcggatatttatatgcatttttaatcactccatcttctcatggttgttctctttatttgctgctccgtatgaccctgcgatagctgtgtatctagaagggcatgggtggtccgattgatagaaaaaaattaaacatcacaaatataactatgccaacatatacaatacatgtatatctaatagaattggccaaaaatgcatcatgatatattactatcatcttacaaacatcttaaaattaacgttaagtaagaaatttgacttgaagaagcttatacggctacaaaagtttgaagaaggttaccccatcatcttatnctgagtttattcttctgatataactgtgggaggcaatcaagaagcattcttctatgttccatattactaaagaaagatgtaatattttcatctttcttcacgtcttaacaatccgtaatacaataagtacattttgagatgagaagaatccaaagtaaaaaattgaaaagaagagtacaagtctagaagacctattcagctaatcaataatcacttaccccttggccacttgcctttctttcttgatgtgtccctgcacactgtgacaccgtgccgtcaccggccggcgcactcgcgtcccgcccttgctgccttgctgtcgtcacttgatcactataggctaggcggcgggaacgtgtaaataggaaaccagga
